United States Patent 6,610,836 (NUCLEIC ACID AMINO ACID SEQUENCES RELATING TO KLEBSIELLA PNEUMONIAE FOR DIAGNOSTICS AND THERAPEUTICS) - sequence listing, part 4

SEQ ID NO: 7207 - protein, 602 aa, Klebsiella pneumoniae
TRCVSKAGVHRLVRKNNGRFQTQNTVTGVQHLGDRFLTKRLVHDRERQTFRYDHPQNGTANGRVFQAGFRDKLTIVVFFVFSDTHFNARMQRGQAGAINTLSFFRASQHHAFAFGVNTVTGHVVQTQYNVLRRNDDWFAVRRGQDVVGRHHQRTRFQLGFQRQRYVNSHLVTIEVGVVCRTNQRVQLDGFTFDQNRFECLNTQTVQGWRTVQQDRMFADNFVQDIPNDSFFALNHLLSGFDGGGQATQFQLAVDERFEQLQRHFLRQTALMQTQVWTYGDNRTTGVVNAFTEQVLAETTLFTFDHIGQRFQRTFVRTGDRTTATTVIQQGVNRFLQHTFFVAYDDIRRSQIQQTFQTVVTVDHATIQIVEVRRRETTTVQRNQRTQIWRQYRQNGQDHPLRLVARLNESFQQLNALGQLFTLGFGVGFVQLFTQLLAFLLQIHIAQQRLDRFRAHFRVEFVTELFQRVQVLFFRQNLVAFEVGHATFDNHIGFKVQYTFDIAQRHIQQQTDTGRQGFQEPDVRSRTCQLDVAHALTTHFSLGHFNAALLTDHTAVFQALVLTAQALIIFYRPKDTGAEKAVTLRFERTVVNGFRLFNFTERP

SEQ ID NO: 7208 - protein, 479 aa, Klebsiella pneumoniae
CRILSNNMAGRSAPKVSRELERYLRFGYRWMLNGGKMSSDKVQILVVDDDVSHCTILQALLRGWGYQVGLAHNGLQALEQIHQQVFDLVLCDIRMAEMDGIATLKEIKAYNPAIPVLIMTAFSSVGTAVEAIKSGALDYLVKPLDFDTLQQTLVQALAHTRQSESDPSVATDSRWGMIGDSPAMQALLNDITLVAPSDATVLICGESGTGKELVARAIHACSERRDKPLVTLNCAALNESLLESELFGHEKGAFTGADRRREGRFVEADGGTLFLDEIGDISPLMQVRLLRAIQEREVQRVGSNQTLSVDVRLIAATHRNLAEEVSAGRFRQDLYYRLNVVTIEIPPLRRRREDIPQLAQHFLKRYTERNRKTVKGFTPQAMDLLIHYPWPGNIRELENAVERAVVLLTGNYISERELPLAIAGTPLPSVGSEEGGIQPLVEVEKEVILAALEKTGGNKTEAARQLGITRKTLLAKLSR

SEQ ID NO: 7209 - protein, 69 aa, Klebsiella pneumoniae
KPFSKTFLYVWVKLLLISKNNQFKGYIFKIPDESWDYFCCCIFGATALERDSRISCFSRSGAEIIPTGR

SEQ ID NO: 7210 - protein, 201 aa, Klebsiella pneumoniae
LREFIMLQNPIHLRLEKLESWQHVTFMACLCERMYPNYAMFCKQTEFGDGLLYRRILDLIWETLTVKDAKVNFDSQLEKLEEAIPAADDFDMYGVYPAIDACVALSELIHSRLSGETLEHAIEVSKTSITTVAMLEMTQEGREMTDEELKANPAVEQEWDIQWEIFRLLADCEERDLELIKGLRADLREAGESNIGINFQQ

SEQ ID NO: 7211 - protein, 275 aa, Klebsiella pneumoniae
RISSTPEAWTAHTSIIFSRIYSENIIPIRSFSNWPMEKVKMQRRDFINAGSAMLGAIALGMSATANADNEIKESNNPGLSGSSKMDNRFSVEKDDAVFIFADLHPGLVSTCNTISPESLTANVGGLAKCAKVVSAPSYFLTVTQNGKPGELVPSLREYADTHNTIFRKIADPFQVSEITDAIKRSGRKTLIVAGYTAEVAVLLTTLGGIQAGYNVFIPVDCIGSRSSRTEDAALRQAEQAGGVITSLSTLAAQFAPDFSQEPGKTILSVIASIKA

SEQ ID NO: 7212 - protein, 311 aa, Klebsiella pneumoniae
HFISFCHANFVFTFTGGVMHSRLKGNEVFLLARTLAPELGKKERAIARFIDDNPQSLARMSITEIANYLKVSVSSITKVSKKLGFTGFHDLKLSVSNNMNAVENTVDIPVIPDSEKYVESVLESTFLNSVLALQESLNVIDCAVIKSVAYLFINKPEEARIFIAGCGGSSAICDDFNHKLLKIGIFSSVFSDSHKQLMTASLMRQGDILLAVSHSGQTSDIIQMVNMANESGAETICLTNYPNSPLSLIARHSIISAVKNNPITGENATTRIVHLNILDAIFTIIASKTSDKSKNSLLSTRNAVASKRTAS

SEQ ID NO: 7213 - protein, 405 aa, Klebsiella pneumoniae
ACISGHLLFSVGGIPGCEGHFFRQSGQLRAEGLRDGESGDKAVRSDHGDGGVMLSKPALQAILPVAHPQRAGGVILLAMDLHLGHHLDKAHANRAPAGDLPGVEPPLRVAAPADNGEIRADDVVEQHALAALQRHLRLNKHFAHRRGLAGAVRQQRPLAVLRHRLKAHFEEVAFHRRQVIQQPGETVAHGPLPALRRRQHVAGGDRQINHRFRVVAALLLVAVEQRLSRFTVDHQRQLPRQVEGVAHAAVVPLALPDRHDVRRIAGQQHAVDAKALGKAGVMRIDPLADQLDAVRVRQHFAQQTAHIVRLAELGFGFSGHHHKFKAAHAVGQRGGNVGSHRVAAQVNMRGGQRVVSDIDDDPLIRRGLTFEGDVQRTTNKAGAAVASHQPVRAHRLLFAVRSFKI

SEQ ID NO: 7214 - protein, 243 aa, Klebsiella pneumoniae
SKSSHSQQNASIQEASMAHYRIIDTASWPRRDHFTFYRQFANPSFNLCVPIAAQRLYECAKDRRVSFFQLALYALLRAANGVPQLRQRVRNDEVIEYDSLAVMTPVMTVGEGFRQVWCDNAPEFTAFSAAATPKIVAARETSPAPLIVDGEHFICASCLPWLHFTSMTHAEYAVGAAVPALTWGKLQNGVIPVAGRFNHAFVDGLHASRFYALVEEGFNDPERLWLPLTETAPSLLPPAAKER

SEQ ID NO: 7215 - protein, 356 aa, Klebsiella pneumoniae
RDASRRAGGRPYPPTARRCLTDNRIMTMTSTTQNQRYALQELEKEALMGAEGEETFAREVRCIDLSNFAARKNDIAEQLWEAAVEIGFFQVSHHGIPLADIRQAFSMTEAFFDLPDEVKRQYPLAGNAGWESKAQVRPSTRTPDQKESYQITRPLMAGRWPSDRELPAFQQTMLGFESQCWQLGMKILSCFALKLGFPESFFTTAHDPQRDTYQSTLRMLHYYATEQSQQGMWRAGAHTDFDCLTLLFQRPGQGGLQVCPGKDRESQQWTSIEPREEVITCNIGDMLMRWSDDQLPSNFHRVRNPLPHEYQGQRYSLAFFCQANKDVEILGPQRKYPPISAEDYLQQRIQANFAKG

SEQ ID NO: 7216 - protein, 1048 aa, Klebsiella pneumoniae
RRASEACVTVSTWLAYRRTRMKQGFNLSAWALKQQQLMAFLMLLIMATGIISYEQLSRNEDPAFTIKTAVVSAQWPGANLSDTVNLVTDTLEKKLQEIPWLDYVQSETHAGRCVIFINLRDSTPPDQVADVWYQVRKKMQDTAPSLPQGVQGPVVNDEFEDTFGTIYGFTADGFTMRELRDRVDSIRRDLMSLPDVGKIQLLGEQEEQLVVAFSPRQLSAMGLDLQQVADALRAQNVVEPAGTARTAGDNVALRVSGAFSSEESLRAVTLRVNNRYIPLTDIASIVRRSAEPPAPLFRVNGQPAIGLAISMAPTGNMLEFGQALRSRMNSEAAQLPHGIEMTKIADQSAVVEEAVSGFVHVLGEAVIIVLAVSFVSLGLRAGLVVAAAIPLVLAMTFICMYLAGIGLQRISLGALIIALGLLVDDAMITVETMVARLEAGDSLASAATYAFTSTAFPMLTGTLVMIAGFIPVGFAASSAGEYCYTLFAVVLIALISSWIVAVLFSPLTGSWLLPGTLQKHHTGTGRLGRFYQRLLTRVLQHRLLTLGIALLALLLAGLGTTYMQGEFFPASDRPELLVSLSLPANASQEATLRQTARLEQAVSASHDVDHYSSYVGTGAIRFYLPMDVLLDDENTAQLVVVAKSLAARERLRHYLDKVLARDFSDITTRVSPLELGPPVGWPIRYRVSGPDYRRVQMLAEQLSAALGASSLTREVNQTAGEPERVITLKVNQTAARAAGLSSDQIARYLNTVWSGTLITTVRDRNRLIDVVLQGNTDERRNLDSLSGLLLTSSTGAKIPMAQVATPEWGLEDPVIWRRQRLPFITVQTDLAPGLRAETVSNGLKPLINHLRAGLPEGYSISEDGAVAESDKGNSSVFAILPVTLLCMLLLLMIQLKRVSRMFLALLMAPFGLPGIVLAMLPTGTPMGFVALLGIIALAGMIIRNAVILIIEADNNRKSGMHFNEAIGAAAIHRARPILLTASAAILGMIPISRQIFWGPMAFAIIGGLLVATLVTLTVLPAAMSLVMQMEDRSATGKSANAASVTEGQ

SEQ ID NO: 7217 - protein, 269 aa, Klebsiella pneumoniae
MMTFSLDALARQLRDAEQSGQAIAPLRDILGVDNADAAYAIQRLNVQHHVAHGRRVVGRKVGLTHPKVQQQLGVNQPDFGTLFADMCYGDNAEVPFGRVLQPKVEAEIALVLKQDLPHADTTFDELYNAIEWVLPALEVVGSRIRDWSIGFVDTVADNASCGLYVIGGPAQRPAGLDLKQCAMHMTRNQELVSSGRGSECLGHPLNAAVWLARKLASLGEPLRAGDIVLTGALGPMVTINEGDSFVAHIEGIGSVAARFVAAGEGDRDA

SEQ ID NO: 7218 - protein, 420 aa, Klebsiella pneumoniae
LPDPRLRSAERRGRLRPGAAADRPGKSRAACGGGARIVIHPERDDWARQLTALRQQMAEQAASLDASGEFPWRNIDHLRAGGWLSLAVPPSCGGAGASLAQLQQVIAAIAWGEPATALIVCMQYLHHLRLAENDAWHAPLRQQVFHDAVEHGGLINSLRVEPELGSPARGGLPDTVATRRAEGWDISGHKIYTTGIEGLRWLAVWARSDDNPPLVGTWLVPGDSPGITVVKSWDHAGMRATGSHEVIFNHVRVAAEHAVDVWPADAPPAAEAEPFRLFANRQTALLAAIYDSIAHAAHDWLVRWLAGRVPAGLGHPLSRLPRVQEKVGQIAGLLLVNRSLLEQAAALRFSAIEANLAKVTITDNAIQAVNIALELTGNHGLSRQNPLERHYRNVLCGRVHTPQSDSAWLAAGNFVFQSQG

SEQ ID NO: 7219 - protein, 346 aa, Klebsiella pneumoniae
DKFPANIVSVYQPEALLFYKGSISILITYSLKNFIWSLMDPFSDVLNLLSARSYATAGLSAGNHWAMSFPGYNGLKFIFIKKGMFWFRLEAEPEWTQLSEGQGLVLTRYARFLMATDVNIPPAESSEKKRPRVNETVNYGGDENLLLAGKMEIDLTSSDILLNGLPLVLHFNTQTDDSSALCTLMSLFFREKVANKPGSVQACDYLMHLIMIEVLRSGYEKSSEGCVVIDKFSDARINKVLSAIHQEPENNWSLLELATISGMSRAGFSKKFREVTGLTPLLYLTNWRMRLASKSLRYTRESVKLICFKLGYSSESTFSSAFKRVYGVAPRIYRDQHFQAGLKKDD

SEQ ID NO: 7220 - protein, 452 aa, Klebsiella pneumoniae
QHCPRRSRLAGEVAGGAGARRSRPSALSSATGAGESRADRRAAAGQPQPAGAGRRAALFRHRGQSGESHHHRQRHSGGEYRARADRQSWSQPTKPAGTPLPQCALRTGTYPTERQRLAGSWQLRLSITRIITMRLSFSGRVAAALMLLALGGYATAQERLTLRIADQKGGMRSQLEAANALQNLPYDIKWAEFPAAAPLAEALNAGAVDAGIIGDAPLLFALANGAPVKAIAVDKSNPAGTAVLVSPGSTLKSGADLKGKRIATGKGSIGHFVALKALEQAGISPKEVQWVFLGPVDAKVALLNGSVDAWATWEPYTTQMVKTNEGQILVSGKGLLPGNTFLAATDSALNDPQKRAALQDYLQRLAGAERWAYANLDSYGKTLGEIIRFPAEIARAQFANRQSQWQPLAEETVAQQQATADFYLANGLIRTRLDVKPTFDRRFSVPAAEVTP

SEQ ID NO: 7221 - protein, 80 aa, Klebsiella pneumoniae
RSRPMSPAFSSFAAFLNMGGYAVYVWLAVAVAVAAFGLLTVHTLWARRALFHEVRRQQARERRIAAAREHDKEAADASAS

SEQ ID NO: 7222 - protein, 188 aa, Klebsiella pneumoniae
RCIPCGRGGRCSMRYDASRRASGGSLPPANMTRRPRMQARRKTRLYIVLAVLAGLGLTVSLTLYALSSNIDLFYTPGEIIYGKTETRALPHTGQRLRVGGYVQPGSLQRDPQTLDVRFKLYDARGVVDVSYKGILPDLFREGQGVVAQGVLDGERHITAQQVLAKHDENYTPPEVKNAMTPEKTGAQP

SEQ ID NO: 7223 - protein, 432 aa, Klebsiella pneumoniae
LKQPEPYLVSATSQCLTLEGNMFEKIGLPRNLLWGYIGLTIFMIGDGVEQAWISIWLVEKGLSVAQASYLITAYGVTVTLAAWVTGVLVQTLGPRKVMFYGLVTFIIGSIGFISVGLKHMEMAWMLPFYALRGIGYPLFAYSFLIWINYSTPVARRATAVGWFWFTFSLGLSVIGPFFSSMALPVLGEIHVLWVGLLFVLVGSVLGIWVNRDVVPASEIHPFSAGELLKGITILQRPVIAMGLVVKSVNGIAQYGLATFLPLYLISYGYSKTEWLHMWSAVFLVAIFANLFFGFFGDKFGWRKTIMWVGGFGYAAVLILVWAVPQVLGHNFYVMAFVLCLCGVTMAGYVPLSALFPMLAPDSKGAAMSVLNLGAGLGAFIAPAITALFYSSLGAGGVLGIYAGLYILSGVLTPFLKTPEELNQQAELKDKVA

SEQ ID NO: 7224 - protein, 330 aa, Klebsiella pneumoniae
PSQPGIPPTLKRRWPDMHAYLHCLSHTPLVGFVDPEQAVLDEVNGVIADARRRIAEFDPELVVLFAPDHYNGFFYDVMPPFCLGVGATAIGDFASAAGDLPVPAELAEACAHAVINSGIDLAVSYNMQVDHGFAQPLEFLLGGLDRVPVLPVFINGVAAPLPGFQRTRLLGEAMGRFLNTLNKRVLILGSGGLSHQPPVPELAKADAHLRDRLLGGGKQLPPDERERRQQRVINAARRFTEDPHSLHPLNPVWDNRFMSLLEQGRLSELDAIGNDELSAMAGKSTHEIKTWVAAFAALSAFGRWRSEGLYYRPIPEWIAGFGSLSATTEI

SEQ ID NO: 7225 - protein, 300 aa, Klebsiella pneumoniae
MISPLAMFYPTCRAGPDAKRFKSAMVSVPARHSLVLSATKTVIFNDRNVMMSSEKTNNSRRDFLVKSMALIPTVVIGGAGAGAIGVATSATAQAAPTSEPASGNTAAASDWKPQFFNDREWAFINAAVARLIPADELGPGAKEAGVPEFIDRQLNTPYATGSIWYMQGPFNPDVPKEMGYQLPLVPKQIYNLGIADAEAWCQDKYHKTFAELSSEQQDEALGLWESGKAEFKQLPASLFFTYLLQNTREGFFSDPIHGGNKGMVGWTLINFPGARADFMDWVERGERYPFPPVSINGERA

SEQ ID NO: 7226 - protein, 308 aa, Klebsiella pneumoniae
PSSPAAHRLLARRRPDAGGGRSGAHADPGGDPDRDRHCPARGAAVYLFTGAIPAPEYGPMNSSLSLQALRYGHRQPLFAPLTLACRPGEIWAVLGANGRGKSTLLDTLTGVLPPLGGEVQCEGGVALVPQSFRPAFRWRVSDVVLMGRARHVDLFAQPDEEDARRVEQALAQLGIAALAEDDFGALSGGQQQLVLIARALVSASQNILLDEPCSALDLGNQQVVLQLIGDLAHRQARTVLFTTHDPNHALQVASHTLLLLPEGRWLAGETADVLSETHLRQAYGLPVRLIRHAASAFPLLAPGFTLRR

SEQ ID NO: 7227 - protein, 103 aa, Klebsiella pneumoniae
SHPPAPPFWFSARAYPRPHAAPSSRGGQFPAPPGRAASRRSPRHRPPAPHRRPPPSDQLCRRHRQAPTPAAPAYVQPDGRFRGTADVRQLKNRRKYQSISSSL

SEQ ID NO: 7228 - protein, 105 aa, Klebsiella pneumoniae
QSPPGSAAGQTPAGQGYRSPTPARRQSARCRTAAIPGRRAARNAPYAAPSGPQNPGCRRRRRWPRSAAPAQKSAAPSAAADVRRGRWRSGRPAAPRPPPGRYRTG

SEQ ID NO: 7229 - protein, 79 aa, Klebsiella pneumoniae
PRPPLATSRRWASRSTATARGLSKRRCGPKLTARCPKPPVNRWATVPPSSPNASPSAACPSRKMSPPASPILPARILII

SEQ ID NO: 7230 - protein, 227 aa, Klebsiella pneumoniae
AVAPSARRAHRRPPAQWPYRAGRSSADRPAGKWQGPPACRPAGCRSALSRGSAPLRRCPSALHPPPWPHRPHPQRCPRRSAAAPASPCARAAAAMRHGLRFAYPPLHSRRRRPPPARPGPRPALTPADRRCRCPAGRCFAGSGRCRFRYGPAGQSPPAAASPDGQTTRHFPASRVPRRTAPASWRISAARRRDNRRFPINGCATGSPAGGPASPSPAAGRPARSAGR

SEQ ID NO: 7231 - protein, 339 aa, Klebsiella pneumoniae
DAAPGRQQRAGHPVRRRRPGHRHDPSTLTGATMFTPRLAVLGAGLMGVGIACHFARHGHAVRLYDTDPQRLAEVPAVASAILCELEASGQQDPADRDAVLARLTPTPTLNALADATLLIEAIPERLALKHALYAELETLIADETIIASNTSGLPPDRLAQGMRHPERLLIAHFWHPPHLIPLVEVVPGSATLPHLARQVSDFCAACALEAVVLNRAAPGFVGNRLQFALLREALHIVHSGIASPEVVDQVMRASLGRRYAMVGPLEAADMTGLATVQDICQHLLPELASGTEMMSLVAEKVARGDTGARSGQGFYRWDEARHQRIQSRREHQLRFALKP

SEQ ID NO: 7232 - protein, 222 aa, Klebsiella pneumoniae
RPWPDCRRRKFSTCWPIVPVLFPQPLPRANSLPLSTCWGAAWRCISSAAATMPSSAGMATISTTTSATPAPTPSSTPCARCGPASSRWIFTTISIRPSRPGPPFARCKNRIFPSTSAARRKRLSPSPANMPTSSHCGVSRWRKPARPSSGCAPKRRNTSVILASASRSGRLSPTAKPKPGRKPSISCTSPPSRRRSAEAGSKPNRTASAPSGCGPPRRRAEW

SEQ ID NO: 7233 - protein, 142 aa, Klebsiella pneumoniae
RFRPFCPQQENTMFSYIMLGTNDLPRAIKFYDPLMALLGHVKAGRNEQGASWGTFNGNHTCGLCVGVPFDQQPAGVGNGTMVALNARSVVHIAELHALALQLGGRDEGGPGHRPQYGDGFHSAYVRDPDGNKLAFVYYASAD

SEQ ID NO: 7234 - protein, 237 aa, Klebsiella pneumoniae
QLFTLNREINMKRAELDVVVLSEDLPNEGLVKGTLGTIVMVFNSPTTGYLVEFCDEKGKTIAMPVLFPAQLKRYFTIRNLKSLMVEGNYPVADPVDPDVMADLMHKVAPVEWEDKKRRVYEDIQRLLISRPDYADMFNIMDGGEYNGMTLYSLVQAENGEPAWSNIFVRNFDTRINEIYVDPNLIGKVVIGEEGMSVIVYSFTDDRFEIRDKVSSDYVIESHTHFNGLLSALIEPVS

SEQ ID NO: 7235 - protein, 544 aa, Klebsiella pneumoniae
PPFTQYLGFLPRTSRITTMSTYAYRQAAGIRQALLDRRELALIDVREEADFATAHPLFAVNLPLSKLELEVRRRIPRFTTPLTVYDNGEGLAEIAVERLRSWGYQDVALLAEGLAGWRRSGGELFQDVNSASKAFGELVESVRHTPSLSAQEVQALIDSRQEVVIVDARRFDEYQTMSIPGSISVPGGELALRVESLTPSPQTPVIVNCAGRTRSIIGTQSLINAGVPNPVHALRNGTIGWTLAGQTLAHQQQRQYDPSARASGARAAEVAHLAERAGVAVIDEATLQRWLQQSDRTTFLFDVRSPEEYAAGHYPGSLSAPGGQLVQETDHFASVRGARIVLLDDDGIRAAITGSWLAQMGWETARLSALSTSQLSERGVPAAEVPPGPQAEEISPAQLAQQLEEPGTVVLDFTTSANFVARHIPGAWWLTRSQLRQALEVIPPAQRYVVTCGSSLLARYAVPEVAALTGKPVQLLTGGTLAWIAAGLPLAHGDSGLAVERRDRYRRPYEGTDNSAEAMQAYLEWEYGLVDQLARDGTHGFRVL

SEQ ID NO: 7236 - protein, 213 aa, Klebsiella pneumoniae
IKEFAFMLHAERLTCIVDDRPLFAALTLSLAAGELLQVAGDNGAGKTSLLRILCGLARPESGVVSWQGQPLAKVRESFHRQLLWLGHKPGVNAALTADENLRFFFPASRLQQRESALAAVGLAGYEDLPLSQLSAGQQRRVALTRLWLTDAPLWILDEPFTALDATAMETLTRRLEQHARQGGCAILTTHQPLRPLGCPLRTLRLGGDAGGGQ

SEQ ID NO: 7237 - protein, 366 aa, Klebsiella pneumoniae
RKELFMSIQFLGMIGHRLSSETIAPVGPIFDRDYIVRFAQTHEAAGFDRLLVGHWSDQPDGFLVTALAGLSTQKIQYLLAHRPGFVSPTLAARKFATLEHLLGGRLAVHIISGGNDAEQRRDGDYLDHDQRYARTDAFLDTVRQVWTSEQPVDIHNDFYQAEQAWSAIRPLQKPHLPIYFGGSSEAAIAVAGKHADVFALWGESLAQTGETIQRVRAEAAKHQRDIGFSVSFRPIIADSEAEAWEKAEHILHVATEQAAQRGGGFKAKPDSIGAQRLRATAAQGRVVDKRLWTGIAQLVGGGHNSTALVGTPEQVADALLDYYDLGVRNFLIRGFDPLNDAADYGRALLPIAREKAARRAVAERAS

SEQ ID NO: 7238 - protein, 300 aa, Klebsiella pneumoniae
RSNTMNLHGKTALVTGSTSGIGLGIAKVLAQAGAQLVLNGFGDSSHARAEVAALGKIPGYHDADLRDVGQIEAMMRYAESTFGGVDIVINNAGIQHVAPVEQFPVDKWNDILAINLSSVFHTTRLALPGMRQRNWGRIINIASVHGLVASKEKSAYVAAKHAVVGLTKTVAPGNRAQRHHLQRHLPWLGANPAGAAADRQTHHRGGRPGAGQRPAAGGKTALRGVCHPAAAGRNGAVSVQRCRRPGARRRMEHGWRLGGAVSRWRREDQNIARKRFTVRERSKRRQAMAISVFSGAPLSG

SEQ ID NO: 7239 - protein, 155 aa, Klebsiella pneumoniae
HLATFHGLNRQHTFFCTLQGCHLSLGRGLATFVIQVWLPGSAPAEREFHILHNLKTKTVMKKTKIVCTIGPKTESEEMLTKMLEAGMNVMRLNFSHGDYAEHGQRIQNLRNVMSKTGKKAAILLDTKGPEIPYHQAGRRQRRLPESRPDLHLHYR

SEQ ID NO: 7240 - protein, 384 aa, Klebsiella pneumoniae
INATHTSGGQQGAAARLTISFLHWRVSSQISSYPRAFVAGRKWRGRASGKQCQEYIPQVSAWVPALTICSALGLATLPLAVTNPGWTVSPLALSTNAIGGALCSTCWWPHSIRANSTSAGILLWLVPMAALALMLGWAHPLTQMSGFFTKAALMTFGGAYAVLPYVYQGAVTHYGWLTAGQMMDGLALGESTPGPLIMVVTFVGFVGDYTKAVLGVDEVLLGGIAAACLVTWFTFCPRLSLFSPAGRLLKPPIIKWDLPRRWPPPRWALSSIWRDCPAQDEVGRQRASDPLAPNRTGDHQVVGLSRVARASGLPSSSSWSRSAQPRSLPGLSNPAGSRDCFTATTSGRITPCLPSSTCSTWGLLILTSLSRNICMMALRRSGVV

SEQ ID NO: 7241 - protein, 889 aa, Klebsiella pneumoniae
VSRFLVLIKGTCFLRKNSMRRLIRVSLQNQHAIAAISFENCPAKTRMLSDGRVVQGRSVLSHCQIVGEIARALMALYPEPMRSRLFPAGSEMAAAGHDIGKVSPTFAAKIFAACDVNDHRLAGLSAVNPGLETLWGGHAGVSQATAESLHAPRYVPEILGQHHGFNPGLNGRRGDAEVFGGPLWFDERKKLVDKLKAEFSADWPTFDSAAQARVVAGLTSVADWIGSGEFFENPEQAWQPVITAALNNAGFIKPVIRQGLSFADVFFPDDPSKKPREAQSRFIDQVVGPGLYILEAQMGMGKTEAALYAAYQMLVQEKATGIYFALPTQLTSNKIYDRFNAFLHQIVSTETPQHSLLLHSGAWLMDTEMGEEGSPGGAWFNHRKRGLLAPFAVGTIDQALMAVMNVKHGFVRAYGLAGKVVILDEVHTYDLYTGTILNALVEFLRQIDCTVIILSATLSQTRRDALLQQSTTSEAYPLITAAPSAERERGLVEIGVPVTENTTVILHSCRKDEPAREEALRRAELGQQVLWIENTIAEAQQTYLDLASRAVEAGCETGLLHSRFTPQHRNRHEQRWVALYGRAGWPQRKQCGRILVGTQVLEQSLDIDADFLVSRFAPTDMLLQRLGRLWRHTDTPRHASAKAECWLLSPSLESALANPGSAFGMSAMVYSPYVLCRSLEVWQAIPSLSLPGDIRPLIDQTYTERAEEGTWATLLHELKNGSRFRSGEQALQSLAKLTLSTGGKTLPEHKAETRYSDRDTHDLLLLRGLRTQDGITYMRLLDGAELTLPHGRHRLSRAQWRQLAVVLNQQLVRVSPAFCPPTIAKSELEKLHLQEVFYLGRPEDDEALLRVAIVSPAGELKTLDGRPAGDKYTLEYSEYLGFRAISKKE

SEQ ID NO: 7242 - protein, 116 aa, Klebsiella pneumoniae
PAGTSAQAAQAKTAVSETTKPLIFLYMIPTFNHQLINTNLTYSGISSPCNDGDGFFLAFVTLAEFKNVVFMALIKTRSRPGFLSSVVCAGAGAAACRRETPPLTFCAGRRSIKRQT

SEQ ID NO: 7243 - protein, 298 aa, Klebsiella pneumoniae
LRGTAMINGYIPAARFLPFLSWTDVAALPDKSNTVIVLPTGAIEQHGPHLPCSVDSVISSGVAGHALARLPATIPAYAIPPIVYGKSEEHLHFPGTLTLSGDTLLHTLLEIAESLYRAGFRKLLMINGHGGQPQILQIACREMRLRHGDFIAIPHDVFNVPNCEKQFLSPHEQRMAMHAGHSETALMLALAPECVHMERAVANFPPEFPCPTLSKGRPAAAWASYDFGPSGVIGDPTPATREQGERLLDSLAASWAQAIIEIHRMAWVERREPTWGKQHWHGFVQSLPPSFAAESREP

SEQ ID NO: 7244 - protein, 160 aa, Klebsiella pneumoniae
SSITQSLNDQNRAVASMIVCPALVVNVPARRFTMKIAHFALWTQQLDVQARFWVDFFAASINEKYLSQTNPGFASYFVTIDDEVVIELMTKPGLQQASAVNNHTGWAHLALSVGGAEQVDAIAQRAGAAGILISPPRTTGDGYYEAVIADPDGNLIEIVA

SEQ ID NO: 7245 - protein, 217 aa, Klebsiella pneumoniae
VLVTGIWLVSSKWRSALLFSGWLAIRPSRKIGFFAWAISFATWSMASSGAAPICGAPLAGSTLPLTGPSTTSCGRLTNALPGRPCSAARKALETTSASASGAVTSTAYLVTGLNIATVSILWWTCFALSARFTAPPRATTGSPSLFAVAMPVIRLEQPGPEVTSATPALPVMRPTAAAINAALASWRTGIMRMEESSSESKTLSILAPGMPNTWRTP

SEQ ID NO: 7246 - protein, 116 aa, Klebsiella pneumoniae
PLTTQAGSHGFHIEPVTLGTKLIRQAWRSIALFCVTECFPDDVITDKAELLTPVYLITTLMPDVPATTGNLKYTAHGFDTELSLMFFDEDILHFRRFAKYVAAFWRMASSSSRSAS

SEQ ID NO: 7247 - protein, 331 aa, Klebsiella pneumoniae
RRRTQQQMTGGESQRPKTGPVNGARHLKNLAAIKINNGAPTRAVIAPVASSCGATSVRAAISASTSASAPTGAARGSARRMSSVTRRRTMCGTTSPTKPIGPATATAAPHSSAIASRPSSRVWTRLTPRPSATLSPSASTLRRGAMSSATPRPISAGTSAVCSVLQFSPARSPASQVRIASSVCSSRINIAAVTADANPDSATPHNVMRSGVAPPRPAEASAITPPNSSPAPQAAVSGRPAGKAPKDRPSAEVATTASEAPALSPRICGSPSGLRITVCSSSPATPSAAPVSSARRQPHQTQIDDNPLLKVTRIVLQQRSQHRLRGDPAGA

SEQ ID NO: 7248 - protein, 62 aa, Klebsiella pneumoniae
GTTAGGVARLLRQGWAFLGPVARQPLPVTKNTLFYRFYSCGRDTLVTRIGDPCPLCLTICGD

SEQ ID NO: 7249 - protein, 344 aa, Klebsiella pneumoniae
ATFARSPSRRKEERDMKTGARLPRGIRWLGLMALGGVSLAVQAEEKIVLLTSWYAQAEQGGYYQAQATGLYKKYGLDVEIRSGGPQVNGMQLLLSKRADVIIGYDLQLLEGIQRGFQAKAIAAPFQYDPQGLLTHADVTSLQGLKDKTLLVSSSGQATWWPWLKAQYQLSDAQVRPYTFNIQPFVVDDAVAQQAYVSSEVFQVQKAGVKANFFLFSEHGYPPYGGILIARPDTIAERKAAMAKFVRASMEGWVSYLKDPEPGNALIKQDNPKMTDDLLAWGVTQIREHHLIDGGDAASQGWGTMTDARWQKTRDFMVSAGLLAAATDWKQAYTTEFVQAMQVKP

SEQ ID NO: 7250 - protein, 408 aa, Klebsiella pneumoniae
REPASGFAHDPRILKALRRRKMGPAPVGAQRLRGAVGTTPQPFNARRRHPRLCEDRFGKGPQIKPQIIAAACGGFERIADRARTGVEQPLAMAGHPVTAGLVQQLLIESGGDFVTAGVNMRPHGDDQIGQCHPLLAKTGQTVVDNTADQPLPAGMHAADVATVARGDQQRQTVGGHHPHLLPGYRGKHRVGVRARRQRLLIMMNLITMHQLHRSQLGIGKGGGFMDIEKSVADARDRIEQTGGVSHRDDKRQGMMSYLRPGDADRQGGGPAFFYQTAGCISDHGRALLAMHQPEHRHAGQHNARRRGRHHPDGAGAEGQHLAGQQRAAHRPKTPHRHGGAHPGGADGRGIKKRRQSVKHTLSAGGEQPGDKPRQQHASQRRRAAQRQQRRQNAAVDQERHPQRGELIH

SEQ ID NO: 7251 - protein, 670 aa, Klebsiella pneumoniae
KLHAAGGEKRHDAGENGGAAMMPELGHFLLCLAAGLALLLSVYPLWGAARQDRRLMALARPLACGLFACIGGAFLLLVHAFVVNDFTVRYVAENSNSALPVWYRVAATWGAHEGSLLLWVLLLSVWTFAVAIFSRRMPLDAVARVLAVMGMIAFGFLLFILFTSNPFSRGLPQYPIDGRDLNPLLQDIGMIFHPPILYMGYVGFSVAFAFAIASLLAGRLDTAWARWSRPWTQAAWMFLTLGIVLGSAWAYYELGWGGWWFWDPVENASFMPWLVGTALLHSLAVTEKRGSFRAWTVLLAIAAFSLCLLGTFLVRSGVLVSVHAFASDPSRGLFILVLLIVAIGGSLLLYALKGGRVRARVEHTLWSRESFLLGNNILLMAAMLVVLLGTLLPLVHKELGLGSISIGEPFFNTMFTALMAPFALLLGLGPLIRWRRDDVARQIKRLIIALLVTLSLSLALPWLLQDRITAMAVIGLMMALWVLIFALMEVHERATHRHGFWRGLRTLTRSQWGMVLGHVGVAVTVIGITFSQNYSVERDVRMRPGDSIDIHLYHFVFNGVRNIVGPNWTGGEGIIAVTRNGRPEATLYAEKRFYTASRMMMTEAAISGGLTRDLYAALGEELSDGSWAVRLYYKPFVRWIWYGGVLMALGGLCCMLDPRYRMRKKLQEAS

SEQ ID NO: 7252 - protein, 170 aa, Klebsiella pneumoniae
PTDACGRRRWHMSLEAGAGAPLARYAAWRRAGDFIFLSGIIPVNPLTGAIVNGFQDVPEPVRELLGATGEFSTDAKQGPILAQSWYVLESIRRTVASAGGQMSDVIKLVQYFRNLDHFPYYSRVRKLFYPDQPPVSTVVQVSEMLPDATVLIEVEATVWLPPSFNSEAPR

SEQ ID NO: 7253 - protein, 393 aa, Klebsiella pneumoniae
RNCAMPDEHHVLLKEDVRNLPDTRYLLSLMPLLGCLVLMTIMLAGCDGKKQPTSLPLRPVRFVTVGPRESPGVQTLTGEIRAHDETSLSFRLDGRILTRSADLGSRFRQGDALAVLDSPTAQNQLTSAQADVSSSRAAEKVAALNLHRMRLLMPSGAIARAQLDTAAADWQAALSRLQSSEAALKNAQENVRWTTLTAPVNGLVTGVSASAGQVVSAGQTVFTVASSNARDVVFDVASPGIVSRQPGATFHVALLQDASVIAQAHLRDISPQADPQTRSWRVRITLDNPPPDMVMGASVSVTLPIADSAGEKVITLPASSLTRLSEAPAVFILDPANNKVYRRAVHIAGYSADAVFIRAGVSPGDRVVTAGVRSLRDGEHVAGIQEDQDEAGL

SEQ ID NO: 7254 - protein, 350 aa, Klebsiella pneumoniae
MTRAVHRAGFRPLAFASRHLLLRPAALKIAASIVLTLLALGLYSLSRGSYPLPASTLARALLAPQEMGEQPRFILFDIRLPRILMALLCGAMLGLAGAAMQSITRNGLADPGLIGVKEGASIVVLALVLFFPAVGLVWRPLAGMVGGIAVALLVLTLARDCSRPRFILIGIGVSWSLAAAVGIFMTTADVRDVQTAMIWLAGSLQAATWPLLAVAFCWALPGAIILFCTARAADVALLGDRTAIGLGVRLQQLTVLRFFAPVLLTSASVSCVGSLGFVGLMAPHMARFVLRGGQVSLLCGSALIGALLVLATDTLGRLAFAPLQIPAGIVIALVGCPFFVVLLWRRRDAL

SEQ ID NO: 7255 - protein, 120 aa, Klebsiella pneumoniae
SYPAIVDTRLSGVNSQPEVTHMTKPTSTTKKPRKQHTPEFRQEALKLAERIGVAAAARELNLYESQLYNWRSKQQNQFSSSEREQDMSAEIARLKRQLAERDEELAILQKAATYFAKRLK

SEQ ID NO: 7256 - protein, 98 aa, Klebsiella pneumoniae
RPAARCGQSTRLPSPPAPFSPAPAGPAARSAAPSATDRASDPETPEFAPAPGRRAPRRRSASVRSAALPAPPAAAAGLIYRSRKGPAAPRFPPGAAAG

SEQ ID NO: 7257 - protein, 66 aa, Klebsiella pneumoniae
VSAAACPAAVSAAIMQHALSKFLTMRFPFYAFILHKNTHTHFYMQPETFPLVNYLLNGPVYRRIYR

SEQ ID NO: 7258 - protein, 137 aa, Klebsiella pneumoniae
RGKASGSANSAIIRPGRGDITSTRSHSSSASSISWVTSRLVYPCCCQRAISSRCILMRVSESSLPNGSSSSSRRGSFNKARASAARCAIPPDSCRGHASLKACSPMRSINASAFASSPFFPCACGPSSTFCRTVSHG

SEQ ID NO: 7259 - protein, 540 aa, Klebsiella pneumoniae
TAGAAVLPVRFPGTSTSFWAAAPAASTSPAPSEGTNLAYRLIGEYQNEDYWRNFGKNKSSFIAPSLTWFGERATVTASYSHRDYSAPFDRGTIFDLNTGHAVNVDRKTRFDEAFNITDGYSDLAQLNAEYRLNDAWTARFDYSYSQDHYNDNQARVMAYDSATGNLTRRVDGTHGSTQKMHSTRADLQGNVVVGGFYNELLTGVAYENYDLLRTDMLRCKNVKGFNIYHPVYGTLDTCNTVSASDSDQRIQQESYAAYVQDALYLTDNWIAVAGVRYQYYTQYAGKGRPFNVNTDSRDEKWTPKAGLVYKVTPNVSLFANVAQSFMPQSSIASYIGELPPEESTSYEVGAKFDLLNGITANIALFDIHKRNVLYTESIGDETVAKTAGKVRSQGVEVDLAGSITDNLSVIASYGYTDAKVLEDPDYAGKPLPNVPKHTGSLFLTYDIHNVYNSNTLTVGGGGHAVSKRSGTNGADYYLQGYAVADVFAAYKMKLQYPVTLQVNVKNLFDKTYYTSSIGTNNLGNQIGDPREVQFTVKMDF

SEQ ID NO: 7260 - protein, 312 aa, Klebsiella pneumoniae
PQGAQRAPSVAAGGLRRRQLFLHQPHPHGDAGADQRIVKVIACVMQRLRRGFAVGAYPEIGPRTGLQHAGKIFGGHRRRLIPAHRLRAESGDGHLAHLLRLQRMVFGHRITREPANLALHIGHLRLGRHIAFDELPHAGANAIAQAAEGTAQHHGVRQDVDRLAAVYLGDADHRGILRRQAAGRNGLQRHYQLRRRDDRIGPALRHRRMTALSAQGDLEGVQRGHHRAIAERHFAKRDPRPVMQRVDGVHREALKQPLLHHFARAAEVLFRRLKDKVDGAAEMAGLRQMGGGRQQHRGMAIVAAGVHHPGAA

SEQ ID NO: 7261 - protein, 332 aa, Klebsiella pneumoniae
IQGALMNTRLTPVFTLLTVAALATSASCFAAEKFTFLTNWYAQAEHGGFYQAQATGLYHHAGLDVEIKMGGPQINVMQLMAAGQADCTLGDNGQALETWQAGVHAVTVATVFQHSPTVFITHDKVENPAELKDKTFLLATEAYTSFWPWAKSELGLAGSKVRPYTFNVQPFLADKNLVQQGYVTSEPFSVAKGGQPFYVYPLSDWGYPPYGNSIICMADTIRKRPAAVAAFVKASMEGWKSYLQDPAPGNSLIGKANPQMGAEQIAFGIAQMKQYQLVTGGDARTGGIGIITEPRLKKTWEMLVKNKLIDASKVPFEQTYTLEMVKDAGVMP

SEQ ID NO: 7262 - protein, 103 aa, Klebsiella pneumoniae
GSVALPGTTSTSGIRCGGCQKWAISNRSGWRMPCASRSGGRPLVLLAIIVSSAISVSSSAYRACFSASRSGIASISSVASARAFSVGVGVRRASTASRSAGSC

SEQ ID NO: 7263 - protein, 70 aa, Klebsiella pneumoniae
HFPAGPCGIRRIPDNTDSQHKKSLIAINTRLAGLSAACRRKAERSVAANQSEAFRCLQSGARFGKICVAW

SEQ ID NO: 7264 - protein, 106 aa, Klebsiella pneumoniae
GRTAYAPPKVISAALVKNPLIWVSGCAQPSISARAAIGTSHSSIPALVLFALMEWGHQHVLHSAPPIALVDSASGETVHPGFVTASGSVASPSALQIVKAGTHAET

SEQ ID NO: 7265 - protein, 216 aa, Klebsiella pneumoniae
SLQAEPLRRQRHAWPGSRGLWRAGDVSHRRSGHYPLAARRRPERTGVARGAPAAVGSIQPEGGLMRRVIVILLALMLTGQTWAAIDTWQFKDEAQEQAFREITSQLRCPKCQNNSIADSNAMIAADMRQKVYELMQQGKTKGQIVDYMVARYGHFVSYEPPLTAGTVLLWLGPGLFVLAGAGVIIARARRRDIPDAALSAEERQRLAALLKEGKER

SEQ ID NO: 7266 - protein, 197 aa, Klebsiella pneumoniae
RRRARTAGTEPILCRVAAAPYPAYKTLLVACPWPAPAQRRRTVTAPAAAPAPAGGRSPRAAHPLPVAGPATPAGPPRPRGNLHYAPRSGPASPAPAGCSAAADAGHAAAARPSEPDRYPPPAPARWRNRKPPPGRPPPEHAPGQRRRSPSRHRLTTGPAAQAAASRRGRSAYPAGGCAGQAAAPPAHPFAAAPPSGP

SEQ ID NO: 7267 - protein, 63 aa, Klebsiella pneumoniae
RRRARAAGAEPLLCRVAAATYPAYGPCDLSLIYSPLLLKLPVLAASKSLRRSRKAGAARMDAG

SEQ ID NO: 7268 - protein, 277 aa, Klebsiella pneumoniae
CYYYCFIGNYMVYACRYFYKEKFMSRFICNTLLLTNDDGFDAPGLKILEKVCQRLAKEVWVVAPACDRSGTSQSLSLHTPLRFRQKGVHRYVVEGTPADCVAMAVRHLMIDSPPDFILSGINRGANIGNETIFSGTVGAAMTGVLLGFRAIALSQYFNNRHNIHWDTAEHASEIVLKYLIQGRWDYGTCFNVNLPDVEPDSIKDIAITRQGEGNLNNIGVIVREDLRAIPYAWLNLERSENAEPSDSEGSAVRAGHISVTPLHFDRTHYRDRLIHSH

SEQ ID NO: 7269 - protein, 451 aa, Klebsiella pneumoniae
QHPLYPRQEPTMSSYSPNPTAAAQPAVTVRRSRRRIGILALLAIGTMINYLDRTVLGIAAPKLTAELGIDPAIMGILFSAFAWTYALAQIPGGLFLDRFGNKVTYFLSLTLWSLFTLFHGMAVGLKTLLLCRFGLGISEAPCFPVNSRVVSAWFPQQERAKATAVYTVGEYLGLACFAPLLFWIMDGFGWRVLFVSVGAVGILFALVWWRCYREPHEDPRLSQQEREHIENGGGLSAPTDQQVAFSWPLVRQLLSKRQIIGASIGQFAGNTVLVFFLTWFPTWLATERHMPWLKVGFFSILPFVAAAGGVMFGGWLSDKLLKATGSANLGRKLPIVAGLLMASCIITANWLESDLAVILVMSFAFFGQGMVGLGWTLISDIAPKGLGGLTGGLFNFCANLAGILTPLVIGFIVAGFGNFFYALIYIGGAALLGVVAYLFILGDVKRIELSQ

SEQ ID NO: 7270 - protein, 326 aa, Klebsiella pneumoniae
MLRYCDKTVASRALIRTTRCKKESTQTMFAFSRFLLYFTEVARQGSFRKASEALHVSASSIDRQILRVEQELAMPLFERHPTGLRLTAAGELLLHAANNWKKDFTRVCEQLDDLRGLRRGHVRIATIDAINRHFFSTMLKEVHKHYPNISFTLTTINNIHIQQALISGEADFGIMLNPQTSRELQVRAFAEMNMGIVVPTGHPLASRSAVRFSQCLDYPFILPSAPLMISEPVEALVNISGNEVKEVAVSNNIHMIRTLIKEQMGIGILCRLDILDEIESGQLAFVPLTDPQLKPFTLALCVSPARQLSLAASMMLNQLEMLFSQL

SEQ ID NO: 7271 - protein, 259 aa, Klebsiella pneumoniae
KGNLMVKNLLKACCMIAALTAAGQAAAETYTVGSGGTYRPFEFENSQKQLEGFDIDIIKAIAKAEGFDVKLVNTPWEGIFATLNTGDRDIIISGITITDKRKQMVDFSAPYFPAEQSIVVAQDSQVDSLAALKNEKVGVVNSSTGDIVVSEVLGKNSTAIKRFDNTPLMLQELFEDGVSAAVGDVGVVKYYIKQHPEKQFKLVPDAKFERQYFGIAVAKGNSELLGKINAGLQKIVADGTYAKIYKTWFDDNVPTLPAQ

SEQ ID NO: 7272 - protein, 301 aa, Klebsiella pneumoniae
RGAQRRRAPAAGGIIERRKRTMSLLVVIVALLLAGALGLLYFPWSGKGAVDRDALNRALYQSRLQELAQERGEDNPALVVELQRTLLTDIPPQPLPGERPLNRWALLPGALLLVVLSLGLYLKTSDIGQVLLWQQAERHYPALLQQVKDPTAAPLRMDELAELRLGLRSHLQDTPNDLAGWQLLGRLGLLLNDGETAIGAFGRAHALAADDPAAAFDYASALVRAGDSGQVRMGELLLRDLHQRQPNSLPVLEMLALSAVRNEDYPEAVAALQALLARLPEGDARREAIVRQLAQAQQQAQ

SEQ ID NO: 7273 - protein, 181 aa, Klebsiella pneumoniae
VTAHRHNQYDNGSTNPGPTMDKDTVVTLLKYKRWIDLATLQAIRAIDGTVHGEKRHLTIRLMNHIHVVDMIFRANLRGRPHGYTALNTPETPTVDELETAMTACTDEYIQYVSAMTPADFHERIAFKFVDGGDGNMTAMEMLNHMLFHGAYHRGAVGWMIGECGGVPPKEVLTVFLRDHHS

SEQ ID NO: 7274 - protein, 194 aa, Klebsiella pneumoniae
TVDQEITLQPDRSRLYLRRVNASDIDDLFRIYGDPATNTFNPAGPYPDISHARNVMARWLNHWENYRFGNWAISLKENPDRIIGFGGLSIISYDDTPIMNLGYRFSTESWGKGLATEFAKYAVGYGFDVLKLAEISAVVRPNHLASQKILTKAGLRFSRNIHDVKNEPASMLFTVTLDEWNNALSRGTTPPIDH

SEQ ID NO: 7275 - protein, 89 aa, Klebsiella pneumoniae
LHDHGDPAPGRVRCPGQPGADGGLYRMVKQSPHDADAPVLAPGEWEAANREARLAQGIPLDAGSWQAICAAARDVGLSESHFDRCRPLA

SEQ ID NO: 7276 - protein, 162 aa, Klebsiella pneumoniae
LVRLNGLEPSTPTMSRWCSNQLSYRRIMVRLIGLEPTTPTMSRWCSNQLSYKRIMVRSIGLEPTTPTMSRWCSNQLSYERNVVVTTGTHIIGREGMWQEVNVTFLAHCMRLRNFYSFRIYFTEPQGYFFASEHHGSHFSGSPNLRGRVADVLNYRPPEEKES

SEQ ID NO: 7277 - protein, 339 aa, Klebsiella pneumoniae
RGRQMPANHHPWLVQGSLALVTLGIAVASLCFGQYPLSLSAVGHTLVHLPPGEGVIGQIVWSVRLPRVVMALLAGGALGLCGATLQGVFQNPLVDPHIIGVTAGSAFGGTLAILLGVGSLLMMASTFFFGLVALGLIYALAALQGRDSTLGLILSGIILSGFFAALVSLMQYLADSEETLPNIVFWLLGSFATASWHKVLLMSLPLAVAAGALWKLRWRINLLALEERDARSLGVPVAALRRGVLVCCAVLVAAQVAVSGSIAWMGLVVPHLARLLVGADHRRLLPTAFWLGAALMLVVDDLARTLTQAEIPIGIVTALLGAPLFTFLLVQSRRRSTAR

SEQ ID NO: 7278 - protein, 305 aa, Klebsiella pneumoniae
GTGHSPKGRDILREAPEMKYVFIEKHQAEFSIKAMCRVLQVTRSGWYIWHQRRYQVNRRQQFRLVCDNVVREAFSDAKQRYGAPRLTDELRAQGYRFNVKTVAASLRRQGLRAKAPRKFSPVRYREHGLPVSENLLKQDFYASGPNQKWVGDITFLRTGESWAYLAVVIDLWSRSVIGWSMSSRMTAQLACDALQMALWRRKRPENVIVHTDRGGQYCSTDYQSLLKRHNLRGSMSARGCCYDNACAESFFHTLKVECIHGEDFVSREIMRTAVFNYIECDYDRWRRHSACGGLSPEQFENQNLA

SEQ ID NO: 7279 - protein, 138 aa, Klebsiella pneumoniae
IIGHQKRRSHNEDEIDWYFLRFFSWRTSAVPRNRPSGWTYAGAAGVGACLWRRQSWSDGGGRRCGAGGRWRGDRRDAARPGGAGNCPPRLDGAACGRGYARAENQNGGAGGWLYCPAGRGGDARGDFRTMDLGAAGDP

SEQ ID NO: 7280 - protein, 589 aa, Klebsiella pneumoniae
PVGQRGHRAGWVVAQPLRERGGADDEDVMHVPALQITVNGAGFRIFPHHRPTVHMGGLVGGGIKVAVGVFWAAEDIFRLHRFSDRRHLIEHKLRHLDVVFLPVEGHAEQRLAEDVFVVRIKIEVVLPIGLVRAVGIHRQVMGVGIGHRRFPLAAPRRGARRYRETGDGLGPGLVDPERRTADKARRTVVEVVGVEVVDADAVAARADKRIGIGVFVENGLDGGHVLVGEVTPYHPFAGLRIVRFADPGEQHQVHVVELEGADNHQVRRLFHFAPLAVDVGHAGGAGFVVGQVDLQHVGVSPQLKAFFLAQRRQNVHVRRGFRVHVAGVAAAETAEVARAHLRAVGVGIGVGGVGRRQVIGVIPHFQRRFFKQLRRPGVFLRRQREVVRAVRGEGVAAAAFADDLAFDRPGGPGSTEYFFRFIEERFQLVVGDAEILDDHILGDEVFAVAFFIVAAHPQLNGIDAEMDAGPVQPGAAHAGTRQEGRQLAIGHRLLAGVMPDGDGAFRQILEQLAADVVGQLINHLRIGAVRPGVAHRAALQRDDVEPRFGQLFGHDRPNPAEADDRDIGFFQYGGHDYALSPLIDTGGKG

SEQ ID NO: 7281 - protein, 291 aa, Klebsiella pneumoniae
ADLHPGDGQRRRSDAMNTAPKLTVMSDTRFMPAAATPAIEVLSAEKIYSNGTRALLPVNLTINQGEFITLLGPSGCGKSTLLKMVAGLVEPSDGKLMLWRRDSREKAQHPLSFVFQEATLMPWSSVRNNVRLPLDLAGVPRAEGNTRVSEVLELVGLGKFADVLPRELSGGMQMRVSIARGLVTRPKLLLMDEPFGALDEITRNKLDSDLLRLWQEQNLTVVFVTHSIHEAVFLSQRVIMMAARPGRVVEDIPIREPFPRSEAFRVSPAFSLYARQLQDSLLQASQSGMEP

SEQ ID NO: 7282 - protein, 759 aa, Klebsiella pneumoniae
ILAQDLHSATGLRLHHHQAIPRSLPVGPGATAILSSLLTGLLLMKKITSVCPYCGAGCKLKLVVDNNKIIRAEAADGVTNQNQLCLKGYYGWDFLNDTQLLTPRLKQPMIRYQKGGAFTPVSWQEAIRYTASKLREIKEKHGPRAIMTTGSSRGTGNETNYVMQKFARAVLNTNNVDCCARVCHGPSVAGLQQALGNGAMSNSISDIENSKCLLVFGYNCADSHPIVARRVIKARDNGAKIIVCDPRRIETARIADRHLQLNNGSNMALVNAFGYVLLEEELYNKTYVERYTEGLDAYREAVKDYAPEAVEGIVGVSAREIREAMRMFAAAPSATIMWGMGVTQFGQAVDVVRGLASLALLTGNLGRPNVGVGPVRGQNNVQGACDMGVLPNLFPGYQEVTDPDVRAKFAAAWGIDPALMDDQVGTRITEVPHKALAGEIKAYYIMGEDPLQTEADLGLVRKGIEALDFVVVQDIFMTKTAEMADVLLPATSWGEHGGVFTCADRGFQRFEQAIPPAGNVKRDWEIISLLASELGYPMHYENNQQIWDEMRELCPLFYGVTWEKMGDMGHVQWPCPTLDHPGTPWLYKDNRFDTPSGKGQLFATAWRAPAERPDDEWPLVLCTVREVGHYSCRSMTGNCAALQSLADEPGRVQMNPADAQRLGIADKQLVWVSSRRGKVISRADLSDRINPGAVYMTYQWWVGACNELTQDNLDPISKTPETKYCAVKVEAIADQQWAERYAWTAYSDMKARLKAAADV

SEQ ID NO: 7283 - protein, 361 aa, Klebsiella pneumoniae
NGKHNKITTDYRRESVPTGHRFLATDLHQFVVSLFTHLGSTPGEATLVADHLIAANLAGHDSHGVGMIPSYVKSHAGGFLQLNRHATVTKDAGAVVTLDGNAGFGQVVAHEAMQLGIEKAKQHGMAAIALRNAHHVGRIGYWAEQCAAAGLISIHFVSVIGDPMVAPFRGKDSRFGTNPLCVVFPRAGHPPLLLDYATSAIAFGKTRVAWHKGEAVAPGCLIDAEGRPTTDPAVMQTSPLGALLTFAQHKGYALATLCEVLGGALSGGQTTHQESLQTSVDAIFNCMTTVILRPDAFDAPDSQAQTEAFIAWLSSRRTMPMPRCWRPANGRPPTAKRGWRRGSRWMPAAGRLSAPPRATSA

SEQ ID NO: 7284 - protein, 303 aa, Klebsiella pneumoniae
SMEHTVAGAIKEWRKHNKVIGQVKISYKKILRKCRELSLAGGKYREYQGLCAKYQCARLTAVTKGLVPFEDKPFKAYLNKRLSKRRKLDIAHGSLNFIEKTFHPDVLPQLYNVADFGREMFSIPLKNGDKLDVKLLASPFQEEGELMLQLFLGDRRVYSVCFSCTDDGRAYIGGIQGGKDITNDEVKVLTKELHGARPKNIIMSVLYGLLRYFNISTVYAIDSDYHVKSDLVKASYSSLWLEMGGEKQARGWYKLPAQEIKKSIEEVKSKHRSQFIKREGLKELIQINMANALQQITLSARVN

SEQ ID NO: 7285 - protein, 65 aa, Klebsiella pneumoniae
WRLQQYVPLIKIHRFIHNRGHINIKAFRQRLITPSLSFHLIFRQEIILSTLFVAKLILSTMNYGR

SEQ ID NO: 7286 - protein, 204 aa, Klebsiella pneumoniae
QEPHMTAPRLEKLRHFIHEVDRLHREHHQTAPLLDAVAQRLAALVRYDDWLPEEYTLPHPHHYQQYLLHADSGERFSIVSFVWGPGQATPIHDHRVWGAIGMLRGAEENQRYQLDADGIPRALGAATLLEAGQVEKVSADDGDIHRVSNALADRVSISIHVYGGNIGAVKRAVYTPEGQQKPFISGYSNRHLPNIWDSSREHQG

SEQ ID NO: 7287 - protein, 435 aa, Klebsiella pneumoniae
RQPQGIHINQAPIPGKPSPTRESSRMKLALGPYIRFSRILLFPLAMVIYDFSAYLTTDLIQPGIIHIIREFEADVALAPASVSLYLAGGLALQWLLGPLSDRIGRRPVLLTGAIIFALACFSMIFVTSIDQYLIARFIQGTSICFISTVGYVSIQEAFDEKESIRIMAALTSIVLLAPVIGPLAGAGLMNFLHWKLLFAIIGAMSLLAWALLIFNMPETVTSQGRGFRPGEVFSEFVRAFKQPVVLTGALVLSFSNLPIITWVALSPVILIDDGGMSRGAYAWTQVPVFGGVIIASIIVARFIKDPTSPRFIWRTIPIQLTGLLVLLAGNIAWPHTWWWSVSGTSLYALGTGLLFPVLFRFALFSHSLPKGTVSATINIVALSFMAASVEVARWVYFQAGGRIAFHCLALIAGIVVIMLVSRLLKLRQQHLLQPA

SEQ ID NO: 7288 - protein, 578 aa, Klebsiella pneumoniae
ITTQSFDEVALLSRLQQGLKTRQTRFALALKVALLGGVVAFSSAVFAEGLLKEGITPATDASQIPASAKLRKDTVVAGISEPQGIFNPYFFVNGWDENVTNVIFSRLIDWDSQGKLVPGLAESWTVSPDNKVYTIKLRPGLTFSDGSPLTAEDVAFTLTVLLDPSYDGDTDITLANIAGGADYKAGKADSVSGLKVIDPLTLQVTTTQPGATTLAKIGGPVLSKAWYGKGYQRGNLDYLRSLHGKPLGNGPYVYDKYIPGQEIRFHANSHFYRGTPPTPRFIYRVTNPSTNFQLFQTGETDYDAFTSRPDDIEQLKMLGFANINLYGSSDYSQVEFNVHRPALQDKRVRQALIYGLDRQKLIDVVYQGYGKVAIEPIAPISWAFNAEGVNPYPYDPAQAKKLLDEAGWKAGADGIRAKDGQRLELTLLVSKKVLNDALIPIAKENWRQIGVLLKPQVVDFNALMAQRKAGNYDLASFSTSTLNDPHDGVWDFYSSEAKESGYHNAEVDKLINAGNAVLDIEQRKPIYHQLYKVLADDPPVILLGYREILSASSARVSGFKPDIYNGLTGSLPDVKIVK

SEQ ID NO: 7289 - protein, 183 aa, Klebsiella pneumoniae
NRAHCRSSSAAQQRQQHGAGKCLRLCAAGGGAVQQNLCRTLYRRAGCLPRGGEGLRPGSGGRDCRGQRAGNPGGDAHVRRRPIRHHYVGHGGHPVWPGGGRGARPGKPGAAHRQPGTAQRRRGAGPRAKQRTGRLRYGRAAEPVPRLSGGHRPGRAGEIRRRLGHRPGADGRPGRHPHHRGAA

SEQ ID NO: 7290 - protein, 328 aa, Klebsiella pneumoniae
LTQHQKCGSVQAYRQLKVEKMKSDVVVIGSLNYDILVQQDRLPELGETFTGNELMLMPGGKGANQAVQCSRLGLNVSMVGCVGNDIYGSELINSLRENNVSVENVNKRGTTTGIGIVQILESGDYCSTIIKGANYLISEDDITESLFEGQPLVILQSEIPAPVVEYIIGVASTHHCRIILNNAPARDVSAHALSLVDYLVVNETEAAFMSGADVSSIDDAHSCATGLHKRVKGQVIITLGEKGAVLSQEHGTRHFPAVFCPDVVDTTGAGDSFIGGIAYCIVNGFSLTDAIPFAAEISSCSIQKYGGQNSFPMLPDVSHALKNSSLLD

SEQ ID NO: 7291 - protein, 283 aa, Klebsiella pneumoniae
AKEQGMVISGNTRLIAHLGYPTASFKAPMIYNPWFVDQQVDVKVVPMGVRPEDYAAFIPPLFTMTNIIGALVTMPHKIATCDLVQRLSPTAAIAGACNAIRREADGSLSGDMFDGEGFVLGLRRKGFNPQGTRALVVGSGGVGSAIAASLAAAGVSALTLYDTRPEVAHALAGRLHQHYPQLDITLMQPDPAGHELVVNATPLGMKASDPLPLDVDRLAPGAWVGEVVMTQEYTPLLRAAQARQCHIQRGTDMLFEMIPAYLRFFDLPVATPEQLRTLAEIRY

SEQ ID NO: 7292 - protein, 351 aa, Klebsiella pneumoniae
QFIKDNLMTTPFRNTRIEFHILQSFPVTCLNRDDVGAPKSAIVGGVSRARVSSQCWKRQVRLALPDFGIRLGVRSKKTASLLANACRALGASEEQATGCGEAMAAFFSDDTLLFLSEAEAAAFAAYAQGKDFDAASLKDKELVKVAKKVVNNTLDALDIALFGRMVAKAADMNVEAAASFAHAISTHKVSNEVEFFTAVDDCKTEDESGSAHMGSLEFNSATYYRYVSLDLGQLAQTLGEDADMKTAVAAFVKALYVAVPSARQTTQSGACPWEYARVLLRKGQGLQASFEQPVKSQGEGFLSPSKAALKNWLHTKEKLSGSLFGKQGDYEWGEDLDYSIDRLIADLQSHL

SEQ ID NO: 7293 - protein, 188 aa, Klebsiella pneumoniae
KLTKAPCAPHHLFIEVTMLYVVECAYTDPQSEAAWNTFYNQEKLPALVSVPGFYASQRFRALSEGCPCYLALHDIHDATVIDSDAYRRNGGGHFARWQSAIADWHRHLYLTNNTLREVAPDEVLLLGDTAEDLPVAAPIHLQPGGLATEQSRYAAILPRDNLHHLATTAAVFIYQPITARLRNPAQRA

SEQ ID NO: 7294 - protein, 428 aa, Klebsiella pneumoniae
FHSKAQGDTQANHHQQNIDKGERRDDIDGPRRPQRHQHRADGFGTRRQQIDAGGILALKDQEHQQPGANQPIARQRNGHVAGDLPPRGAGATRRLLQLRAHLQQRRGDEPQAVGHPHHGVGQPDAEDGVAQGAQLHDKVLPQPVGHRQRREPAVLQRLIEPHRHKQEYPQECQPGQQPRYSARDQHAVVEKAGDVVRFAVHGDADKQIADHRQRAADDADSHRVDDRPQQVGLLPDIVERRQRQLIPQRHADAPVGDKSAQRHAEQRYADGHRQPGHHHRPGHPAPFAQRQRPRLGRLALHGDKAVGGAHQPPLEHHQRDGDADQHHRHRRHQMVGGGAELVSQLVEIGRQHHVALGVAQHQHQTENLQTEEKEQHAGVKNGWPHHRQTHRGHHLQRRGADGERRLFHVGADAAQRRRDIEIGMRNVS

SEQ ID NO: 7295 - protein, 422 aa, Klebsiella pneumoniae
LLCNSGRQFAEGSTTDLSVIGNKMFNPDQNRLAPTLAMIMAASLVGFITGYTVPLISLELAQQQIAPLYVGLLAALPPAGMMISSFLSPALCRRVEMGVLLSGSLILLALATIASCMTTDMTLLLLPRLLTGLASGVIIVLGESWITGGAAGSQRATLTGLYASAFTGCQLAGPLLISVGPAWQTSALIAIVAVTAVCLLMLRHLPTGTRESLGERASWRSLGAFLPVLASGVFCFAFFDASILALLPLYGMDKGLNEGLAVLLVTVVLTGDAMFQTPLGWLADRVGIRRVHLSCAVVFSLSLLALPLMLGSRIQLMAICLLLGAAAGALYTLSLVRAGKTFNGQKLIMINALFGFFWSAGSVAGPVVSGMLIGITGYDGLIVTLVASGVLFLLIQCLCKNEKTLLASEQEEEMDEATESAR

SEQ ID NO: 7296 - protein, 71 aa, Klebsiella pneumoniae
ASCKTQQRYLKVSGVVTYASAQRGNLAGMKVCFERRATCHCVRLNILSHEHNNPVEKSGSNIYISAIYSTL

SEQ ID NO: 7297 - protein, 232 aa, Klebsiella pneumoniae
SDRKSRFVHEKQIMTQPHVACRTLPGRALFSLLFLASPGLMAADNRAAKSTNDAEETITVVADGAQQSATSGYQPLSSATATLTSMPLPDIPQVVNTVSDRVLEDQHATSLDEALYNVANVVQTNTLGGTQDAFTRRGFGANRDGSIMTNGLRTVLPRSFNAATERVEVLKGPASTLYGILDPGGLINVITKQPERQFSRFGFRGPPPAFGRRHRQRRHHRPHRKAQIWRTD

SEQ ID NO: 7298 - protein, 238 aa, Klebsiella pneumoniae
SSGNSKNVLNSAPCAPEGTEMLTREQMAMRVAQELRDGDYVNLGIGIPTLVANYIPAGIEVMLQSENGLLGMGEFPDEETIDADMINAGKQTVTAQTGAAIFDSAQSFAMIRGGHVDLTVLGAFEVDIAGNIASWMIPGKMVKGMGGAMDLVAGAQNIIVVMTHASKNGESKLLPQCTLPLTGVGCIRRVLTDLALLEIVDGAFVLREVAPGVSPDEVIRKTAGRLIVADDVREMRFS

SEQ ID NO: 7299 - protein, 316 aa, Klebsiella pneumoniae
YYLNAIYAYINMQISHKDPMRIDDIDALLATVQFSSLNQAAEYLGITQSAITRRLQRLEQELNVTLLERQTRPLTLTAAGHRVYEQCLSIKRETKKLYSLLDPQGEPRGALRLGVPQSLSEIALPAALSALSQQFPGLSPQITCGWSGQLQRRLENGELDGMLAMGPAQQSFAEGYSGRLLCPLEVVPIVGRRLNLRASSLRECAERGWILNPDGCGLRAGLIRELQSQGLRLTLNVESAGAQLQIALVAQGLGLGLVPRAALASSPWRDEVAVLSLSDFQPAVSLWLIHAQYLANLQPPLAFFASKVMQQLTVSD

SEQ ID NO: 7300 - protein, 478 aa, Klebsiella pneumoniae
RTGKRMMTDEQRQHAVAAIQQALPALEWTLQPAKIKRLSRDFHWFSPLLTEQLAGKQADAVVRPRDEEELRQLVCACAQHQLPLTLRGSATGNYGQLVPLEGGLLVDMTGLNQIVALGNGTVRAQAGIRLADIETAARPTGWELRCMPSTYRLASLGGLYGGGFGGIGSINYGPLAAPGNVLSVKVMTVEPAPRVLTVPAPEALLLHHAYGTNGIILEVELALAPAHQWIERLDVFDDFADALNYANACVRSPGLVKRQVALLATPIADYFSHLNDRYRAGQHAVISLIAEESEGLCASLLPRHRGSNAIRQASEEARTRNGSLMEYCWNHTTLHALKVDNTLTYLQTAFDPLRYPQQILQMEQHFAGEVMSHIEFLRDIEGNLTASGLQLVRYTTPERLNAIMQIFRDNDVKINNPHVLQVEDGKQGVIRPDVVAVKQSLDPAGLLNPGKLRGWALRDQLELDGNPLARATRESPTT

SEQ ID NO: 7301 - protein, 99 aa, Klebsiella pneumoniae
WEGKVLVVLANDLPPAVRGRMKLWFVEPRPNVFVSGVKDSVAQTVVDYLLQYTPVESGLMLFRSIPQPPGYEIRYKGEVRKPIIDLSGLQLIIETLKLS

SEQ ID NO: 7302 - protein, 97 aa, Klebsiella pneumoniae
ILLKMILVCAVQASGVEEILYNICYLLIILIRKRKMSVPVYSMLGKNKERSLPTMSVESINELPRTYFINAPEFLTKTRTLRPYNVVPNDDHNGDGC

SEQ ID NO: 7303 - protein, 61 aa, Klebsiella pneumoniae
IFVNYVCPILSLGASQSFEFITRLEILFFILIIYSFLYYYFWLLSLIQCVVGIFDFIKSYL

SEQ ID NO: 7304 - protein, 102 aa, Klebsiella pneumoniae
NLSKQRVWSVIRIQQNLTKYVNISLVDYEYKTNITHPAFPCYQRGWDGIRCFRYRAGWLVLFFSVNEYKFLWGLLLVVEFLVGYLIYRFAYAYIYDEWNDYH

SEQ ID NO: 7305 - protein, 393 aa, Klebsiella pneumoniae
FSENKRLIMKKKFDASILPLMAAALLLPSVSNAADISRYDKAARPPIVLTDMGSLMFAGKTDTDEEGNTFHYDHGYAQYFIPQSSHSLPVVMWHGGGQSGKSWETTPDGRDGFWQMFTRAHWPVFIIDQPRRGRAGRTEPASAVSDIPTDHKESIAWNTFRLGKWLPPQKPVFFSDSQFPQNERAIEQFLRWQTPNTGPEPSPDIQERQFMAKSMTALLKQTGPAILMTHSLSGQYGWETAMESPKLVRSIIAFEPGAFAFPSNDLPKNVKTSLSFVGKATAPQVVSPERFRALTAIPVMVIIGDNVVRSESASFGEELWRVNEIRARQFVDTLNRHGGQATLFILPEHGIHGNTHFAFADKNNQQIADIVENFLHSRGLDSTHQYHFQQNLQ

SEQ ID NO: 7306 - protein, 300 aa, Klebsiella pneumoniae
SKENEIYFDLTAECPAIVWNAAAQERVMPQRVKPAEQGIVLDALSAGYGQTLIVDDINLTIPTGKMTVLAGANGSGKSTLLSTIARMLKPLGGCVRLDGQAIHQMPTKAVSRQLGILPQSPLTPEGLTVFELVSRGRYPWQGLMRQWSEADELAVEEALRLTGTAEFAHLPVDSLSGGQRQRCWIAMALAQQTATILLDEPTTWLDLRYQVDILELLQTLTREHGRTVVTVLHDLNFAVNYADLLVFLKQGRIAGTISDNDVCSPELIKRVFDVDVQMSINPQTGKPFFMPFRDRQAAAQ

SEQ ID NO: 7307 - protein, 508 aa, Klebsiella pneumoniae
TMENRFNLIDEPWIAVVDVGLVSLTDIFSQPELRALGGNPVEKIALTKLLLAIAQAAATPTDDSDWQQMGWQGMAHCCLQYLAKWHDRFYLYGEKPFLQMPAIQAAECKSLGVLSPEVSTGNTTVLTESQQQQQLTDADKALAIVMQMGFGLGGKTTDNSVVLTPGYRGKQNDKGKPGSGKAGVSVGHMGLLHSFWQGNSIVQSIWLNLFTAEDITQLAMYPTLGTAPWERMPTGEDDDIARSLKASLLGRLISMGKFCLLAEDGIHYSDGISHAGYLEGKTDPSVSVDFSGKKPKALWVNPGKRPWRELTSLLQFIEQDSPRGYETRQLSLPLKRITHHAEQFALWSGGLRVSSNAGEQYASGTDDYVQSEIWLSSDLINHTFLEYLKYEMTQLDAVQKQLWGAVVRYFRQLSDIDKSATGKAQPFVAKQAEKATTIFWQLCERQAQTLINACLNSGEDHTARLQLRKIFARYAGQVFDQLCPADSARQLDAWALARPNFSQYLTLD

SEQ ID NO: 7308 - protein, 405 aa, Klebsiella pneumoniae
RAAERAWRGLQVSSAMKVKQPQTLWRWLCLRILTLAIGTVLLIALCMWLRFTVQYLWTTHRMPEAVLNEFLTLREHPELNPARYHEIIDKWWGISFSSPSIASSDWLTVGVLVLVTIPFIAYFGLRHARPLSAQFSQLRIAADEVTDGHFGAQAELTPEAPAELVQFAQNFNAMTRQLARYEKELRASHVAMAHELRSPLTAAMVRLQALLDGVFTPEQRHLALIMGQLSCLSRLIDELHLLSIADAGQLSLEKVRCCPSDILRERLLWIKPQLDEAGINVVSDMPETSVLNVDPFRLGQVFTILMENALRYAGKGTTLFLSTRSINGNYEIIFQDTGPGVSQEFLDVMFERFVRGDTSRARHSGGSGLGLSIAQAICQAHGGTIEASLPSGGGLRMRIVLQATA

SEQ ID NO: 7309 - protein, 278 aa, Klebsiella pneumoniae
PAADGPAASESDSVSHHNKERKMKKVALVTGAGQGIGKAIALRLVKDGFAVAIADYNDATAKAVASEINQAGGRAMAVKVDVSDRDQVFAAVEQARKTLGGFDVIVNNAGVAPSTPIESITPEIVDKVYNINVKGVIWGIQAAVEAFKKEGHGGKIINACSQAGHVGNPELAVYSSSKFAVRGLTQTAARDLAPLGITVNGYCPGIVKTPMWAEIDRQVSEAAGKPLGYGTAEFAKRITLGRLSEPEDVAACVSYLASPDSDYMTGQSLLIDGGMVFN

SEQ ID NO: 7310 - protein, 268 aa, Klebsiella pneumoniae
PAAELAARRDAMVTETIARGAAVSISHLHHAFTLGKQTVPVLENISLQLRPGESVALLGPSGCGKSTLLRLLAGLEAPQSGQMQIDGAALGAPGPERILVFQDPTLYPWLTVRQNVLLGPQAQGKKGLEAKADALIDRIGLQAFSEAWPRQLSGGMAQRAALARALLNEPRLLLLDEPLGKLDSLTRISMQRELIALWQQQGYTSLLVTHDIEEALLLCERVLVMSPRPGRIIAEFALPLAFPRHRDNPQLLQHRQDILRILGQEADW

SEQ ID NO: 7311 - protein, 621 aa, Klebsiella pneumoniae
PEDLMLRSIATVSISGTLPEKLHAIAAAGYQGVEIFENDLLYYTGTPAEIRQLAADLGLKITLFQPFRDFEGASRAQFAANMARARRKFALMRELGCETLLLCSNVQPDCSADSELQVADLRALATLAEEEGIAIGYEALAWGTHVNRWQQAWERVRRVDSPALGLVLDSFHILARGDTLDALPSVPVEKITFVQLADAPYMKMDLLEWSRHFRCFPGQGELPLEAFAEQITRCGYRGPWSLEIFNDGFRASPNGATAKDGYRSLLWLEEQTRRRLPTCDADLFSPPPLPVYHGLEFIEFAASAAEAQRLGQHLQALGFQHEGSHRSRQVTLWRNGGARIVINHQPHSWADHFYQRHGVSLCAMALRVEHSASLVARARALGYATWQGDAGPNETPIPAICAPDGSLIYLIDAGEAIYERDFHLRDGVTVREDYLGIDHLALGMEADSRDNWVMFFRTVFGFSLEHEQTLPDPYGLVRSLAVRSPQGDIRLALNISQSRATQIARSVACYQGAGLQHAAFACRDLPAACDQLAEVARHTLPIPANYYDDLLARFGGELDVGQLQRQQLLYDRDPQGGDFLHLYTRPFTAGRFFFELTERRAGYALYGAANAAVRLAAMQYC

SEQ ID NO: 7312 - protein, 70 aa, Klebsiella pneumoniae
PGGDGLIDKDGGSRGQVMQVVSWEDGGIPALFGRQAAWLQVYRRSDGQVLRGIAQQQHFIRGNLPQRIIR

SEQ ID NO: 7313 - protein, 294 aa, Klebsiella pneumoniae
DVFDMELRYLRYFVAVARTRHFTQAAKELGISQPPLSQQIQRLEREVGTPLFRRLTRGVELTEAGESFYEDARQILAMSDAALEKAKGIARGMNGSLSLGITSSDAFHPQIFTLLHRFQLDHPGVTLHQMEDNMANLMTALSEAELDIAFVRLPCESSKAFNLRIIDEEPMVIALPRDNPLATQPTLALEQLRDVAPILFPREVAPGLYELVYNSCLRAGIDMERAWQSSQISSSLSMVNAGFGFALVPQSMTCIQQPNVSYHPLSGAPLKTDIAIAWRRFERSRTVKRFLAMF

SEQ ID NO: 7314 - protein, 362 aa, Klebsiella pneumoniae
RRNDRFTHFLARRTVHREGELSLRRPWPPCRQRSEGEKTVMHSHDLISVSVGEIRPNGQGNLSIILQAAAGEILPAYSAGAHIDIIIPGVGPRQYSLCGTPDRSNTYEICVRLTDTSTGGSRYLHQQLKAGDRLAISPPRNHFPLPQAGRYLLFAGGIGITPLLAMAEAIAARKGAQELHYYVASSRQTAFSPRLNQLTANGTVAIHCSEEGASFRQRVPECLTVPHPDTVVIACGPEGFIQRLRSVMEEYRWSPSQFVFERFTPAAENNTAAKNAFYIELASSGQRLQVAADQTIAQVLQHAGVEVMLSCEQGMCGSCITGVLDGIPEHRDSVLTAEEKADNDQITLCCSRAKSPLLVLDL

SEQ ID NO: 7315 - protein, 62 aa, Klebsiella pneumoniae
DADDILGGMQLYQQVERLMLQNHNAGDVVGEGDLATQLVGDGAVGEGLAGEQAGAEQRQAQQ

SEQ ID NO: 7316 - protein, 98 aa, Klebsiella pneumoniae
SRPDPAAGPAGDCAAVRRGGGGGRADRLRRAGGAAHGAPSGDGRHPPGAAPGRAGGSAGAGAGGYRRPDAGRAAGAGHRSDDRPGGRAVVYLYRREVF

SEQ ID NO: 7317 - protein, 242 aa, Klebsiella pneumoniae
WTVEMRQTTQYMLLWLEGPLQSWGGDSKFGVRDTLNFPTRSGILGLICCARGAAGPEVEWLAEMNNLPMEVRAYARTDKEGQPLLREPTLCDFQMVGSGYDDSDPWQSLLIPKTSDGKKAVGGGTKMTYRHYLQDAVFAVVMGLGSQQAESLPEALQNPVWDLYLGRKSCVPCELIYQGIYDSAEAAWQQARTLAESKRRTLSYRVIEGEGDGDVITLNDVPVQFGRHKRYRDRQVTVLECG

SEQ ID NO: 7318 - protein, 262 aa, Klebsiella pneumoniae
SFKDCVMLDYAAFPQQRQALICQILQENGRVVCAELAARLQVSEHTIRRDLHELSREGFCKKVYGGAVLSLPEAGDYSQRKDKNRAIKLRIAQQCARLVKPGGTIFIDTGTTNLAMAEALPAELALTVVTNSPEIAAVLVKKPLYDVVILGGQVQRASGGCVGAAAVAQVQGMLFDQGFIGGCAMAPESGLTGFDYADCEFKKAVIKQCSEIIVGLTSDKIPAAARFVVAASSDIDVLVVEENISREYRVAFQQHDIRIYTV

SEQ ID NO: 7319 - protein, 98 aa, Klebsiella pneumoniae
SDEEQADKRCNQFGKATAEAVTLPDGCSPGGRNIDSLLNQQLLTHMAAGPKPQHLTRSGMRKRGTPQEECPLFLQGVLPDYYYPLELKHPEQYTRPDI

SEQ ID NO: 7320 - protein, 269 aa, Klebsiella pneumoniae
QEWESLFKQLRRKRAPPTPASPRLTHTFLTCFPEPVCYSVCSNRPHVTDRLPAADITGVAMFLSSLMAIAAVLIMGVISPGPSFIFVARNAVARSRLHGMVTALGTGAGAAIFSIMAMLGLQKVLTAVPELFIGLKVAGGLYLLWLGYKIFRGSAQPMDFSASGMAGNRSLLKTFRDGLYTQLSNPKTALVFASIFTALLPAQIPTAFYYIVPLMSFLIDVSWYSLVALVLSADHPRRVYLRLKRRIDIATATVLGALGLRLIATSLTR

SEQ ID NO: 7321 - protein, 363 aa, Klebsiella pneumoniae
MVLLEMKFLCLSGIILFICSNIFPLLFTEMKFNLIKTPGIQNKVTAMKFSSRINSFRSRPELFDAKNKMDTCDLITRMGSAEGLTHIELNYPEHFIGQDKELIKKCIADNGLQVGGIALRYNKDFIDGEFTNPNPALRSKAIETTLEAAEMCKFLEGNTVTLWFGYDGYDYPFQQDYFRAYELLVDALRIVTQAHGDMQFSFEYKPYEPRTFSFIGDVSSTLMLIDDVGSDNLGITLDFCHMIMKKENPAFSLFQSARKNRLVGFHLNDGYGHFDDGLMLGSVHLLQTLEYIYYAKRVGFSGLIYFDTFPSREDPVAECAQNIRMYKALSDFIDRLSIPEIEQMIQSQDALKVQGMLLKMIAE

SEQ ID NO: 7322 - protein, 75 aa, Klebsiella pneumoniae
YKSLFFGAWVSSARCECRWFTASRLWQHSSHDDRPVNFSPISRVSLRIVYYPNDNPINDIASGDVLSDLPGRARR

SEQ ID NO: 7323 - protein, 299 aa, Klebsiella pneumoniae
GGGFRLQSKHHRMCTRCTTLFLKHFKGVFMRDDGSAAYKTVRGLSRGLLLLKLLNKFDGGATPGLLAEFSGLHRTTVRRLLETLQEEGFVRRSRSDDSFRLTINVRQLSDGFRDEHWISALATPLLGELLREVQWPTDITTLDVDAMVVRETTHRFSRLSFHRAMVGRRLPLLLTASGLTWLAFAPDAERDAIVSMLAARPEAEYQLAREPERLAAILARTRQNGYGENFRGWRQEEKIASIAVPVCSQQRVIGCLNLVYIASAMTIEQAAQKHLPALQRVARQIEARMEDEEVWYEMP

SEQ ID NO: 7324 - protein, 369 aa, Klebsiella pneumoniae
LAPCWCWRPIPLAGWRLPRCRSRRGLSLPWWAARSSLSCSGVAVMPFNQEGSMRWFVSLLLLLTGAVSAAAPQTQTFTDDLGRTVTVPLHPQRIVSMHDLDITIPLIELGAPPIASHGRTRPDGSHYLRSSAQLTGVDFDNSDIRFIGTADIDLEAVAAARPDLIITEPSRHVSVEQLEKIAPTVSIDHLQGSAPEIYRKLAQLTGTQPRLAILERRYQEQIKQLKAMVNPPQYSVSVIQANNGKVTVHHSYHALGRVLRDAGFRFPPLIERIPDGQRIDVSAEQLPELDADFVFATWRSDTGGKPQDELQAMEGVMPGWCDFMRACRTGHYILLPREEVISNSYAALSLMVAQVQSHIAGRPIPAEAK

SEQ ID NO: 7325 - protein, 309 aa, Klebsiella pneumoniae
QCFWLINGNYIGREFISSFWTDRTMLMKFTTLNNGVQMPILGFGVYQMQDLKECQEAVLGALQTGYRLIDTAAAYENETAVGAAIQQSGIARDELFITTKLWVQDAGYEKARSAFLRALDRLKLDYLDLYLIHQPYSDVHGAWRAMEELYDEGLIKAIGVSNFAPDRLTDLATFNRITPAVNQIEMHPFLQQGQNVEFMQSMNVQAQSWASFAEGKNNLFSNPLLASIAQVYNKSVAQVVLRWLIQRNVIVIPKSVNLPRIRENFNVFDFSISDADMEKISQLDTGETLFTAHTDPERIKTVGTKIFNT

SEQ ID NO: 7326 - protein, 211 aa, Klebsiella pneumoniae
FSVCAKTRKPCLPVSRKRRWTRRRSPHGSPHGLAWRQPFFMALTGGYPVLAGSLLLTIAGPQPKGNPMESNTLHRGRLIDHILLVVEDFEASKNFYTAVLSALEIPVITTANEYLLADELVVASRRSPEAAGKLTGRHHLAFQARDRDMVDAFYHAALTHGGRDNGAPGERHYHPGYYAAFVLDPQENNIEAVYHGKAERSAGSVAISFTQ

SEQ ID NO: 7327 - protein, 179 aa, Klebsiella pneumoniae
SPSCWRSWLTVWKRGLAKVIHINNLHKRYGDSHVLRGISCDIKPQEVVCIIGPSGSGKSTFLRCMNALETVSEGEVVVNGFAAHDRTTDLNKMRESVGMVFQRFNLFPHMTVLENLIMAPMNLRNMPRQQAIDLAEALLAKVGLSDKRDAWPSSLSGGQQQRVAIAPRAGDEAVDYAVR

SEQ ID NO: 7328 - protein, 570 aa, Klebsiella pneumoniae
QIACQPGSFRVVRSLRMTTSTPDIQPAVQHTAQVAIVGAGPVGLMMANYLGQMGISVLVVEKLATLIDYPRAIGIDDESLRAMQAVGLVNDVLPHTTPWHAMRFLTPKGRCFADIQPMTDEFGWSRRNAFIQPQVDAVMYHGLQRFPQVRCLFSREVEAFSQTGDSVTLNLKGPDGEQETVRADWLVACDGGASFIRRTLNIPFEGKTAPNQWIVIDIANDPLATPHVYLCCDPVRPYVSAALPHGVRRFEFMVMPGETEAQLSEPHNMRRLLSKVLPDPDRVELIRQRVYTHNARLAERFRIDRVLLAGDAAHIMPVWQGQGYNSGMRDAFNLAWKLALVVNGKAGEALLDSYQQERRDHAKAMIDLSVTAGYVLAPPKRWQGAVRDGLSWLLNYLPPVKRYFLEMRFKPMPQYREGALLTDCAGKTSPVGKMFIQPQVTLESGESVLLDDVIGANFAIIGWGCNPQWGLDAGQIARWRAIGVRFIQVVPEVQIHREQDNAPGTLRVGDRQNRLKSWFAQHNTAIAVVRPDRFVAALAIPQTLGAQLTALAEKMTLATGDTAHAEEKVA

SEQ ID NO: 7329 - protein, 94 aa, Klebsiella pneumoniae
TRCWYPAAHRAPAAPGSAAGCRAGAASRRAAPRSAPAAARRMVPAARQFWRSALPRQQTAPAAAPATCWHAAHARRAPASSDSSAPAAASRRRG

SEQ ID NO: 7330 - protein, 531 aa, Klebsiella pneumoniae
QVRLFSFSFPYCDDLQNLTQMQLAHQQRVIAIIHRDGHYRRAVDVHRRAQGRLQRLGAFHGKPFRAEGFGIGFKIHRPKLDAGQALIFFLFLDSDHVVAVIDPDKMQHVGFQADGGLQLHARLQEAAVAGDGDHFALRIDQPGADGPGQGDAHGLLAVGDHHLAGAEAVQVAGNPDMEAAHVHGQRDVAVDDVLHGANDTQGMQGKLVELRAAAVQQLALVLAVAEDLRRLRGEHQPMIDILRQLVESAGDIAHQLDIRGVVALFIGGQHVDVHQRRVAAVPHRRFVFHRAVADADHQVGELQQTVPGLVVKQPNPAGEAREVILIHRSGGLIGAGDWNMAGLQQMAQRLAVFRLAGHQAEQEDRVLRLGDKFRHLVDGIIRRGAHLRGPAGRQHFAADRAIDHILRQANERAARPALLGGAEGVGDHFRQRIRRRHLDGVFGDRAEHRHRIHTLVDLLRFIGAFYRAAQGHHRVAFAVRGGHAGDQVGTARTGGDQRHARFAGNASDGGGHKCGVGFMAYRNNANGGIQQ

SEQ ID NO: 7331 - protein, 397 aa, Klebsiella pneumoniae
KPAWRMKKCGTKCPDRDEGNRDQPLRPASLYNLIHNEFSRHSGHTMSKHPLLLGLTLLSASLFTGQAFADRTVTDQLGRQVTLPDHVTRVVVLQHQTLNLLVQLHAAEDIVGVLSSWQKQLGPQFARFMPEIGQLATPGDLTQVNIESLLALRPQVVFVANYAPPAMIAQIQQAGIPVVAISLRHDAAGEKNKMNPTMADEEQAYNAGLMEGIRLIGEVVERQPEAEALIHYTFEARKQANAPVADIPPNQRVRVYMANPDLNTYGAGKYTGLMMAHAGALNVAAASVKGARQVSLEQVLEWNPQVIFVQDRYPQVVKQIENDPQWQAIDAVKHHRVWLMPEYAKAWGYPMPEALALGELWMAKKLYPARYQSIDVDSKASDYYQRFYRVTWTPDAR

SEQ ID NO: 7332 - protein, 247 aa, Klebsiella pneumoniae
ASMWKALHQLAIPERLYRLCGCWIPWLAALSALLLVIGLGWGFGFAPADYQQGESYRIMYLHVPTAMWSMGLYLAMAVAAFVGVVWQIKMADLAIAALAPVGAVCTLVALVSGAAWGKPMWGTWWIWDARLTSELVLLFLYAGVIALWHAFDDRRLAGRAAGILVLVGVVNLPIIHYSVYWWNTLHQGSTNLQQTIDPSMRLPLRICIFAFLTLSVTLTLMRLRNLILQLERRRPWVVALVNKGAAR

SEQ ID NO: 7333 - protein, 94 aa, Klebsiella pneumoniae
PKPWPLETARSGITCNAICPGWVLTPLVQQQIDKRITEGVDPEQASAQLLAEKQPSGEFVTPQQLGEMALFLCSDAAAQVRGAAWNMDGGWVAQ

SEQ ID NO: 7334 - protein, 264 aa, Klebsiella pneumoniae
TRKWYMNHSAECTCEESLCETLRAFSAQHPESVLYQTSLMSALLSGVYEGSTTIADLLKHGDFGLGTFNELDGELIAFSSQVYQLRADGSARKAQPEQKTPFAVMTWFQPQYRKTFDHPVSRQQLHEVIDQQIPSDNLFCALRIDGHFRHAHTRTVPRQTPPYRAMTDVLDDQPVFRFNQREGVLVGFRTPQHMQGINVAGYHEHFITDDRKGGGHLLDYQLDHGVLTFGEIHKLMIDLPADSAFLQANLHPDNLDAAIRSVES

SEQ ID NO: 7335 - protein, 170 aa, Klebsiella pneumoniae
TAGCKDAGNLPPADRGHRGAAGAEAARRPALRQSAPANRHNNWPGSAAYGGQPRQAGRRRPADRGRQRRHAAAPPPGSRQRSGRSASPGSAKYSAPDGYRPAGCAPPGCAPVHTGPAASAHAQGKNQTPYGRTSPSYRGCRPPFPAPDDRYRDNPRAPSRHHADENRARR

SEQ ID NO: 7336 - protein, 107 aa, Klebsiella pneumoniae
ASGCQAARSAPAHRRHADSSPAAAPPAARRSAAAGRSSSSGQPPSPAPPPPAASAGASVAPGNRPASRRETTDPSPAAPPAARRPTPRPAQSAPAAAARRLRRTETG

SEQ ID NO: 7337 - protein, 74 aa, Klebsiella pneumoniae
WILRQIAVLSCIIINRLAVVTVEITTKKGPQGSRWAVRRAAAAFRDVVSVVTTGYNGGSGSAPTPVSDGEKRDA

SEQ ID NO: 7338 - protein, 372 aa, Klebsiella pneumoniae
QPDRFPAPPLAVDAAGHRHLYHRDRHQRAGRWPARRHGSQYETEAEMTTPLVSFNHLSVSFAGERSRVRAVQEVSFTIQAGQTVGVVGESGCGKSVTAMALMGLLPPQTARIDGGEIRFADRDLLRLKARQMADLRGHELAMIFQEPMSALNPVLTIGEQLCEPPIRHLGATPKAAWHQAIQLLSEVGLARGDSLMTRYPHQLSGGMLQRVMIAMALSCRPKLLIADEPTTALDVTVQAQILRLLRDRARASQMAMMLITHDLGVIAQMAEQVVVMYAGRIVEQGATAEVLRHPQHPYTRGLIASRPVPGERRRRLYSIPGQVPDLAALPAGCAFAGRCERATPRCREAIPPLLGERQRAACFYSEFAEATA

SEQ ID NO: 7339 - protein, 114 aa, Klebsiella pneumoniae
AGDRDGARGAGGDGHRFRAIAQPQPAVYPAGGGPLRGDRSPTIPAGEEKAAHLAGAVEPRLYYPAAPLGGTPDAGGGAGAQRTSAGRGAGESSAGDGGEDGGQRPGGQRGAGAV

SEQ ID NO: 7340 - protein, 253 aa, Klebsiella pneumoniae
PPPRAVYIASNRVYSLNILIHSNNIYFNIGIAQCFRDIQKTAPELKVIHSLPLSHLPELSGLDVIILSLENYHDYLAAAEIAQHFQGLVIGFTSAGNVRRGRAFFADTLLWVSQREAVREVSRLLRCLAERRWPLVPRHQRQSVSFRQRAPLNRLEMRMIDATMKGQSVHQMAATLGINRKRVYNGLERIKVNFRLVSHSHFHHFMTDRLSFSRLSADLRCLTTAANATLPPRAASRLAENHSYYLKEFRKLF

SEQ ID NO: 7341 - protein, 405 aa, Klebsiella pneumoniae
GYPRGQAGQPARRRLFFRPENRGVPRSGRGGALSASVRGQPRYYDLGGAGDGGANGRGNAQRGGSDSMNGKKLYISDVTLRDGMHAIRHQYSLAQVQQIAGALDKAGVDSIEVAHGDGLQGSSFNYGFGAHSDIAWIEAAAAAVSQAKIATLLLPGIGTLHDLKAAYQAGARVVRVATHCSEADVAAQHIAFARELGMDTVGFLMMSHMISPQALAQQALKMESYGATCIYVVDSGGAMNMNDIRDRFRALKAVLKPETATGMHAHHNLSLGVANSIVAVEEGCDRIDASLAGMGAGAGNAPLEVFIAAADKLGWQHGTDLYALMNAADELVRPLQDRPVRVDRETLALGYAGVYSSFLRHSEAAAKRYGLSAVDILVELGKRRMVGGQEDMIVDVALDLLNRNK

SEQ ID NO: 7342 - protein, 95 aa, Klebsiella pneumoniae
PSPRALAMKPSIMLFDEPTSALDPELVGDVMEVMKNLASEGMTMVIVTHEMGFAREVADRVIFIDQGVIQEEGKPGQIFSAPTNPRTAAFLSKVL

SEQ ID NO: 7343 - protein, 274 aa, Klebsiella pneumoniae
AVHRPRRHGDGNPDPSPGAARPAGGMRHPHHPPAAAAAGLSVAHPAPRRRRWRRAMMRALLARELRLAWRSGAEILNPLWFFLIVITLFPFGVGAAPQLLAQIAPGVVWVAALLAALLVMDRLFRDDWQDGSLEQLMLLPTPLVAVVLVKVVAHWMMSGLPLLIVSPLAALLLGMSLHDAGVLALTLLLGTPTLSFLGAVGVGLTVGLKRGGVLLSLLVLPLAVPLLIFATAACQAAAAGLPVGGYLAMLAAFLTASATLCPFATAAALRLTVR

SEQ ID NO: 7344 - protein, 112 aa, Klebsiella pneumoniae
PANRQTLLYAVSRPPGSGTMSVAILLSARRRPRPRLALLLLTLLLIAASLVHLGLGARWIAPQTVLRALLEYDPRNFEQRIIVDLRLVRLAAGAADRRGARRRRAAAADGDP

SEQ ID NO: 7345 - protein, 98 aa, Klebsiella pneumoniae
SACRQALQRAGWTLDEVDLIEANEAFAVQALAVGQLLEWDSEKVNVNGGAIALGHPIGASGCRIIVSLVHEMQRRGASKGLATLCVGGGQGIAMTLQR

SEQ ID NO: 7346 - protein, 484 aa, Klebsiella pneumoniae
MVRRRSPLAAGRRDDQYRQRRERLAVCAAGGCPPGAAGAGAGDAAGGQPDALCARQYARRGENGFYPYRPRQGVAGAHGDPQTCPAQRPAADYHPAGLRAAGAVLRGDHYRKGIQLAGGGPHSYRLAGRPRLSGTDGVYPVSGGADDRRESARRRAVRLGRSAYSGEVIMILSYLASRRRQRQAAIPALAHITPSPWRQGWRQLRRNRLAMFCLLLLAVMAVWCVLGPVWSPWSDDATDALSINQPPGAEHWLGTDFLGRDVYTRLLLAGRISLIIGLLTMVMSVCLGYLLGALSGYVGGLTDKLIMRVADLVMTIPGLPLLIVAGAMLSELDFSPDSRIYMVVVMLSLLEWPRLARLVRGQCLSLRERDFMLATQVLGLSARRRLFGHLLPNTIPILVVMATMAVANAILSESALSYLGLGVVPPTPSWGNMMDAANSLIDFQRRPWLWMPPGIAIFITVIAINVLGDGLRDAMDPNMKPRLK

SEQ ID NO: 7347 - protein, 353 aa, Klebsiella pneumoniae
RARRRGDAMTRTPFSRRRFLQLSGGLALAGVSLPLWAHDMADMAGGDAHPALRLPEPYKIKLAINKSAVCLAPVAVAEQQKIFSKYNLDVEFVNFGNSTDVLLEAIATGKADAGVGMALRWLKALEQGFDVKLTAGTHGGCLNLLTAKDSPFGGLESLKGQTIGVTDMAGPDKNFFAILLKRHGIDPISDVQWKVYPADLLSVALDKREIAAISGSEPFSYRLLETGKYQLIASNMTGDYANLSCCVLGVSGSLARDHKPAAAALTQAILEAHSYAAEHPESVAQSFLAHALNTSEAEVSGILHGQGHGHHAVGEAFVKELTQYAVDLQRVQVIKPGTDPHQFAESIYANVFA

SEQ ID NO: 7348 - protein, 326 aa, Klebsiella pneumoniae
LLRRAVPDGGPGAVAYCRQADPGGGQMKSAVKKEKGKVDLFGERYRARAHQLSPRLRAVVSYINDNREVVLEHTAMEIATATQTSDATVVRAIQALGFAGLRELKQTMERWFGTSVTSAEKMRSTVTALSSDVNSSIDFVLEGHQRVCEVLSRADNRAAVAQAVALLSDARQVGIFGIGASGILAEYTARLFSRIGLPAYVMNRTGFSLAEQLIGLQRGDVLIMMGQKSPHREGLTTLREAKRLGIPTILLTQAVDSRFSQEAQVVIDVPRGGDSSRMPLHGTVLVCLEMIVLSVASTTPQKTVKSLKRINDLHRAIGKSGGKRGH

SEQ ID NO: 7349 - protein, 72 aa, Klebsiella pneumoniae
WSGRDSGAGHYPIQSVLMSKMHFYHILICLISIKQKCIVLSVGYGQLLHHFAGKKGQRRLQVRQILGVDQPQ

SEQ ID NO: 7350 - protein, 76 aa, Klebsiella pneumoniae
LPLRGDTLILNLWNYPGNGSLLFRSVFMVIATRKPLCNKRWSASPASQDLQLTQLRHPWVATKASCKSKKGWKSRG

SEQ ID NO: 7351 - protein, 359 aa, Klebsiella pneumoniae
RIIRCGRLPRMKCCCWAIPRRTCPSLRRYTCSQAAWRPNKAGMPPSSHETTCITWPRLPPSLSISPSPPGYATRRSAREVAMSPAPFYTLTAGDLTVTAVSDGLMSAPLSLLSGISREEAEHLQRQSGLASPETIAIGAYLIRGRGNTVLVDTGTGGANGVGGELIANLARLGVGPEEIDAILLTHAHPDHIGGLLSAAGTPAYPNATVFLPTRESAYWLATSTFDNASDRGRRNVLLVRRVLANCAAQISGVDDEEVIAGIRPCPLPGHTPGHTGYRLEAGDTSLLIWGDIVHFPSIQSARPEASVAFDVDPEQARRTREILLRQAASERWLIAGMHLGLPGFARVENTASGYCLRSV

SEQ ID NO: 7352 - protein, 71 aa, Klebsiella pneumoniae
IKSLAPEGKHSYRETFVIIMGKIGEHSPVSAFDFSAVIISPASDGRKSDYQMIRFSSIDASAMGMNYLSRK

SEQ ID NO: 7353 - protein, 145 aa, Klebsiella pneumoniae
ARGRGQARRRPGIFLPDRRMHIRPWPRAAGDASARTPPRRPAQCPAPRPPSPRRCRCRGPASCRPAAGRSSPQDAPPPRRCPPRWRGWPRDKKAAPERKAHFVRRWRTARRQTPPAACQSATTRCPAPTATPECRCRSGATSAAG

SEQ ID NO: 7354 - protein, 90 aa, Klebsiella pneumoniae
TTARPPGRSSLRWPAPAARPASGRRYPPAPAPALPPARPGAAPGGCLPSPDGAPCAAPPARRSRSARPPPPPRRTAAQSPAGPAAGSGRD

SEQ ID NO: 7355 - protein, 99 aa, Klebsiella pneumoniae
DLHSYVAFVHRAFYVEMSCIFPSVGQKRGCDHSPHRRGRNVYTLLLANLLVLKYIESLQDLIGVLNHVTGKVETYEFPILHFIRIIRRYCFKQFPSLSQ

SEQ ID NO: 7356 - protein, 93 aa, Klebsiella pneumoniae
GCRSTSAVAPCSTIRPAYITTTCSAICAITPRSWVISIIAIWLARARSRSRRRICACTVTSSAVVGSSAISSLGRQLSAMAIITRCSMPPESW

SEQ ID NO: 7357 - protein, 417 aa, Klebsiella pneumoniae
QSISRQSPAPFVRLSLRYPMTKITTATPSRLVVTIGLCFMVALMEGLDLQAAGIAAVGMAQAFALDKMQMGWIFSAGILGLLPGALVGGMLADRHGRKRILLGSVLLFGLFSLATALAWSFPTLLLARLLTGVGLGAALPNLIALTSEAAGSRFRGRAVSLMYCGVPIGAALAAALGFSGLAAAWQIIFWIGGVVPLLLIPLLMRWLPESQAFQRAEASVPLRTLFAPGQAAATLLLWLGYFFTLLVVYMLINWLPMLLVGQGFRASQAAGVMFSLQIGAACGTLLLGALMDKLTPLRMSLLIYSGILASLLALGSASSLTGMLLAGFVAGLFATGGQSVLYALAPLFYPAAIRATGVGTAVAVGRLGAMSGPLLAGKMLALGTGTVGVMAASAPGIVLAGVAVFWLMHRQQRAAMV

SEQ ID NO: 7358 - protein, 211 aa, Klebsiella pneumoniae
RAYREKAGLTRNASLRGNGSRMGISSTTRPGRAAIMITRWERNTASWIEWVTNTTVRFCSCQRRNRSLSSLLRVISSSAPKGSSISSSFGRVTRPRAMETRICMPPESSRGRTSANLPRPTSSRTSLTRVFPSARGTPARSSGSLTLLRTLLHGIRVASWKTNDSGCWAFSRLSRRHSISLPSLGSTRPATIFSRVLLPQPDGPSRVINSP

SEQ ID NO: 7359 - protein, 308 aa, Klebsiella pneumoniae
SMDSLTSLTSFVRTAETLSFVQAARLLGISASAVGKNVARLEHKLGVRLFNRSTRNVSLTAEGAAFLTRCQSILELIQEAESELTSSLSQPTGKLRISLPVIGYRLLLPALTAFSRLYPQVELDLDFSDRLVNLIDEGVDVAIRSGELADSRLIARTLGGFRFVLCASPAYLAEYGAPGSPAELAAHKCIFFRFPATGLIQPWELRGMRLTGDFRAAAVMTVNNIEAAIRLSAAGMGIAYVPDFVVREAMDEGQLQEVLPGCCVKDGHFSVLWPASRYLSPRIRCFIDFIAAAEIPLSPASATPAPCV

SEQ ID NO: 7360 - protein, 112 aa, Klebsiella pneumoniae
PRRLWPARRAHSRAAEPGIAVDAQRRERGRAAADSAGGAGAGAGSGAEGGAGQQPVAGRGRGPQPQRFSACGLTVADPRPVSGEPAAAAGLFCQQSDAAADRIRLKALCIFV

SEQ ID NO: 7361 - protein, 583 aa, Klebsiella pneumoniae
PTGSDRGSALRSLRSDVGSGFQSRFHVAVGRPGIALRPLLVGNRFHFHRTVFGFRRFGDRIEVILGQLIAGAHPPLIGHIDRPRIDAIAEVGAGDHLPAPGADPHQLFVGDPQSLRIRGIHLHPSRLVGQRLQRGAVAGHRAAGIMPDFPHGAEHQRPLVIRALRRRAPGGGEQLPFTRGGVEAVVFIQPRRAGMIEGRARPLDMAHIAHFLPGHAVEQRAELAHLVPDLLVVLIVHRIAQFAGQQANDLPVALHISRRRDRLFKPLEPAVGAGEDAAVLAPGGGRQQDIGHFRCFGHEDVLHDHEVQRLDAFAHQAEVGFGLQRIFAHDVIGFDLAGQRFMRHLGDAGADLVVHQRRVDAPGGGEFRPHVRVGDLLIAGEQVRQHAHIAGALYVVLPADRPHADVGPSQVAGEQRQACQAAHHVHRLAKLGDPHAPHNGGGWGGGEHAHRLPDFPRADPDNPFHRFRGVILHRLAVSIQPFGIAFDIGFVVQLLLQQHIAEGIYQRHVAAVVELQMTIGNARGFNAPRIADDDFGAVVPGLDYPAGDDGMGVGAVVAKNQQALRVFDVANRVAHRPVAQRLL

SEQ ID NO: 7362 - protein, 131 aa, Klebsiella pneumoniae
QRGSNNPRCANKNFTPSVGNVPSFFIHRKDGQPIIMAAIGSTPLERVDEAEGILIVTAAADKGLVDIHDRRPLVLVPDAAREWMKQDVSGKEAEEIATDGAVSADHFIWHPVTRAVGNVKNQGPELIEPVG

SEQ ID NO: 7363 - protein, 65 aa, Klebsiella pneumoniae
NVARCYAFYHAVQCAETIQERIEAHYTLPKSKRKIKTSFQIMDKTRNKTGTLCKNLRNTLFRHRL

SEQ ID NO: 7364 - protein, 218 aa, Klebsiella pneumoniae
LQRRDTAMQHIIEGFLNFQKEIFPQRKELFRSLASSQNPKALFISCSDSRLVPELVTQQEPGQLFVIRNAGNIVPSFGPEPGGVSATIEYAVVALGVTDIVICGHSNCGAMKAIATCQCLEPMPAVSHWLRYADAAKAVVEKKTWASETDKVNGMVQENVIAQLNNIKTHPSVAVGLRDHTLRLHGWFYDIETGDIQALDKNTKSFVSLSENPDVFFE

SEQ ID NO: 7365 - protein, 346 aa, Klebsiella pneumoniae
RLTRGTALSPISKVLAQSRHASSPPEKEIVMRKRKVAIIGSGNIGTDLMIKILRHGQHLEMAVMVGIDPQSDGLARARRLGVATTHEGVGGLMQMAEFADIDFVFDATSAGAHIKNDAALREAKPGIRVIDLTPAAIGPYCVPVVNLADNLHQGNVNMVTCGGQATIPMVAAVSRVAKAHYAEIVASIASQSAGPGTRANIDEFTETTSQAIEKVGGAGKGKAIIVLNPAEPPLMMRDTVYILSELASQEAIAASIAEMAAAVQAYVPGYRLKQQVQFEVIPEDRPVNLPGVGCFSGLKTAVYLEVEGAAHYLPAYAGNLDIMTSAALATAEQMAGAMHSAAGATA

SEQ ID NO: 7366 - protein, 233 aa, Klebsiella pneumoniae
VMQSKNILIIEDDADAAEVLEAYLRRESYTVRVMADGLSGLEQAQRWQPDLIVLDVMLPGLNGTEVLAKIRRSSDVPVIMVTAIGDTPDRIGALRYGADDYVVKPYHPGEVVARVQAVLRRSGGSRDPQEEVLRWQGMEVNTGAMTVTVADSKGRVTSVDVTPTEFNLLVTMMRAPVRALSRQFLLEQCLPDSDALERVVDTHIYNLRKKLESAGQSDVLLNVRGVGYRFRQP

SEQ ID NO: 7367 - protein, 478 aa, Klebsiella pneumoniae
TLRSDAMSLMIKNAHAILSGLPGEAARLAGPDIRIRDGKIAAIGSLTPLPEERQIDARDCVIYPAWVNTHHHLFQSLLKGEPQGLNQSLTAWLSATPYRFRAAFDEHTFRLAVRIGLVELLRSGCASVADHNYLYWPDMPFDTSEIVFSEGEALGMRIVLCRGGATQGRAVEQDLPVALRPETFDGYMADVERLVSRYHDPRPESLRRVVMAPTTVLHSAPGAQLREMAKLARQLGIRLHSHLSETVDYLDAARQKFAMTPVQFCAEHDWLGNDVWFAHLVKLLPEEIALLGRTGTGIAHCPQSNGRLGSGIADLLALEQAGVPVSLGVDGAASNEAADMQSEAHAAWLLQRARKGMLAQPRYAGGTFEGGADAATVEDVVRWGSAGGAQILGLAQSGTLQVGMQADLAIYRLDDPRYFGLHDMAIGPVACGGRAALKALLLNGRPIVEDDAIPGLDLDAMRHDALAAVRTLQQRAAV

SEQ ID NO: 7368 - protein, 168 aa, Klebsiella pneumoniae
NSLGQSAAGRYSAPARRGFVRELWMTKGYKLLGYKLADNIFYCLHHREIITLRGTRTQVQLRSTMACLLEYLLAHGRERLVSDEELMINVWEKNNLRPSAQRLWQVIQSLKSRLHQAGVESALIIRVKCAGYYINNVYVAEIYSYKPPGMMNYINTSPADMNKLLVRS

SEQ ID NO: 7369 - protein, 367 aa, Klebsiella pneumoniae
LKVGIMYKKISGLVVSLTAVFACAAWAEVPAGYPADYQKTIDAAVKEGKVVIYSTTDTKAAGPLIKGFEAQYPGVKVEYNDMNSTELYNRYISEQAAGGGSGDVVWSSSMDTALKLATEYAEQYASPEVKQLPDWAVWQQKAYGTTYEPVVFIYNKRLIPQNEVPDSHTALAKLIASQADKFKGKVTTYDIEKSGLGFMLAVQDSQADANYFADLANIAKGGLTVQSSTGTMMERVSSGENLIGYNILGSYAEARAKNDPSLGITYPKDYVLVLSRVSFISQESEHPNAAKLWLDYVLSEKGQQILASQADIPSIRRDIAGKNDIDGMTALLGKALKPIPVNETLLDYLQPQKRLQFIKQWRSAAAK

SEQ ID NO: 7370 - protein, 62 aa, Klebsiella pneumoniae
SAAGGHRGGVPGDMVYLLPSFIFILAGGSFIETTHNKVGFTAPLAAAAVGFIVHMAGLSGAG

SEQ ID NO: 7371 - protein, 305 aa, Klebsiella pneumoniae
APAGSPRRRCCERCWSTIRVTLSSGLSSICVWCGWRRALLTGAALGVAGLLLQTVIRNPLGEPHILGLNAGASLAVVATSALGLSFGAFPAGRPLTAACGAGLLFGGVMALASAGRGGATPLRITLCGVALSGFASAVTAAILILDEQTLLAMRTWLAGDLAGLNWSTLQTALVPALIGLGVALLIAPRLNVLALGDKVALGLGVNLVQTRLLGLLAIALLCGAAVAVAGPIGFVGLVVPHMVRRLVTEDIRLALPLAAPVGALALVLADIAARTLVAPQELATGAMTALVGAPLFIFIAARFFK

SEQ ID NO: 7372 - protein, 275 aa, Klebsiella pneumoniae
YASGGLVKKCRAAALPVRVPWPKVRHHSLTLIVPMAYTSRLLNAIPGIRHAFLDVHETAAFPYAELAPVKLVHGNEVHHYQQPLPTRPHADAVFTAVAGQKVGVVTADCLPLLIASRDGRYVCSVHAGWQGLVSGIVDNSLACFRQQGVALADLVIAVGPHIHPCCYEVSAGFYQQLLDQPGGDRVARHRQRLFHSRSGPVSDPLKAAARGSDNLWFDLRAFAEAIFAEAGVAPASVEWLGSCTYCTPQSLGSYRRRTHFPAPKSFQYSWIMREA

SEQ ID NO: 7373 - protein, 330 aa, Klebsiella pneumoniae
RICGGDSMSDRYVIEVDGLKKYFPLRDGLFGQQTGELRAVDGVSFNIRPGTIFGLVGESGSGKTTVGRTLLGLYEKSAGSVKFHGQELADLTAPALRAIRPRMQLVFQDPYSSLNPRLRIGDAIGEAMLEHKLCARNELYDRVIDVMKICGLAPEHYARFPHQFSGGQRQRIGIARALILNPDFIVADEPISALDVSIQAQIINLFSDLRDNRGVTFLFISHDLGVVEHLCDDVAVMYLGQLVESASRDALFSRPLHPYTRALMAAVPTLDPHSEPQALVQGEIPDPANPPAGCRFSSRCPLASERCRREPPALRELAPGHRVACHWVAS

SEQ ID NO: 7374 - protein, 119 aa, Klebsiella pneumoniae
PARGQSAPAAAGRRRGRRSHLRPGRQSPAAPAPAQPAGHPPRPAGQRDPRDGPGPSAPHRSRASGKRDETTAGPGPRRPRTAPRRPAAAARRSGYPAGCFFPGHWRPAPPRSHRDGRPA

SEQ ID NO: 7375 - protein, 68 aa, Klebsiella pneumoniae
KFSGEEQDVLNTSSRECSVVIYLILFYFNYIGLAQPRCSQRPRLKTMASIDYYIHPRHDQKRMRFILI

SEQ ID NO: 7376 - protein, 130 aa, Klebsiella pneumoniae
ARSGKSSPSVRNRYSQRSPRYMLVSSGSWRLLSCAAPSSRRRSTRITAVAGSPTLTPSPARPHRLQLAPSIRALPFSSAITLPCRRLLLPINSAANSVAGLPYISCGVPCCSMTPLFSSKIRSEMAIASF

SEQ ID NO: 7377 - protein, 190 aa, Klebsiella pneumoniae
EAAGGLMNRKLLFIPLVLFLALAAALFWQLMRNAEGDDPTTLESALIGKPLPEFRLEALNTPGQTLDRRTLIDGKPLLLNVWATWCPTCRAEHQFLNGLAQQGVRVVGMNYKDDRQKAMSWLQRLGNPYRLSLYDGNGMLGLDLGVYGAPETFLIDGQGIIRWRHAGDLNERVWREELQPLWDQYNRRAG

SEQ ID NO: 7378 - protein, 305 aa, Klebsiella pneumoniae
ALPGSSGDRAGVRLMAQGERLFVKVTRELLPQVKDKYPFLYLERGRLEIDDSSVKWVDADGNVVPLPVATINTLLLGPGTTVTHEAIKTATAANCAVCWVGEDSLLFYAAGFLPTADTRNLKAQMALACDASSALKVARAMFAKRFPDADLEGKSLNSMMGMEGSRVRALYQQKAQEYGVGWKGRQFTPGKFELSDLTNQVLTSTNAALYGILCSVVHAMGYSPHIGFIHSGSPLPFVYDLADLYKERLCIDLAFSLSREMAGRYDKHKVSEAFRKRVIALDLLNLIAADINELMGGKGARRTGK

SEQ ID NO: 7379 - protein, 69 aa, Klebsiella pneumoniae
GCQGQTGHIHQHFSGYHYVTSLFVRYPPLPGRPHRESGVSRSCVNKQPGIYEETVKVSHAEQKYSDYRG

SEQ ID NO: 7380 - protein, 600 aa, Klebsiella pneumoniae
WGEGVIMATVLKKTDVAIVGFGWVGAIMAKELTEAGLNVVALERGPMRDTWPDGAYPQVIDELTYNIRRKLFQDLSKSTVTIRHNTSQQAVPYRQLAAFLPGTGVGGAGLHWSGVHFRVDPIELRMRSHYEERYGKNFIPQDMIIQDFGVTYDELEPFFDKAEKVFGTSGTAWSIKGKVVGKGRGGNAFAPDRSDDFPLPAQKNTWSAQLFEKAALEVGYHPYNLPSANTSDSYTNPYGAQMGPCNFCGFCSGYACYMYSKASPNVNILPALRQEKRFELRTNANVLKVNLTDDKSRATGVTYVDGQGREMEQPADLVIIGAFQFHNVHLMLLSGIGKPYNPETGEGVVGRNFAYQNMTTIKAIFDKDTYTNPFIGAGGNGVGVDDFNADNFDHGAAGFVGGSPFWVNQAGTKPISGFPVPPGTPAWGSKWKAAVADTYTHHLSMDAHGAHQSYRQNYLDLDPNYKNVFGQPLLRMTFDWQENDIKMAQFMFDKMAPIAKAMKPKYILGSPKNANSHFDTTTYQTTHMNGGAVMGEDPKTSAVNRYLQSWDVHNVFVIGASAFPQGLGYNPTGTVAALAYWSAKAIREQYLKNPGPLVQA

SEQ ID NO: 7381 - protein, 250 aa, Klebsiella pneumoniae
RYPMANTTLTLLAAGSLRSAFLPLVAHFRQHTGLAVDAQFGPAGLLRERIEAGAPCAVFASANAAHPQALLQAGLAQECQGFASNQLMLTARRSPDNDSLDWLALLSTPRLRLATSTPGCDPSGDYTWQLFARIEARYPGLGNAMAGRAQQLAGGRDSLSVPPGEIAGAWLIRQDLADLFIGYAHYGPALATCDDLRTLTIPAPWNIRCDYQLARLRADPAALALYRFILGDVGQGYLRQAGFMPFSDAA

SEQ ID NO: 7382 - protein, 257 aa, Klebsiella pneumoniae
GRTMTGFRWEIIEEYGPLFVDGALMTIKCTIICVILGTLWGLTLGLGRMAKAEHGPWKYILRYLVQFPVRFYVSAFRGTPLFVQIMVVHFALVPLFINPRDGLLVTSGLMSADFARELRASYGAFLSCIVAITLNAGAYVSEIFRAGIQSIDKGQMEASRALGMPWWKTMRKVILPQAFRRILPPLGNNAIAIVKDSSLASAIGLADLAYAARTVSGAYATYWEPYLTISLVYWVITFLLAQLVNRLEKRFGKSDSH

SEQ ID NO: 7383 - protein, 374 aa, Klebsiella pneumoniae
GIHMFRLYQSHDLIRQLNPEDFQYILTPAGSLREACIHYDLSCEANGHSLAFGLPKEIYNSSPHKRPYERRQRSYADPIYDEVEHRLQIGWLVGVDISRCWSSDRNPFYIDDNGDLIFTPTASSYHAWFKDEIMNAYRHTIADRQGRRPAPTQRIQHNYNGSRIAPASKTLNSKTIGRLLAAGGIYNGNLEGFHETALQLGGDAPAGYDQIMGNKGLLIAGASFAAGLTMGRLNPLSELDELSSLSKIPAFESPYVKGFISENGTLVNAEYAVIDPKKLATYALDSTHPTGGHKARVFESALGYNPTNADVLAARIQKGVLSAPATILQTNNYGQTMAVDMPILGINGETAVIRTGWMYETDALVPRLTTIYVK

SEQ ID NO: 7384 - protein, 151 aa, Klebsiella pneumoniae
EANIAVDVVGLAVVFPFAVIFSGLAFILPFIAMVATVTVVTMIAAIAMVTTVPVITTAVAIAITRVGIRWRGHDGKRNNRRQCCFESATLKHDVDTLRGSTRLKNKIKLYPRQSHVVLFFCPYLISGGKRVAGRGRAIPLLRFDRRATAPR

SEQ ID NO: 7385 - protein, 60 aa, Klebsiella pneumoniae
AGNISPAAACKIMDRFPCPLGRISPTETEIRSWLCITVFSPSLRCLQGGQGRRRDNSPSR

SEQ ID NO: 7386 - protein, 146 aa, Klebsiella pneumoniae
LSCIYCPASAFSWRYPIHRRREDMFDHVKFGVSDYAASKAFFLQALAPLGVTLVGEGEPSYGAELAGSGDASLCLYQSAEKPAPLHIAFRADSSEQVDAFWQAALAAGGKDNGAPGLRPNYHASYYAAFVIAPDGHNIEAVCHLAG

SEQ ID NO: 7387 - protein, 79 aa, Klebsiella pneumoniae
IPGMGVSDVQSSRSRYTRYKATGGFCGVETTVTWSHQFDPHWASLVSADYTWLGDHAADSPIVSRRNEATGTVGFTYSF

SEQ ID NO: 7388 - protein, 425 aa, Klebsiella pneumoniae
RLLIMRRSLLTHLRHIAGADRRRVVAPAGADEIDHIRHLLVVQAPAERRHGQVGDRIFHRRRGAPGQNDVDKRSGIFRLDHRVALQRREGAFIARAVGTVAGGAVIDVQRGACFAVVTLPQIFRHAVFHRGWGLFAAARRERFQVAGDGGDVVIREILQTMLHHIAHAAEDHGFIVASGFEELGQLGFAPGPQAVAVFAAQAGGDPAVNRRIATRQVIIAFAFAERFFLHRQATRGMTGAAVAQAFHQIAAALQHRVNLRVGDKVARRRGEDAAPERQRPAHRQRPWDVGVLVGDIHRLHAVHKVGVHGAHVRFADPRKRGIRHRRIERGTVFPHALAHRVVELFEGVPANAVFFIRRDIGGVDGADRRLHRQTAGERFPRFAVGVAGDTVPRPRQILPLLNQIAVRRRLFGEGRAAQCPKHQGR

SEQ ID NO: 7389 - protein, 297 aa, Klebsiella pneumoniae
GEIMTDIAIVAAVRTPIGSFRGAFAPLSAVDLGAAVVRGLLERCQLPAAAVDELIFGQVLTAGCGQNPARQTALRAGLPVDTPAVTVNLVCGSGLKAVQQAVQAIRCGDAGIVIAGGQESMSNAPYLMHGARDGLRFGHASLQDSMIQDGLWDAFNDYHMGITAENLADAFDISRERQDAFAASSQRKAAAAIAAGRFREELVPVSVPQGKKPPRVVTDDEQPRPETSEQQLAQLRPAFRPADGSVTAGNASSLNDGAAAVLLMRVDKARELGLPVLARIVSSAVTGVDPSVMGIGR

SEQ ID NO: 7390 - protein, 562 aa, Klebsiella pneumoniae
GGHMDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAVEVTAPDALAEVVSNAFRAAEQGRPGSAFVSLPQDVVDGPVSGKVLPASGAPQMGAAPDDAIDQVAKLIAQAKNPIFLLGLMASQPENSKALRHLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYSFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 7391 - protein, 179 aa, Klebsiella pneumoniae
GINIMLKRRTLKTALAAVISLAVMAAPAYANPGNGNGNGGGNHGNSGNHGNSGNHGNNGNSGDHGNKGQNKGQSTEDHGKRKNYGKPDHVDSDISFSRARSLAVNYGLVGYQALPPGIAKNVARGKPLPPGIAKKTLPASMINDLPYYPGYEWRAVGDDLVLVALSTAIVTAVINGVFD

SEQ ID NO: 7392 - protein, 198 aa, Klebsiella pneumoniae
RGDIMIPGKMLMYMAGLALTTSATAQADSSDSQNGVAIGAGAQYAPRYSGSEKMRLQVVPFFQAREDAFFADARKGIGYDLQSDSGLYLEHTLGYNLGRDDKDSDWRDGASSLKGMGKIRATVNTALAAGWQFTPWFSAEGKATLPLSDDQGVNYQASVTLLPLQSDTDTVAYHTAALFGDARYMNTWYGRQRCAEQP

SEQ ID NO: 7393 - protein, 159 aa, Klebsiella pneumoniae
AASISNASAARAIITLITTSHSHCYCRGTERDTRVSGRSAAGVPGATGCAGAGPRPSGKSLARCGRRCRLAPLSPPPATSSPCRWPAPAAGAGRYPGLSPGRSCPQPPAGRPSHSGGPARRASPGPPPPGKRCRCGRYAVLRAAGRTAAGCRQSPARRG

SEQ ID NO: 7394 - protein, 201 aa, Klebsiella pneumoniae
FFPISHPRLRRIIMDQVPADVTAESAGNESPAKRFVGYVIERIAKDNGFAARLKRADNPATEYQSWEILAGFGIDLEKEWQRLPYCVIGAALAKAKPASNGTITLGAAIAGCYPEGNQSEQAKARLRRLLACTSTSEACRILRPLLALMASRSVTPDFAGLLNELQWFSGSSRERIRARWAQEFYRRAGEAAGSEARNSHD

SEQ ID NO: 7395 - protein, 95 aa, Klebsiella pneumoniae
APAIKRILYHIRATGPLSDTKLRNTTMKFIKTFVAVAALSLFSAASFAQSVSATASTLDRAEAKIAAQAAEQGASYKITSAQFNNRVHMTAELSK

SEQ ID NO: 7396 - protein, 297 aa, Klebsiella pneumoniae
KMRMSVKQLRAFLAVAHTLNFAHASERLNLSQPALSLTIKGLEEALGGALLQRSTRKVTLTQEGELFLPMARQLLADWDNVEEAMRQSFTLQRGKISVAAMPSFAANVLPEALKAFRDRYAGVNVTVHDVINEQVIEMVREGRVEMGIAFEPSPNHNLLFTPLAVDRFVAIVPQQSPLAKKKQLTWQELLSLDFITLQRPSAVRLMLEEALARSGRQLDVALESHQLVTVGRMVASGLGGSAVPALCKTQMASLGAVCIPLSDPPIEKCVGAIHAGHLPLSKAAQALLDTLKGFLPT

SEQ ID NO: 7397 - protein, 147 aa, Klebsiella pneumoniae
HYGIKIMFSSEISEFRYQLTRLARQLRRISQNDPQSWSRMLVVSAIDRMGNNVTPSELAMAEDIYSSNLAVILRQLEEEGMVERKTDATDRRKTRVRLTEKGCSVLAESRKRRDDWLAQAFDEALSPEEATHLLKMTPLLNKLADHT

SEQ ID NO: 7398 - protein, 372 aa, Klebsiella pneumoniae
FFLIVKGIPRRFALGIGVGAFDDIEHSDLDEQMMWRTRRFSEFSSSYRLKMALKNDVNSRLSDILSLTFGEPAQGALAMRRKIPSSAALLAFEAAARHGNFARAAAELALTEGAISRQIARLEALLDSKLFDRTGSRVRLNPAGARYARQVREILARLERDTHDVSGMPVDGRSLEIAVLPTFASRWLIPRLGRFAAQHPHIVVNIAARSDPFILPGSGFDAAIHFEHPAWTGMEVTFLFAEYLLPVCHAALLTDDDLPGLLNRLTRIHRRQNPDAWLHYARECGLALDNPAQGPRYDLHEMAIAAVLSQQGVALVPKMYVESELSAGTLVAPWPGSPTLAKRFCLIKPGGGEGEPALQMFERWLQTEIAAG

SEQ ID NO: 7399 - protein, 358 aa, Klebsiella pneumoniae
NYMIELSVENLHLTYGDNPVLKGVSMTLGRGEVVSLLGPSGSGKTTLLRAVAGLEKPTSGRIAIGNRTVYDGTPRSEIPAEERNLGLVFQSYALWPHKTVFDNVAYPLKLRKVAAGEIKERVQRVLDQLGLGHLGNRHPHQLSGGQQQRVAIGRALVYNPPVILLDEPLSNLDAKLREEARVFLRELIIKLGLSALMVTHDQNEAMAISDRILLLNNGVIEQQGTPQEMYGSPATLFAAEFMGSNNRLHGKVMALENGRARIEGASWSLWGRAGEGVSVGEPATAVIRVERLRLDGAAQDNSLQLPLLTSMYLGDRWEYLFRTEGDDFPLRAYGTALRDAEHCHLTLPAEDVWIFPQR

SEQ ID NO: 7400 - protein, 80 aa, Klebsiella pneumoniae
LIMIKYEPNSMGNKAKDDDLYQEMCRVVGKVVLEMRDLGQEPKHIVIAGVLRTSLANRKIQRSPLTVEAMEKVIHALSGH

SEQ ID NO: 7401 - protein, 466 aa, Klebsiella pneumoniae
DVVMSVIIALAALALLMLAAYRGYSVILFAPIAALGAVLLTDPGAVGPAFTGLFMEKMVGFVKLYFPVFLLGAVFGKLIELSGFSRSIVAAAIRILGRRHAIPVIVLVCALLTYGGVSLFVVAFAVYPFAAELFRQSGIPKRLIPATVALGAFSFTMDALPGTPQIQNIIPTSFFGTNAWAAPWLGLIGSLFIIIFGLLWLERQRRKAQARGEGYGTDLQNEPETPDDIDLPHPLIAIAPLLLVGVLNLLFTHWIPQWYGASHELNLPGLAKPVVTEVGKITAIWAVQAALLSGIVLVLVCGYRNIRGRLAEGSRTAVGGAILAAMNTASEYGFGAVIAALPGFLVLSKALAAIPNPLLNEAISVTVLAGITGSASGGMSIALAAMSETFVAAAHAANIPLEVLHRVAAMASGGMDTLPHNGAVITLLAITGLSHRQAYGGIFAITVIKSLAVLFVIATFYVTGIV

SEQ ID NO: 7402 - protein, 508 aa, Klebsiella pneumoniae
SSVIETMKKRVYLQILLPVLMTLIVLSVTNYFIVLSQKDYQSRVAERLLQYSERVAGQLADAIEVAESSGIAGCTPAGINLLRTIRQKNKYIDDIGIVNGNRILCTAGWGTLRSSILLSSPPYQTPSGYLLYPVRKDNVHLRNPGTVTIKHNIAVVSPALTFANVLNVNPDFYIALAVRNGQKQLFSLGKNYLALQATSGSPFRISTRHCSQIRDLCVTTNKPDGGVMSLSWMLIFLLSLFGIITGCWMVSLIDSALEAKNSLEKRFIRAVKKKDFYIEYQPIVQASDRVVVAYEALVRWQDRYFGRVSPELFIGLASRLKLYQKLSGFVTETALDEMQEHLRRNPSLRLSLNVGDNEMNDCQFLEQLVSGCRRLKIQLQQIKLEITESSRSESGLIAAFCQRAREYGFNISLDDFGTGTANIEWLTVLDFDEIKIDRIFIANIDDPVKRALLVSVVKGLRGTGKPLVFEGVETPAQFKFIRYLDKKALIQGWFTGKPAPIAALNIQV

SEQ ID NO: 7403 - protein, 437 aa, Klebsiella pneumoniae
RRAIADQPRLPVEQVAELSAEQTAGQGVQRVIAPRRAEGILHVVAAEQGGHAGGLRLVQQRDPPLARRAAERRILQQQVGHRQSDKGDAVRRQLAQDRRRLFVAAGGQRAAVAAADMSGKRVAGEMIRQPGQPLRHFAELLINMQIQIQIPAGRAAQQIFHGGGVPVGGVDEAAQQAALSAVGDRPGDGLRLRWLAKQGQRDQRHPLQGDADGIEAGDLLPGVRRVGGKPVDMAAQMGHAIRCRPGQRGGRPTLNIRPGPVPAILVHSVDRRQQPGLRRTAAFNGECLVQMGMGFHQAGERQGSRQVPQAGSRLVGWGQCGNPAVAKGQVRQQRLTVGPRRPAVGQRPGRESGAADPGERRARGGERHRQSPHRSKTRSGDFAREQQSVIWSLSAFSSAVSTLSRCSGIPSRTPVIQEPHIPCSQESMTSTPACCNT

SEQ ID NO: 7404 - protein, 224 aa, Klebsiella pneumoniae
TTRIFLRQRASRLSFFRQSKPARKGCRCVKLSATRREGVITKMKSIGIFCGSSAGEHPLYLETARLVGRTLAQQGLALVYGGGKVGLMGAVADAALEAGGVVIGVMPRGLVEREIAHRGLTELHVVEDMHERKTKMAALADGFIALPGGAGTLEEIFEQWTWAQLGIHEKPCAFLNIKGYYDPLQAMVDNMVRERFMHPRYAEMLPFATSADEIIAGFRDYTPP

SEQ ID NO: 7405 - protein, 482 aa, Klebsiella pneumoniae
TGNVRLLYYRGPRRDPRAPGQRADGGRESRQRPDHALLFAGEIPASGFGSVRRLTMTFPSSCAPLTGISRARLPAWALPDGWPTRANGEPLLADLAFRDGRIAALTPTDQPTPGLWDLAGALTLPGLVEPHAHLDKTFTIERCRPAQAGLLAAIHAMHEDRRHWTRADIQRRASAALARAAANGVTHLRSHVDWFTADAPDAWQEIARLDTVGITLERVALVPLPLFREPAQAEAIARTVANSGERCLLGGFIHSSNWDAAAMENLLCSAARWDLDLDLHIDEELSEVSQGLTWLADHLSRHPFPGHICCSHGCALAAGSDEQAAPILRQLAAHGVTLIALPMTNLLLQDATFGRTPRQRGITLLHEAQAAGVATLLGCDNVQDAFCPAGSYDPLDTLACGLFSAQLSDLFDRQSRLICDRAALTGSPADAAPFAVGAAASVVIFPGSDRFTWPLNSAARLVVNHGRLTHRRVWQEEMAHES

SEQ ID NO: 7406 - protein, 226 aa, Klebsiella pneumoniae
SLCVFFVTQEKGVAMTVVAHDEAQSLKARIFSAAIAVFAEHGLSGARMEQIATEAQTTKRMVVYYFKSKEQLYQEVLQHVYARIRETEQQLGLENVPPVEALVRLVRWSVRYHATHADYMRVICMENMQRGKWLKSSGELKPLNRTALSILEDILLRGQQQGVFQAGLDARDVHRLISSFSFYQVSNFYTFSSLYLDDPLPAIDDEAMVAHHCDIAVRAVIRFVIS

SEQ ID NO: 7407 - protein, 142 aa, Klebsiella pneumoniae
VPSVFPTHVGVFRVKLFFCLIRFRLPHARGGVSTCGTTSWSASASSPRTWGCFQTGVIHDTKQIVFPTHVGVFLPRPREFEQILRLPHARGGVSEEMIAIDRKAMSSPRTWGCFRCAVFGDAKIPVFPTHVGVFLYSKVKRA

SEQ ID NO: 7408 - protein, 323 aa, Klebsiella pneumoniae
WRPVPDGWSKISPSASRSRAARRSASARPFPCMPVSCRTVCCRPASPVWSHNMKTTTATPWIQHPRFLKILYPTLVAVAVVLLWQGAVSYFRIPAFLVPSPLVMLESLWTHLTPLLLALLFTLKITLISFLLSIVIGAAVAFILVQNRFVETALFPYIVFLQVTPIVAIAPLIIIWVKDATLSLVVCATLMAVFPIISNTTQGLRSVSPGLLSYFRLNHASRWQTLVRLRIPSALPYFFGALRISSGLSLIGAVVAEFVAGTGGTNTGLAYQILQAGYQLDIPLMFAALLLISLAGIALFGVMSWVSRRALSAWHESEAVQSH

SEQ ID NO: 7409 - protein, 323 aa, Klebsiella pneumoniae
CETVMRNFILRRLLQTLPMLLLASFIIFLLFAKTPGDFIDGNITLTAARAAELKAIYGLDQPLLTRYLHWLGQLLRGDLGFSLQYQIPVSQLLNQYIWNSFLLASVALVFYWGIGLAVGVVSALRPGSWFDHLVSVAVFAAMSFPTFFLCLLLIKWFAVDLHWLPVGGMTNTGSDESGWQYVLQVAAHLALPVLALVMLQAGSLTRYVRASMLDVVKMDFIRTARAKGLQERTVILKHALRNALLPIITLLGFELPGLFSGAIITEKVFNWPGAGHIHIDSLAARDYPVLMGFTLFLAVLTIVGNLLADVLYAWADPRIRVRS

SEQ ID NO: 7410 - protein, 386 aa, Klebsiella pneumoniae
YMAVSPSLIAEAVGWRREFHAAPELGYQEQETSRRVAELLASFGLQVHRGLAGTGVVATLENGPGPVIGLRADMDALPITELGSVSYRSRRAGVMHACGHDGHTAMLLAAAAHLAQTRHFSGTVHFVFQPAEENLGGARKMVEEGLFERFPMDAIYALHNWPGIPLGEVALSDGAMMASLDAFEITLRGKSCHAAMPESGADPIVAAAQLIMALQTIPSRRLSPQDSAVVSITQINGGEAINVLPDTVVLRGTFRCLSNRVRARVRELIESYVATQPQVSDVQGEISWFPGYPVTKNHALQAQQVREVAVATLGAQAVRWNQAPSMASEDFACMLEACPGAYFWIGTDGETPSKPLHNASYDFNDALIGPGVAMWVGLVEKQLPAA

SEQ ID NO: 7411 - protein, 208 aa, Klebsiella pneumoniae
KRYVMTVTWTVTPVGYQHIAKRCPACNVKRDFAPSGAIRVNSQKKLLDIWSIYKCTRCDYTWNIALFSRLHVSKINRELLQRLLKNDAAMVHYYAADLATLKRNRAEPSGQPDFRIHEQWSVTLMACQRITVRVRVSQPFRISLLSILKKQLKLSTAEIRWLVATGHIEGIPLKQLKTKKLKAMEYDFQLAAETLYARRRITLSLCGR

SEQ ID NO: 7412 - protein, 590 aa, Klebsiella pneumoniae
TMNVLRRKWQGLPRGVVVCITALVIYVPLLFIVVQSFLSAPFFSRSKSWSLEAFAFIFTDPDFYLALRSGFILAFGLVIIAIPLGGILAFLMVRTDLPGRRIIEPLILVPIFVSPMVLGFGYVVAAGPVGFFSQWAQQLIGFVPWNIYSMFSIVVIAGLTHVPHAYLYISSALRSVGSDVEEAALTVGATPLQVMTSVSLPMVRPSILYACVLLFFLGLEVFGLMLVLGDPEGNMVLATYLYKLTNKLGTPSYHLMAAVAVVLICITIPLVMLQRRLMRTANRFVTMKGKASQARALPLGKWRWVAGAVVVAWLTVTIGVPLLGVALRAFISNWGVGVSLWDELSLATFHNIWQQPNLLRAIVNSMAIGIIGGALAVICYLFVGIAMHRKADNVTRFLDYSVLVPRAVPGLLAGLAFLWVFLFVPMWLDQSLKHGWLSALPVADWLREHLIVQLRALRNTIFSVWLAYTVVWMAYGLRLISSTLLQVGPELEEAARSTGASRGQITRHVTVPLSRYGLIGSWLLMFLIFEREYSTGVYLLSPGTETIGSMLVSLWAAGAIDIVAALSFINILLVVIGLGIALRFGVKLHD

SEQ ID NO: 7413 - protein, 297 aa, Klebsiella pneumoniae
RAVVSLVVSARMVASGKYLRTARADLPPWVATTISGASSFSAVSTAPRHTASVMRSLRLSLLKSRRLVITRSVRSQMVAMMVTASSGYLPFADSPDSITASVPSRMALATSPASARVGRGFLIMESSIWVAVITTLRARIHFSMIIFWAKITSSTGISTPMSPRATMMPSDASRISSKLFRPSWFSILEMIWMFSPPWAFRCSRISTTSERLRMKEAATKSTPCSQPKIRSCLSFSASAGRAMETPGRLTPLFSPRSPLFSTLQITLLPSIAVTSMPIRPSSTRTVLPTARSEVKPS

SEQ ID NO: 7414 - protein, 93 aa, Klebsiella pneumoniae
CTSVFPTCVGVFLQDEQAVKRQAGLPHMRGGVSELTLEQAIQHTSSPHAWGCFFITCERIWLYPVFPTYVEVFSPFKCRQVTSVRISQMKGDS

SEQ ID NO: 7415 - protein, 416 aa, Klebsiella pneumoniae
AKPVRKPLFCWTPKGRKSRTIKLEGGNDVSLKAGQTFTFTTDKSVIGNNEIVAVTYEGFTSDLAVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDMGVEIPVEEVIFAQKMIIEKCIRARKVVITATQMLDSMIKNPRPTRAEAGDVANAILDGTDAVMLSGESAKGKYPLEAVTIMATICERTDRVMTSRLDFNNDNRKLRITEAVCRGAVETAEKLEAPLIVVATQGGKSARAVRKYFPDATILALTTNETTARQLVLSKGVVPQLVEEIASTDDFYHLGKDLALKSGLARKGDVVVMVSGALVPSGTTNTASVHVL

SEQ ID NO: 7416 - protein, 459 aa, Klebsiella pneumoniae
KIRVPWCRHKGRQMMKMQWLSALVLGALSCAAFAEEAPADSNLIKQGEYLARAGDCVACHTNGKAGKPFAGGLPMETPIGTIYSTNITPDKEHGIGGYTFEEFDDAVRKGVRKDGSTLYPAMPYPSFARISEADMRAMYAYFMHGVEPVNVANKDTDIPWPLSMRWPLAFWRGIFAPTPSDFVANPQVDPVLERGRYLVEGLGHCGACHTPRSLTMQEKALSESEGDDYLAGSNAPIDGWVASSLRGENRDGLGTWSEAELAEFLKTGRNDKSVVFGGMSDVVEHSLQYLSDDDITSIARYLKSLPPRGGKQTPAPVEDSVAKDLWKGNDSKTGAALYVDNCAACHRTDGAGYKRAFPSLKGNPVVQTEDATSLIHIVLTGSTTPAVKDAVSNLTMPSFGWRLDDQQVADVVNFIRTSWGNNAPAVSASDVAKVRKETAAHDEKALGNADISKLPGAGQ

SEQ ID NO: 7417 - protein, 345 aa, Klebsiella pneumoniae
SSRVPIPISSRRVSMPTYSPEQALARPTGRAPLWGEGLLAAALWLMGGLFTLTWPDAGRRWPFSEGWALAQFTLGGGLLLLALSYRYWRARGARVLHASKWLALLPVLFAVWEGLTAKTAVLPVPFFAPPQALIEVLHDDWPRLLDSLLHSLGLLGLGVLLGTSSGFITGLAIGWSQRIGYWVHPVLRLLGPVPSTALLPLCLFIFPSSFGASVFLIALSTWFPVTVLTWSGVMGIDKAWYDVARTLGASQRFLILRVAIPAALPNVFVGLFMGLGASFSVLIVAEMVGVKSGIGFYLQWAQGWAAYPNMYAALLVMALLCSGLISGLFMLRDRLLSWQRGGMQW

SEQ ID NO: 7418 - protein, 318 aa, Klebsiella pneumoniae
RPLLPADPRVDRRIRLAERHHRDLINRETNMSYQPQTEAATSRFLNVDEGGRTLRIHINDCGDGKETVVMLHGSGPGATGWANFSRNIDPLVEAGYRVLLLDCPGWGKSDAIVNSGSRSDLNARILKSVVDQLGIDKVHLLGNSMGGHSAVAFTLSWPERVAKLVLMGGGTGGMSLFTPMPTEGIKLLNALYREPTIENLKKMMSIFVFDTRDLTEALFEARLNNMLSRRDHLDNFVKSLEANPKQFPDFGPRLGEISAPTLIVWGRNDRFVPMDAGLRLLAGIAGSELHIYRDCGHWAQWEHADSFNQLVLNFLARA

SEQ ID NO: 7419 - protein, 552 aa, Klebsiella pneumoniae
GCPLIINLMSLKKIFSVYLSALTSAIGWRQFIHSLPTDEGRPMLLTARTPSRYASALAALSVFMAALLLPLCFTGGVMTTPAIQQSLGGSPAALSWLTNGFMLTFGSFLLAAGVTADAIDRKRIFIAGAALFCLSSLLFCLTHNLFLSGVLRALQGLAAAMILASGSAALAQLYDGAQRTRAFSILGTVFGIGLAFGPLLIGFMIDAVGWRGVYALFALLSAGVLLIGLVSLPATEKSEPRTPDNLGLTLFTLALMLFTASLMVIPARGFLSLTTLALLIASGGLFVAFVVRCRRVNNPVLELSLLRHPRFVGVLLLPVATCCCYVVLLIIVPLHFMGGEGMSESQSALYLMALTTPMLVFPSVAALLTRWFSPGQVSTAGLMMASVGVLLLGDAFHSNHLPQLVLALILCGAGAALPWGLMDGLAISAVPVAKAGMAAGLFNTVRVAGEGIALAIVSAVLTASNTLTLQSRVHGYAPEVIHRAAGWLGAGNMPQAAALLPDFSLRVLRESYDSAYTLLFSGLAVVTLLCALMVWRTLCRKGGAIQTRDSGS

SEQ ID NO: 7420 - protein, 125 aa, Klebsiella pneumoniae
ETLSRAENQETNNSLHHRRQEIRLRAQHVAGWRLAPYPAYKGHPRFGALFAPFVGPRKRSAAGQGQRARSRFCAGWRLRLTRPTKLFWWHAPGPRLRSAAGQSLRLLLRLRQLADDRLAPRIPFR

SEQ ID NO: 7421 - protein, 260 aa, Klebsiella pneumoniae
RRISQGYSMNCSGSPAAVANGSAPAGRRNSIVVPVRLPGVRRGIHMTDLFASALHLDRAAVKALKISDAYSLHRVVYSLFADARTDREKCSHISSGIAYADQGGDFHGRKILIVSDRPPAAKVDGLYGEVISKSIPAAFLSHSRYRFQVQVNPVRKDKQTGKRVAVKGRADIAQWFIQRAASRWGFDVDLPGLQVEAMEVLQFKDKAGRQVTLGKATVQGLLTVTDRQKFQHSFHHGIGKGRAFGCGLLQIVPVVDALFS

SEQ ID NO: 7422 - protein, 259 aa, Klebsiella pneumoniae
VTNSKLSNQSPAPMIRLSQGRRDKMAGLDKRVASYEAALEGLTDGMTLLAGGFGLCGIPENLIAEVQRRQVQGLTVVSNNCGVDGFGLGMLLESRQVSKVVASYVGENALFEQLVLSGELAVELTPQGTLAEKIRAGGAGIPGFYTATGYGTPVAEGKEVRQFDGRHYILEEAIRGDFALVKGWKADWYGNVVYRHTAQNFNPLMATAGRITVVEVEEIVPPGELPPSAIHTPGIYVDRLIVGQFEKRIEQRTLRAGGH

SEQ ID NO: 7423 - protein, 230 aa, Klebsiella pneumoniae
NFASPSPRRCLATAVCANWWGRVTTSSSPCGVHPLNQDEPWEVETLRALAAEEGVVAMGETGLDYFYTPETKAQQQSSFRDHIRIGRELNKPVIVHTRDARADTLAILREEKVTDCGGVLHCFTEDRETAGKLLDMGFYISFSGIVTFRNAEQLRDAARYVPLDRLLVETDSPYLAPVPHRGKENQPALVRDVAEYMAVLKGVSLEQLAQQTTDNFATLFHIDPARLQPA

SEQ ID NO: 7424 - protein, 69 aa, Klebsiella pneumoniae
GAGSTAAGATTSAASTNSGSAAATGSTTTGSAVTGSMVAGSTVTGAAVTVSTTATGAATASTVFATLAS

SEQ ID NO: 7425 - protein, 246 aa, Klebsiella pneumoniae
DELSEIVVNRMNNTPVQREYFFDSIRAWLMLLGIPFHISLIYSSHSWHVNSAEPSWWLTLFNDFIHAFRMQVFFVISGYFSYMLFLRYPLKKWWKVRVERVGIPMLTAIPLLTLPQFIMLQYVNGKAENWHTLSGYDKFNTLAWELISHLWFLLVLVVLTSLGVVLFKWLTRRPAGGASAFGDTVTMSQLTMIFLALGVLYALIRRSLFLIYPPLLSNGLFNFVVMQTLSIFPSLCWGRRPLLIRV

SEQ ID NO: 7426 - protein, 109 aa, Klebsiella pneumoniae
GNSSRIKAVIAANASASSSPLISSWQASPFRVLLPIIASALLAFPPVPRRKFRHSIADEKRLHSVSTRLAGRACTPLGKSHVNSMTRAIAFLQSNPLFPQKVIKDSPRH

SEQ ID NO: 7427 - protein, 165 aa, Klebsiella pneumoniae
NRPSTSVDVAPPARPASPPHSACPPMVYPHKHEPRHSVSDSLLHNVKPSRYGQRPHRTVPPGHRGNQRMASARFRRSAAPSLYPATRPPAASSFPPPPAPAATLSAQCCLSRPPQCAILSPRFSLPDGVTANRGALSAPPPRPPALQPWRADRRHRPAARELPLW

SEQ ID NO: 7428 - protein, 450 aa, Klebsiella pneumoniae
KGRSPPWRKIWLSCAGSWGWTKSMAQQKPHDVNEPSRRRLLKGIGALGGALAITGGCPVAHAAKAESSPGTLTPDARQEKQPFYGRHQAGILTPQQASMMLVAFDVLAADKADLERLFRLLTQRIAFLTQGGPAPDTPNPRLPPMDSGILGPWIAPDNLTITVSVGHSLFDERFGLADKAPKKLQPMTRFPNDSLDAALCHGDLLLQICANTQDTVIHALRDVIKHTPDLLSVRWKREGFISDSAARSKGKETPINLLGFKDGTANPASHDSALMDKVVWVTADQDEPAWTVGGSYQAARIIQFHVEFWDRTPLKEQQTIFGRDKHTGAPLGMKNEHDTPDYSKDPNGEVIALDSHIRLANPRTPETQSSLMMRRGYSYSLGVTNAGQLDMGLLFVCYQHDLEKGFLTVQKRLNGEALEEYVKPIGGGYFFVLPGVVDDKHYLGESLLQA

SEQ ID NO: 7429 - protein, 483 aa, Klebsiella pneumoniae
AGLSRGRWARKLLTARGGWAMAINPPAHNAAQAGRPRLRKSLKLWQVVMMGLAYLTPMTVFDTFGIVSGISNGHVPASYLLALAGVLFTAISYGKLVRQFPEAGSAYTYAQKSISPHVGFMVGWSSLLDYLFLPMINVLLAKIYLSALFPEVPPWVWVVTFVAILTAANLKSVNLVANFNTLFVLVQISIMVVFVILVVQGLHKGEGVGTVWSLQPFISQNAHLIPIITGATIVCFSFLGFDAVTTLSEETPDAARVIPKAIFLTAMYGGIIFIVASFFMQLFFPDIHRFKDPDAALPEIALYVGGKLFQSIFLCTTFVNTLASGLASHASVSRLLYVMGRDNVFPERIFGYVHPKWRTPALNVIMVGIVALSALFFDLVTATALINFGALVAFTFVNLSVFNHFWRRKGYNKTWKDRLHYLLLPMVGALTVGVLWINLEATSLTLGLVWAALGLLYLTYLTRRFRKPPPQFDAAKAEQAWES

SEQ ID NO: 7430 - protein, 196 aa, Klebsiella pneumoniae
KNMSDLILASTSPWRRMLLEKLGLPFECAAPDVDETPRPDESARQLVTRLAQAKAQSLATRFPNHLIIGSDQVCVLDGEITGKPHTEENARRQLRKASGSIITFYTGLALYNSASGHLQTECEPFDVHFRHLSDKEIEGYVRKENPLQCAGSFKSEGLGITLFERLEGRDPNTLVGLPLIALCQMLRRENYNPLLG

SEQ ID NO: 7431 - protein, 61 aa, Klebsiella pneumoniae
GVRSMAVQQNKPTRSKRGMRRSHDALTAVTSLSVDKTSGEKHLRHHITADGFYRGRKVIAK

SEQ ID NO: 7432 - protein, 233 aa, Klebsiella pneumoniae
PILFQKWNNGGRMQDLNDFAWFVQVVDHGGFAAAGRALDQPKSKLSRRIAQLEERLGVRLIQRTTRQFAVTEVGQTFYQHCKAMLIEAEAAQQAVETLRAEPRGSVRITCPVTLLHVHIGPMLARFMARYPGVTLHLEATNRRVDVVGEGIDVAIRVRPRPIEDSDLVMRVLADRGHRLVASPDLISRLGRPQAPSELSAWPGLSLGANKHQHKWQLTGPGGARAEVYSRREW

SEQ ID NO: 7433 - protein, 107 aa, Klebsiella pneumoniae
DIMFLVDSHCHLDGLDYQTLHKNVDDVLAKAAARDVKFCLAVATTLPGYRSMRELVGTRDNVVFSLWRTPIKPGRALGGRDSARAGSGRGRRGDGGDRSGLFLYPGN

SEQ ID NO: 7434 - protein, 111 aa, Klebsiella pneumoniae
KIMFIFEGNEIETDSEGYLKDTTQWSEAMAEVIAAQEGITLAVEHWEVVRFVREFYLEFNTSPAIRMLVKAMANKFGEEKGNSRYLYRLFPKGPAKQATKIAGLPKPVKCI

SEQ ID NO: 7435 - protein, 465 aa, Klebsiella pneumoniae
SLFPAALIPAGKLRRSGFRLSFSFKSSPPLRHLFLRRIISRLIFSLNLTCRAGQWNPMSSAETPINWKRNLTVTWLGCFLTGAAFSLVMPFLPLYVEQLGVTGHSALNMWSGLVFSITFLFSAIASPFWGGLADRKGRKIMLLRSALGMAIVMMLMGMAQNIWQFLLLRALLGLLGGFIPNANALIATQIPRHKSGWALGTLSTGAVSGALLGPLAGGFLADPWGLRTVFFMTAGVLFICFLFTLFLIRENFVPIARKEMLSAREVFSSLQNPKLVLSLFVTSLIIQVATGSIAPILTLYVRDLAGNVSNIAFISGMIASVPGIAALMSAPRLGKLGDRIGPEKILIVALIISVLLLIPMSFVQTPLQLGILRFLLGAADGALLPAVQTLLVYNSTSQISGRIFSYNQSFRDIGNVTGPLIGASVSANYGFRAVFLVTAGVVLFNAIYSTLSLRRPAADTSHSVN

SEQ ID NO: 7436 - protein, 145 aa, Klebsiella pneumoniae
LRLPDGSLFYGSRTMKRTLFAVMALLASGAALADECSSANTQTEMNQCAAAQYQAADKKLNDTWQQALQRAVGKQQTLLKQAQQAWIALRDADCAFLASGAEGGSMQPMLISQCMTDKSVERESFLASLLQCEDGDQSCPLPPAN

SEQ ID NO: 7437 - protein, 177 aa, Klebsiella pneumoniae
YARPMQKVKLPLTLDPVRTAQKRLDYEGIYARDQVERVTDSVVSVDSDVECSMSFAIDNQRLAVITGDAKVTVTLECQRCGKPFSHHVHTTYCFSPVRNDEQAEALPEAYEPIEVNEFGEIDLQAMVEDEIILSLPVVPVHDSEHCEVSDADMVFGELPEEAQKPNPFAVLASLKRK

SEQ ID NO: 7438 - protein, 107 aa, Klebsiella pneumoniae
KRSPLLSTLTGYCINNQYRTQGAIMRIEVSIAKTTALPNGALEALNNELSRRIAEQFPAIDSQVSIRYATGNQLSVFGALKEDKDRISEILQETWESADDWFVHDLS

SEQ ID NO: 7439 - protein, 134 aa, Klebsiella pneumoniae
VPVPARHGRTAVRAGGGQGRRRQTESAVPDLRPGGHPRDAAGVSGASSAGERRQYLFRQPYRGQYPAAGRAGGRPGQRGRKTGAAGRPGRPAASENPAAARSLRQRPEQLRRSRSGERAPSGLPLLFPAQQRAA

SEQ ID NO: 7440 - protein, 156 aa, Klebsiella pneumoniae
KMPPAVARTACCRSGQSAKTMLALLPPASSHTRFILLSPASFSSCLPVRVEPVKVMTSTSGCRASSCPASWPKPLTTFNTPSGRPASFASPARRRAVSGDFSEGLRITLLPAASAGPSFQQASSSGKFHGTTAAITPIGSRTIIASSLLPVGATSP

SEQ ID NO: 7441 - protein, 329 aa, Klebsiella pneumoniae
NKTPALIGQRRLLSGAPMEIIFYHPTFDTQYWICELEKQLPGARVREWKAGDNRPADYALVWHPPVEMLQGRALKAVFALGAGVDSILSKLRDHPDMLPLSIPLFRLEDTGMGRQMQEYAVSQVLHWFRRFDDYQALKLASRWQPLPEYRADEFTVGIMGAGVLGAKVAESLQPWGFPLRVWSRNRKSWPQVQSFAGQAELGEFLQGTRVLINLLPNTAETAGIINQTLLAQLPDESYVLNLARGVHVVEEDLLAALNSGKLKGAMLDVFSREPLPQESPLWAHPRVAMTPHVAAVTRPMEAITYIAETISRLERGEPVSGQVDRQRGY

SEQ ID NO: 7442 - protein, 351 aa, Klebsiella pneumoniae
TNWPIFYRPSASSSCSIFSSTWSMPTPCVKRSSGRRTLPAWWYGSRATAPSLLSCRRRFRMTLSAAPRISCEVIDTRADRARIFNLQRYSLNDGQGIRTVVFFKGCPHTCPWCANPESISPRIQTLRRESKCLRCTRCQQDVAECPSGAWEQIGRDVTLDNLLQEVLKDEVFFRASGGGVTLSGGEVLMQAGFAARFLQRLRQWGIRTAIETAGDSAFDRFLPVAEACNEVLFDFKIMEPERARSLLRMNQPRVLDNFRQLAARKINLIPRVPLIPGYTLNTDNFRQILAFLAPFALKEMHLLPFHQYGEPKYRLLGKPWTLASVKAPDEAEIQPYRVMAEAAGFHVTIGG

SEQ ID NO: 7443 - protein, 256 aa, Klebsiella pneumoniae
ACWPKWLPAWAVIEETFGEASTALGYDLWALTQHGPVEELNKTWQTQPALLAASVALYRVWQQQGGKAPALLAGHSLGEYSALVCAGVIGFADAVRLVELRGKFMQEAVPEGTGAMSAIIGLDDAAIAKACEESAEGQVVSPVNYNSPGQVVIAGHKEAVERAGAACKAAGAKRALPLPVSVPSHCALMKPAAEKLAVELQKITFNAPTIPVVNNVDVKCETAPDAIRDALVRQLYSPVQWTKTVELMATEGVSHL

SEQ ID NO: 7444 - protein, 211 aa, Klebsiella pneumoniae
QLKFNYMINKGMIMRKLVCPRLPQFQACVSPLGQLHTRPLFGGYSLAIDDTVFAMVAEGNIYLKACEQSAAYRVEHRNPLLTLRRHGRIVPLKYYQIDDTLWRDEQQLFRLSLLSWQSAQREKNCRRASGRLKDLPNISFHMELQLIHAGIPDVRTLREVGAQEAWLRLRVNNASLSLSVLLALEGAIAGVHAAALPTPRRQELLEWAATR

SEQ ID NO: 7445 - protein, 214 aa, Klebsiella pneumoniae
YHFTRRAVRYAAGRQGDPMNDAINHTACETLFTQARTHNGWLDKPVSDAQLQAVWDLMKMGPTSANCSPARIVFVRSAEGKEKLRPTLSSGNLQKTMQAPVTAIVAWDSAFYDRLPTLFPHGDARSWFTSSPQLAEETAFRNSSLQAAYLIFACRALGLDTGPMSGFDREKVDAAFFADNGWKSNLLVNIGYGDPGKLYGRLPRLSFDEACLLA

SEQ ID NO: 7446 - protein, 285 aa, Klebsiella pneumoniae
RCFTFKGIGMFVPFLIMLREGLEAALIVSLIASYLKRTQRGNWIGVMWIGVILAAALCLGLGIFINETTGEFPQREQELFEGIVAVIAVVILTWMVFWMRNVSRNVKQQLEQAVDKALQRGNHHGWALVMMVFFAVAREGLESVFFLLAAFQQDVGIWPPLGALLGLATAIVLGFLIYWGGIRLNLGVFFKWTSLFILLVAAGLAAGAIRAFHEAGLWNLFQDTAFDLSNVLSTHTLFGTLLEGIFGYQETPSVSEVAVYLLYLIPALVLFALPPRNNTTASRAA

SEQ ID NO: 7447 - protein, 67 aa, Klebsiella pneumoniae
PATTTGLLTGGSALTGSAGAASVTGACSTVSATGAIVSTGAATTGVVSTASGSTTTGSASSVTGAIA

SEQ ID NO: 7448 - protein, 184 aa, Klebsiella pneumoniae
MNEFSILCRVLGSLYYRQPQDPLLVPLFTLIREGKLAASWPLEQDELLARLQKSCEMQSLATDYNALFVGEACSVPPYRSAWVEGSSEAEVRAFLSEHGIPTGEGPADHLGSLLLAASWLEDHAAEDQSETLELLFADYILPWCGTMLGKVEAHAHTPFWRTMAPLTRDAIAAMWDELQEEDEQ

SEQ ID NO: 7449 - protein, 793 aa, Klebsiella pneumoniae
TRYTATFPRAPEALKGRLRALRHNMEFIMTNRTQRLKASLFAQPREISLERALLYTASHRQTEGEPVIIRRAKATAWILDKVMISIREDELIAGNRTVKPRAGIMSPEMDPYWLLNELDAFPTRPQDRFAISEEDKQIYRETLYPYWEKRSMKDFINGQMTEEVKAAVNTQIFSVNQTDKGQGHIIIDYPRLLNHGLGALVSELKTHCARQPENPFYQAVLILLEASQRHILRYAALAEEMAGHCQDPQRQQELLTIAAISRHNAQHRPTDFPQACQLFWYMNIILQYESNASSISLGRFDQYMLPFYQASLNQGQDPAYLKELLESLWVKCNDIVLLRSSSSARYFAGFPTGYTALLGGLTDTGRSAVNVLSFLCLDAYQNVQLPQPNLGVRVNELIDRPFLRKTAETIRLGTGIPQIFNDEVVVPAFLNRGVSLEDARDYAVVGCVELSIPGRTYGLHDIAMFNLLKVMEIVLQENEHQPDVSWDGLICQIRDKIRHYIKLMVEGSNICDIGHRDWAPVPLLSSFIEDCVQHGKDITAGGARYNFSGVQGIGIANLSDSLYALKGMVFDQQRLSFDQLMAVLKANFQTPDGKKIRARLINRFDKYGNDIDDVDNISADLLRFYCKEVEQYLNPRGGHFTPGSYTVSAHVPLGSVVGATPDGRLAGEQLADGGLSPMVGQDSQGPTAVLKSVSKLDNYLLSNGTLLNVKFTPATLAGDGGLNKLADFLQAFCKLKLQHIQFNVVNADTLREAQQRPQDFAGLVVRVAGYSAFFVELSKEIQDDIIRRTAHQL

SEQ ID NO: 7450 - protein, 490 aa, Klebsiella pneumoniae
GFFTFAHAQDGVVRRLHFVVWHDNNAHIALTGFDSAHCGTFFVQQIGGDRYRNNGVDFFGILFQRFFFDQTQNRERQRFVITHGAGAGAARADVVAGLAQRRAQALTGHLQQAEARNMADLNARPVLTDGFAQTILHGALVANRGHIDEVDNDQAAEVAQTQLAGNFVSRFEVGIEGCLFDIAAAGGAGGVDIDRGQRFGAIDNDRPAGRQAHFALEGRLNLRFDLIMAEQRDFTGVQFDFAAEIRTTQRGDMLARQLKHFRVIDQDFADVLAQVVTEGADNDVAFLVDQERRRTAFRGFLNRFPVLQAEAKVPLQGFGGFADASGANDQAHAVRKLQARQRFFQFGTVVALDTAGNSPGARVVRHQYQIAARQADKGGERSAFVAAFFFINLHDNFLTFPQYVFDIRTTMRIVVGGEVFAGDFFEGEETMTLGAVINKRGFKAGFNAGDFAFVDVRFFLFVPGAFDIQVVQALPINKGDAQLFLLSCVD

SEQ ID NO: 7451 - protein, 385 aa, Klebsiella pneumoniae
QQVTPPVKDLTVRSFVTSWRILDDNEAQKMKKTAIAIAVALAGFATVAQAAPKDNTWYAGGKLGWSQYHDTGFYGNGFQNNNGPTRNDQLGAGAFGGYQVNPYLGFEMGYDWLGRMAYKGSVDNGAFKAQGVQLTAKLGYPITDDLDIYTRLGGMVWRADSKGNYASTGVSRSEHDTGVSPVFAGGVEWAVTRDIATRLEYQWVNNIGDAGTVGTRPDNGMLSLGVSYRFGQEDAAPVVAPAPAPAPEVATKHFTLKSDVLFNFNKATLKPEGQQALDQLYTQLSNMDPKDGSAVVLGYTDRIGSEAYNQQLSEKRAQSVVDYLVAKGIPAGKISARGMGESNPVTGNTCDNVKARAALIDCLAPDRRVEIEVKGYKEVVTQPAA

SEQ ID NO: 7452 - protein, 533 aa, Klebsiella pneumoniae
TIATFQRPHLRAFYSRVWNNSVMNLLKSLAAVSSMTMFSRVLGFARDAIVARIFGAGMATDAFFVAFKLPNLLRRIFAEGAFSQAFVPILAEYKSKQGEDATRVFVSYVSGLLTLALAIVTVIGMLAAPWVITITAPGFADTADKFALTTQLLRITFPYILLISLASLVGAILNTWNRFSVPAFAPTFLNVSMIGFALFAAPYFHPPVLALAWAVTVGGVLQLAYQLPHLKKIGMLVLPRINLKDAGAMRVVKQMGPAILGVSVSQISLIINTIFASFLVSGSVSWMYYADRLMEFPSGVLGVALGTILLPSLSKSFASGNHDEYCRLMDWGLRLCFLLALPSAVALGILAKPLTVALFQYGKFSAFDAAMTQRALVAYSVGLMGLIVVKVLAPGFYSRQDIKTPVKIAIITLIMTQVMNLAFIGPLKHAGLSLSIGLAACLNAALLYWQLRKQKIFTPQPGWLAFLLRLIIAVLVMAAALLGVMHLMPEWSLGTMPFRLMRLLAVVIAGVVAYFATLLVLGFRVKEFVRRTA

SEQ ID NO: 7453 - protein, 137 aa, Klebsiella pneumoniae
CNYTPPAGGTAGADSARRATQWGSRKPLSAAPRPPPGAGSGAENARDRHAASCRCRPAIASGTGPVREPPSPASPAAEAVAARQKRPLYPAQAASARGPPRRRYARNALYRVRRSPAAGSPGSTRPARLPAYWRPDR

SEQ ID NO: 7454 - protein, 104 aa, Klebsiella pneumoniae
NHLTECYAISGETQAVTSLREIFYHNPAAGYSRDEASSFRHIPMLSSHRALYLFPFPNRILGWSMSGLILFIVAVALLGVAIYSLVSYLKERRASQLPVHKKKK

SEQ ID NO: 7455 - protein, 67 aa, Klebsiella pneumoniae
KKGLPKGNPFLLLPVAVLTALHLHLPTPQTRHVCSVIAGEKVTINPLQMVVILIIQPLVINGNGAEE

SEQ ID NO: 7456 - protein, 105 aa, Klebsiella pneumoniae
KRKTMSFEGKIALVTGASRGIGRAIAETLVARGAKVIGTATSESGAQAISDYLGANGKGLMLNVTDPASIESVLENVRAEFGEVDILVNNAGITRDNLLMRMKDD

SEQ ID NO: 7457 - protein, 232 aa, Klebsiella pneumoniae
IMETNIVEVENFVQQTEERRVSAFAKEVKRYLETYPDTQYVDVLLTDLNGCFRGKRIPVAGLSKLEKGCYFPASVFAMDILGNVVEEAGLGQEMGEPDRSCIPVPGTLTPSAADPQSIAQVQLTMVDEDGAPFDVEPRNVLNRLWQQLRQRGLFPVVAVELEFYLLDRKRDAEGYLQPPCAPGTDDRNTQSQVYSVDNLNHFADVLNDIDELAKLQLIPRRWRGGGSLAGPV

SEQ ID NO: 7458 - protein, 141 aa, Klebsiella pneumoniae
QEETMKENDIAGILTSTRTIALVGASDKPDRPSYRVMKYLLDQGYHVIPVSPKVAGKTLLGQQGYATLADVPEKVDMVDVFRNSEAAWGVAQEAIAIGAKTLWLQLGVINEQAAVLAREAGLSVVMDRCPAIELPRLGLAK

SEQ ID NO: 7459 - protein, 366 aa, Klebsiella pneumoniae
KVRTGMKKTCRIAAIPGDGIGKEVLPEGIRVLQAAAQRWDLSLSFEQMEWASCEYYAHHGKMMPDYWREQLQGFDAIYFGAVGWPDTVPDHISLWGSLLKFRREFDQYVNLRPVRLFPGVPCPLAGKKAGDIDFYVVRENTEGEYSALGGRANEGTEHEVVIQESVFTRRGVDRILRYAFELAKSRPRKTLTSATKSNGLAISMPYWDERVEEMAKNYPEIRWDKQHIDILCARFVLQPERFDVVVGSNLFGDILSDLGPACTGTIGIAPSANLNPERNFPSLFEPVHGSAPDIYGKNIANPLATIWAGAMMLDFLGNGDERYRAAHDGILAAIEQTIASGPKTPDMQGTASTRQVGEAVCLALTQ

SEQ ID NO: 7460 - protein, 156 aa, Klebsiella pneumoniae
YFLTNTNEDSKDDVQTGCNGAGAGRVTQRLRGGWKFIDQRAEARGFARADKSMVQTTLYFGLSRPAGKDITAEEWQQFVDRDVTPRFRDGLTVFDAHGQWLGQNGQVVREQSKALMVIHGHDAQSEAGIEALRQGYKSRFAQESVMRVDQPVCVQF

SEQ ID NO: 7461 - protein, 443 aa, Klebsiella pneumoniae
PGPTARAITAQDIVWSWQRLVSPATASPYASYPGNMHIANAREIALGQKGPETLGVKALNDTTLQVTLTQPNAAFLAMLAHPSLVPIDKVLVERYADKWTRPEHIVTSGPYKLSQWVVNERLVAERNAKYWDNAHTVINKVTYLPISSEAADVNRYKAGEIDIVYTVPINQFAQLQKTMGDQLDVSPQLATYYYEFNTTRPPFNDARVRRALNMALDKDIIAGKVLGQGQRPAWLIGQPDIGGVTLHNPDYASWPREKRIAEAKKLLAQAGYDESHPLVFTLLYNTSESHQRIAIAASSMWKKNLGVEAKLQNQEWKTMLDTMHTHNFDAVRYAWIADYDDAATFLNTFRTGDSENTSQYSNPAYDAALRNAAKASDVATRGKYYQQAEDLLAQDVPAIPVYHYVRTHLVKPWVGGFTPDKLGYYYTKDMYIKKHPSASGDGR

SEQ ID NO: 7462 - protein, 175 aa, Klebsiella pneumoniae
PPRTRCSSAKKRYNHQVLLSTGQNRGFMRTILNILNFILGGFATTLGWLLATLVSIILIVTLPLTRSCWEITRLSLFPYGNEAIHVDELEPGRKNGLLNAGGTVLNILWFIFFGWWLCLMHIFSGIAQCLTIIGIPVGIANFKIAAIALWPVGRRVVSVETARAAREANARRRFQ

SEQ ID NO: 7463 - protein, 308 aa, Klebsiella pneumoniae
NVGTRLRIGVVGLGSIAQKAWLPVLGAAESWTLQAAWSPGKEKALRICETWRMPYADSLDALAAQCDAVFVHTSTASHYEVVNHLLNAGVHVCVDKPLADKLSEAETLVELAARRRLTLMVGFNRRFAPLYRELKGRLGEAASLRMDKHRSDSVGNDLRFTLLDDYLHVVDTALWLADGQARLRGGALKITPQGEMLYAEHQFSSPRLQVTTSMHRRAGSQREWVQAVTDGGLYAVSEMREWQEECGHGVVQRPVAGWQTTLEQRGFVGCARHFIECVQNQTVPETAGEQALLAQRIVEKLWRDAISE

SEQ ID NO: 7464 - protein, 318 aa, Klebsiella pneumoniae
PFCAADCRPAVAHASPEKRLLMSITLCGLAYVCPVFCSARLVSCRGGTSRVCLCYRNVKKERKMNSSSANFLDALGASQTLSAQMKHELDTLGYTVVHNVVDAQWLSEMRLLIDTLVEREGDNLAMEHHQEATATRIANLINKGVIWEKVWSHPLILSACRYIFNGDFKVSSLNAREALYNGGHQPLHADWKKPRPDFPKVHLVNTIWAIDDLSAANGAPRIIPGTHLRPELPEEVLADPEQAHPDEIVFAAPAGSVMIYNAHAWHGGTRNREGSRRRVLHGLYIDRADTPQQDQRRWLTPETASRLTPAQKWLLDVE

SEQ ID NO: 7465 - protein, 726 aa, Klebsiella pneumoniae
SQCASSLSVTERNTDMISPLLRRYTWNSAWLYNVRIFIALCGTTLFPWWIGEVKLTIPLTLGVVAAALTDLDDRLAGRLRNLAITLVCFFIASASVELLFPWPPLFALGLTVSTIGFILLGGLGQRYATIAFGALLIAIYTMLGVTLYDHWYLQPLFLLAGAVWYNLLTLSGHLIFPIRPLQDNLARSYEQLARYLELKSRLFDPDLEDESQAPLYDLALANGQLVATLNQTKVSLLTRLRGDRGQRGTRRTLQYYFVAQDIHERASSSHIQYQTLRDQFRYSDVMFRFQRMLSMQAQACQKLSRAILLREPYQHDAHFERAFMHLDAALERVRAGGASDEQLNALGYLLNNLRAIDAQLATIESVQTTAPAGSNTETLLADDRLGGLSDIWLRLQRNMSPESALFRHAVRMSLVLCAGYAFIQFTGLQHGYWILLTSLFVCQPNYNATRHRLALRIIGTLVGVAIGLPVLLLVPSVEGQLLLIVLTGVLFFAFRNVQYAHATMFITLLVLLCFNLLGEGFEVALPRIIDTLIGCAIAWAAVSFIWPDWKFRNLPRVLDRAMNANCRYLDAILEQYHQGRDNRLAYRVARRDAYNRDAELASVVSNLSTEPRADATQRETAFRLLCLNHTFTSYISALGAHREKLSTPEILALLDDAVCYVDDALHHTPADEQRVQQALNSLQSRIHHLEPRADSKEPLVLQQIGLLLALLPEICRLQQRVHAQTE

SEQ ID NO: 7466 - protein, 137 aa, Klebsiella pneumoniae
RSLLKGWLTCRQREQSSPGLAERWENKDNLLRTFHLRPGLTWSDGTGHYSAGYRLELATAGLAGNSLPLRELPWQYAYRQRPRDCPRAKGTRDVGGESAERHHAAGHSDPAECRLPGDAGAPFAGTDRQSAGGAVCR

SEQ ID NO: 7467 - protein, 359 aa, Klebsiella pneumoniae
RNSAAGCRGARHSRHDRPVDGGASGMKWYPWLRPSFEQLVGSYQAGRGHHALLLQSLNGMGGEALIYALCRFLMCRQPEGHKSCGHCHSCQLMQAGTHPDYYALSPEKGKSALGIDAVRDVNEKLYEHARLGGAKVVWISDAALLTDAAANALLKTLEEPPENTWFFLACEEPARLLTTLRSRCRLHHLAPPSEPYALAWLEREVSLPQESLLTALRLCASAPAAALELLQEPLWTARQQLCQALAATLASGDWLALLPILNHEQAAVRLHWLASLLVDAQKRQQGITLVSNPDVWPLLEQLAHSLPAARLQAIAHDVCTCREQLLNVVGVNRELLLTERLLRWEHYLQPGTGLPVSHL

SEQ ID NO: 7468 - protein, 121 aa, Klebsiella pneumoniae
LRSARHGNDACHVWNGLVYSVVRPWTLLLNYLRFKLANTANGFGFCASSGSSPKTMSASDTSQCSESCTGTTGRERIISSSTIACRSISPNSLTSIGSYASGSASACSSFLTGLKQYVVWT

SEQ ID NO: 7469 - protein, 161 aa, Klebsiella pneumoniae
PPAAVSSPDRAAGRCPATVLHNPPPAQPPAGSAHPVRYPLRTARARAASASGCCARRLAPAAGVGCRFAPARCTAGTAPAAQDGPRPTAAAPAAVFPAAFSAGRPADALHPGGRRSRQPRPADGWRADGTDTADRRLSDRYRTTLRRRTAERRPPRQPYCG

SEQ ID NO: 7470 - protein, 99 aa, Klebsiella pneumoniae
MAAYRARGSESGSVFTPRMVTTDMLALREAAMAGVGVVQLPLLMVRDQLASGELEVVLDEWQPRREVIHAVFASRRGLLPSVRALVDYLSEEYQRMEED

SEQ ID NO: 7471 - protein, 372 aa, Klebsiella pneumoniae
CTYYIRGSSRQCDVSLWRSRMVRSRTGQRKTSDRTLQHGSPASGSDFLTLSLSASHYYNLGRVRGARSRDSLSVLPASNGLQGSQTSIVRAHSRVDVDACDVNQQRKVLSMGRQKAVIKARREAKRVLRRDSRSHKQREEESVTSLVQMSGVEAIGMARDSRDTSPIEARNEAQAHYLNAIDNKQLIFATGEAGCGKTWISAAKAAEALIHKDVDRIIVTRPVLQADEDLGFLPGDIAEKFAPYFRPVYDVLVKRLGASFMQYCLRPEIGKVEIAPFDYMRGRTFENAVVILDEAQNVTAAQMKMFLTRLGENVTVIVNGDITQCDLPSGVRSGLSDALARFEEDEMIGIVRFTTDDCVRSALCQRTLKAYY

SEQ ID NO: 7472 - protein, 73 aa, Klebsiella pneumoniae
IYNYIPMEIKFILHKIKYNKTIILIYIDIILSLLPLLCRHHGYHHLTVQLLLYKTILSLQCLTDMSRCLFPGY

SEQ ID NO: 7473 - protein, 380 aa, Klebsiella pneumoniae
QGNYPELTMQYDLIIIGSGSVGAAAGYYARRAGLNVLMTDAHQPPHQEGSHHGSSRLIRHAYGEGEKYVPLVLRAQQLWDELAEISGEAVFERTGVINLGPASSAFLANVAASARAFQLEVEELDAQAVMQRWPEIRLPDDYRAIFEPASGVLRSELAVETWIRLAREAGCAQLFNCPVSAIHHHADGITIDTLDGEYHGKKLLVSAGTWVTRLLPDLPIQPVRKVFAWYQADGRYSSKNHFPAFTGELPNGDQYYGFPAEDNELKIGKHNGGQPISTPQERVAFGAVASDGSESFPFLRNVLPGIGGCLHGASCTYDNTVDEDFIIDTLPGRPDTLLITGLSGHGFKFAPVLGEIASQFAQGEASSFNLAPFSLARFNA

SEQ ID NO: 7474 - protein, 204 aa, Klebsiella pneumoniae
RRLYLLRAAAAAVDGRQSPPDCRRYGSGPYPDAGGLCARHSVPAPARRPPRSPPADPGEKRAAGAPAAPVQPHRPAQLTAGGQSADRYGGDHGAGYRPGGGDPRPGGQAGKNGGHGDDRAAAGDPALPDGQRRGGRRIRLAGDVSGGGGQRRADWPVNVARPAALRCALDAELSAADGLDGASVAALPGITPRRASSGRALHRL

SEQ ID NO: 7475 - protein, 385 aa, Klebsiella pneumoniae
ATLYLPKGMIMMIHFRRNALRVTVAALLSSAFGAQAADIPQVKVTVNDKQCEPMQVTVNAGKTQFIIQNHSQKALEWEILKGVMVVEERENIAPGFTQKLTANLQPGEYDMTCGLLTNPKGKLIVTGAATKDAAKADAVLSLGDAITAYKAYVTAETAQLVSGTKAFTDAVKAGDIEKAKALYAPTRQHYERIEPIAELFSDLDGSIDAREDDFEKKAEDPKFTGFHRLEKALFGDNSVKGMEKYADQLNSDVLELQKRISELAFPPSKVVGGAAGLIEEVAASKISGEEDRYSHTDLWDFQANIDGAQKIVDLLRPQLQKENSALLAKVDANFKKVDSILSKYRTKDGFETYDKLTTADRNALKGPITTLAEDLAQLRGILGLD

SEQ ID NO: 7476 - protein, 167 aa, Klebsiella pneumoniae
LIDFVLNMAVRGGLTRFARPCGAARLLRARSVQLAAPVVEPRSGVLIPPCGEYKRKEPVLAYELFLKYGGEGGIRTPDTLPYTHFPGVLLQPLGHLTILSFPLLSGTGANVGKYVSPVNQLFAKKARLDKLRATCSLNVRNPFFLSPVAFPFSLGGNLLCWQTNRKQ

SEQ ID NO: 7477 - protein, 241 aa, Klebsiella pneumoniae
KRQYMSSSNSSSTFSVLSFVDGLWDLAKVAKLIYFTLCFDVLFFYLKGNGLFGIKLGKEFDLSLADLAGMIIALGIFSSIILEITSLCFNLLLIRIKYSNLLQSKDERIYQKSSTEVFMSELRDDALENGDDMSLKLYTEEQSKREKNYKEGRAAEIISFGTIFVFSIEWYLSASNGSSRMFIDWLWEQSKHSDPTTPHYLIGLLISSALLFYAVSVCWPKEDGHKIYYPKLAKKLRKKEH

SEQ ID NO: 7478 - protein, 137 aa, Klebsiella pneumoniae
KWKYLVKKHREGELITRYIEASAAQAAVDDLLTLENEPVLVHAWIEQHMNPALMNRMKQTIRARRKRHFNAEHQHTRKKSIDLEFVVWQRLAGLAQRRGKTFSETIVQLIEDAEHKEKYASKMSSLKHDLQVLLGKE

SEQ ID NO: 7479 - protein, 319 aa, Klebsiella pneumoniae
AYMYTKIIGTGSYLPEQVRTNADLEKMVETSDEWIVTRTGIRERRIAAAHETVATMGFEAAKQALAMAGVSAEQIGLIIVATTFGTHAFPSSACQIQSMLGVKGCPAFDVAAACAGFTYALSVADQYVKKRAVDYALVCGADVLARTCDPADRGTIIIFGDGAGAVVLGASEEPGIISTHLHADGSYGELLTLPNADRVDPENPIYLTMAGNEVFKVAVTELAHIVDETLAANNLERSALDWLVPHQANLRIISATAKKLGMSMDNVVVTLDRHGNTSAASVPCALDEAVRDGRIQRGQLILLEAFGGGFTWGSALVRF

SEQ ID NO: 7480 - protein, 682 aa, Klebsiella pneumoniae
RGAHGLPAARQQLNNARRHAGFQQNRHALGGDKRRLLGRFRQHAVAGRQRGGNLAGEDRQREVPRADTDHRTQWAVSFIIEIVAHLAGVIVQEVNGFAHFSDGVAEGFTRLAHQDPHQGRHLAFHQHRGALKNGGALLRRSGEPDRRIVDSAGQRLLHFSVAGFADVADDIFRLCRVNHRLHLAFGHRLLQHRQCLPFMQRAVEQGRGEGGQTVLVRQIETGGVAPAAAVEIARQRDFRMRQAGLAFLLRQFFYRADRVGHQLVQRQGIVRDTVDERGIGAVLQQTTHQIRQQRLVGAHRGVDPARPIQFAVGDLAHHLLVQRFAHAVQALELILARVVVLARQLVDSRQSMGVMGGELRVNQVRHRQQLLRAGEVGDVGVNLAGVYRIAFETFHLRAFNFAIPVGAFHQTDHQATAAAGGEVNQVINDKRTALLVGLNHEANPVPAGQFRLEAQFFQQVEGDLQTVCLFGVNIDADVILARQQGQRFQPWVKLFHHPVILRAAVARVQRGELNGDTRTFINAAAVGGFADGMNRLLIRNHIGLGVSGGQGGFAEHIVGVAEPFFFQLAGVGQRFGDGFPGDELLAHQAHRHIHAFADQRFAALADDAVQGAGEAGLVMGRHQFSGEQQPPGGGVDEQRRAAPDVRLPVAVADFVADQRIAGGFIRNTQQGFRQAHQRHPFL

SEQ ID NO: 7481 - protein, 824 aa, Klebsiella pneumoniae
FTCHGFYADTETREVSMPDINPQNIKELRALVEQQLQYTLCVSLNKATHGDIFNAVALAIRHFQQDHFLLSQKRQREERKKRVYYLSMEFLLGQSLRNNLLNMNLLAEMHQVVNDLGFDLDHLLDEEPDAALGNGGLGRLAACFIDSMATLDIAASGHGIKYEYGLFRQSFQNDQQIEHPDDWHSMHSPWLVEHHAQQILIPLGGYIEHSEDVDGNYNPMWLGWKTIIGIPHDYFVSGYRDTTTNKLRLYSAVASDSFNIHIFNRGDYIKAVSDKIASENISKILYPSDEVLTGKELRLTQEYFLVACTLRDIFRDYAEVNDDITFLPQHVAIQLNDTHPALVVVELMRILVDEYRLPWEQAWEITQNTCAYTNHTLMPEALETWPVTLFEKLLPRHLQIIFEINHRFLEEVARRWPDKNHLLSSLSLIDEHHDKQIRMANLAIVGSHRVNGVAWLHSELVKKQLVPDFYFMTPEKFINQTNGVTPRRWVQQANPGLAAFLHQQLGEGWPTDLPLLSSLESLADDTAVIDNIRAIKFANKTALSQLVAQRYGIALDPLAMFDCQVKRIHEYKRQLLNILHVIALYLDIKETGKTIAPKVHLFAGKAAPGYRMAKLIIQLINTVARKINRDPQVAGQLKVVFLEDYKVSLAEKIIPATDLSEQISTAGTEASGTSNMKFAMNGALTIGTYDGANIEIREAVGIDNFYLFGAVAEEIEESRRLGHHHNFYHQNPAMARVVDTLVSGLFTSDRELFAPLHHMLTEGDHYCHLLDFDSYCQAQQQAMIDFEQPEQWHRRALLNICRMGEFSSDRTIRGYARDIWGITS

SEQ ID NO: 7482 - protein, 417 aa, Klebsiella pneumoniae
STRHFSVPTFPLLKGSPMTDSLFPRLVLAKGREKSLLRRHPWIFSGGVARMEGKARSGETIDIVDHQGKWLARGAYSPSSQIRARVWTFDRNEAIDSAFFERRLQQAQTWRAWLAERDGLDSYRLIAGESDGLPGVTIDRFGNFFVLQLLSAGAEYQRAAIISALQNLFPDCAIYDRSDVAVRKKEGLELAQGPVVGELPPALLPITEHGMKLLVDIQGGHKTGYYLDQRDSRLATRRYVADKRVLNCFSYTGGFAVSALMGGCRQVTSVDTSQEALDVARQNVEINGLDLSKAEFVRDDVFKLLRKYRDQGEKFDVIVMDPPKFVENKSQLMGACRGYKDINMLAIQLLNPGGVLLTFSCSGLMTTDLFQKIIADAAIDAGRDVQFIEQFRQAADHPVIATYPEGLYLKGFACRVM

SEQ ID NO: 7483 - protein, 400 aa, Klebsiella pneumoniae
SSGHLTGNRSNVVPAAHQRLNAFAKGVNAGKKIIKGQQHAVGAGHARYFIKHTGDAGIRSDQGAHINVDRRGGVGHLAHVGIAAGAGIFLTLLGEPRQRFFIGARFVMFPFGARRLVGFVGDNHEQHIGPHVAAGFFRRLHHACGGRGKGRWRVDPFAKAKVVVRMLGGEGHPGIALPGADHLHRLRRARADTAVVHGEVVAFEIAAPGAPQVTEHLNVFGEIVIAAGEIVISRPHAHLVIFRFLPAGHQIDAKPAAGDGVDSGGHPGDNRRRQRQGGGGGVDLDLRGHRGQAGHQGEGLQVVIPEFSFPAEAAQFDHGEREVEMVVLGLLHDGLIQFKGRHILRGMGGDQPAVVANGNENTNFHTYLSAVMEDGLRWCGILPLPGPPRRKGKAKAMPVL

SEQ ID NO: 7484 - protein, 266 aa, Klebsiella pneumoniae
KVGLMESIHFQHNALTAAEITTRRLCRLHRVRLFSPALCRVKRGSKVIVQGESRVLATPQQLIVLPADVELEVINQPENGLFCSDLLSLTPELLTRFKTRYLSEPPPGRLTSLCAPVTTELAFMWQSVLQAVREGLSVALQQHQTMGLLLALHEAGYAGPLLVERQQDLSAQVRQLIMLSPAQAWSVSRVAKMLFLGESTLRRRLQQESQSFRQIVEEVRMAHALGQLQTTSRPIGEIAQNSGYQSGSRFTARFRQHYGLLPKHVR

SEQ ID NO: 7485 - protein, 697 aa, Klebsiella pneumoniae
TEKQSTLIENRHYMELKATTLGKRMAQHPYDRVQLLNAGVKVSGDRHEYLIPFNQLLSVHCKRGLVWGELEFVLPDGKVVRLHGTEWSETQRFYHHLHTLWQQWSTEMSDIAAGVLKQQLATIEHTRAEGKWLTRQQVADVQDNIRHALTGLPMPTSRLDAFDNCRELWRECQRWLGDIEATRLAHNQAFTEAMLEQYREFFDSVESSPLNASQARAVVNGERSLLVLAGAGSGKTSVLVARAGWLLARGEAAADQILLLAFGRQAAQEMDERIRERLASDDITARTFHSLALHIIQQGSKKVPTISKLESDTAARHALLLKSWQKQCQEKKAQAKGWRLWLEEEMGWQLPEGDFWQDKKVQRRMASRLDRWVSLMRMHGGSQAEMIAGAPEAVRDLFSKRVKLMSPLMKDWKAALKAENAVDFSGLIHQAVNILDKGRFVSPWKHILVDEFQDISPQRASLLAALRRQNSQTTLFAVGDDWQAIYRFSGAQLSLTTAFNHYFGEGDCCALDTTYRFNGRIGEIANGFIQQNPHQLSKPLNSLMAGDKKAVTLLADDKLDDLLDKLSGYVKPEQRILLLARYHHLKPEALNKAATRWPHLQLDFMTIHASKGQQADFVIVLGLQEGEDAFPAPARESIMEQALLPQPEDFPDAEERRLLYVALTRARHRVWLLFNKAQPSPFVEILQALDVPVARKP

SEQ ID NO: 7486 - protein, 321 aa, Klebsiella pneumoniae
LVKHKTQIMNNLPLLNDLRVFMLVARRAGFAAAAEELGVSPAFVSKRVSLLEQTLNVMLLHRTTRRVTITEEGERIYEWAQRILQDVDEMMDELSDVRQVPQGTLRIISSFGFGRRVVAPALSALALQYPQLELRFDVQDRLVDLVNEGVDLDIRVGDDIAPNLIARQLAANHRVLCASPQFLARHAPPKQLSDLAALPCLVIKERDHPFGVWQLHSKEGQHAIKVTGPLSSNHGEIVHQWCLDGQGIALRSWWDVRENIASGHLVQVLPDYWQPANVWAVYVSRLATSAKIRTTVEFLRHYFQLHYPQHEPTASAVGRGD

SEQ ID NO: 7487 - protein, 123 aa, Klebsiella pneumoniae
KTKHEPHIGSIHVSQEVPMIASKFGIGQQVRHTLLGYLGVIVDVDPEYSLAEPEEDEIAANDELRAAPWYHVVMEDDDGQPIHTYLAEAQLSSETRDEHPEQPSLDELAKTIRQQLQAPRLRN

SEQ ID NO: 7488 - protein, 95 aa, Klebsiella pneumoniae
RRGQARRYPAQEISPVGDLFDRLTDAVYPADLQSFFALSMRIILLMVIYFFLPGSVSLAILRSGLPASCSACIAGKEIIDVHHTLWARVRMSSFL

SEQ ID NO: 7489 - protein, 275 aa, Klebsiella pneumoniae
IWFNNATFYEAFLMTQPSHTAFITGASSGIGAIYAERLAARGYNLILAARREDRLQALADQLQARYAIQASILKADLSEEHGIAAVEQRLQQDPAIDLFINNAGTAKLAGFLASTPREHQAIHTLNTTALLRLSYAALAAFTPRRRGTLINIASILALHTLPGSAVYSASKAWVLSFTRGLQEEFADSGVRIQAVLPAATATDLWPTSGVALDALPSGTVMTTEDLVDAALRGLEMGEQVTLPPVHDLGLWETFEQSRLALFTSARTGQPAPRYR

SEQ ID NO: 7490 - protein, 260 aa, Klebsiella pneumoniae
PGFLLFLRQTEEENVMYPVDLHMHTVASTHAYSTLHDYIAEAKRKGIKLFAITDHGPDMADAPHYWHFVNMRIWPRLVDGVGILRGIESNIKNIEGEIDCSGPMLTSLDLIIAGFHEPVFPPQDRDTHTQAMIAAMASGKVHMISHPGNPKFPVDIPAIAEAAARYQVALEINNSSFVSSRVGSEDNCRAIAAAVRDAGGWVALGSDSHTAFTLGEFTECRKILDAVDFPEERILNVSPRRLLNFLESRGMPAIPEFADL

SEQ ID NO: 7491 - protein, 195 aa, Klebsiella pneumoniae
VYANPQQGAIQPNPQIQQNFHPRCLQRQPHSVICLQVKMWNENMELTTRTLPAQKHIALVAHDHCKDMLMKWVARHQALLAQHILYATGTTGNLVSRATGLEVNAMLSGPMGGDQQVGALISEGKIDVLIFFWDPLNAVPHDPDVKALLRLATVWNIPVATNVSTADFIIQSPHFGQPLDILIPDYPRYLAERLK

SEQ ID NO: 7492 - protein, 73 aa, Klebsiella pneumoniae
FMNKKILVLSVLFGFSTMSHASEPKYAFPQSDKQVVSKIKIQNAPINHDKYGHGEVLANGAWVKGNSGSQNKK

SEQ ID NO: 7493 - protein, 193 aa, Klebsiella pneumoniae
KQDNDKYKHIKMSGANASGYLESRTMKTETPTVKMVAIAADEAGQRIDNFLRTQLKGVPKSMIYRILRKGEVRVNKKRVKPEYKLEAGDEVRIPPVRVAEREEEAVSPHLQKVAALSEVILYEDDHILVLNKPSGTAVHGGSGLSFGVIEGLRALRPEARFLELCHVSTGIPTACCWWQKSLSACVAARATAR

SEQ ID NO: 7494 - protein, 260 aa, Klebsiella pneumoniae
KSTKYSGALSIMFKNAFANLQKVGKSLMLPVSVLPIAGILLGVGSANFSWLPAVVSHVMAEAGGSVFANMPLIFAIGVALGFTNNDGVSALAAVVAYGIMVKTMAVVAPLVLHLPADEIAAKHLADTGVLGGIISGAIAAYMFNRFYRIKLPEYLGFFAGKRFVPIISGLAAIFTGVILSFIWPPIGSAIQTFSQWAAYQNPVVAFGIYGFIERCLVPFGLHHIWNVPFQMQIGEYTNAAGQVFHGDIPRYMAGDLLIET

SEQ ID NO: 7495 - protein, 84 aa, Klebsiella pneumoniae
IIYKTLIRIRIVSSKWVKASGTSGFFTMNKGVCLVNNPETNTCSCQSGTVAKELFYTTATEQLGGGSHGGGITVVKERVLYQCR

SEQ ID NO: 7496 - protein, 189 aa, Klebsiella pneumoniae
GNANMSDDGLAPGKRLSEIRQQLGLSQRRAAELSGLTHSAISTIEQDKVSPAISTLQKLLKVYGLSLSEFFSEPEKPDEPQVVINQDDLIEMGSQGVSMKLVHNGNPNRTLAMIFETYQPGTTTGERIKHQGEEIGTILEGEIVLTINGQSYHLVAGQSYAINTGIPHSFSNTSAGICRIISAHTPTTF

SEQ ID NO: 7497 - protein, 177 aa, Klebsiella pneumoniae
SLANLDRSRKFPLPGKEFYNETINLEAFVKRTRLENSCCPIARSLDVIGDWWSLLIVRDALRGVRRFSEFQKNLGIAKNMLAGRLKMLVDEGILRLQPASDGSAWQEYVLTDKGRALQTVLVALSQWADDYLFDPDEPATRLIDRQQRQPLRKLVLQAADGRELAPADITIAIPLND

SEQ ID NO: 7498 - protein, 99 aa, Klebsiella pneumoniae
VTEKYCLIAVLRLSVEEGDYPVRQRQREMTLHKKNHITRTLLAVSMLAMSGGALAAQVPPGTQLAEKQELVRNNGSEPASLDPHKVESDVEFNIISDLF

SEQ ID NO: 7499 - protein, 135 aa, Klebsiella pneumoniae
PRRNVMPKQVIIPPGTTAPIAPFVPGTLADGVVYVSGTLPFDKQNNVVHIGDPKAQTRHVLETIRSVIETAGGSMADVTFNSIFITDWTNYAAINEVYAEFFPGDKPARFCIQCGLVKPDALVEIASVAHIGTPT

SEQ ID NO: 7500 - protein, 176 aa, Klebsiella pneumoniae
SILNSRNNGTVGPYSIFAGWANFPATEPYVATPGIFGVSPAKERTRRAKKGLVDEYQSLLRMSMNVELHTEQGVKIIVPLVRRLDASVVQAFKQQVLEAIDPDTKNVLLDLSHVDFIDSSCLGALVSILKSVNGQGELALCSLNDTIKNLFKLTRMDRIFAIKETRQDALNAFTSL

SEQ ID NO: 7501 - protein, 62 aa, Klebsiella pneumoniae
QIMKRSEIRKAIESWFDIERYDAIEQLTLQQFYVEIERRILAYRMLLSRNTIPTLNRLLLDD

SEQ ID NO: 7502 - protein, 1079 aa, Klebsiella pneumoniae
VTMKRMLINATQQEELRVALVDGQRLYDLDIESPGHEQKKANIYKGKITRIEPSLEAAFVDYGAERHGFLPLKEIAREYFPANYNAHGRPNIKDVLREGQEVIVQIDKEERGNKGAALTTFISLAGSYLVLMPNNPRAGGISRRIEGDDRTELKEALASLELPDGMGLIVRTAGVGKSAEALQWDLSFRLKHWEAIQKAAESRPAPFLIHQESNVIVRAFRDYLRQDIGEILIDNPKVLELARQHIAALGRPDFSSKIKLYTGEIPLFSHYQIESQIESAFQREVRLPSGGSIVIDSTEALTAIDINSARATRGGDIEETAFNTNLEAADEIARQLRLRDLGGLIVIDFIDMTPVRHQRAVENRLREAVRQDRARIQISHISRFGLLEMSRQRLSPSLGESSHHVCPRCSGTGTVRDNESLSLSILRLIEEEALKENTKEVHAIVPVPIASYLLNEKRAAVSAIESRQGDVRVIIVPNDEMQTPHYSVLRVRKGEETSTLSYLLPKLHEEEMALPGDDEPAERKRPEQPALAAFVMPDAPPAPMLEEPAAAPVAAAAPVAAAAPAQPGLLSRFFSALKNIFSGAEEAKPAEVQVEKKAEEKPERQQERRKPRANNRRDRNDRRDNRDNRDNRDNRDNRDTRADNAEGREPRESREENRRNRREKPSQNVEARDVRQTSGDDAEKAKSRDEQQPRRERTRRRSDDKRQAQQEAKAQTREEPVVQETEQEERVQTLPRRKPRQLAQKVRVESAVVEPVAEIVPEAVVAEVIAPHSEPVKAELPAGVESVADQDENGESREANGMPRRSRRSPRHLRVSGQRRRRYRDERYPTQSPMPLTVACASPEMASGKVWIRYPVVRPQDQQPEEVQVQDASVAKTVEAVAAPVAVVETVTAAPVTVEPATMEPVTAEPVVVEPVAAAEPLFVDAAEVVAPAAVEPAPQEPVTEAPAVEAPQAIAPVTLDAEPVVVEPEAVETTPVVAAPVETIAPVAETVEQAPVTEAAPAEPVKAEPPVSKPVVVAGHRHATAPMTRAPAPDYVPEAPRHSTWVRPPFAFEGKGAAGGHSATHKATAEPTRPQPVE

SEQ ID NO: 7503 - protein, 98 aa, Klebsiella pneumoniae
GGIDSLPGGTARGRTTWRVGSGSPGEALLPTPGMSAVPHAKKKPVLAYELFLKYGGEGGIRTPDTLPYTHFPGVLLQPLGHLTILSCCSPWVGNGALL

SEQ ID NO: 7504 - protein, 310 aa, Klebsiella pneumoniae
YGYEMTHLPKFSPALLHPRYWLLWLGIGLLWLVVQLPYPLIYRLGNAIGRLAMRFMKRRAKIAYRNLELCFPDKSEQERHRMVVMNFESVGMGLMETGMAWFWPVRRIARWTDTIGFEHIRDVQAQQRGILLIGIHFLTLEMGARMFGMNEPGIGVYRPNDNPVIDWLQTWGRLRSNKDMIDRKDLKGMIRALKKGEVVWYAPDHDYGPTASVFAPLFAVDQAATTSGTWMLAKMSKACIVPFVPRRKPDGKGYELIILPPECSPPLDDAETTAAWMNKIVEQCIMMAPEQYMWLHRRFKTRPEGMPSRY

SEQ ID NO: 7505 - protein, 277 aa, Klebsiella pneumoniae
PTSEKESFMFLINGVVQDTLAANDRATQFGDGCFTTARIQQGQVALLDAHLQRLQTTCEKLHIPFNDWLTLSEEMQRLARPHAQGVLKVTLTRGVGGRGYSTAGCVSPTRILSFSPFPAHYARWREEGITLTQSPVPLGRNSWLAGLKHLNRLEQVLIRSHLEQTDADEALVLDSDGWLTECCAANLFWRQGRDVFTPRLDYAGVNGIMRQRCIAQLAPSTFRVVEVTARPETLREADEVLICNALMPLVPVRRWEETTWSSRELYHFLAPLCELSG

SEQ ID NO: 7506 - protein, 174 aa, Klebsiella pneumoniae
LCGDADAVYLPFFVLGAQTFINPRLKAMFTTPSPWCCAAALLGFIAYRLNQQYGSGDGWMYETESVITMVLGLWMVNVVFSLGHRLLNFQSARVTYFVNASLFIYLVHHPLTLLYGAWITPAIKSNTLGFIGGLVFVVGIALILYEIHLRIPLLRFLFSGKPMNKPAKTPASAS

SEQ ID NO: 7507 - protein, 342 aa, Klebsiella pneumoniae
CRVDVNENGRANGGRPRVFSSVEEQGALAFAAANKAMHVVGMGIVNQHAHGGVRIERVARLPVLRLSFQPRQELVSDALLEQQTGPGDAHLSLVVEDAAGGGANRLLQIRAIGEDNVGALAARFQPHALHIAVAGVFQQLLAGAGGAGEGDDFNIRMQGQLLPGLVAKAADHVQHAVRQAGLFRQPGQTQGGERRFFRGFEDYAIARRQRRAEFPAGQQQREVPRHHRGDHANWFANDHRQLVAAGGGHFAIDFIQRFGIPANGAGGAGNIVAQAVANRFAGIQRFQQRQLFTMGLHQISKASEDRFTLCGGGLRPVAVIKSLARGFHRPFDVGFFTAGDLG

SEQ ID NO: 7508 - protein, 257 aa, Klebsiella pneumoniae
SPADGAVAEASPGQFEINLHHTDNVLDACDDALALKRLVRLMAEKHKMHATFMAKPYEEHAGSGMHIHISMLNNKGENVLVDGDGEDSALLKRALAGMIDLMPASMALLAPNVNSYRRFQPGMYVPTQASWGHNNRTVALRIPCGERQNHRVEYRVAGADANPYLVMAAIFAGILHGLDNPQLPLQEEVEGNGLEQEGLPFPIRQSDALWEFMQNDHLRERLGERFCHVFHACKHDELLQFERLITETEIEWMLKNA

SEQ ID NO: 7509 - protein, 95 aa, Klebsiella pneumoniae
CFGLFVISDGAKTIRGVDVMGERFPATLAFESYRYLCIASNNGETLVIDSERHAAFHIAVHADYRIGYTFNLIAGIDAFVIKAFLSRAYRIKSQG

SEQ ID NO: 7510 - protein, 469 aa, Klebsiella pneumoniae
LPGLLRFSGIKLRRRFAEASGQISQVQQTKRRPHQAERQGGGLEIDPQYPDRQRPDHRQQQIMQSILPGFVVPLAPPEVVEHRQVNEGEGHQRAEINQRGGGHQVEEQRRQRNDAHHNHVQRRGTPFRMHIAKNALREDVVAAHHVQQTGDAGMGGQAGRQGVNKGGAQENRLEQLAAHVQRNLRQRGIGVFKAMNIREEQLHKERRDDKDNAAVHRGEKNCLRDHPRGVRGLFRQGGHRVETEKREADNGRAGNNRDQMRILADKRLQRPDGTHPLAFMQPLHHQNDKHHHDRNLHQHEQGIEVGHQVNAFQVRGGQNSDKGHYPHPRRHFGEQGREIDLRQQDVDHRQKQIIQQRRPANHKADVRTDGFLRVGIGGTGFRKLTHQFAVADGGEQHASQRQQIRRRNVAIADAGDDAEGIKHRHWRQIGQPHHHHLPEFEGFTQTRSARLSGVMRRRINSHRPSPPCC

SEQ ID NO: 7511 - protein, 533 aa, Klebsiella pneumoniae
NRSDRFKHTKGEVLTYMKHKPQMMKMRWLSAALMLSLCTSSAWAFSIDDVAKEAKTLAGKGYEAPKSNLPSAFRDMKYADYQQIQFNHDKAYWNNQKTPFKLEFYHQGMYFDTPVTINEVTATSVRKIKYSPDYFNFGNVQHDKDTVKDLGFAGFKVLYPINSKDKNDEIVSMLGASYFRVLGQGQVYGLSARGLAIDTALPSGEEFPRFREFWIERPKATDKRLTIYALLDSPRATGAYRFVIMPGRDTVVDVQSKVYLRDKVGKLGVAPLTSMFLFGSNQPSPALNYRPALHDSNGLSILAGNGEWIWRPLNNPKHLAVSSYAMENPQGFGLLQRGRQFSRFEDLDDRYDLRPSAWITPKGEWGKGKIELVEIPTNDETNDNIVTYWTPDQLPEPGKEMNFKYTITFSRDEDKLHAPDNAYVMQTRRSTGDVKQSNLIRQPDGTIAFIVDFTGADMKKLPADTPVAAQASTGDNAEIVENTVRYNPVTKGWRMILRLKVKDPKKTTEMRAALVNGDDTLSETWSYQLPANE

SEQ ID NO: 7512 - protein, 421 aa, Klebsiella pneumoniae
MTKDEGMKKRLLAAAVTGAVMLSAGAQAQDKAAPEGYQLQQVLIMSRHNLRAPLANNGSVLEQSTAKAWPQWDVPGGQLTTKGGVLEVYMGHYMREWLAQQKLVTSGECPPENAVYAYANSLQRTVATAQFFITGAFPGCGIPVHHQPQMGTMDPTFNPVITDDSPAFREKALQAMEKERQGMQLTESYKLLETMIDYRNSPSCKEKKVCSLSEGKDTFSAGYQQEPGVSGPLKVGNSLVDAFTLQYYEGFPKDQVAWGEIASDKQWRVLSKLKNGYQDSLFTSVAVAQNVAKPLVKYIDNALVGEGASKAKVTLLVGHDSNIASLLTALDFKPYQLPGQYERTPIGGKLLFQRWHDSAGNRDLMKIEYVYQSTEQLRNADALTLQAPPQRVTLALNGCPVDDQGFCPLETFKMVINEAAK

SEQ ID NO: 7513 - protein, 104 aa, Klebsiella pneumoniae
TKKEIKMNIFKNKSTEIFYVVSLHIYAELFNSKDKTTSNMIITHVMDHEFVSKLIDLAMRNAEKHLLKKAWKKNADEKLSEVDFKEVKQALAKMHYTVLAESIC

SEQ ID NO: 7514 - protein, 118 aa, Klebsiella pneumoniae
RQEDVMDFNIVAVTACVSGVAHTYMAAERLEKVGHHEKWHLKVETQGALGVENRITAEDIARAEVVLLVTDIEIDDPHRFRGLRTIKTSIKSFLLQPQQIVEAVKSIMKKPVVYVELP

SEQ ID NO: 7515 - protein, 402 aa, Klebsiella pneumoniae
LTICLTGIVWSKDLCSGYITSKWTECEMEKIKYWLIAGFIILLAIVYTAISDRYSTLSRLKSAGENGDVEAQYALGLMYLYGEILDVDYQQAKIWYEKAATQNDPRAQVKLGLMYANGLGVNQDYQQAKSWYEKASVQNDVDAQFLLGEMYNDGLGVGQDYQQAKMWYEKAAAQNDERAQVNLAVLYAKGNGVEQDYRQAKSWYEKAAAQNSPDAQFAIGILYANANGVEQDYQQAKDWYEKAAEQNFANAQFNLGMFYYKGEGVNQNFQQAREWFEKAASQNQLNAQYNLGQIYYYGQGVTQSYRKAKEWFEKAAGEGHVDAQYNLGVIYENGEGVGQDFHQARAWYEKAASQNDAQAQFDLGVMNELGQGGSINLKQARTWFGLACNNGHKEGCERYENN

SEQ ID NO: 7516 - protein, 114 aa, Klebsiella pneumoniae
LTDWKEQIMTHIIAVTACPSGVAHTYMAAESLESAAKAKGWQVKVETQGSIGIENELTAEEIAAADMVILTKDIGIKFEERFAGKTIVRVNISDAVKRADAIMNKIYSHLSQSA

SEQ ID NO: 7517 - protein, 193 aa, Klebsiella pneumoniae
LKGCAPCARRRASWSCAMSRPGYLRRAAGGKKASALASLHEQLRDKGMQKDYLALVRAQWQSHTKVFQPPLLKNILQSGERIVRVSQEGKPSETRFKVEERYEFATLVRCSPVTGRTHQIRVHTQYAGHPIAFDDRYGDREFDKQLSATGLNRLFLHAAALKFTHPGSGEVMRVEAPLDNQLKHCLQVLRKSK

SEQ ID NO: 7518 - protein, 418 aa, Klebsiella pneumoniae
LPGWRRTAPYPGYPLAVVGSPGKRSATGEPVLADGHQAGVTACRRGVNAQRTLDIQPLQQQIGFAAGEALHGDNRPVARRHLLAQLAQLVGIAVVDNRVEGLARQLLRFGKANALADLPRQFLRQIALQGAVRPQYFTTHRQHSRQLDQRILFVIRYAQHALARHQRQGVALAGWPRQQALGAALRLLAVLLAQRLQLRTARGPLLQRLQRFFQQRFQLGVQRTLCILAGEGHANRVLRTAGEQTVQIQRTAGFRTGTGQPFAAERLNADHRANHIAVDVQVAHLGAAGDLGDGFVDTGMHAEGQAVARGVNLLDQFVQLVTVIAHHVQYRAEDLFFQLVEAVELDKRRRHEGPVTPFAGVFAILTHRLVNGAAFGAHRLNMAFDILFRFRIDNRTDIGGQAPRIAHPALAHGAAQHG

SEQ ID NO: 7519 - protein, 216 aa, Klebsiella pneumoniae
RRGCMAQGAVKKSGKRSQAVSAKKEAILAAALEAFSQFGIHGTRLEQVAERAGVSKTNLLYYYPSKEALYVAVLQQILAIWLAPLKAFREDISPLVAIREYIRLKLEVSRDHPQASKLFCLEMLQGAPLLMGELTGDLKALVDEKSAIVSGWIDRGKLAPVDPQHLIFMIWATTQHYADFATQVEAVTGATLQDAAFFEQTVDNVQRMIIEGIRVR

SEQ ID NO: 7520 - protein, 142 aa, Klebsiella pneumoniae
IESCSIHILLRRFAMPKDSMFYATLEEAIDAAREEFLANNPDSDEESANVEQLNIQKYVLQDGDIAWQAEFFADEEEQGECLPMLSGEAAQSVFVGDYDEIELRQEWLEENTLHEWDEGEFQLEPSLDTEEGQTAADEWDER

SEQ ID NO: 7521 - protein, 109 aa, Klebsiella pneumoniae
ANLLSSAYSVSEKEMIMASICTMAWVYGSVQGVGFRYSTQREALQLGVTGYARNLDDGGVEVLACGEAEQVEKLIAWLKAGGPRSARVDRVLTEPHQPTRSWDKFAILY

SEQ ID NO: 7522 - protein, 366 aa, Klebsiella pneumoniae
RATRTVLFDAVLISPTQPHRPRRRHLPAVFLSVGGCAPAGRIAHWSPVNRHGCLMSSLKFSVSRQEALLIMITMFWGGTFLAVQYAVSLSGPLFFVGLRFATAALAVGLLSLRTLRGLTWLEVKAGVAIGVAIALGYGLQTWGLQTISSSKSAFITAMYVPLVPLLQWLCLGRMPGVMSCVGIVLAFIGLILLAGPENNLLALGVGEMITLASAVAIAAEIILISAWAGKVDVRRVTVVQLATASLVAFAAMKPAGESVPSLTPALLGVALGLGIFSAIIQVTMNWAQRSVSPTRATLIYTGEPVWAGIFGRLAGERLPLLALLGCVLILAGVLVSELKWKRKSPPQVSTNDDAQPLTDLADRREP

SEQ ID NO: 7523 - protein, 397 aa, Klebsiella pneumoniae
NWHRLCFTFSARWSRERQDAAPSQPIFHDCREVGMKIGVFVPIGNNGWLISTHAPQYMPTFELNKAIVQKAEHYHFDFALSMIKLRGFGGKTEFWDHNLESFTLMAGLAAVTSKIQIYATAATLTLPPAIVARMASTIDSISGGRFGVNLVTGWQKPEYDQMGMWPGDDYFASRYDYLTEYVQVLRDLWGTGRSDFKGDYFTMNDCRVSPRPSQPMKVICAGQSDAGMAFSAQHADYNFCFGKGVNTPTAFAPTAARMMQAAEKTGRDVGSYVLFMVIADETDEAARAKWEHYKAGADEEALAWLTEQSQKDTRSGSDTNVRQMADPTSAVNINMGTLVGSYASVARMLDEVASVPGTDGVLLTFDDFLAGIDAFGERIQPLMRCRNHIASVTREVA

SEQ ID NO: 7524 - protein, 220 aa, Klebsiella pneumoniae
LMDRIITSSRDRSSLLSTHKVLRNTYFLLSLTLAFSAITATASTVLMLPSPGLILTLVGMYGLMFLTYKTANKPTGIISAFAFTGFLGYILGPMLNAYLSAGMGDLIGLALGGTALVFFCCSAYVLTTRKDMSFLGGMLMAGVVVVLIGMVANLFLQLPALHLAISAVFILISSGAILFETSNIIRGGETNYIRATVSLYVSLYNIFVSLLSILGFASRD

SEQ ID NO: 7525 - protein, 540 aa, Klebsiella pneumoniae
IHFRSRSPGPGKLPFMLMLVRSQAESRPGAQLGRRLRTSEPGNEIRAGHQPVPAVRQHAHHQVAILDGPGTDADRHINALPDHIHPAVGRLKMQRYPRIARHKSRQHRSDMDMQQGDRTGDPDATARLGAQRLDRLLRRLGLNQHRFAMLIKGLPDLGDRELTGGSLNQTHAQPLLELRNAAAEFGFRLVKRSPRRGETAMVYHLDKPGEVIEILHPSSIVPFLEQYRSFLLTTAYVVPDISLFTSDTDTQEKAMKQITGVYTAPAQHWVGDGFPVRSMFSYQTHGQQLSPFLLLDYAGPYTFPAGSEKRGVGEHPHRGFETVTIVYAGEVEHRDSTGRGGVIGPGDVQWMTAGAGILHEEFHSEAFTRSGGELKMIQLWVNLPAKDKMAPPGYQSITAGTIPTVALANGAGQVRVIAGQYDDVSGPAHTFSPLNVWDLQLNQGHDLTLRQPEGWSTALVVLEGEVIINGSESAREGQLAVLSQAGDAVHLEATAPAKVLLMAGEPLQEPIVGYGPFVMNNKTQIAEAVRDFNSGRFGQI

SEQ ID NO: 7526 - protein, 200 aa, Klebsiella pneumoniae
SCSRRRECPSLGRKPYPHAMPTGGEMAVKPEVILGDITTLDVDVIVNAANPSLLGGGGVDGAIHRAAGPALLAACKQVLQQQGECPPGHAVITIAGNLPASAVIHTVGPVWHGGDRMEAQTLADAYKNSLQLASANNYRSIAFPAISTGVYGYPKEEAAAIAVRTVTAFLTRYNPLERVLFVCFDEETVAIYRRLLESYP

SEQ ID NO: 7527 - protein, 447 aa, Klebsiella pneumoniae
PLTRDIIMALFDFPRWKLTSPAAESGVVAPDERLSAGQTLVMGVQHAVAMFGATVLMPLLMGLDPNLSILMSGVGTLLFFVVTGGRVPSYLGSSAAFVGVVIAITGFNGQGLNPHLSVALGGIIACGLVYTLIGLVVMKIGTRWIERLMPPVVTGAVVMAIGLNLAPIAVRSVSASAFDSWMAVLTVLCIGIVAVFTRGMLQRLLILVGLIVACALYALLANGLGLGKPLDFSPLAQAAWFGLPHFTTPSFNGQAMMLIAPVAVILVAENLGHLKAVAGMTGRNMDPYMGRAFVGDGLATMLSGSVGGSGVTTYAENIGVMAVTKVYSTLVFVAAALIAMLLGFSPKFGALIHTIPGPVIGGASIVVFGLIAVAGARIWVQNRVDLSQNSNLIMVSVTLVLGAGDFALSLGGFTLGGIGTATFGAILLHALLHRGTREAKEARVTPV

SEQ ID NO: 7528 - protein, 64 aa, Klebsiella pneumoniae
GASRRISWGITTPKTCTLKNTHPPAAMGVDFLCKLPEIQTNNTKLFVFKAVDQNDALQHPPRCL

SEQ ID NO: 7529 - protein, 448 aa, Klebsiella pneumoniae
IAARTGKIHRTENHLDCPGVLIMTEHTTSYYAASANKYEPFPTLEGSINCDVCVVGGGYTGLSSALHLAEMGYDVVVLEGARIGFGASGRNGGQLVNSYSRDIDVIEKNYGPDAAKMLGSMMFEGGDIIRERIQRYQIQCDYRPGGLFVAMNHKQLETLEEQKANWERYGNTQLELLDREAIRREVDSDRYVGALLDHSGGHIHPLNLAIGEADAIRLNGGRVYEQSPVTRIQHTSPAVVSTARGQVTARYVIVAGNAYLGDKLEPELAKRSMPCGTQVVTTAPLSEEVARSLIPKNYCVEDCNYLLDYYRLTGDNRLLYGGGVVYGARDPDDVERLIMPKLLKTFPQLQGVKIDYRWTGNFLLTLSRMPQFGRLDNNIYYMQGYSGHGVTCTHLAGRLISELLRGDAERFDAFAKLPHYPFPGGRSLRIPFTAMGAAYYSLRDRLGV

SEQ ID NO: 7530 - protein, 451 aa, Klebsiella pneumoniae
LHQRPPGVSEHLQAVIRPPEFYLFFVPQESIFPPWRTNVSKRRVVVTGLGMLSPVGNTVESTWKALLAGQSGISLIDHFDTSAYATKFAGLVKDFNCDDIISRKEQRKMDAFIQYGIVAGVQAMQDSGLEVTEENATRIGAAIGSGIGGLGLIEENHSSLVNGGPRKISPFFVPSTIVNMVAGHLTIMFGLRGPSISIATACTSGVHNIGQAARIIAYGDADAMVAGGAEKASTPLGVGGFGAARALSTRNDNPQAASRPWDKDRDGFVLGDGAGMVVLEEYEHAKKRGAKIYAEIVGFGMSSDAYHMTSPPEDGAGAALAMVNAIRDAGIEPGQIGYVNAHGTSTPAGDKAEAQAVKSVFGDAASRVLVSSTKSMTGHLLGAAGAVESIYSILALRDQAVPPTINLDNPDEGCDLDFVPHEARQVSGMEYTLCNSFGFGGTNGSLIFKKV

SEQ ID NO: 7531 - protein, 296 aa, Klebsiella pneumoniae
TGALLHSVRTGEARCASGNRQRRPYRDPDMMRLNIAPAPWSGAPVVVLSAGLGGGGGYWLAQRAALEEQYQLVSYDHNGTGENAGPLPADYSLATMAGELFSALQAAGIARFALVGHALGALIGLQLALDRPEAVSALALVNGWLSLSPHTRRCFQVRERLLHAGGAQAWVEAQPLFLYPAEWMAARLPRLEAEDALAISHFQGKENLLKRLQALKQADFSRRASAIACPTLIISAADDLLVPASCSRVLQTAIPGSQLVEMPWGGHACNVTDADTFNTILRDGLSAMLPVARETR

SEQ ID NO: 7532 - protein, 309 aa, Klebsiella pneumoniae
STKRMEISGKTTKKPSTTSMLSTNRKYLPRLLACETRDISPPGKNRDKRGYSAGNLLLFPAPLRQYFFIKKQDRLSLFIEKRRWRRKWYVAVFTLSCRKGIVMKARVKSGGLKKEMFGYRSNVPKVRLTTDRLVVRLVHDRDAWRLADYYAENKAFLKPWEPVRDDSHCYPSGWQARLSMIAEFHKQGSAFYFALLDPEEKEIIGVANFSNVVRGSFHACYLGYSIGEKWQGQGLMFEALTSAIRYMQRTQHIHRIMANYMPHNQRSGALLARLGFEKEGYAKDYLLIDGQWRDHVLTALTTPDWSAGR

SEQ ID NO: 7533 - protein, 127 aa, Klebsiella pneumoniae
IGERRESGGNCMSFEAKKEHAIAIMESKKMWRSNYAPPLLRLAWKAGLKIPPLPFATFWQITLLMGGWFGPAWGICMWFSSWKDSGMQPGVAFVSSIVAGICFGVLMAAYHWWRKVVNNLPDWDSLE

SEQ ID NO: 7534 - protein, 229 aa, Klebsiella pneumoniae
HTWRTQASFARQAQVSVSAQNAGASAHSAGADSHTLFSHPNEEQTMKTGIRMAVAMVTAVSSGAMAAPFSVSSNDMRDGQPLAQQHWFAGFGCTGGNVSPQLAWKNAPAGTRSFAVTVRDPDAPTGSGWWHWTVVNIASSVFSLPAGAGDKNSATLPGGAIQGRNDFGYAGFGGACPPAGDKPHRYRFTVWALDVPTLPVDAGASGALVGYLLHSHALASAQLTAMAGR

SEQ ID NO: 7535 - protein, 376 aa, Klebsiella pneumoniae
IKQLCYIMPAVYFLISMSSRYTMPVLHNRISNETLKAQMLAETEPRTTISFYKYFTIVDPQATRDALWVALTQLKVFGRIYLAREGINAQISVPQSNVEALREFLYGFDPALAGLRFNIAVEDDGKSFWVLRLKVRHRIVADGIDDPSFDASNVGEYLKAAEVNAMLDDPDAVFIDMRNHYEYEVGHFENALEIPADTFRDQLPKAVEMMQDHKDKKIVMYCTGGIRCEKASAWMKHNGFNKVWHIEGGIIEYARRAREQGLPVRFIGKNFVFDERMGERISNDVIAHCHQCGAPCDTHTNCLNDGCHLLFIQCPSCAEKFAGCCSEACMEEHKLPEEEQRKLRAGRENGNKIFNKSRGRLNTKLGILDPEPSEKP

SEQ ID NO: 7536 - protein, 170 aa, Klebsiella pneumoniae
TMFSSAHANRSAQASAPAGHYAHRSGEQNTNGLISEIVYCEDQPMMTQLLLLPLLQQLGQQSRWQLWLTPQQKLSREWVQSAGLPLSKVMQISQLSPSHTIDSMIRALRTGNYSVVICWLAEELTADEHERLVNAAQVGSAMGFIMRPERNQGTLGRQLSGLKIHSNLYH

SEQ ID NO: 7537 - protein, 269 aa, Klebsiella pneumoniae
TRYSGHNLVHFVRAIMENIMYKPVIGVVMCRNRLKGHQTQTLQEKYLNAIVNAGGLPIALPHALAEPELLNAVVDKLDGIYLPGSPSNVQPHLYGENGDEPDADPGRDLLSMALINAALERRIPIFAICRGLQELVVATGGTLYRRLFEQPELLEHREDPELPVEQQYAPSHQVEVQEGGLLSQLIPGCNTFWVNSLHGQGAKTLSPQLRVEARAPDGLVEAVSVNDHPFALGVQWHPEWNSSEYALSRMLFDGFITACQGHHAEKRRR

SEQ ID NO: 7538 - protein, 416 aa, Klebsiella pneumoniae
GKNSQVGSSTRLPVVALAGGLLHSSQPLKWARGHKKNPPKRVFFIGYNLSRRLSYNFFVAFNFDLYTTIRSQAIDQGSASFHVVTGVASNRVGFTHAASGDFASRDAFSNQVVNNGLSTFLRQLLVVSFGTDAVGVAQNNSGTVFRIHVAQLSVQLIQSLLTFRFQGSFVEVEQNVRLQGEVLGSHFRSRSRSRSNNRCSIFLTEAVGNAQAQHAVIRTGTHGARVADVVNPLVFQTGSDVTSNSPLYAASKYWGNASVVFATGNAGRSVVAFGVSAPNHAAQTGVDVQIVSDRVTQFSGQLNALSFESTVVNAAFICHTAQPVITHFETEVRVNLVTTERTSTKLIVTGRTVVVLETVTVETGVVILGPTQFTTCIPGVIFRSGLRYGSEASQCHCNRDSCLFHFLRLIIIQNSP

SEQ ID NO: 7539 - protein, 86 aa, Klebsiella pneumoniae
TARLIFCRRSTMPTQEAKAHRVGEWASLRNTSPEIAEAIFEVAHYDEKLAEQIWEEGSDEVLALAFAKTDKDSLFWGEQTIERKNV

SEQ ID NO: 7540 - protein, 219 aa, Klebsiella pneumoniae
KYLRKKMRSNYIVIEGLEGAGKTTARQLVVETLQSAGIHDMVFTREPLGTILAEKLRSLVLDIQSTGDEVINDKAEVLMFYAARVQLVETVIKPALARGQWVIGDRHDLSTQAYQGGGRGIDRTMLATLRDAVLGDFRPNLTLYLDVTPEVGLQRARARGELDRIEQESMNFFNRTRARYLELAAADPSIRTVDATQPLDAVARDIRATIAQWMAEQAA

SEQ ID NO: 7541 - protein, 508 aa, Klebsiella pneumoniae
KFWRLCMAISTPMLVTFIVYIFGMVLIGFIAWRSTKNFDDYILGGRSLGPFVTALSAGASDMSGWLLMGLPGAIFLSGISESWIAIGLTLGAWINWKLVAGRLRVHTEVNNNALTLPDYFTGRFEDKSRVLRIISALVILLFFTIYCASGIVAGARLFESTFGMSYETALWAGAAATIIYTFVGGFLAVSWTDTVQASLMIFALILTPVIVIISVGGFGDSLEVIKQKSIENIDMLKGLNFVAIISLMGWGLGYFGQPHILARFMAADSHHSIVHARRISMTWMILCLGGAVAVGFFGIAYFNNNPSLAGAVNQNAERVFIELAQILFNPWIAGILLSAILAAVMSTLSCQLLVCSSAITEDLYKAFLRKNAGQKELVWVGRMMVLVVALVAIALAANPENRVLGLVSYAWAGFGAAFGPVVLFSVMWSRMTRNGALAGMVIGALTVIVWKQFGWLGLYEIIPGFVFGSIGIVVFSLLDKAPSASMQQRFAEADAHYHTPPPVRATAE

SEQ ID NO: 7542 - protein, 125 aa, Klebsiella pneumoniae
VISGGWWVENSKSCCRILLFALLKDLPHVRDNNLVFPAPRGGQLSDMSLLAVLKRMNHSGLTQHGFRSTFRDWDDVTTDHQREVIEHALAHQLADKAEAAYQRGTLWPKRVALMDEWSGYCLAMF

SEQ ID NO: 7543 - protein, 68 aa, Klebsiella pneumoniae
APPGKHEYSLYEAHVSFFKLHDATGKPLQIQPFRVGCDHRVVGSLTELFYKLYITPGINCGIGDDFLK

SEQ ID NO: 7544 - protein, 852 aa, Klebsiella pneumoniae
AKPGAISCLPMNKITKYIDALPLSDAEKSALPDTSLQAVHQALDDDHQTFAREDDSPLGSVKARLAHSWPDSLSGDQLVKDDEGRTQLHAMPKAKRSSMIPDPWRTNPVGRFWDRLRGRDVTPRYLSRLTQEERESEQKWRTVGTIRRYILLLLTLSQTVVATWYMKTILPYQGWALINPADMVGQNLWISFMQLLPYVLQSGILILFAVLFCWVSAGFWTALMGFLQLLIGRDKYSISASTVGDEPLNPAHRTALIMPICNEDVDRVFAGLRATWESVKATGNAAHFDVYILSDSYNPDICVAEQKAWMELIAEVQGEGQIFYRRRRRRVKRKSGNIDDFCRRWGSQYSYMVVLDADSVMTGECLSSLVRLMEANPNAGIIQSSPRASGMDTLYARCQQFATRVYGPLFTAGLHFWQLGESHYWGHNAIIRVKPFIEHCALAPLPGEGNFAGSILSHDFVEAALMRRAGWGVWIAYDLPGSYEELPPNLLDELKRDRRWCQGNLMNFRLFLVRGMHPVHRAVFLTGVMSYLSAPLWFMFLALSTALQVVHALTEPQYFLQPRQLFPVWPQWRSELAIALFASTMVLLFLPKLLSIILVWCKGPKEYGGFIRVTLSLLLEVLFSVLLAPVRMLFHTVFVVSAFLGWEVVWNSPQRDDDSTPWGEAFMRHGSQLLLGLVWAVGMAWLDLRFLFWLAPIVVSLILSPFVSAISSRATVGLRTKRWKLFLIPEEYSPPQVLKDTDAYLTMNRQRSLDDGFMHAVFNPSFNALATAMATARHRQGHILEIARERHVEQALNETPDKLNRDRRLVLLSDPVTMSRLHYRVWAAPEKYSSWVNAYQQLALNPLALKTK

SEQ ID NO: 7545 - protein, 843 aa, Klebsiella pneumoniae
GNNGLLWRKAMALVIEFTCDLPNGVHARPASLVETLCNRFSSAIEWRNLRRGTGGNAKSALAIIGSNTLKGDACQLLISGEDEAEAFAAITAFMRDEFPHCDAPLPAAPTLDVQPVPESLSRLNPTLFHAHPVCAGSAGGTLVHLKSRDLHELGELPVAVSPEQEQAALDNGLRLLVKDIELRLLDNDGTASAILEAHRSLATDASLRQHLLGGILTGLSCAQAIVATGDHFCAQFRDSGNSYLQERVLDVRDVCFQLLQHIYGEARFPAPGQLREAAICLADELTPSQFLELDKTHLKGLLLRSGGTTSHTVILARSFNIPTLVGVDLAALLPWVDTQVQIDGNAGLLVVDPSPAVARYYQQEAWLQAQIRQQQQVWLDKAGQTQDGIRVEIAANIAHSVEAVAAFNQGAQSVGLFRTEMLYMDRPSAPSEDELYNIFCQALEPAAGRSIIVRTMDIGGDKPVAYLSIPAENNPFLGYRAVRIYEEYQALFHTQLRAILRASAHGSLKIMIPMISSMEEILWVKERLAEAKQSLRVEQIPFDEKIPLGIMLEVPSVMFIIDQCCEEVDFFSIGSNDLTQYLLAVDRDNAKVTRHYNSLNPAFLRALDYAVQAVHRQGKWIGLCGELGAKGSVLPLLVGLGLDELSMSAPAIPATKSRLAQLDSRACRQLLNQAMQCRTSLEVEHLLAQFRMRQQDVPLVSAECITLNSDWRSKEEVLKGMTDNLLLAGRCRYPRKLEADLWAREAVFSTGLGFSFAIPHSKSEHIEQSTISVARLAQPVIWGDEEAQFVIMLTLNKHSAGDQHMRIFSRLARRIMHAEFRQSLVSAESSEAIATLLQRELEL

SEQ ID NO: 7546 - protein, 204 aa, Klebsiella pneumoniae
WVAGGSRVSEGKVQQKQQARRAEIVVAAQKCFAEKGLHGASVADIAREAGLSVGQLYRIFASKEAIIEAIVSEIVNARVGEMIDENHNLARKAAVLAGRIPTSAATKSDNYLLMEINAEASRNPRLREILMQADRRLKEEGGRLSQRYHPGLSDARRNAASELIAVLTEGAAYRCELSASTPVDKADLEALYNMIFDRLFDEQA

SEQ ID NO: 7547 - protein, 83 aa, Klebsiella pneumoniae
SIKGQCMKIEFNTTEQFISEAADSYNRYMNKRLRNQPVHFYHLLKNKGDMNEVIENIIDKTKSRFYGAEGEQKSNGSPGALTM

SEQ ID NO: 7548 - protein, 205 aa, Klebsiella pneumoniae
CNRGVMEMAKILVLYYSMYGHIETMAHAVADGANRVDGVEVVVKRVPETMQAEAFAKAGGKTQNAPVATPQELAEYDAIIFGTPTRFGNMSGQMRTFLDQTGGLWASGALYGKIASVFSSTGTGGGQEQTITSTWTTLAHHGMIIVPIGYGAQELFDISQVRGGTPYGATTIAGGDGSRQPSEEELAIARYQGEHVAKLAVKLHG

SEQ ID NO: 7549 - protein, 78 aa, Klebsiella pneumoniae
NKRGQTMKENTENNVKRFIRVPDVLNRVGFSRTTLYERIKEGNFPDRVKIGPRCVAFVESEIDEWIEATIRNSRQNAA

SEQ ID NO: 7550 - protein, 108 aa, Klebsiella pneumoniae
DLPGFSCKFFNMLYTTKTIAKASFDRKFKSMSTIEERVKKIIGEQLGVKQEEVTNNASFVEDLGADSLDTVELVMALEEEFDTEIPDEEAEKITTVQAAIDYINGHQA

SEQ ID NO: 7551 - protein, 393 aa, Klebsiella pneumoniae
IFAGASVMKLSEDSPGNWGITEPGSDDTLTRLTLALDVMGGDFGPSVTVPAALQALNSNSQLTLLLVGDPDAITPLLAKADFEQRSRLQIIPAQSVIASDARPAQAIRSSRGSSMRVALELVKEGRAQACVSAGNTGALMGLAKLLLKPIEGIERPALVTVLPHQQKGKTVVLDLGANVDCDSTMLVQFAVMGAVLAEEVVGIANPRVALLNIGEEEMKGLGSIRDAAAVLKTLPSLNYIGYLEANELLTGKTDVLVCDGFTGNVTLKTMEGVVRMFLSLLKSQGEGKKRSWWLLLLKRWLQKSLARRFSHLNPDQYNGACLLGLRGSVIKSHGAANQRAFSVAIEQAVQAVQRQIPQRIAARLESLYPAGFELPESDSDVNARQQSGTNGHD

SEQ ID NO: 7552 - protein, 342 aa, Klebsiella pneumoniae
MRWGYFSLNAAGAVAGLVVKRLYVARIGKRKMKRQERIDRIELMRTYIRIVEAGSLSAAAGQMDTTQATVSRRLQSLEGLLGVKLILRTTHAMKLTDDGERCYRHARQVVDAWLALEDDLRIADDRPVGVLRVRAPHAFGQQQLLAPLVAFLQRHPQLSVEWMLNDNTVDFLSDNIDCAIRVGAEVDPATVSVLLAEVPRCVVASPELLAKYPPLTSLEALSGLPWIAINTFYQHEVRLRHQASGQIVSTAITPCLSTDSLYVARNTALAGLGVAMVSSWTVVEDIAAGRLIELFPQWRPASLPVHLVYPWARYYPTRLRKFLDLMREIMPDLAGMQRPQSA

SEQ ID NO: 7553 - protein, 140 aa, Klebsiella pneumoniae
RDRGERRSAARRLQPGDDGRGAVQRSAGGGDRPLRAGGPRPGGADWPAAGARSPRGGERPGAGQRLAVAVAAYPPLLPGARASAACRRRAGVGRSAAAISLPGGMDGRAPAAPRSGRCACHQPFSGQRESAEAAAGPEAG

SEQ ID NO: 7554 - protein, 93 aa, Klebsiella pneumoniae
KPIINRHTVSKARASPGFVVFGHPPGGAALSRATWRVGSGSPGEALLPTPGMSAVPHAKKKPVHAYELFLKYGGEGGLTRFPAVLRVAGLPGG

SEQ ID NO: 7555 - protein, 173 aa, Klebsiella pneumoniae
IAFFRRVSARIRAMNILFAIALTTGILSGIWGWVAVALGLLSWAGFLGCTAYFACPQGGLKGLAISSCTVMSGVAWALVIIHGSALAPQVQILSYMMTGVVAFLMCIQARRTLLSFVPGTFIGACATFAADGDWRLVIPSLALGLVFGYAMKNSGLWLAARADKHKSFANDNA

SEQ ID NO: 7556 - protein, 357 aa, Klebsiella pneumoniae
PRFFICSRKKWQGCNMLELSSISKSFADALVLDNLNLTVAPGSRTAIVGPSGSGKTTLLRILAGFETPDRGRIVMHGKSLFADGVFVPAHQRRIGYVPQEGALFPHLNVADNIAWGLDASREEKRRRVGALMEMVALDAGLASHWPHEISGGQQQRVALARALAQQPALMLLDEPFSALDTGLRASTRKATADLLAETGIASILVTHDQNEALSFATQVAVMRQGRFAQVGTPRTVYSQPVDEETALFLGDALILPARLSPGRASCALGDLATDALHPAGEGRVMLRPEQLSVSVSGPQESTAIIRDVDFSGQLSTLTLSMAGHERPIVLRTVSQPAWQPGAMVRLTVSGKARVFSG

SEQ ID NO: 7557 - protein, 309 aa, Klebsiella pneumoniae
DTAMPELHTPANRPGPVAVARVTLLPALLVIVAVAVGCALVSPPVGTRHEILTNPGLYIDLLALLFLVFMLWSSAKVRMSHIAVNWVRYGLLLWIAGGTFDVMDEIVVQPRWMGYYCEDLLRLSGMLLTVVGVYKIIERINLLYVDARSQSLKDELTQLPNRRFFIDTIREKSGHALGLMILDIDFFKKINDSWGHLVGDEVLFSLGKQLAKLTSEQVQPARIGGEEFAIIVDGLSEPELHALAQSILANARTILINHQTPLSISIGVGTWRPGEAQETFIRKVDEALYKAKHNGRGRVEWAPSAGAAG

SEQ ID NO: 7558 - protein, 194 aa, Klebsiella pneumoniae
TSAMATPASCTAACRACPLMKPACWHKEFTMELTDKTSFRDAMAHVGAAVNIITTDGPAGRAGFTASAVCSVTDTPPTLLVCLNRSASVWPVFSEHHTLCVNTLAAGQEALSTLFGGKTAMDERFAAADWQTGATGCPRLEAALVSFDCRIDQRVSVGTHDILFCHVVAITRHPEPRGLMWFDRGYHTLMRPAC

SEQ ID NO: 7559 - protein, 111 aa, Klebsiella pneumoniae
WNDIIETNLSSDLRLSKAVMRAMMKKRHGRIITIGSVVGTMGNAGQANYAAAKAGLIGFIKSLAREVASRGITVNDVAPGFIDSDMTRALTDEQRAGTLTASPAGAPWHPT

SEQ ID NO: 7560 - protein, 76 aa, Klebsiella pneumoniae
ESVMYKKTLSLLGVALALSAFASQAESERQASRERIVEQVLKPCEGKKAGDKVVITDRRGGEHEAICTLTAVPLPE

SEQ ID NO: 7561 - protein, 81 aa, Klebsiella pneumoniae
KTPIRQRRWALIFCANCLKFRRITQNCLFLRQLIKMMLYSIRRGVYSAPHTGSVAERLKAPVLKTGDPKGFQSSNLCASAI

SEQ ID NO: 7562 - protein, 413 aa, Klebsiella pneumoniae
PHRIYEALNMTPTSLSTRDAGWIIFILALGAGFSVASIYYAQPLLPLMGANLHLTVEGMGLVPTLTQAGYALGILFLLPLGDRHDRRRLILVKSALLALLLLLCSLTGQLSSLLVVSLLIGMAATMAQDIVPAAAILAPAGKQGKMVGTVMTGLLLGILLSRTVSGVVGAVFGWRVMYQAAAVSVALIGLLMWRVLPRFAVHSTLSYPQLMASMAHLWQRYPALRRAALAQGALSIAFSAFWSTLAVMLSEHYHMGSAVAGGFGIAGAAGALAAPLAGGLADKFGAGKVTQMGAALVTLSFALMFMLPLLPVHAQLALIALSAIGFDLGLQSSLVAHQNLVYGLEPQARGRLNALLFTVVFIGMSLGSVLGSKLYVLAGWNGVVTLAVITGALALAIRLLENARILAAERSAS

SEQ ID NO: 7563 - protein, 389 aa, Klebsiella pneumoniae
MHFFSTVLCDALFLMLSHPYCHGPYSAQEQAMNELVQILKNTRQHLMTGVSHMIPFVVSGGILLAVSVMLYGKGAVPDAASDPNLKKLFDIGVAGLTLMVPFLAAYIGYSISDRAALAPCAIGAWVGNSFGAGFFGALIAGMIGGLVVYYLKKIPVHKVLRSVMPIFIIPIVGTFITAGIMMWGLGEPVGALTANLTGWLQGMREGSIVVLAIIMGLMLAFDMGGPVNKVAYAFMLICVSQGVYSVVAIAAVGIAVPPLGMGLATLIGRKYFTAEERETGKAALVMGCVGVTEGAIPFAAADPLRVIPANMIGAASGCVTAALMGAQCYAGWGGLIVLPVVQGKLGFVAALLVGACVSAACVILLKAFAKKKPTNVATDDELDLDFEIN

SEQ ID NO: 7564 - protein, 95 aa, Klebsiella pneumoniae
KLKMAMKTYSIQGAKMIDEFHVMYMYKKIQAEAATTDIKTLEQLLKKFRRVVNERREEYYQEIGEKKARKLKMKRAQRLLEKMVCDRVSPEDLRA

SEQ ID NO: 7565 - protein, 428 aa, Klebsiella pneumoniae
QNRMSCVPTLTRWSMRQSKLTRAASSRGQPVAPVCQSAAAKRSSIAVLPPNSVDRASCPAARVLTHSVWCSLNTGHTEAERFRQTSRVGGVSVTLQTALAVNPARPAGPSVVIMLTAAPTWAMASRKLVLSVNSIVNSLCQQAGFIKGQARQAAVQLAGVAIADVHQQVAFPAVVGKKCRVDFFPVKTRHWPGVEAQRPAGKNQIRRLQGAVAKRGLFRQLRAGGKPAAGVTVGKQGRQPVVEGAIPRHDGGHRRLHGFLQIAAGERRAKFLFAFRAAHEHDARWRTVGGSRPHFHQVPDGLQLRIAHRLIQPAVVGPGLGKQRLAGRVVYRVVHRVSLATGSIADSPSRKMVLKVSASVTLQAWPPHGISTSWLPGIAVCSTREQEAGTSRSSAALIISVGQAMADARREKSACFRACSRFSRFSLP

SEQ ID NO: 7566 - protein, 280 aa, Klebsiella pneumoniae
GQRMIEDLPDILHRLIGQKDHLQVRFPEPDISVPALAFNVPFPRLEIVLEGQLNEQGLPLAASTLTTLQVLYVQAGKWTLPQWTGPATTLSILFGRQKLGFSIQRWDGKSLHTEKQSVSRLGPRVGSYLLLSLNEVSLQPDPLTARLVIAALLSHCREQLVGLEMRVSRSRDLFLAVQDYLEENLSLPLTRESVAKRFHITPNYLSHIFQKSGSVGFNEYLTRVRLEKAKQLLRGYDLKVKEIAHNCGFVDSNYFCRVFKRYTERSPSEYRRHCRSAQQA

SEQ ID NO: 7567 - protein, 239 aa, Klebsiella pneumoniae
GGLMITLPARPESLTFAPQQSALIVVDMQNAYASQGGYLDLAGFDVSATRPVIDNINTAVAAARAAGMLIIWFQNGWDDQYVEAGGPGSPNYHKSNALKTMRQRPELQGKLLAKGGWDYQLVDELTPQEGDIVLPKPRYSGFFNTPLDSILRSRGIRHLVFTGIATNVCVESTLRDGFFLEYFGIVLEDATHQAGPAFAQQAALFNIETFFGWVSDVESFCHTLSPATPLALAKEKRYA

SEQ ID NO: 7568 - protein, 87 aa, Klebsiella pneumoniae
GVMMEKNNEVIQTHPLVGWDISTVDSYDALMLRLHYQNPTQENSNDAEIGQTLWLTTDVARQFISILEAGIAKIESGEYQENEYRRH

SEQ ID NO: 7569 - protein, 498 aa, Klebsiella pneumoniae
GVMMNFQHLAYWQEKAKNLAIETRLFINGEYCAAADNTTFETIDPAAQQTLAQVARGKKADVERAVKAARQAFDNGDWSQASPAQRKAILTRFADLMEAHREELALLETLDTGKPIRHSLRDDIPGAARAIRWYAEALDKVYGEVAPTGSNELAMIVREPIGVIAAVVPWNFPLLLACWKLGPALAAGNSVILKPSEKSPLTALRLAGLAKEAGLPDGVLNVVSGFGHEAGQELALHPDVEVITFTGSTRTGKQLLKDAGDSNMKRVWLEAGGKSANIVFADCPDLQQAVRATAGGIFYNQGQVCIAGTRLLLEESIADEFLARLKAEAQHWQPGNPLDPDTTMGMLIDNTHADNVHSFIRGGESQSTLFLDGRKNPWPAAVGPTIFVDVDPASTLSREEIFGPVLVVTRFKSEEEALKLANDSDYGLGAAVWTRDLSRAHRMSRRLKAGSVFVNNYNDGDMTVPFGGYKQSGNGRDKSLHALEKFTELKTIWIALES

SEQ ID NO: 7570 - protein, 204 aa, Klebsiella pneumoniae
QVMMLCVRMKEGMSLRNPMKKILIAAALIVSGLLSGCNQLTQYTVSEQEINQALQKRNHFAKDIGLKGVADAHIELQNLTSAIGREEPGKVTLSGIANVDLNSLFGTQKATIDLKLKALPTFDREKGAIFLQEMEVVDAKVAPEKLQSVIQALLPYLNQSLRSYFSQQPAYVLREDASTGEALAKKYAKGIEVKPGEIVIPFTN

SEQ ID NO: 7571 - protein, 66 aa, Klebsiella pneumoniae
WSTISMVSPLRALPSMRATPPENIHGWRRSRDFSRPLANTKRGNRESVMGLPLSNGNVGTEKWRVD

SEQ ID NO: 7572 - protein, 235 aa, Klebsiella pneumoniae
RRTIVKRRRRLVGTEQEHAGQRRHAQFSHFVTQVNFGLDIYHGVASRHDDKAISAGCPRGVQQRIDSQTFVGGFRTLDPELAKTRELFAGRQRGIDSQAARGQAVNLTLTQHAEVAGTEHADDLIVLIFAIDRIQYFEAGETEVFHRVFIVLNVTKVKIVRAIFNFAHAGGRHFIDGDRRVEVHTLMVKFKLEWGFLVIPVSFIVIKLNLLVIRVFHVAESGGQVTLRRFIAFPG

SEQ ID NO: 7573 - protein, 61 aa, Klebsiella pneumoniae
TRFFCKKLIDGRYVFPYISARSRQQRERQYGEVSEWLKEHAWKVCIRQRIGGSNPPLTAIF

SEQ ID NO: 7574 - protein, 405 aa, Klebsiella pneumoniae
MAALLTCEKNNMTAFFHFLLALAVILALAWLVSYDRQKIRIRYILQLIIIEIALAFFFLHAESGLWLVRNISGFFASLLGFAAEGTNFVFGGMSEKGLAFIFLGVLCPIVFISALIGILQHWRILPIFIRVIGTLLSKVNGMGKLESFNAVSSLILGQSENFIAYKGVLGDLSSRRLFTMAATAMSTVSLSIVGAYMTMLDAKYVVTALILNMFSTFIVLSVINPTRPGSEQEIKLEKLHESQSFFEMLGEYILAGFKVAMIILAMLIGFIALISAINALFPTLFGLSFQQILGYVFYPLAWLIGIPLSDALNAGSIMATKLVANEFVAMIELQKIAASMTPRGLGILSVFLVSFANFASIGIIAGAIKGLNEPQGNIVSRFGLRLVYSATLVSLLSASFAGLVL

SEQ ID NO: 7575 - protein, 221 aa, Klebsiella pneumoniae
RYKILRGEIFFSGDTATLGHELARTYTVNPTTRSHAQFYAKTLALTEATPEISSLSQSEFLSEYLKETPLKNLARITVDIHLEEASTEDIIEHLKVLIPQWKRRLKMKAPADREYRFGKSTFRKVIEYRLIPMMDLIFWGADNNDTKIPLSLMSSLLHEDSDNDRDEGMLKATDYPLAMAFLTDESYLKSLEDYIMQNNHLKDTPVDKHVEDDKKKKKAAK

SEQ ID NO: 7576 - protein, 511 aa, Klebsiella pneumoniae
MKEIKRRNAWIAFSLALVVFLAGVFVINWQLWHSDQATHVAAARQAAKKIAAILDEAREATATALNVSRSGCSGQGQFQLGTEAALQPHLRTILLIKDGQVWCSSLPGNRVLTLSPESLPDEPLLLLPARMMVNKRPVLIYQARVAAIRVIVTISDIHLRDALYSDTDNNGLALWVQNQMIARYGDVKPLAADPHQGVFTSPAYPFRITYPDSLFFSPGRLVHNGSGLLIFIFSVSLLFYFLMRKYLNVYTSEEERLRYAINQGYIVPYYQPLVNGKTGEIYGVEILARWQNSTTPSRSPAEFIPLAERTGLIIPLTRSLMAQVNAQMRPLFSKLPDGFHIGLNISVSHINAPSFIDDCLHYQRGFEGKAVKLMLEITEQEPLLLNDAVVDKLNTLHSRGFSIALDDFGTGYSGLSCLHELIFDYIKIDQSFVGRVTGEAPSSKLLDCVIEMARTLSLRIIAEGVETQAQLEYLNRQNIHLLQGYYFWKPMPYVALVMLLLSKPKARIVEQ

SEQ ID NO: 7577 - protein, 80 aa, Klebsiella pneumoniae
NTRMWMRILPIIAMALLLSGCGSIISRTVPGQGHGNQYYPGVQWDVRDSAWRYLTILDLPFSLVFDTLLLPLDASHGPYN

SEQ ID NO: 7578 - protein, 220 aa, Klebsiella pneumoniae
GERMKYQLTAHEARVIGCLLEKQVTTPEQYPLSVNAVVTACNQKTNREPVMSLSESEVQALLDTLVKRHYLRTVSGFGNRVTKYEQRFCNSEFGDLKLSAGEVAVVTTLLLRGAQTPGELRSRAQRMYEFSDMAEVESVLEGLTTREDGPFVARLPREPGKRESRYMHLFCDDIDTLITTVEALAPLDDDGDLRARVEALEGEVAELKARLDSLLHHLGD

SEQ ID NO: 7579 - protein, 75 aa, Klebsiella pneumoniae
AERIKSQQKKNDNENNYHKLKKAKNNVGAPLWMGKCLKTYRTGIYIKKTLNFDFLLSVEKSAVVTCGKRPCQWVL

SEQ ID NO: 7580 - protein, 430 aa, Klebsiella pneumoniae
CIDVLFIICHFMQYRMHYRRMMIMPKKARGLSVLAVSRLKADGRYAVGGVDGLYLRIAGRSRAWVLSVAMGTRINKAGKTVPRRLNMGLGPCQEVSLAEARDKAREVRKQIRDGIDPLEEKHARKAFHEAQARKQKTFRECAEAVLEIKGNELKNKKHVAQWRSTLETYAYPVIGDKAVSEITKMDLLAILEPIWLTKNETASRVRGRIETVMDYAKAKEYFEGDNPAAWKGVLKPLLPMPSKVQTKKHHAALPYKDAGSFMAELRQRAGISARALEFSILTVARSGEIRGAEWCEIDLDAKTWIIPAERMKAAKEHRVPLSDTAVELLKALPRFTDNNLVFPAPRGGQLSDMSLTAVLKRMGRSDLTQHGFRSTFREWAGETTSYQREVIEHALAHQLADKAEAAYQRGTLWPKRVALMDDWTSYCSVA

SEQ ID NO: 7581 - protein, 529 aa, Klebsiella pneumoniae
GSDVAMSVLSLSLGKKTGRLPERRRPAFPMVALALLFSLLALLPLGFVVAVGFDTGWPTIKALVFRPRVGELLSNTLWLTVVAVPISIVLGVTLAWLTERTALAGRQLWSALAVAPLAIPAFVQSYAWVSAVPSLHGLSAGVFLSVLAYYPFIYMPVAAVLRRLDPTLEDVAASLGTPPWKVFFRVVLPQLRLAICGGALLVALHLLAEYGLYVMIRFDTFTTAIYDQFQSTFSGPAANMLAGVLALCCLAILLLESASRGKARYARIGAGAAREQKRLVLGKGAAFGAQLLLLLLVMLAMGVPLLVLCRWLWLGGIDNWLHADLWHSLRQTLLLGAGGALLTTVCAIPIAWLGVRYPRPLFRLLEGCNYITSSLPGIVTALALVTVTIHYARPVYQTEVTLFLAYLLMFMPRALINLRAGIAQAPVELENVARSLGRSPARALWSITMRLAAPGAAAGAALVFLGVSNELTATLLLSPLGTRTLSTGFWALTSEIDYVAAAPYALLMIVISLPLTAVLYMQSKKMAGL

SEQ ID NO: 7582 - protein, 349 aa, Klebsiella pneumoniae
PLCVSCLVSMKKMLRFILLLVVLLGIAAAAGMWKVRQLADSKLLIKEETIFTLEAGTGRLALGQDLYREKVINRPRVFQWLLRVEPELSHFKAGTYRFTPQMTVREMLQLLASGKEAQFPLRFVEGMRVSDYLRQLRDAPYVKHTLEDDSYATVAKALGLEHADWVEGWFWPDTWMYTANTSDIAILKRAHQKMVAEVAKVWEGRMENLPYADQNQLLTMASIIEKETAVAEERDRVASVFINRLRIGMRLQTDPTVIYGMGEGYTGKLTRKDLETPTAYNTYTISGLPPGPIAVPGEASLKAAAHPAKTPYLYFVADGKGGHTFTTNLVSHNRAVQDYLKVLKEKNAQ

SEQ ID NO: 7583 - protein, 61 aa, Klebsiella pneumoniae
WRSVMANHRGGSGNFAEDRERASEAGRKGGQHSGGNFKNDPQRASEAGKKGGKNSHGSRES

SEQ ID NO: 7584 - protein, 1326 aa, Klebsiella pneumoniae
MTGVLSMGTTTMGVKLDDATRERIKSAASRIDRTPHWLIKQAIFNYLEKLENDETLPELPALLSGAANESDDASEPTEEPYQPFLEFAEQILPQSVSRAAITAAWRRPETDAVPMLLEQARLPQPLGEQAHKLAYQLAEKLRNQKTASGRAGMVQSLLQEFSLSSQEGVALMCLAEALLRIPDKATRDALIRDKISNGNWQSHIGRSPSLFVNAATWGLLFTGKLVSTHNETSLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPFVIDYLIDLATRSRRRLMIRLVKGAYWDSEIKRAQMEGLEGYPVYTRKVYTDVSYLACAKKLLAVPNLIYPQFATHNAHTLAAIYQLAGQNYYPGQYEFQCLHGMGEPLYEQVVGKVADGKLNRPCRIYAPVGTHETLLAYLVRRLLENGANTSFVNRIADNTLPLDELVADPVSAVEKLAQQEGQAGLPHPKIPLPRDLYGSGRSNSAGLDLANEHRLASLSSSLLNSALHKWQALPMLEQPVAEGEMQPVVNPAEPKDIVGYVREASDAEVQQALTSAINNAPIWFATPPQERAAILERAAVLMESQMPTLMGILVREAGKTFSNAIAEVREAVDFLHYYAGQVRDDFDNETHRPLGPVVCISPWNFPLAIFTGQIAAALAAGNSVLAKPAEQTPLIAAQGVAILLEAGVPPGVIQLLPGRGETVGAALTSDERVRGVMFTGSTEVATLLQRNIASRLDPQGRPTPLIAETGGMNAMIVDSSALTEQVVIDVLASAFDSAGQRCSALRVLCLQEEVADHTLTMLRGAMSECRMGNPGRLTTDIGPVIDAEAKENIERHIQAMRAKGRTVYQAVRENSEDAREWRHGTFVPPTLIELDSFDELKKEVFGPVLHVVRYNRNELDKLVEQINASGYGLTLGVHTRIDETIAQVTGSAKVGNLYVNRNMVGAVVGVQPFGGEGLSGTGPKAGGPLYLYRLLSSRPQDAVGVTFARQDAERPLDAQLKTLLEKPLQALQQWAAGRPELQALCQQYSEQAQSGTQRLLPGPTGERNTLTLMPRERVLCVADNEQDALIQLAAVLAVGCEVLWPDSALQRDLAKKLPREVSERIRFAKAEQLPGQAFDAVIYHGDSDQLRELCEQVAARDGAIVSVQGFARGETNLLLERLYIERSLSVNTAAAGGNASLMTIG

SEQ ID NO: 7585 - protein, 231 aa, Klebsiella pneumoniae
LIEVNTMSTPANFNGARPVIDVNDTAMLLIDHQSGLFQTVGDMPMPELRARAAALAKMASLAGIPVITTASVPQGPNGPLIPEIHENAPHAKYIARKGEINAWDNPEFVAAVKATGRKTLIIAGTITSVCMAFPAIAAVADGYKVFAVIDASGTYSKMAQEITLARVVQAGVVPMDTAAIASELQRTWNRPDAAEWAEVYTKVFPAYQLLIESYSKAQDVVKNNEQLDSQR

SEQ ID NO: 7586 - protein, 116 aa, Klebsiella pneumoniae
VVGVLSCHVLAVLIENTTQDICGQGFHTLACSALIESGLWSEDAVKHQVDHKESNRIRVAYNHKTKHLKQRHLMLQWLLISLMLTATVWSGRLNLLITSKELKAKDGLPPFFNSLI

SEQ ID NO: 7587 - protein, 369 aa, Klebsiella pneumoniae
LFSLSFFFCCDLILSAQAIYRLLPYFIKDAFMKFRLSPLRTAALVAASLFLAPQGMAADAQNGIVVYNAQHENLVKSWVDGFTKETGIKVTLRNGDDSELGNQLVQEGSASPADVFLTENSPSMVLVDNAKLFAPLDAATLQQVPAQYRPQHGRWIGIAARSTVFVYNPAKISEAQLPHSLMDLAKPEWKGRWAASPSGADFQAIVSAMLALKGEQATLDWLKAMKTNFVAYKGNSTVMKAVNAGQIDGGVIYHYYRFVDQSKTGENSKNTQLYYFKHQDPGAFVSISGGGVLASSKHKAQAQAFIKWITGKQGQDALRTNNAFEYAVGVDAASNPKLTPLKDLDAPKVEPSSLNSKKVIELMTQAGLL

SEQ ID NO: 7588 - protein, 481 aa, Klebsiella pneumoniae
PNISFFSPPDFTLAFITIPFLHDSVKTATYHFLRHLLFSMNRLNRSCFLIKKYCRKGAGKSSRLPAEYPRLSLFFPGGEMSRVSQARSLGKYFLLVDNMLVVLGFFVVFPLISIRFVDQMGWAALMVGIALGLRQLVQQGLGIFGGAIADRFGAKPMIVTGMLMRAGGFAAMAVAHEPWVLWFSCILSGLGGTLFDPPRAALVVKLVRPHQRGRFFSILMMQDSAGAVIGALLGSWLLQYDFRLVCSAGAALFIACAAFNAWYLPAWKLSTVKTPIREGLGRVLRDKRFVTYVLTLTGYYMLAVQVMLMLPIMVNDIAGSPAAVKWMYAIEATISLTLLYPIARWSEKRFRLEHRLMAGLLVMTLAMLPIGMTSSLQQLFTLICLFYIGSIIAEPARETLGASLADARARGSYMGFSRLGLAFGGALGYAGGGWLFDAGKAVGQPELPWLMLGAIGVITFLALWWQFSPKRSASGMLEPRT

SEQ ID NO: 7589 - protein, 352 aa, Klebsiella pneumoniae
PEPSMTAQSQVLKIRRPDDWHIHLRDDDMLKTVVPYTSEFYGRAIVMPNLVPPVTTVAAAIAYRQRIMDAVPAGHDFTPLMTCYLTDSLDPAELERGFNEGVFTAAKLYPANATTNSSHGVTSTDAIMPVLERMEKLGMPLLVHGEVTHAEIDIFDREARFIETVMEPLRQRLPGLKVVFEHITTKDAAEYVRDGNELLAATITPQHLMFNRNHMLVGGIRPHLYCLPVLKRNIHQQALRELVASGFSRAFLGTDSAPHARHRKEASCGCAGCFNAPTALGSYATVFEEMNALQHFEAFCSLNGPRFYGLPVNESYVELVREETTVVDSIALPNDTLVPFLAGETVRWTVKK

SEQ ID NO: 7590 - protein, 256 aa, Klebsiella pneumoniae
GLCSTGGIAILTCLVLSVSSRHKEPAMKTPLRLALVGDYHPDIVAHQAIPLAIDDAAAVLEQPVKYDWLATPSIASGEALAEYDAIWVVPGSPYRHPEGAFTAIRYARENSIPFLGTCGGFQHAVIEYARNVLGWQDAGHAETDSEGRMVIAPLSCSLVETSAVVELRANTLIARAYGRESIEEGYHCRYGVSSAFAAELEQGDLRVTGWDEEGEIRAVELVTHPFFVATLFQHERHALDGRPAPLVQAFLRAAAQ

SEQ ID NO: 7591 - protein, 84 aa, Klebsiella pneumoniae
YSRSPEEKLMLELRPNCECCDKDLPPDSPEAFICSFECTFCRDCMTTRLNGHCPNCGGELVRRPVRPEEALRRHPASTLRRHAQ

SEQ ID NO: 7592 - protein, 199 aa, Klebsiella pneumoniae
FAPSRLRLQNCINSNKGGTPVNKSMLAGIGIGVAAALGVAAVAGLNVLDRGPQYAQVVSSTPIKETVKTPRQECRNVTVTHRRPVQDENRIAGSVLGAVAGGVIGHQFGGGHGRSVATVVGALGGGYAGNQIQGAMQDNDTYTTTQQRCKTVYDKSDKMLGYDVTYKIGDQQGKIRMDHDPGSQIPLDNNGQLVLNNKI

SEQ ID NO: 7593 - protein, 203 aa, Klebsiella pneumoniae
NEPLRKSVSAGEPRRADFLCGKGSSQRKVHAMNNPSVIPAFDFREMVTTLDNKVITTSLKVANYFGKRHKDVLRAIRNLKCSEDFTRRNFAPIDFIDKNGDVQPMYNITRDGCMMLVMGFTGKTAAAVKECYINAFNWMAEQLNRRAVMGEEMQHRHAIKETRSKLKGTIGSRLMNERKKEKCVLKLEYEHIMQVTQPELLID

SEQ ID NO: 7594 - protein, 308 aa, Klebsiella pneumoniae
FSRFCQHLTVLSVSRYFATTPGRSPNRERLAVWKAHKRSTFRYDVHLQGEGEKMLLIARRTALAAALLLVMPLTVWLSGWLWQPGLPVAMLKSLWWVTETVTQPWGIITHVVLCGWFLWCLRFRLRAALILFLILAAAILAGQGAKSWVKARVQEPRPFVIWLENTRQVPVTQFYALKRKERAKLVHEQLAQAQDIPSFLRKHWQKETGFAFPSGHTMFAASWALLAAGLLWPRRRWGTIAVLLVWATAVMGSRLALGMHWPLDLIVATLISWLLVTVACWLTQRLCGPLSPPGEEAQDIKKRMPEAE

SEQ ID NO: 7595 - protein, 274 aa, Klebsiella pneumoniae
NDRLSLISDNMMIGLGLDGYEPDSGHESAIAFRIRVVEAEQYIPAHSHRKGQLILALHGALTCEVENAMWMVPPQYAVWVPGQLSHSNRATPGAQVCFLFIEPGAAPMPDRCCTLKISPLVRELILTLAERGGESLAAPATARLVQVLFDELPRQPQEHLQLPVSNHPKIRQMVTMMAEDPARWQTLSQWAAVFAMSERNLARLVVRETGLSFRRWRHQLQLILALQLLIRGQTVQQTAQALGYDSTTAFITMFKKGLGQTPGRYHGSLATTSQ

SEQ ID NO: 7596 - protein, 287 aa, Klebsiella pneumoniae
CRSSAPSLTARRCRWRLSRCRSLLSPWWRWCWPCCLRCTLPGALPPPNPLRLYVMNNILLQCDNLCKRYQEGNVQTDVLHNVSFSIGEGEMMAIVGTSGSGKSTLLHLLGGLDTPTSGDVIFSGQPMSKLSTAARADLRNRELGFIYQFHHLLPDFSALENVAMPLLIGKKKPADIERQAKAMLQAVGLEHRSHHRPSELSGGERQRVAIARALVNKPRLVLADEPTGNLDARNADSIFQLLGELNVAQRTAFLVVTHDLQLAKRMSRQLEMRDGRLTADLTLMGGE

SEQ ID NO: 7597 - protein, 303 aa, Klebsiella pneumoniae
GRQSVLEQQSILALLQTFEVTARHLSFTLAAHEMNLTQGAVSHRIRRLEMHIGFRLFIRMTRKLALTEEGKRLLATLSHSLRAINDEIEDIRDQDLRGTLHIGIAPTLAHLWLMPRLPRFQAQWPGLNLQFRVRAGVMDFNEERVDLAIYYGATRYPDLYQQRLMAESLLPVCSPRYRQQYRPLSGGDPAALVWIHACESTDVQDQFAEWRLWCQHNGQALPFEGRYYAVNNHSLAIEMALNGLGVVMGRKTLIQPLLDAGRLVALSENEAPSPFGYDLICPQENRSRPRFRAFSEWLAAECA

SEQ ID NO: 7598 - protein, 410 aa, Klebsiella pneumoniae
TTGSSMSQVASAISQKETYKSMAWRYSLAGERDLRIDFMRGIALVMMVVAHTEVMSIFNIFSWERFGLTTGAEGFVILSGFMLGMLNRARLQKAVLLTVGWGLYLRAWKIYQVNIIIIVTFLLLRYFPFINAFEVTHFTDRFSGTSWSLYPLTPQIKETWFNIILYLQIGPHQTQILGLYIFLLLLSPLFLGMLQKGHVYPLLGVSLLIYGCWQRWPVRVTPCEFEFAFPLLAWQFIFVLGMCCGWYKAELISFARTPPGKVAVVALVFIALILAFVAQNHTNPFMPPALLMHVIPPAEFNAFYHTWAAKNGLGPVRILNDISLMVTIYLLLTWCWRPLNWLAGWFLIPLGQRSLYTFILHVYIVLAVSQLVTFDLWRQAWIVNTLIHAAALGVLWLMAKYRVAARWIPN

SEQ ID NO: 7599 - protein, 351 aa, Klebsiella pneumoniae
QEMSMSEQAIRLTQYSHGAGCGCKISPKVLETILHSEQAKFVDPNLLVGNETSDDAAVYDLGNGTSIVSTTDFFMPIVDNPFDFGRIAATNAISDIFAMGGKPIMAIAILGWPINTLAPEIAREVVEGGRFACQQAGIALAGGHSIDAPEPIFGLAVTGVVPTERIKKNSTAHAGCKLYLTKPLGIGVLTTAEKKSLLKPEHQGLATETMCQMNLAGAAFAAIDGVKAMTDVTGFGLLGHLSEVCRGAGVQAQLRYADIPKLPGVEDYIAAGAVPGGTGRNFASYGHLMGEMPTEWRDLLCDPQTSGGLLLAVTPEAEAEVQAAAAEFGIKLAAIGELVTARGGRPMIEIR

SEQ ID NO: 7600 - protein, 94 aa, Klebsiella pneumoniae
WRYPDADPTALRRAFAHPPAPATAQSPASRRAAGAGAPAVYCRTSRWRHTPNAASPARPARCAGRPAPPDRPFPAPAASCVKRPRPRRSESDGG

SEQ ID NO: 7601 - protein, 265 aa, Klebsiella pneumoniae
SLMFSAERKGENMNNSAKIALVTGGSRGLGRATVEALAQRGVNVVLTYKTRLAEANEVVTRVEALGARAIALPFSAGEIDTFDAFVSAFQGALTELGADKFDYLVNNAGNASGMGFLNATEAEFDALYRIHVKSVFFLSQKLLPLLADGGRIVNVSSGLTRIVMANRAPYAIMKSAVETLTRYMAFELGSRGITVNCVAPGAIATDFSGGVVRDNPQVAQAVAAMTALGRPGLPEDIGQMIASLLSDDHRWVNAQRIEVSGGMRI

SEQ ID NO: 7602 - protein, 392 aa, Klebsiella pneumoniae
SQTPQRPEICRCVYMGQSQKLNIQPRSRSPLVHLAGIRKSFDGKTVIDNLNLTINNGEFLTLLGPSGCGKTTVLRLIAGLENVDSGRIHLEDHDITHVPAENRHVNTVFQSYALFPHMTVFENVAFGLRMQKTPAAEITPRVMDALKMVQLEAFAQRKPHQLSGGQQQRVAIARAVVNKPRLLLLDESLSALDYKLRKQMQNELKALQRKLGITFVFVTHDQEEALTMSDRIVVMRDGKIEQDGTPREIYEEPKNLFVASFIGEINIFDATVIERLDEQRVRARVEGRECNITVNFAVEAGQRLHVLLRPEDLRVDEIHHNSDADGLIGYVRERNYKGMTLESVVELENGKMVMVSEFFNEDDPDFDHSLDQKMSINWVESWEVVLADEEHQ

SEQ ID NO: 7603 - protein, 463 aa, Klebsiella pneumoniae
IANPDAARQPEPGSRLSGRGGVMTAREVNFDGLPGLTHHYAGLSFGNEASTRHRYRVSNPQLAAKQGLKKMKALADAGYPQAVIPPQERPNVPLLRQLGFSGSDEQVVARVAQQEPDLLSAVSSASAMWVANAATVCPSADSLDGLVHLTVANLQDKFHRASEAPTTEALLQAIFPDRTRFAIHPALPASAWFGDEGAANHNRLGGEYGAPGVQLFVYGRRRGSEEAPRRYPARQTLEASQAVARLNQVNPRQLIFVRQHPAAIDTGVFHNDVIAVSNRQVLFCHEQAFADQTALLQQLAQRVPGFTPLVVPASRVSVAEAVATYLFNSQLVSRADGSMALILPQEAQEHAGVWEYLNELLAGDNPIADLRVFDLRESMANGGGPACLRLRVVLTAEEYQAVNPHVLMNDTLFVTLNDWVDRYYRDRLTQADLADPQLLREGRDALDRLTQILQLGSVYPFQQ

SEQ ID NO: 7604 - protein, 92 aa, Klebsiella pneumoniae
NYRPRSAYRGQKMFVELIYDKRNFAGLPGAREAILNELTKRMQRIFPEAEVRVKPMMTLPAINTDASKHEKELISRTVQEMFEEADMWLTEE

SEQ ID NO: 7605 - protein, 389 aa, Klebsiella pneumoniae
SRRPAAFAGMGSHAGRCAGAYLCGAVDRDAPRGGDYAQRTAGQPAGRRYSPGDHCRGRIMPLLDIRHLTIEFKTSEGWVKAVDRVSLTLTEGEIRGLVGESGSGKSLIAKAICGVTKDNWRVTADRMRFDDIDLLRLSNRERRKLIGHNVSMIFQEPQSCLDPSERIGQQLIQSIPGWTYKGRWWQRLGWRKRRAIELLHRVGIKDHKDAMRSFPYQLTEGECQKVMIAIALANQPRLLIADEPTNAMEPTTQAQIIRLLTRLNQNNNTTILLISHDLQMLSKWADKINVMYCGQTVESGPSEELITLPHHPYTQALIRAIPDFGSAMPHKSRLNTLPGAIPLLEQLPIGCRLGPRCPYAQRECIETPRLTGARNHLYACHFPLNMEKE

SEQ ID NO: 7606 - protein, 302 aa, Klebsiella pneumoniae
GSIPMKLPPLNALRCFEAAARLLSLKLAASELCVTPSAVSQQIARLEETLNVPLFIRTPRRLQLTAVGEIYLRAVQPAFHQIAAATQRLQVPPGPEKVAISCTSGFAIQWLLPRLADFERRYPQIEIQIGTTNRRVDLLSEGIDFAVRHGVGGWPELQAYRLLDDDLMPVCSPQLIAPRRTLTDASDLLQYPLLHDEHREDWALWCEAVGLAPHFARRGPVFTDSNGVTEAAFAGMGMALLRRSFIAPALTQGRLVNPLAQPIACPLAYHLVYHETALLAPANRCFRDWLLGQRPAVAEERA

SEQ ID NO: 7607 - protein, 476 aa, Klebsiella pneumoniae
RDIPSGHNGLAMKRLKTELNALVNRGVDRHLRLAVTGLSRSGKTAFITALVNQLLNIHTGARLPLLSAAREERLLGVKRVPQRDFGIPRFTYDEGLAQLYGQPPMWPTPTRGVSEIRLALRYRSNDSLLRHFKDTSTLYLEIVDYPGEWLLDLPMLAQDYLSWSRQMTGLLQGQRAEWSARWRQLCAGLDPLAPADEARLADIAAAWTDYLHACKREGLHFIQPGRFVLPGEMAGAPALQFFPWPDVDAVGEAKLAQADKHSNAGMLRERYKYYCERVVKGFYKEHFLRFDRQIVLVDCLQPLNSGPQAFNDMRLALTQLMQSFHYGQRTLFRRLFSPVIDKLLFAATKADHVTIDQHSNMVSLLQQLIQDAWQNAAFEGISMDCLGLASIQATQSGLIEVNGEKIPALRGNRLSDGQPLTIYPGEVPARLPGQAFWQQQGFQFENFRPQVMDVDRPLPHIRLDAALEFLIGDKLR

SEQ ID NO: 7608 - protein, 81 aa, Klebsiella pneumoniae
RAIPSIPSRWKSSKGPPARTMAAARPPARCNMISKQPRLDSGIDGSASIRSAWSRPGHSRPEPGVYRQRLVPSEPDGGKNP

SEQ ID NO: 7609 - protein, 159 aa, Klebsiella pneumoniae
TGQPAAHRLGRIAAQLALCRSAKAGTGRFFSCHRGRGVAVGQRPADVYRPPRTNAAAAHQPAGAAGLRQSPSGQRNLPAAAGLHRYRPAGATADRAHRPASRPAPAAAAGDLRGGHRPAVALSRCAAPGPVAGGQGFPGVAGADGRHAQPGHPPPVADV

SEQ ID NO: 7610 - protein, 454 aa, Klebsiella pneumoniae
PDEPGLFAHRGRPRGDARYFRRRNLHHQGGGLIMFAHCDVNAFYASCQTAFRPDLKGRPVVVLSNNDGCVIARSAEAKPFVKMGEPYFKQKAAFLRHGVVAFSSNYELYADMSSRVMATLEELTPRCEIYSIDEAFCDVSGVRHCRDLTDFGREIRATVLQRTHLTLGVGIAPTKTLAKLANHAAKQWPRQTGGVVDLSCPQRQRKLMALLPVSEVWGIGRRIGKKLEAMGIGTVLQLAESDIRFIRKHFTVVLERTVRELRGEPCLALEEFAPAKQEIICSRSFGDRITAYEDMRQAICSYAARAAEKLRGEHQYCRFVSAFVKTSPFALNEPYYGNSASLKLLTPTQDSRDIIAAATSCLDAIWKAGHRYQKAGVMLGDFYSQGVAQLNLFDELAPRHNSARLMQVLDQLNAKNGRGALYFAAQGIQQQWQMKREMLSPRYTTRYGDLLRVR

SEQ ID NO: 7611 - protein, 184 aa, Klebsiella pneumoniae
GMLPMMVPFQLSTLPVTPWKNGGGETREIICVTAPDAPFLWRASIATLQADGPFSPFPGVDRVITLLAGQPLRLCGENIDQPLALWQPWAFPGEWALSSVGIVAPGLDFNIMTQRGRASATVQVVSDLQCPASEGVAYVLQGEWDLAGRRCAAGSGLCWRGGSPRNLRPVGSNGRLLLAEIALK

SEQ ID NO: 7612 - protein, 437 aa, Klebsiella pneumoniae
PTLPALARDLQRLDLLAKRFAPAIAEQGVPGKGGAGRGDRRLLRGGTARGEGALRLPVRQRAGIIRRGLGVVGADRRLADPQAMTALLDLHDAPGDLRTLRVKAQLKPGEQVRQADQRRLPPPRRAQPLVGHHDAVDVDHLLPLRRVGHRQPRGAVDQPQRMAGIQPVAKAVPRFIRRQRPVVHRRRGLAGGAVADERADPPLIKQIPHRGGVLRIAPEQRLQGGEQASHTDGGGVRVAEDLQRVGMVLSGGQSLGVEGQLTERKQGGGNALIAFGGGHNMQLLCGDHGEKIAADAPQAKPGFVILRVGQTVWLSIIHIILPGHSRPDRLVKGQLARGRERRKILAQRHPTAALDARRHLFFHPYDNRKTQQEANEDGEIAAGGEQGVADPHRLASCSSGGVHMAAKISGSMAAIFTAPQKMLMTYPEGSSTSPRAT

SEQ ID NO: 7613 - protein, 754 aa, Klebsiella pneumoniae
QIMPGPIFSNENPGSPLLKGLSPPQAQQLTKFSGDMAVTNAAVSKKAEQSAVTGLTTRMTSAEGKLDSQSQQLTSLQNSLTTMNTELGKKADTSAVSSLTGRVSQVENTITSQSQSITSLTSTINTIRTQGANPWVDGTFESYSDGQVLGGNGTAVVVASQKFTGNKSLQVSRGANNNGNSDKQLGSWQSVREDAKFRFEFWAMMPADQAPSSGWTTLVGINSLNAAGQNSWQSAVTVSEAALGARDKWVKFTGIASNNGGGRTRAVVWISTRGASGSGTPGYSLYIDDLVITDVTDAKAAQDASDATASAVSGLTARVTDAEGKITAQAQQQTALATKVDNANSRVDNMAKTLSDSQSTQASLNTSLQSQIDAQAAANIKNQTTLDNTIKSVASITSTQQTHATALEALATQQTTLTSSVGDLSASVQNTAKTVADVNGTVSSLWSMKVETVNGKNVGAGITLGSNGETSDMILYADRFSLFNRNNATAVPVMVAEGNELYIDTARIKNSSLTSTKIADGSITNAKIGHEIRSNDFVDGSRGWRIAKDGSSQFNNVIVRGAVYATDGWFQGTVYANHIEGDIGSFAINIAQHRTRKVPKATWQWFELARFRRQNFDQVINIRGGLLQTDSITIDGGAKLRAGMSYAPGADGGLNPGYLSYAMLLRGTGATSGGGSMELGIELMYETGGATRLLTAQESMNVDNMSFVVPAGTGDAVLRYGCYLDRNGQMVLTILSRFDAFAARNNNVIRGSST

SEQ ID NO: 7614 - protein, 88 aa, Klebsiella pneumoniae
PHSPAASAPPAAEPRRSSHNDARAAPADPTADPDAQSAQAAPGQRAPPVRSAPWAAAAQAAAAAVWPLLPARAAPATPHSLRGISPVL

SEQ ID NO: 7615 - protein, 913 aa, Klebsiella pneumoniae
VSAPPGGAPLSDRRSLIMHAANRADLNVLPSAVMIYDERERLQAWNDKVALFYPTIAPWLAVGASLESLAEKFIDAGYNIDPGRQQTLRETIIRNCRQANHCEVRQSGNRQIYVQHQRLADGGIVSLHTDITELDEARRARHQLHDDFLFTAESIQIGIWDWQVSHDNLQVNDTLLAMVGQSRAQWRYPLRFILNLVHEDDRATLQQAMIASQNEHMPVFECELRVQHPTQGWRWMLLSGQIVTLNMQQQAERVIGTLQDITRRKAAELLAIEAAKEAREANEAKSAFLANMSHEIRTPMNGILGMTQLCLDTPLTAEQREYLSLVMSSAQSLLHIINDILDFSRIESGKMQVDEEPLEIRPFIQSLIRPHMPAASEKGIELLVDISPAVPEVLIVDGPRLRQILTNLLGNALKFTHQGEVLLAIAPADDESRWRFRIRDTGIGIAPEKQKAIFEAFSQADSSTTRRYGGTGLGLTISARLVSLMGGELTVESQPGTGSEFAFTLPLAGLHTASANAPPGRFNNERVLVVDDNSTNLRLLDTMLRQMGLIPICVDNASEALRRAAEGPPWPLILLDAQMPDMDGVSLALELSALPEARQSQIIMLSSMSRHFDANMLKRIGIAHYLHKPVAQRELHQVIAGILLPTPVVATAPAPVAEPVRDQTGLHILLAEDNLVNQKVARRLLEQLGHRCEVVSNGREALERWRAACWDLLLIDLQMPEMDGETAIRLLREETPALGRQHQPAMAMTAHAMQGDRERCLAMGFDGYIAKPVSLEALREAIARVGAAEDSDLEEEKGLPDEAHLLKQCADDPELVEELLGLFAEGLDAAIIALTHAIDTNDRETWRRTAHKLRGEAVTLGFQRLAGVLQQMESRAKSPGQTVPDDLRDALAEATTGCHRWLHRRSQEVLRDR

SEQ ID NO: 7616 - protein, 302 aa, Klebsiella pneumoniae
ARAPRRCRGNARCGLPSPDPLITEVAMQSRRLHRLSRFRRNKRRLRDRLRQRIFFREDRMKPEAMAKPRVVVLTGAGISAESGIKTFRAADGLWEEHRVEDVATPEGFARDPALVQAFYNARRRQLQSPEIKPNAAHLALARLEDLLGDHFLLVTQNIDNLHERAGNRRVIHMHGELLKVRCSWSGQVLEWTGDVTAEDKCHCCQFPAALRPHVVWFGEMPLGMDEIYSALADADIFIAIGTSGHVYPAAGFVHEARLHGAHTVELNLEPSQVGSEFAEKHYGLASEVVPAFIDKLLQENAL

SEQ ID NO: 7617 - protein, 311 aa, Klebsiella pneumoniae
LMFTGKIMACVFNKQLLHPRNWLTWFGLGILWLIVQLPYPLLHFIGTSAGRLSRRFLKRREHIARRNIELCFPDMSPAARETLIDQNFMSLGMGLIETGMAWFWSDERVKKWFDVEGFANLNHALSGGKGVMVVGVHFMSLELGGRAMGLCRPMMATYRPHNSPLMEWVQTRGRLRSNKAMIDRNNLTGLVHALKSGEAVWFAPDQDYGPKGSVFAPFFSVPQAATTNGTYVLSRLSGAKMLSISMVRKLDRRGYSLHISEVMNDYPGEDKQIAAGYINKVIEREILRAPEQYLWVHRRFKTRPLGEPSVY

SEQ ID NO: 7618 - protein, 130 aa, Klebsiella pneumoniae
PDVTSLTGSQRLLKALVSHIEEAFMEKKHIYLFCSAGMSTSLLVSKMRAQAEKYEVPVIIEAYPETLAGEKGPEADVVLLGPQIAYMLPEIQRLLPNKPVEVIDSLLYGKVDGLGVLKAAVAAIKKAAAQ

SEQ ID NO: 7619 - protein, 65 aa, Klebsiella pneumoniae
GMNTLFALVISVCALTGECSDVLIGVYPSEASCNSNADEQKVQGQCLPYRNAQNMADDQQPAVSF

SEQ ID NO: 7620 - protein, 317 aa, Klebsiella pneumoniae
IQWLSDEYRVTALFYPGNDRPANTVAQQVDQQYAEHNRRPGEHHGPRRHIDKLQRIAQHGSPFRRRQLGAEIKKAQRGNIQNGHRQGASDLGHQAGGDIGQDGEQQNIQRRGAIEAGGDDVLFLQLIVDHAVDGAHHARQQRQPDGEHRMAEMRPGKGDDDNRQQQRGDGEQGVEDMVHHRRAQAVGRSGNHAQHQTKQRGAEGDDKSAADGGRRAAQQSAQHIAAEVIGSQKEGDFAIARPRRRQQLVAEELLVDAVGGEPAAEDAEQQQARAAVQTDHRRGVAIELTPYGAQRAGRTLFQINAIVGHTIPYVSVG

SEQ ID NO: 7621 - protein, 75 aa, Klebsiella pneumoniae
ISPTAVNCNRRGVRINSGTFSVSSRRAICWLTALGVTQSSLAASFRLSSRAAASKQRNAFSGGSFMGMEPQLRKT

SEQ ID NO: 7622 - protein, 81 aa, Klebsiella pneumoniae
GSCTINQRMPSPNQVSQLRGCKSCLLNTQAMIFPVNINYVVTLKENRIHLSSLGGTYSKFDNTNPLKFPPASKKQQADKKT

SEQ ID NO: 7623 - protein, 244 aa, Klebsiella pneumoniae
LMCTYAREHSCKQSAQPQTTPYRIVVHEYGRYPVITGNKFFHNGYPYPVNTTAESGVRLDILTPIAAELDAILSSYSRVYLTRFDFRLPAGTPVDTANEWVSQLFKKLRERLKSKFRRPEGIADPILNFAYGWVREKEMAKQVHYHCWIALPHRQVKRLGTPTSGIAGAITEIWAKLSGGEPTLVEFPKPSDRYTKYYVIERGKPETLKGPILWLSYLAKERGKYQTGKGDKVHSTSQLRNKKP

SEQ ID NO: 7624 - protein, 101 aa, Klebsiella pneumoniae
FLSTLPVALTGSASTNITRSGICHLGTRFSNQLSRSVSSTSPPSARTHSSTGRSSQRGWRAAMAAALRTPGCAMAIFSSSTVEIHSPPDLIISFARSLITR

SEQ ID NO: 7625 - protein, 310 aa, Klebsiella pneumoniae
PPVTRIKRIMDRFSALKAFTRVVEAGSFTRAADSLNMPNATLSKTIQQLEAHLGVSLLQRTTRRITVTPEGREYYEKARCLLEDLEEIDASFNTARNKPKGHLRIAIGGSTACDVLIPLLADFMTSWPDIRIDLQVADKPADLISGNIDCAIRGGPMEDSTLIARKIGEATLVTCATPGYLQRYGTPASPDELHHGHRLISYLSPASGRAFPFRFTRHGVSTELKTEPHLGINESNAHIAAGEAGLGIVQTFTYSLKPALASGELVEILSAWRPAPYPFHVVYARHRHVPPRLRVFIDWLAAVFPAAVQG

SEQ ID NO: 7626 - protein, 183 aa, Klebsiella pneumoniae
RIPTAPANPYAHLLPIRRPSMTTKKKLSNQITPELQSFIDKIAAKYQPNAEVLQRRIDNAEARYNRYQQFSDIPARLVSTLQKLILEGWRFCPGANASVFANAAMVSVTLQKPAQLIAAELKELRSKASDSYTNELFSAMEREIDELMQQAAEDSQRKAEEQAEAEQAAMRDRLRTLLNGAKA

SEQ ID NO: 7627 - protein, 216 aa, Klebsiella pneumoniae
QPPTLLETFVLDSHLHPRLKPLLNAVAGALDRPGISPDGLTLVGFAIGVLALPFLALGWYGAALAAILLNRLLDGLDGALARRRGLTDAGGFLDIALDFLFYALVPFGFILSDPLNNALAGGWLLFAFIGTGSSFLAFAALAARHQIANPGYAHKSLYYLGGLTEGTETILLFVLGCLFPAHFAWLAWLFGALCWLTTATRICSGYQTLKRVTTTA

SEQ ID NO: 7628 - protein, 787 aa, Klebsiella pneumoniae
QKTTGCFLSTEESHVEQHAGDFSVTVRDVRQLTQPESDLLTLLWVLEGSVNLAVAEGASQPLVADGLAIVNRNRRWSLRSAGANAVMILTLSASWLARLDNAFFAVDYQITPRTRDADDGLRRLMRQLLVSGLVNHPGHYRLEANRWLSEIALLLATRFSQPIASTPRRDTEKWSRRIASVVARIDANYQRRLSLQEVAAAEFVSEAWLSRLFRKEVGVSFVQYLTALRLRHAADQVLTTRKTVQQIAREQGFASTRMMSDLFKRQHGVTPRQYREQHPLELARPRPPQADRWQPVAADRLYARLNEPEPRDRESPPLPINPPQTREINLRDRPARPAALRHTRMVVTVRELDDLLRADVRRELEQLHHALPVYAIDINDPFLSSRLFGTGWDDPQMAGYACWYNLQQIFSWLAAMGWQVILHTGVTTRSDLLQRFLQLAANHFPPATLNSWRFVWHWSPQASEAARQAAWRQQRGVLHRLLPQPQLGIWHRFAPSDPGNDPLFHSPLLAEADFLACQADANEQLDLAQADSSRLASSEHYPLHKLRQIHSALRQRQLNLPLWLLSWNTLTGDTRDTNGRFFRGALLMDNLLGVADQVWLAGFWLNSGLQGEARANGKLDTSSLALHYLHGLPRPVYWVLWLWRRLRGEILVHDKNLLLLHHQGHYQLLLRNTVVYNPWLSSEAAFIQRFSQLYSVRLQGLDGSWRIKQHLFDQHHGALFPLVDAFRSRSGPDAEDYQWLMHQARPALSVDEARLDGYWLRIDSLQSNALVLYEFTPQLSSGADPAP

SEQ ID NO: 7629 - protein, 133 aa, Klebsiella pneumoniae
SMTTTDLAPKGEMVLRTLAMPADTNANGDIFGGWLMSQMDIGGAIMAKEIAQGRVVTVRVDGMTFLRPVAVGDVVCCYARCVKRGNTSVTINIEVWVKKVSSEPIGQRYKATEALFIYVAVDNQGKPRPLPAE

SEQ ID NO: 7630 - protein, 392 aa, Klebsiella pneumoniae
YLATISAARKKTESAAQRTQSTKTSRQRLRYTVQQRQCFTQGENVELLAQYGLFLAKIATVVVAIAVIAAIIVNLAQRKKQRGELRVTNLSEHYKEMKESLAVALLDGPQQKQWHKAQKKKQKQEAKAAKARAKLGNAEPEGKPRAWVLDFKGSMDAHEVNSLREEITAVLAAAKARDQVVIRLESPGGVVHGYGLAASQLQRLRDKQIPLTVAVDKVAASGGYMMACVANKIVSAPFAILGSIGVVAQIPNLHRFLKNKDIDIELHTAGQYKRTLTMLGENTEEGRRKFREDLNETHHLFKDFVHRMRPGLDIEQVATGEHWYGVQALEKGLVDAVETSDELLLGLMESHEVIGVRYQQRKKMLDRFTGSAAESADRLLLRWWQRGQKPLM

SEQ ID NO: 7631 - protein, 574 aa, Klebsiella pneumoniae
LMATYPNVNAANQYARDIVGGKILACQLTILACQRHLDDLERAKDPHWPYRFDKNKAERFLRFAQKMPHTSGEWARRKLRIEFEAWQKFALGVPFGWVHKKTGLRRFSEIYIEVPRKNGKSAIAAAVGNYMFCADGEHGAEVYCGATTEKQAWKVFSPALQMVKKLPALRQKFSIKPWAKKMTRPDGSVFAPVIGDPGDGDSPSCAIIDEYHEHTTDALYTTMTTGMGAREQPMTLIITTAGYDITSPCYEKRTQVVEILRRTRNGEENETIFGLIYGLDDDDDWTTPEALIKANPNYGISVKADFLRAKQLLGMSTPGQTNKILTKHFNRWVSAKSAYYDLRKWMDAADKTLKLSDFEGEECWLGIDLASKVDLNAVVPVFRREIDGITHFYCVSPLFWAPEETIYSQETALKSTAERYQSFVRQGKLIPTDGGEVDYRLIFETILKLRNTVKIAQCPIDPYGATSLRHMLEEEGLEPVEIRQNFTHMSDPMREIEAALISGRFHHDGHPVMNWCISNIVGQYLPGSDDIVRPGKEGRQNKIDGAVGLMMGLGRAMLNSSVMTSVYDEEDIAC

SEQ ID NO: 7632 - protein, 453 aa, Klebsiella pneumoniae
RMQTVLAKIVADKAIWVEARKQQQPLASFQNEIVPTQRNFYDALAGTRTAFILECKKASPSKGLIREDFDPAAIASIYKHYASAISVLCDEKYFQGSFDFLPIVSQVAPQPILCKDFTIDPYQIYLARYYQADACLLMLSVLDDEQYRQLSAVAHSLNMGVLTEVSNEEELERAIALKAKVVGINNRDLRDMSIDLNRTRQLAARLGPDVTVISESGIHTYAEVRELSHFANGFLIGSALMEQADLEAAVKRVLLGENKVCGLTRPQDAQVAWESGAIYGGLIFVPTSPRAVNDAQAKAVIAAAPLQYVGVFRNAPLEEVVARAQALGLAAVQLHGDEDQAYIDALRDALADNVRIWKALSVGETFPARTLRHVDKYLLDNGQGGSGQRFDWSLLQGQDLRNVMLAGGLGADNCVEAAKSGCAGLDFNSGVESQPAIKDASKLASVFQTLRAY

SEQ ID NO: 7633 - protein, 138 aa, Klebsiella pneumoniae
TMKTPIQMLEVFVSDIIENTVLLEEIYKKSNENYETDCSINSLIRSMRKTVDNMNGYIKSHINSVKPCIPVAARNDLTDDIFDVILTAKKLEAVAQTYSESFFTDEDNDNPACHMSAVIFDYARELCTDLKAIENKIG

SEQ ID NO: 7634 - protein, 398 aa, Klebsiella pneumoniae
VQKTNMAISDTKLRSIYGKPYSGPAEITDSDGLGIRITPKGVISFQFRFRWEGKQNRMGLGRYPALTLRDARNIVADLRESADKGIDPRTLAGGNKSKSKPTVKDCLDYWKENYVDVTLRAKTIALYKSTVIKHMRDAFPGIPVEDIPVRLWVERFTEEEKINPRRARHLLIQLRSAIGWCTRRQFISTTELMLLQPKDIGVKPVIGETTLSYNQLAKIWMAIERSRGSTSNRLLHQLLMLYGARNSELRLAIRGEFDREEGLWVVPAEKSKTNKIIRRPIFSAADDLLKKAEMTYGDILFPGEDLKSPITISGANKFLRRIKDSLGFGEFTSHDFRRTLATRLSEEGVAPHVIEKMLGHELGGVLSVYNKHDWIAEQKDAYDLYAEKIFWHIRMISG

SEQ ID NO: 7635 - protein, 233 aa, Klebsiella pneumoniae
MPETRTMRIEIMGIFSRFADIVNANINSLLEKAEDPQKLVRLMIQEMEDTLVEVRSTSARALAEKKQLSRRIEQAVAQQAEWQEKAELALRKEKEDLARAALIEKQKLTDLIAQLDHEVQLVDETLARMKKEIGELENKLSETRARQQALALRHQAASSSRDVRRQLDSGKLDEAMARFESFERRIDQMEAEAESHRFGKQQTLDQQFAELKADDEISEQLAALKAKMNQSNQ

SEQ ID NO: 7636 - protein, 103 aa, Klebsiella pneumoniae
KPRTAGRSGKSEATRNRQAGGSGKKLSDSPWLELIFWLADRWGEPDPSKIAALPANTLYHWRAYFLKQGTFRRPGDENAPPTETTPAPSRVDDECAAVMRALM

SEQ ID NO: 7637 - protein, 117 aa, Klebsiella pneumoniae
KRGTKMNKSLAGILGVTVALTLLAGCTAYDRTKDQFTQPVVKDVKKGMSRQQVMQIAGKPSTEVTMVHARGTCQTYILGQRDGKVETYFVALDETGHVMNSGYQTCAEYDTDPRNAR

SEQ ID NO: 7638 - protein, 283 aa, Klebsiella pneumoniae
AIATMRQPRMMTTEISTAREQQLFNGKNFHVVIYNKTESVSGLHQHDYYEFTVVLTGRYYQEINGKRVLLERGDFVFIPMGSHHQSFYEFGATRILNVGISRRFFEKHYLPLLPFGLVASQVYAVQSAFLGYVESVIASLNFRETEFDEFIELVSFYVINRLRHYREEPVADVTPQWLKNTVEAMHDKLKFGEGALENMVRLSGKTQEYLTRATQRYYGKTPMQIINDIRINFAKKQLEITNYSVTDIAYESGYSSPSLFIKTFKKLTSFTPSSYRKHLTSIN

SEQ ID NO: 7639 - protein, 357 aa, Klebsiella pneumoniae
QKIAQTDSHYRQEGDTDAIAPVSGKTRYAEAGRLSQHQARVKREEQNQKRSKERLMESKVVVPAEGQKITLQNGKLNVPHNPIIPFIEGDGIGVDVTPAMLKVVDAAVEKAYKGERKISWMEVYTGEKSTHVYGQDVWLPAETLDLIRDYRVAIKGPLTTPVGGGIRSLNVALRQELDLYVCLRPVRYYQGTPSPVKHPELTDMVIFRENSEDIYAGIEWKADSAEADKVIKFLRDEMGVKKIRFPEHCGIGIKPCSEEGTKRLVRAAIEYAITNDRDSVTLVHKGNIMKFHRRRVQRLGLPAGSRRVRRRADRRRSVGENQEPEHRQRDRGERRDRRCVPAADPAASGGIRRYRPV

SEQ ID NO: 7640 - protein, 160 aa, Klebsiella pneumoniae
SVYFDSVKSFDMRPEEKICIIFLMCLFGWMKMNFGVRLQRVLDEIGMSQSELGRRIGATSQSVNGWCQAGILPRKEMLEQLPDITGKPLYWFFMTDEDEETLQPPRSEDIYVLTPETKKLIEIYDQLPQVEQERFVGLMQLRLEELDAFMNEYLMKRKKD

SEQ ID NO: 7641 - protein, 120 aa, Klebsiella pneumoniae
CGPARLVGGAPALGGNLSEPSSGAPAPDQGCPGRHCPGVGGRGSGGQRAAGGRSAGGGRVAGGPLRANGRLQRAYRHPGATGGEDLSAADPAADAGGRPPGAAGGARHALGSAASVWCSR

SEQ ID NO: 7642 - protein, 159 aa, Klebsiella pneumoniae
SSTATATAARKCTISICICWAVVRLARCWRTKANVMLRTLLGACLAAGLLAGCSSHPEIPVSDQQALVMESSVLAAGISASEPAVVATEIQATASSTLYNERQQPVTVHYRFFWYDARGLEMHPLDAPRTIVVPARSSVTLYGSANILGAHKARLYLYL

SEQ ID NO: 7643 - protein, 204 aa, Klebsiella pneumoniae
TMAARPRKNNISIPNLYPLFSRKVNKVYWRYKHPITGKFHSLGTDEAEATAIAIEANKRLAEQQTRQIMAITDRISTSSGKSISTNTWLERYWKIQQERLKSGDIKENTIKQKAKPVSLLKERVGMKLISAVNVRDVAQILDEYLAEGQPRMAQVIRSVLIDVFKEAQHAGEVPPGYNPALATKQPRRKITRQRLTLEGMAKDF

SEQ ID NO: 7644 - protein, 272 aa, Klebsiella pneumoniae
SHYFEPGRGVRRMKLEASLKHFSPQGMHISDDVKSTSPNRLNGTDIMTGIGVTSSRARFGLAAFFGKAGISKTDEQLAIQALAQFAIKNAPKNVRKAAGDKLGACMLTLAQFAFAEYSRSADTSATCHSCSGTGFISSHEDVIKHPGIFDADGVEVKAPKIRNELVKRVCGVCGGKKVIHARCRCSGKGEVLDRKATKELGAPVFKTCERCSGNGFSVVPSATVHRAILKRLPDLHQSSWSRNWKPFYEGLVDMLHKGERQAAAEFEKATIY

SEQ ID NO: 7645 - protein, 286 aa, Klebsiella pneumoniae
GSCAYRNEGKEMKKAIMASIIALSAIGLVGCDRVEPGNVGIKVNKLGDDKGVGEVVGVGRYWTGWNTEVYIFPTFKQMKTYDDAFNFQMSDGTTIGYHIGVAYKVDPTKVTTVFQTYRKGVDDITDTDLRQKIADALNRLASRMSTDKFIDGGKAELLENALKEIQSDMGPVGIQVISLSYVGRPEYPPTVIESINAKVTANQKTLQREQEVKQREAEANMLRAEADGQADAKLKLAEAEAKSIQIRGQAMRENPEVLQLEAINKWNGTLPQYMSSGTNTPFIQVK

SEQ ID NO: 7646 - protein, 424 aa, Klebsiella pneumoniae
ISCAGDIPKAATRLRAALSCRREIMSALGHTRAHWSGVLAMTLCVFVLIASEFMPVSLLTPIAGDLHITEGLAGQGIALSGALAVLTSLTISRLTGSLDRKWLLLGLTALMAASGVIIALASSFPVYMLGRALIGIVIGGFWSMSAATAIRLVPQRQVPRALAIFNGGNALATVVAAPLGSYLGATVGWRGAFLCLVPLAVLAFVWQCISLPSMKSPRAPQRQGSVLRLFRLSTLSLGLLACGLFFMGQFTLFTYVRPFLETVTQVSPSGLSLILLTMGIAGFIGTLLITTVLNARFYPTLVAIPLLMAAIAGTLLLAGHHTGSVAVLLSLWGLLATAAPTGWWTWIARTLPEDAETGGGLMVAVIQLSISLGSTVGGLVFDSLGWHSTFALSGLLLLGAAGVTFLLSVKIRSSQRTAINELNA

SEQ ID NO: 7647 - protein, 538 aa, Klebsiella pneumoniae
RILATTGGLLRRRRGIVCRFFAFRLPFTFAERLLRPARRHQAAELTHRRAARLIDQLIQRPHQRLHKVLIAALFLADLRQHRLPVGGHVRSPGHLRQGMNERPAGLRRVDIAPLFAQETTLEQQLDNPCAGRFRAEAVGGAEDLLQIFILHEAGNPGHRRQQRGVGKVARRLGLTLHHLTPLAQQFIAFGHHRQRRAVVLFIALFAAKQRPPARLGQKTRLGDKLAVGDLKINLAFAEHCVRAELHQILAGDQGVHLRFVIGELHLAAAGGWDNRMVRVDLFIIPATVADLRIHYRLRQQVRRMDGNRIQHRMAASEVLFRQIAAVRTRIGDEFVGFVQLLADIQHVLRAEAETFGRLNLQRRQRERQRRGFGIALIVIAGHDCRLAFDALNHMLGQRTMQQAPFFILVRFAGFARHPGGDKTLLLRRDDMRLHVEEIFGDEIFNLFIATDHQAKYRGLHPPHREHPLIAGVAPQQGVGAGHIDAVQPVGAGPRQRRHAERHELAVGAQTVDRPLHRLRVEIVNQTALHLLTLLRRQL

SEQ ID NO: 7648 - protein, 190 aa, Klebsiella pneumoniae
EIVAMSLPPLDSVPLILRPQAWLHRRHYGQVLSPIRWWGRIPWLFYLVSLFVGYIERRRSPLDPVLRSLVSARIAQLCHCEFCIDITSMTLAARSGSQDKLLAVADWRSSTLFSEKERLALAYAEAATQTPPAVDDALRSAMAAHFDARALTELTALIGLQNLSARFNAAMAIPAQGLCQIPTSSSQNKE

SEQ ID NO: 7649 - protein, 318 aa, Klebsiella pneumoniae
LFPAARDDLEDNMTTKLINLPHLADMVFGVPHYVTRQTMDSVKAVLIPRIQGITEDAVIQMALNPGKSPAAEQVQPTGGVAVIPVHGILVPRRGQITAMCSELTSYERIRGQLQAALNDPSISEIVLDINSGGGAAVGCKELADYIYQSRDTKPITAIVNYSAYSAAYFIASACSKIIVSQTSGVGSIGVIMEHLDTSKMEEKMGLTFTTIYRGDNKNNGTQHEPLSEESLGMFQGMIDEMYETFTGSVAEYRGLNQQAVIDTQAGLYFGPGAVSAGLADEVSDPQAAINAIAAKYQQPRQKTSIQMQAAAMDLQTKM

SEQ ID NO: 7650 - protein, 65 aa, Klebsiella pneumoniae
AIAAGKRRHFSMPRDPERMAQAGLIDRSGEIFFHQLAQLRNQHLAYVEMAIGALRMGVFTGNDPS

SEQ ID NO: 7651 - protein, 62 aa, Klebsiella pneumoniae
GEAAIRHFVVSMAAMSYPSIIASRLHQIRLPHPPNPTDTIPGAHRDERSNTANPAPDGHDRA

SEQ ID NO: 7652 - protein, 72 aa, Klebsiella pneumoniae
SKHAPPVSHPTGTASRPSGHRLSPRYTESILASARRRRLVNRGQTELTGDIGDKKLPCFTIQTRFRRLFLIN

SEQ ID NO: 7653 - protein, 583 aa, Klebsiella pneumoniae
KSGALANWYTVSRQEVRNVSSWKSRTQKGLTMLNITPNFAQERGLNMLRRTWKAHDSFMVYAPTGSGKTGLAAFIAAGLVSRGMRVLFVAPYTILINQTAQRFTEYGLPEDQISFIWRDHPNYDPNLLIQIASADTLIRREFPKNIDLLIVDEAHLRKRRILKEIERITAEKKAKVIGLSGTPFAPFLGHYYQHLIKPTTIGELIQRGDLSKYEFFAPTKPDLSGVETKPSMEFGTDYDESQLAEIMCGSDLVGDIVDNWLRHGRDLPTVAFCVNKAHANFVTMQFNKAGINAEVMVAETPHEERQVMIHRFETGATKIIVSVGVLVAGFDSDVRCIIYARPTKSEIRWLQALGRGLRTAPGKDACLIFDHSGTVHRLGFPDSIEYDDLPSKNDGMKAAAAGATKEREEKLPKECPECHFMKPSGVYVCPKCGFKPLVGQDVETDGTRNIKKMSKHETVYTKSDKQSWWSQIKFYQRHRAAQGKPVSDGWCAHTFQEKFGEWPNGLSDFPMEITPEVSNHIKHKLIKFAKRRERLQQMGKKPDQDLFPPPSASINYEPPEGSDGQLIIEAKRKLQKNVNSASQ

SEQ ID NO: 7654 - protein, 466 aa, Klebsiella pneumoniae
RTIACKPALPQRNRRLASGEYALHFLPSGISMKRVSQLTALALLMGLAASTTCAAETMPALTLSHLQQQHGVAIDTRLSAYYNGWPQRANGPEGHEPQALNLSAHWLGAMSDDQLRAWAKQHQLQSDTPIALYGSPEDNVSVAARLKQTGFTRLSTLSDALSQTDRLQKLPHFEQLVYPQWLHDLQQGKAVAAAPAGDWKVFEAAWGAPKLYLLSHIPGAGYIDTNEVESEPLWNKVSDAQLKAMLAKHGIRHDTTVILYGRDVYAAARVAQIMLYAGVKDVRLLDGGWQTWSDAGLPVERGMPPAQQPAPDFGAPIPGQPQLMLDTEQARGLLHRQDASLVSVRSWPEFIGTTSGYSYIKPKGDIAGARWGHAGSDSTHMEDFHNPDGTMRSADDIATLWRQWNILPSQQVAFYCGTGWRASETFMYARAMGWPHVAVYDGGWYEWSSNPHNPVARGERGPESSQ

SEQ ID NO: 7655 - protein, 158 aa, Klebsiella pneumoniae
PAAALPAARRQPFSASHAQQLALCLALVAAGQRSCAPGRLAAAARGPSSPAAAAAAGDLAPLCSQRSRERSAVPLAAAGRGGFSRLPGRCQRTAGSGPGRQQPPGLQRTLPAAQAAADPQRPAPASAQPAAVAALLEYADRRYAGYQRPLFSRRAADG

SEQ ID NO: 7656 - protein, 184 aa, Klebsiella pneumoniae
ARQAQRRRAKAIRLILRREPHMSDYRRSYIPGGCWFFTVNLQNRRSDLLTRHIVHLRAATASVKSKKPFLINAWVVLPEHMHCIWTLPEGDTDYSGRWRDIKKMFTRALAQRHIWQPRFWEHAIRNEEDYRRHMDYVYINPVKHGHVRRVQDWPYSTFHRDVRRGWYPSDWAGEVSEFDAGERR

SEQ ID NO: 7657 - protein, 96 aa, Klebsiella pneumoniae
RDKALAWVDRNIHVPLTLPQKVGIASFCPYNIGPGKCFPSTFYQRINAGDRKGACEAIRWWIKDGGKDCRVRSNNCYGQVTRRDQESALTCWGIDE

SEQ ID NO: 7658 - protein, 156 aa, Klebsiella pneumoniae
KGKAMFKPHVTVACVVHAQDKFLIVEETINGKALWNQPAGHLEANETLLQAAERELWEETGIRATPQHFIRMHQWLAPDNTPFLRFLFAIELSDLCATEPHDSDIDRCLWLSAEEILNAPNLRSPLVAESIRCYLQDPRQPLSLIGAFNWPFTGGE

SEQ ID NO: 7659 - protein, 316 aa, Klebsiella pneumoniae
FMKAAVVFDLAEGPVWADFIDPQPAPGQTLIDVRAAAISHVVKARASGRHYSFDGNLPFVPGIDGVGTTPQGQRVYFAFPTAPFGSMAQRAPVALQNCLPLPDALDDIQAAAMANPGMSAWASLVTRAQLQAGETVLINGATGSAGQLAVQIARYLGAKKIIATGRNAQTLAALDADECIQLTADDKTLSGQFSAVSAAQIDVVIDYLWGHSAELLLPALAKYTPAGSPVRYVQVGSLAGADIALNGAVLRSAPLLLMGSGIGSLSVSQLLAATGEMLQAAVPGKLTIATTPRPLQEIAAAWPQDDSQKRTVFTLG

SEQ ID NO: 7660 - protein, 516 aa, Klebsiella pneumoniae
RAGAGMAAPLRYPLILLAWGAMAAIYLPLLPAAGELVGAARSPAHWRALFADPQLGQALAATLVSTLLSVGGALLIALTIVAALWPSARWRRLASRLPLLLAVPHLALATAALLLFAEGGWLWQQLPFLTPPVDRYGIGLGLTMALKESAFVLWVIYGLLGEKRLADQATALKSLGYGRWQCLRWLVLPALLPALGMVLLATTAWSLSAVDVALVLGPGNPPTLAVLAWQWLSQGDELQQAKGALANLLLMAILGGLALVAWGVWRLQRQYQPDLRGVRHPHPHALPGRLLAALLPLSGLLGALLLAGLARSAPPQMDALGNSLGLALAACALGAAVCLLWLACGPARGDGWVWLPLVLPALPLADGQYRLALYAWLDGDWWTVLWGHLLWVVPWMLFILRPAWRQRDPRLTVVARTLGWGSTRIFWLLTLPSLTRPLLTALAVGFSVSIAQYLPTLWLGAGRIPTLTSQAVALSSGGEAQTLAAQALWQLLLPAVCFTLTALLAWLAGRYRRGLR

SEQ ID NO: 7661 - protein, 266 aa, Klebsiella pneumoniae
KGGAGMIGRLLRGGFMTAIYAYLYIPIIILIVNSFNRSRFGINWQGFTTDWYSLLMNNDSLLQAAQHSLTMAVLSATFATLIGSLTAVALYRYRFRGKPFVSGMLFVVMMSPDIVMAISLLVLFMLIGVQLGFWSLLFSHITFCLPFVVVTVYSRLKGFDVRMLEAAKDLGASEMTILRKIILPLALPAVAAGWLLSFTLSMDDVVVSSFVTGPGYEILPLKIYSMVKVGVSPEVNALATILLVLSLVMVIASQLIARDKTQGTLK

SEQ ID NO: 7662 - protein, 226 aa, Klebsiella pneumoniae
VYLAALKNHNEEVDMKKLAAAALILGTLSTGSVWAHEAGEFFIRAGTATVRPTEGSDNVLGSLGSFNVSNNTQLGLTFTYMATDNIGVELLAATPFRHKVGTGPTGTIATVHQLPPTLMAQWYFGDAQSKVRPYVGAGINYTTFFNEDFNDTGKAAGLSDLSLKDSWGAAGQVGLDYLINRDWLLNMSVWYMDIDTDVKFKAGGVDQKVSTRLDPWVFMFSAGYRF

SEQ ID NO: 7663 - protein, 126 aa, Klebsiella pneumoniae
PAMAGWANGSGSRRKKIACRWKRSPTSWRVSTIVLSNSSAMSRRISTAITMCICSPRFIPSSRPLPARRALRYALTARWRRRVGSTSRRRAAAPASAASFTAKRSLRNCFCRRWMPPSPAGSAPWR

SEQ ID NO: 7664 - protein, 98 aa, Klebsiella pneumoniae
GPVACLVYFEDLAVSKKQEMPNTGYAIIRCDDGVIVARLTSFPVCERALMYRRGDTVSFMPLQPDEIVGTLSLFSQMIEKAKSGVGYQVPPGSVTIPS

SEQ ID NO: 7665 - protein, 152 aa, Klebsiella pneumoniae
RYPAGYSVSGQRCVSEWPYRTVAGNRCGEASSFPPAGAYAMSLKPGDMNCRIAISYVQSGRGPLGEPLPEKQVESGKAWAKRELVSGRKVRTLDQQQVVETCLFTVYPGVLVDIDWKITTKNLVYTVRNIDRKTDRIIITGEADGRHDRAGD

SEQ ID NO: 7666 - protein, 191 aa, Klebsiella pneumoniae
VRPAKSSRYPGGKMKHRWPTGSKMSGIWLPSAKAKHRFFHITEYASPACSGITHRIGEHSQMYDIHVILSNSPGSLGAMGMALGNNGVGLEGGGVFTTPDAGHAHFLVEDGETARRVLTEAGFTVSNVCRPLIRKLPQERPGELGDIADTLAHNGINILVQYSDHCNRLILLTDDDARAAEVTKKWAILSE

SEQ ID NO: 7667 - protein, 385 aa, Klebsiella pneumoniae
YAAAAPSPGAAFFPLLPTLPQSPRPTLYFFLRLFILRLSTTNLSDAMQKKSIYVAYTGGTIGMQRSEHGYVPVSGHLQRQLALMPEFHRPEMPDFTIHEYHPLMDSSDMTPEDWQHIADDIRSHYEEYDGFVILHGTDTMAFTASALSFMLENLGKPVIVTGSQIPLAELRSDGQINLLNALYVAANYPINEVALFFNNRLFRGNRTTKAHADGFDAFASPNLAPLLEAGIHIRRLGTPPAPQGSGDLIVHPITPQPIGVVTIYPGISADVVRNFLRQPVKALILRSYGVGNAPQNGEFIQVLAEASQRGIVVVNLTQCMSGKVNMGGYATGNALAQAGVISGFDMTVEATLTKLHYLLSQQLDIDAIRAAMQQNLRGELTPDEA

SEQ ID NO: 7668 - protein, 527 aa, Klebsiella pneumoniae
YEQARTIMQTSKPALELLTSDAIYRENPTALFHQLCGARPATLLLESADIDSKDDLKSLLLVDSALRITALGDTVTIQALSANGAALLELLDGALPSGINNQRQPNGRILTFPAVSALLDEDARLCSLSVFDAFRLLQELVSVPDNEREAMFFGGLFAYDLVAGFEDLPQLQSDTACPDYCFYLAETLLVIDHQTKHTRIQASLFTPQESEKQRLEQRLSQLRQQLNEPPAPLPVTTVAEMRCDVDQSDEEYGAVVRKMQRAIRAGEIFQVVPSRRFSLPCPSPLAAYDVLKKSNPSPYMFFMQDNDFTLFGASPESSLKYDAVSRQIEIYPIAGTRPRGRRADGSLDRDLDSRIELEMRTDHKELSEHLMLVDLARNDLARICTPGSRYVADLTKVDRYSFVMHLVSRVVGELRQDLDVLHAYRACMNMGTLSGAPKVRAMQLIAAAEGKRRGSYGGAVGYFTAHGDLDTCIVIRSAYVQEGIATVQAGAGIVLDSVPQSEADETRNKARAVLRAIAQAHHAKEIF

SEQ ID NO: 7669 - protein, 135 aa, Klebsiella pneumoniae
LMQAFHQRGIHHYIADRPLIAHQQDGFRRRQIYRLTASAIPECFRHPHPQGITYFLSKVIPPSVELPYFIKFLAWGTLHGCIVHHPNLITAIINILCRPIETERNKKSSIENENHSFFYLQNSSAPAGLHHSTVK

SEQ ID NO: 7670 - protein, 375 aa, Klebsiella pneumoniae
RSRALSSTTSTRMAVLPSIFDSSLTLIIYAKYKRLLNKAFYKKGPWCPRAGQHSAAPFAHTAWNSFILCVISVNAQRQDANGERVGDVNFLCNSAGITPQERRRLSIMSQQQSADWVRLAQSPSRTERIEAFFGGHGYEPHRHDTYAIGQTIAGVQSFHYRGGLQHSLPGGTMVLHPDEIHDGEAGTEAGFHYRMVYIEPALIQKILGGRPLPFIPDGLSADPRLRRAAQPLLKAVTDTFEPLEEEDALYDLAQTLAVVGGQRSRRQAFDYQAAERAREYIHACFMQDMTLDTLSQVSGRDRWSLSRDFRTLYGTSPWRYVMMRRLDFCRQRMRAGERLVDIAADAGFADQSHMTRQFISRFGLSPGRWLRAIRG

SEQ ID NO: 7671 - protein, 70 aa, Klebsiella pneumoniae
AWRAESMIAYLRVVLSVVIVASVYGLFVPILISMKDTTAVISGFALAILTPPCIYAICKGLVLTVTKEKK

SEQ ID NO: 7672 - protein, 227 aa, Klebsiella pneumoniae
RFLFPSGVKGFSPLENGECPAGAASCALARGEVRVTLYGALLSGEDAMIIYLHGFDSNSPGNHEKVMQLQFIDPDVRLISYSTRHPKHDMQHLLKEVDKMLQLTADDRPLICGVGLGGYWAERIGFLCDIRQAVFNPNLFPHENMEGKIDRPEEYADIATKCVTNFREKNRDRCLVVLSRQDEALDSQRSADLLHHYYEIIWDEEQTHKFKNISPHLQRLKAFKTLG

SEQ ID NO: 7673 - protein, 67 aa, Klebsiella pneumoniae
IRNFSRPGIWFTIDRAELCVTDCHVSFLYSPFWYFMYLFCTQYRMNEHKQQYQIMYNHVHNLTEKKK

SEQ ID NO: 7674 - protein, 308 aa, Klebsiella pneumoniae
AFSYQFVGRSPTMSLRALRHFVVVAEELHMHRAAERLHIAQPALSQQIKQLEQRLGVVLFSRANRRLTLTAAGEAFLHKTRLALEMADQAVLDAQRIARGEQGRLHLGYVSSAMYDSKLPGLLRRLRADWPGIELSLVQGDVQMLYEALLDLRLDIAIIRAPLASPPDALVVRPFVREKLCLALYQQHPLAGVGALNLASLRTDNWISLDDPQGTGLEQVFMDACRVAGFTPQVAQRINDVTSMISLVSAGVGVALVPLSARALRLDNVVYIDLQDRLAESELSMVYHRHIRSAVVRKVISLLNTAER

SEQ ID NO: 7675 - protein, 229 aa, Klebsiella pneumoniae
PLTYFGVMVMRNRFPVTLWLTLVALVAALALPARANTWPLPPPGSRLVGQNQFHVVQDDGGSLEAIAKKYNVGFLALLQANPGVDPYVPRAGSVLTIPLQTLLPDAPREGLVINLAELRLYYYPPGKNEVTVYPIGIGQLGGTTITPTMVTTVSDKRANPTWTPTANIRARYKAMGIELPAVVPAGPDNPMGHHAIRLAALWRSLSPARHQCRFRHRYARQFRLHSSAR

SEQ ID NO: 7676 - protein, 379 aa, Klebsiella pneumoniae
KAAYFHDLQFQAINAFSSGDAPRYEQIMDLFSKEKARITAELSPFEPSAQTTSLLLSEAWGMFTAEKGKGWAATIANENQRYYDVLIYVVGDLPVSSISKQNIRQTLEVVKNLPRRNKKPYSEWTLEQCVEADIPEDDLISSANVKKHLKIYSSFFKVFLKDEKDILEKAPTEGIKYEVQENKSGHYSRPEMRRFVERLNTFTDWRRDYFLTLIYTGARRGEIAAIRKEQFRKDEETGRYYIFIADGKTEHAQRQIPVSRTLEALLVERVKNIKSSALVFGDLPPYEQIGIEWYSLMESCQVLKYNEFGQRRVIHALRHTFISEAIAKTHNAALAQFVVGHSRTQSLGITARYAHRPLLKDLLPVVDCIQWYTATSISS

SEQ ID NO: 7677 - protein, 689 aa, Klebsiella pneumoniae
MEKYVMYFHIRDIFMSKIDFEKLSEECKGYKVTSLLDALPDYAENPSLRNLIEYETVNIKNLQIHNTKNRKKRDDFFDALISNINNQEATDRLKKILSVCHISEIYIDSIKEELKSSPLMSQDFKIQCWAVIEKALDEGYYLLDQINKSIDYYGENAKHLTLNNRNILNENGESFSPDSALDKIVNYLTLTIKMLSHEHGFSASGEIIIPERIDVEESAIAGANQVFYYSLLWNELLTCAESCILFDNEIQIAGLEDLTDEFKEDGVEQGVLFNRTKDEFERYDTISNERLSRRISQNYWEAMADYNLERRIPKYVTDWSGTLNHPITFEELPFLVSLMEAIASHDPEQIVLGLSLREWVRGYSVISYLAKEIKNKVLYTKGELMSMLLLGGFKEKKAEEFIKHITFGVDSRDIYDSPLVKTSNSLFFLYTPAHISPLISNIILSKFSSKQADLTKKGYGFERDIIEKLNENNLENRSFKFKRDADEFEYDAIFLLDDKAFILECKNTNLSGGSVARAYQKKIFINETIKQVKRLVCGLTSHPEVFKEHFDKDISNYELVPVIMNNLPFSIPGKVNGVYVTDSSAFGRLIKSRYINSGLISHQGRFKITDNKPAFSMWKSDVLTASDIINHFNEPVQLQDFLKHQKTKEYLLRINKSKVFLNVVNETDYDTMSAEHSEFFINAQTTQKA

SEQ ID NO: 7678 - protein, 650 aa, Klebsiella pneumoniae
PRKYLIMFQDNPLLAQLKQQLHSQTPRAEGVVKGTEKGFGFLEVDAQKSYFIPPPQMKKVMHGDRIVAVIHSEKERESAEPESLVEPFLTRFVGKVQKKDDRLAIVPDHPLLKDAIPCRAARGVEHDFKQGDWAVAEMRRHPLKGDRGFYAELTQFITFSDDHFVPWWVTLARHNLEKEAPDGVATEMLDEGLTRRDLTTLDFVTIDSASTEDMDDALYAESTADGKLLLTVAIADPTAWIAEGSKLDNAAKVRAFTNYLPGFNIPMLPRELSDDLCSMRANEVRPVLACRMTLGADGTIEDNIEFFAATIESKAKLAYDDVSDWLEGRGSWQPDSEAIAQQITLLKDVCQRRSEWRQTHALVFKDRPDYRFVLGEKGEVLDIVAEPRRIANRIVEESMIAANICAARVLRDKLGFGVYNVHTGFDPANTEQLAALLKTHDVHVDPTEVLTLEGFCKLRRELDAQPTGFLDSRIRRFQSFAEISTEPGPHFGLGLEAYATWTSPIRKYGDMINHRLLKAIIKGETIARPQDEATVQMAERRRLNRMAERDVADWLYARFLNDKAGTDTRFAAEIIDVSRGGMRVRLVDNGAVAFIPAPFLHAVRDELVCSQENGTVQIKGEVVYKVTDVIDVTIAEVRMETRSIIARPAV

SEQ ID NO: 7679 - protein, 335 aa, Klebsiella pneumoniae
LVEYMTIKVGINGFGRIGRIVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLVSWYDNETGYSNKVLDLIAHISK

SEQ ID NO: 7680 - protein, 144 aa, Klebsiella pneumoniae
AMMYKRTDLTLSMFYASSADADGNKVATLTMQVIAAEAGAVQTSQLLCITDSAKKKTYSVGEQSVSNGSDPLLVAIENYWRQSTDTAVKGLIAEVTDFIAGNINSVSTWIGQFGMKVFENQPLDERLPESVLQADGGSATATGS

SEQ ID NO: 7681 - protein, 83 aa, Klebsiella pneumoniae
DSQYTNGSTRSHAFVSIPAKQTIIFFRISGAPDSALGTQGTSWAREDSPGRMGHIDHHDFLWFCEDKNNDRAKKTKIEEEHYH

SEQ ID NO: 7682 - protein, 511 aa, Klebsiella pneumoniae
DMDFENELTSKILDPIHGTIRLTTLEIASINHPLFQRLRNIKQNSFLYKVFPSAVHSRFEHSLGVLHLSSEILNNLRLNAIRYQKKYDDGHVFGHIDQIPKHNIQELRLAALMHDIGHGPVSHQFESFMPGKHEFSDVLPTAYHSIIDVLSKPEQKVEHEQLSLLFSLMIYHDLRKQGKVDDEINIENVLKIIEKRYGDQQIIEEINGKATDILPLMTSIISSCPIDADRMDYLLRDGYFSGVKCGIYDYNRLFMSIVPVEEQGKLYLAYKESGIDSIAEFIGARSSLFSQVYYHKTNRAFATMLSTLCEIMQSKDPQNVIIADVTDRIVDHSDESFIDALKDFYLACSDDYFLNDKVGEWIDISDIEAVNKKIIDDIINRHPWSKVYEAKHSVYKANIADKENKAWKSQLTGLLTSVLQPHFKPHEFAVDIVSDCAFKDLDKTEVKLLVKDLKNRYEIKPLIECGDKLNQYQIIKYCIRVFVDRDIKERVTPEIIYKINEIVVKQIALLN

SEQ ID NO: 7683 - protein, 79 aa, Klebsiella pneumoniae
TFHLAPLNHPANRMLSNHTTASLQNKYFLTATFLIQRTRSLPISSYTQATTIRHALLLLEPYIPPQCCYAISEKMAKEI

SEQ ID NO: 7684 - protein, 183 aa, Klebsiella pneumoniae
LPNLLQTFARSSALNCFYSQEPAMTPFYQLTATRLRGQPLSMADYAGKVVLVVNTASHCGFTPQYAGLEALYKKYAAQGLVVLGFPCNQFGKQEPGGADEIEQTCHVNYGVSFPMFEKVDVNGPAAHPLFRYLKQALPGVLGGRIKWNFTKFLIGRDGTPLTRFAPFTTPEKMEASIVAALTR

SEQ ID NO: 7685 - protein, 373 aa, Klebsiella pneumoniae
AFVHFGSSFLLCNDKPGINSVIFQAEQRNHVRLCYCVNRIDLPTSDGGAMRGTASIMKTYVIDCLLFRQSKPRSLSFQRQRGSFKPTACQTDSLSEGAMTLQQEIIQALGAKPQIDVAGEIRRSVDFLKSYLQTYPFIKSLVLGISGGQDSTLTGKLCQIAINELRAETGDSSLQFIAVRLPYGVQADEQDCQDAIAFIQPDRVLTVNIKAAVLASEQALREAGIELSDFVRGNEKARERMKAQYSIAGMTKGVVVGTDHAAEAITGFFTKYGDGGTDINPIFRLNKRQGKQLLAHLGCPEHLYKKLPTADLEDDRPSLPDEVALGVTYENIDDYLEGKTLDPSIAKTIEGWYLKTEHKRRPPITVFDDFWKK

SEQ ID NO: 7686 - protein, 558 aa, Klebsiella pneumoniae
DRVQLYNQTENMRLKLSSLLAAVSLLCGPAFAAPALPDRADIRDSGFVYCVSGQVNTFNPQKVSSGLIVDTLAAQIYDRLLDVDPYTYRLVPELAESWEVLDNGATYRFHLRRHVPFQRTAWFTPTRDFNADDVIFTFGRIFNRDHPWHNVNGSSFPYFDSLQFADSVESVRKLDNQTVEFRLKRPDASFLWHLATHYASITSAEYAARLTQDDRQEQLDRQPVGTGPFQLSDYRSGQYVRLQRHPGYWRGKPLMPQVVVDLGSGGTGRLSKLLTGECDVLAWPAASQLTILRDDPRLRLTLRPGMNIAWLAFNTAKPPLDNPEVRHALALAINNQRLMQSIYYGTAETAASMLPRASWAYDNDAKITEYNPQEARARLKALGLENLTLKLWVPTSSQAWNPSPLKTAELIQADMAQIGVKVIIVPVEGRFQEARLMDMSHDLTLSGWATDSNDPDSFFRPLLSCAAIASQTNFAHWCNREFDDVLQKALLSQQLSSRMDAYKEAQRILARELPVLPLASSLRLQAYRYDMKGLVLSPFGNASFAGVSRENTEEVKKP

SEQ ID NO: 7687 - protein, 112 aa, Klebsiella pneumoniae
DVYHHRRTQMIVRTWHGCVPLQHVEGFARHLERTGVEHAQSIAGNRGALVRQENQGEWAHFFLATYWQDLAAVKAFAGEDYHVAVTYPDDEAFELLSDPYVFQHEVEAVSPL

SEQ ID NO: 7688 - protein, 419 aa, Klebsiella pneumoniae
RYDQPYLVLADLGGAMSAQHVLIVEDSLVYRRLLSRMLTQWGYIVSEAENGVAALAILENQPVSLVISDWEMPEMNGLMLCREVRRRQFGHYVYLILLTAREDPGDLTQGFAAGADDFLSKPVEQSELRARLHAGARILSLEADLAARNTRLSEALRQIEQDLELAARIQQSVLPAHQLCYQGFFSDWIFLPSAWVSGDIFNVFPLGEHLGFYCVDVSGHGVGAAMMSLAVARQFLHGRAVERFLFSADNQPASPAEVVQILNGRFCSDEAEIVSYFTLIYGVIDLTTGEGKLCQAGHPTPFIVTVDGGVRSVGSGGAPVGLINHLSWADVSFSLAPGERLCLFSDGITECENRSGEQFGEVRLQAWLQDSVTQPLPALLPRFARHLIHWRNGDAQETQSMADDVSLLIIERTGDSDEN

SEQ ID NO: 7689 - protein, 620 aa, Klebsiella pneumoniae
QTCHSNSARNQDILAMDFYFSRFEHRRPPEPLSTPSWVRMIWQVFAVAALVLGANYIYWRWTASLNTDALWYAIPLVLAETLAWIGTVLFTINLWQEKDPPPGVPPTEINDCLRADEAVESRPIKVDLFIATYSEDVELVRLSIRDAMQMTYPGPLDYKVHVLDDGRRPEMKAVCEQEGANYITRQSNIGYKAGNLRNGLEHTDGDFLIICDADTRVFPTLLSHTLGYFRDPDVAWVQTPQWFFDLPEGEDLACWLRRKAGGAGYGVGWLAQKIVGPVTIGRDPFFNDPRMFYDVILRRRNWANAAFCCGAASVHRREAVMQAALRSYVWSVDAEIDRHTRDIRDPVTREALQDAMRPHVAFDTELTPYKFHVSEDIYTSILLHGDAARRWRSVMHPRIESKMLSPQDMLTWMIQRFKYAAGSLDILFHDNIFSRRRFKLSLPQTLMYATTFWSYLACVWNTVFLISPVIYLFTGIPPVSAWSTPFYLHFLPFFIVSELAFMFGTWGISAWDGRASYLSFFSMNLRALDTVLRGEQIKFHVTPKERQTGRFLYLVKPQIAIVLLTLTGLIWGGIQVARGEVDDPSGYVINIFWGAVNIAAMLPLIFAAMWTPPEEQEASR

SEQ ID NO: 7690 - protein, 484 aa, Klebsiella pneumoniae
PCRHKSWLSTSPGYKNIRRTGMNFPLIANVVVFAVLLFALGQTRHKQWSLARKVLVGLATGVVFGLALQLIYGSDSQVLKDSIQWFNIVGNGYVQLLQMIVMPLVFASILSAVARLHNASQLGKISFLSIGTLLFTTLIAALVGVLVTNMFGLTAEGLVQGSAETARLNAIQSNYVGKVADLSVPQLILSFVPKNPFADLTGANPTSIISIVIFSAFLGVAALKLLKEDVEKGQRVLTAIDTLQGWVMKLVRLVMQLTPYGVLALMTKVVAGSNLQDIIKLGGFVVASYIALGIMFVVHGLLLAINGVSPLKYFRKVWPVITFAFTSRSSAASIPLNVEAQTRRLGVPESIASFSASFGATIGQNGCAGIYPAMLAVMVAPTVGINPLDPMWIATLVGIVTVSSAGVAGVGGGATFAALIVLPAMGLPVTLVALLISVEPLIDMGRTALNVNGSMTAGTLTSQWLRQTDKSIFDSEEEAELAHR

SEQ ID NO: 7691 - protein, 198 aa, Klebsiella pneumoniae
PSTQSASVSWAEPPSHRRWSQPCPTNGPIRPGHLPPIFARATRLWGLSCRRWCLLVLTIRWAITPSASPPYGGVYLLHGTNADFGIGMRVSSGCIRLRDNDIKALYNTISPGTKVNIINTPIKASVEPDGRRLVEVHQPLSEHIDDDPQTLPITLNAAMTAFKQAPQTDGTVMERAMNYRSGMPIDVTRHAEPGPQSL

SEQ ID NO: 7692 - protein, 554 aa, Klebsiella pneumoniae
RRYQRDRAGKPGLHFPGADAVSGLPEPCPSTLVLSRSNAMKLTYFSRFPLLAGLMALWLSLSGAQAATGLPAAEYAPRSGELTPREMTIARNAWQYFVANFQPTTGLVNAVNKYPSTTMWDSASYLAAMTAARELGIIDKAEFDRRMLKFLATLNKLDLFRNELPNKAYNTVSGQKVNYQNKPGEIGYSALDIGRMLIWLKVIKERYPEYSNSIDNVVLGWDFSHVVDPCGTLYGAYLENGQPKYVQEGRLGYEEYGAAGFQLWGFNTCQASRPQPYELAEIYCVMVPYDSRDPRQTSQHNYVVSESYVLYGMEFGFDNPGDRNDSPREYSHPWMKNFADRVYQAQENRYAITGILTARSEHQLDKSPYFVYDTVFSDGFNWNTITDKGQFVPNSAAVSLKAAMGMWVLWNSPYTDRLLDAIENANEAGKGYYEGLYENGDGPINEFTANNNGIMLEALLFKKEGKLLQFSSDNPKNRDFAPSLWDKKLVDLFEPNNGPRNRPFLSNTPAVKTWCEQTGTTQRTQPACQACQCAACKADEPVKLPPVTAQCLKP

SEQ ID NO: 7693 - protein, 208 aa, Klebsiella pneumoniae
MIHQPGDKPGTYERFAMLQNMLNPEPTSTGIRSGNRVIGYSAAIRLLDNGRYDKHLADGMEILACIMEAVESNWITLNIEKELILWRWLLAAVFITEELEKNGTVDVPNDTGGVDTAVIYSSKHGAISVYPGPERFALANHIELGAIEKYGPEVGQQLALRMYQDMVIADEEFGFRLSALGREGFNLLHDSFIEHIQIEGVPEAPIMH

SEQ ID NO: 7694 - protein, 196 aa, Klebsiella pneumoniae
IANHVHLWPYSINNVQRPHLAEDYETMVPFQALQMIGHQVDAVCPDKAAGDYVMTAIHDFDGAQTYSEKPGHRFTLNADFAAVKAENYDALVIPGGRAPEYLRLNEEVIKLVQAFDAARKPIAAVCHGPQLLAAAGILQGRTCSAYPACAPEVRLSGGHYADIGIDQAHVDGNLVTAPAWPAHPQWLAKFAALLAE

SEQ ID NO: 7695 - protein, 65 aa, Klebsiella pneumoniae
AADHARRAESLRPEPEGSDQNRLTISRLASRQAAISTRYLPFHVILHANTSDGPMIDTLTPGDAL

SEQ ID NO: 7696 - protein, 101 aa, Klebsiella pneumoniae
KVRHLTQNPAYHQLKSAALIFLKTTIVFSTEHHPYKVYIMIEHIHFRCPCCHGSQYRTSQFDVTEKNPFGAKCIFCKSAMMTFDAIRPRHLGAQSTAQAQQ

SEQ ID NO: 7697 - protein, 354 aa, Klebsiella pneumoniae
QDLHTEDVEGLMRALLNVDIARHLGIVLLKPGSELMPLFGAGRVLVEIPPASMKKIPSGRLPDARQPLRDDMGIRPFFMKKAVITAAGGVSALESWLRRQVKNCQWTHSDYHHHELVPFRHSTGVIIACWHCDNELKNQTEQTLDQLVGVNNADWVIDTARIALGLDAQRSLSLAELCWWAVGAGIGDEITEEMARRSLRIKDDGIKSVYRESEIVPSVPATSILSPRIEKAIRPTAKTTPGKPLVPVNVDPVAPATLFARPKRSRWLSADFISWVKKQPCMCCGQPADDAHHLIGWGQGGVGTKAHDIFTIPLCRKHHRALHHDPAAFEREYGTQPVLIIKLLDRAYALGVLA

SEQ ID NO: 7698 - protein, 82 aa, Klebsiella pneumoniae
KSKHGGYSHVVGKKLSAVVVNWLPSPGGTRRRIAKPHPNTELTGDNYEGFCPSTYREPGDPPELVRGETTPAVLLAGAERKP

SEQ ID NO: 7699 - protein, 421 aa, Klebsiella pneumoniae
TSVHRTERSFPKDTPDMKEIALPLHPAPARVWIAVVALGICAFSIVTSELAPVGMLSALAADFHQTESGVGLAVTAYGWVGALAALLSGAMPTRISRKALLVGLMLILAFSCLAATRSYSMFALMSARMIGALAHGAFWALIGIVAAQLVPPHRLGLATAIIFGGVSAASVVGVPLASFIATLAGWRLAFMSMALLSLAAAAVLCSTLPPLAAPAPVRLRVYRDIFRNPLLGGLYGATACIITAHFAAFTYIEPLLINLQGVPATALSGLLLLSGVSGLLGNVIAGKLIDRHLKGLIFAALLLSGGALALLGAARLAPLPFCFSGLLLALWGAGIAIVFVGLQTWLLRSAGAVAQPASAIYVAIFNAAIGTGAFVGGQLIASAGLSGMVWLAAGIMVGSTLLIALLKAPLPGQISAATAGA

SEQ ID NO: 7700 - protein, 452 aa, Klebsiella pneumoniae
TLSQFQQVIAASLARLFFRHAISVAWLFLCQRGTTMKRLPLLAALPLLCASALSAQPLMSVGYFNGGGDVTAGPGGDIDKLDVRQITHLNYSFGLIYNDEKDETNAALKDPAHLHEIWLSPKVQADLQKLPALRKQNPDLKVLLSVGGWGARGFSGAAATAESRAVFIRSAQKIIQQYGLDGIDLDWEFPVNGAWGLVASQPADRDNFTALLKSLREAVGEQKLVTIAVGANAESPKSWVDVKAVAPVLNYINLMTYDMAYGTQYFNSNLYDSSHWPTVAAADKYSADFVVNNYLAAGLKPSQMNLGIGFYGRVPKRAVEPGIDWTKADAQNNPVTQPYFGPQQIALFASLGYDLSKDTYVKYNDIVGKLLNDPQKRFTEHWDDEAKVPWLSVQSAEGKPLFALSYENPRSVAIKADYIKAKGLAGAMFWEYGADDQNQLARQLAESLGIKH

SEQ ID NO: 7701 - protein, 836 aa, Klebsiella pneumoniae
NSAQTILSWSRSCWDSSLKGLMLRSSPSPTPLILMTGRRGAVPPTNCAARRSPSAFNALPGCSSKWRAGRSRPARPCQMTCATRWPRQPQAATGGYIADRRRSSVIVKRLLLLMVCLPLAHAGSAPVTWSLAGQWRVHDANDSAFDGAQASDGDWRTLRVPANWYSAGYDHQGALWYRHQFTLHGLSPDAMATLVFDGVDYFAEVALNGKTLARHEGYFQRFPVDISGAVRRHNQLAVRVDSPNEDPQKIWPLHKTLMKGILNQHDTRPGGAWSVQGQDANSGGIWAPVRLHLSRGVTIDEVILRPDWQQGLEQPMLRAEIRYRAVTPGPVTLRLTATPDNFSGPRFHQAFAVTLEKTAGVLHVSLPMPSAKLWWPVGAGKPNLYRVRATLTDDRGMMDTAVTRTGLRKVEALADNQGWRINDRRLFIKGSNYIGSPWLSTMTRKKYRRDFRLVTAMNANAIRVHGHVAGRALYEVADEMGLMIWQDVPLQWGYDDSAAFAENAVRQTRTMMDQFGNSPAIIVWGGHNEPPWNSPWMEKRFPDWRKTLNQTLTQRVGDALAEDTSRIVHRFSAVEEHYWAGWYFGTLRDLLAPAKTGIITEFGAQALPRLSTLKTIIPARLLWPKTTAADDPGWVRWKYHNFQPFQTFKFAGIPRGNNIQEMIENTQAYQARLVALAAESYRRQRYQPVTALFHFMFVETWPSINWGVVDYLRQPKAGYYALQRAYQPILPSIEPVTASWRQGSPATVRLWAINDTWAACEDCRLTWQVRQNGQMLAQGETSLTLPPDAGQMVRELTVTPAGPQPVTIVYRIDNRRGKHVGANQHTEPVAAAQAGR

SEQ ID NO: 7702 - protein, 60 aa, Klebsiella pneumoniae
DTRQLMAAALVVVIGQNSIPESFGRLTGYLTRLARVLCFMGLANRPAAAVIRERRQALAG

SEQ ID NO: 7703 - protein, 77 aa, Klebsiella pneumoniae
RMRQRMNSKWQRAGQQVKPGLKIVGKLALLTALRYGPAGVAGWAVKSVARRPLKMLLAVALEPLLSRLANRVTRGMK

SEQ ID NO: 7704 - protein, 188 aa, Klebsiella pneumoniae
LTGHPPRFPPHGVKILFIHATMRRVSGIFLAFLFWQGPLYMFDTTLLILLGLAALGFISHNTTVAISILVLIIVRVTPLNAFFPWVEKQGLTVGIIILTIGVMAPIASGTLPPSTLIHSFMNWKSLLAIAVGVFVSWLGGRGVSLMGSQPHLVAGLLVGTVLGVALFRGVPVGPLIAAGIISLFIGKS

SEQ ID NO: 7705 - protein, 447 aa, Klebsiella pneumoniae
LLFNNWLIILGVHMTTPLKKIVIVGGGAGGLELATQLGRKLGRHKKAKITLVDRNHSHLWKPLLHEVATGSLDEGVDALSYLAHARNHGFQFQLGSVVDINREGKTITLGELRNEKGELLVAERKLPYDTLVMALGSTSNDFNTPGVKENCIFLDNPHQARRFHQEMLNLFLKYSANLGANGKVNIAIVGGGATGVELSAELHNAVKQLHSYGYKGLTNEALNVTLVEAGERILPALPPRISGAAHNELTKLGVRVLTQTMVTSADAGGLHTKDGEYIEADLMVWAAGIKAPDFMKEIGGLETNRINQLVVEPTLQTTRDADIFAIGDCASCARPEGGFVPPRAQAAHQMATCALNNILAQMKGKPLKAYTYKDHGSLVSLSNYSTVGSLMGNLMRGSMMVEGRIARFVYISLYRMHQIALHGYFKTGLMMLVGRINRIIRPRLKLH

SEQ ID NO: 7706 - protein, 486 aa, Klebsiella pneumoniae
GDINNLSEEPMSSFSSTDGQSKSNYAGMSERRSIDYIPESERHGHPFSQFTLWFGGNLQITAIVTGALAVVLGGDVVWSLVGLLVGQMLGAAVMSLHALQGPRLGLPQMILSRAQFGVFGAVVPLVLVCVMYIGFSASGTVLAGQAMAKLLNISHVAGMLIFSAIIIVIAVLGYKVIHKLGRLASIVGILAFVYMFITLLLSADLSALAHNNHFSLPTFLLAVSLSSSWQIAFCPYVSDYSRYLPRDVSATKTWCSVFFGTVLGTQTSMTLGVLTAAIAGSAFPGHEVSYLVGLGKSQAMAMVIYFAICFGKITFTTLNAYGSFMSLTTIVSAFRRQTVLSQKCRIAFVVLMVTASCIIALLSEPAFLKHFTHFLLFLLAFFVPWSAICLTDYYLISKGAIDIPALSDPQQRYGFWNLYAITLYIVGVLIQLPFIENPLFHGSLTWIFAGNDVSWIIGWFGTGVLYYALRRFDRRSLPAQSLFPST

SEQ ID NO: 7707 - protein, 64 aa, Klebsiella pneumoniae
GRVKAVLSKGNCEKGSDEHDNPSHSIATSFSSMYAIFKFFIALPFANKKAPQMRGYTVDIPTKG

SEQ ID NO: 7708 - protein, 413 aa, Klebsiella pneumoniae
IMFLPQMFRGRQYSGNSFWEAMLGGVRSSQSKTGIIITPETALGLSAVRACVTLLAESVAQLPCELYRRDKNGGRQRATDHPVYDLIHSQPNRKDTSFEYFEQQQGLLGLEGNCYSIIERDGKGYPKELIPINPKKVIVLKGPDGMPYYELPEVGEILPMRMMHHVKVFSLDGYIGSSPIQTNADVLGLNLAVEEHAAATFRRGTTMSGVIERPKEAATIKSQDAIDRLLAKWTERHSGIHNMFSVALLQEGMSYKQLSQDNEKAQLLQSRQWGVEEVCRLYKIPPHMVQMLAKATNNNIEHQGLQFVMYTLLAWLKRHEGAMQRDLLLPSERRDLYIEFNVSGLLRGDQKSRYESYALGRQWGWLSTNDIRRMENLPPIAGGDKYLTPLNMVDSAKILPGDKSPTAKQLAEI

SEQ ID NO: 7709 - protein, 237 aa, Klebsiella pneumoniae
MNLLKPQQDSEPEEALETAMAMVASALSDSSRVSILCALMDGRAWTATELSTVAEVSASTTSGHLARLLSNGLVVCLAQGRHRYYRLAGSHIAGLLENLMGVSMQAHKALLPSTPVNLRYARTCYDHLAGELAVNIYEFMLREKWLAADGLALTSAGKTQLERLGAVFNARPRRKPCCPCLDWSERRFHLGGDAGSALMTLFLQKGWITRAPGYREVQVTDSGKAALSRLFNLKVSG

SEQ ID NO: 7710 - protein, 60 aa, Klebsiella pneumoniae
KINNLLFCREIMESIKEGRLKTKHFTRNNLQIYTGARKNKMAKKDARNKAGRPADGLPSG

SEQ ID NO: 7711 - protein, 130 aa, Klebsiella pneumoniae
LSLNSCSRMLMPPRAKRPCRHRGCATVTNDVGGYCEMHRQQHAGDGWRNYQPGKTRQERGYGRPWEIKRARIMKRDKYLCQNCRRDGIATKASSVDHIIPKAHGGTDDDFNLESLCWTCHSKKTATERTR

SEQ ID NO: 7712 - protein, 195 aa, Klebsiella pneumoniae
QLNNLVERSLASASLLREWQKIFDIADENHKYMGNAMLLAIVTGQRLGDISRMKFSDIWDDHLHVEQEKTGSKIAIPLALRCNAINWSLRDVISRCRDYAVSPYLVHFFRTTSQAERGAQVKPRTLTMNFSKARDSADIDWGQGTPATFHEQRSLSERLYKAQGINTKDLLGHKTQQQTDRYHDDRGKGWTTVAL

SEQ ID NO: 7713 - protein, 62 aa, Klebsiella pneumoniae
TKNNRLFFVITDMYEKHSLIFRQYKTKKRACKLSHPHKLESVVQTQHRNNKNDTSVARSIAG

SEQ ID NO: 7714 - protein, 412 aa, Klebsiella pneumoniae
TRDKAAIVTPLVSYLENDMSSVISSTGRRPALLIAGILLIATTLRVVFTGAAPLLDAIRSDYGLTTAQTGLLTTLPLLAFGLVSPLAAGVARRFGMERSLLLAMLLICAGIALRSLPSAALLFIGTAVIGCGIALGNVLLPGLIKRDFSQHVARMTGAYSLTMGGAAALGSALVVPVAMAGFGWRGALLLLMVFPLLALLSWLPQSRRRAETPLTGSGAMHNRGIWRSALAWQVTLFLGINSLVYYVIIGWLPSILQSMGYSEAQAGSLHGLLQLATAAPGLAIPLILHRLRDQRGIAVLVALMCAISAAGLWLLPELAIGWTLLFGFGSGATMILGLTFIGLRASSAHQAAALSGMAQSVGYLLAACGPPLMGRIHDANGDWHIPLLAVALISLVMAVCGALAGRDREIHP

SEQ ID NO: 7715 - protein, 280 aa, Klebsiella pneumoniae
FCINDPRNGGSPHTEQGKPMEPRRVNGKNHWYHETQSTICPVDVLPLVPEAAHVEDRFLLDLTLPAAWLRAHADWLHPARQLAELLFPDQVAVSRLQTFTAYDRLSTALTVAQVYGVQRLCNHYAARLAPLPGPDSSRESNRRLAQITQYARQLAGSPSVINALSRSQLDEVGLTSRDIILFNQIIGFVGFQARTIAVLQAAQGFSRCAGSPVCPSKRRHPRSCSPRRREHGRQTLRIPTCSMPMMSVSGASPAGSRCPVWASWRRCWPATHSYSRLWRP

SEQ ID NO: 7716 - protein, 176 aa, Klebsiella pneumoniae
LYVNRKITMSQTVHFQGNPVSVQGTIPQAGAKAQPFTLVAKDLSDVALSQYAGKRKVLNIFPSIDTGVCAASVRKFNQLAAELDNTVVLCISADLPFAQSRFCGAEGLSNVVTLSTLRGASFLADYGVAIATGPLAGLAARAVVVIDENDQVLYSQLVNEITEEPDYDAALAALKA

SEQ ID NO: 7717 - protein, 198 aa, Klebsiella pneumoniae
HSQNKYFKTQFHFYEKQLPAHGCYLYNELRMKINSQQAEGLMQQYTNEITPEINEAQSQPPYDEELLSLCDDKIRKELEEIKKQHLSRPLAYIFRFAVVGSLTRRGGVIRHASGGATTGGLQVARVGDKVVYADGSESTIISGAGKARIMQGASAALVGSMLDNGDEIISTPQSCSKLVFREGRELPEGFLTVSGSKH

SEQ ID NO: 7718 - protein, 60 aa, Klebsiella pneumoniae
HAQNGLEVVIQGGSDKGVCNLFNRAKLLRQRLHMVLLAGANTERYNRVPFTLAGGRADFD

SEQ ID NO: 7719 - protein, 305 aa, Klebsiella pneumoniae
KRKNNPGGRPMFRHVKQLQYTVRVAEPNPGLANLLLEQFGGPQGELAAACRYFTQGLSDDDPGRKDMLMDIATEELSHLEIIGTLVGMLNKGAKGALAEGTESEAELYRSLTANGNDSHITSLLYGGGTPLTNSAGVPWTAAYIDTIGEPTADLRSNVAAEARAKIVYERLINVTDDPGVKDALAFLMTREAAHQLSFEKALQSIRNNYPPGKLPPISEYANTYYNMSEGGEVRGSWNSDKHFDYVKDPQPGVDGGDGSASVGLTPEQEALCKAMLKRTQSDPQGDPLTGAELGAGKQNTSSSAK

SEQ ID NO: 7720 - protein, 535 aa, Klebsiella pneumoniae
LPENLFLAYYSPVIGTFRVNTPMRLEVFCEDRLGLTRELLDLLVLRGIDLRGIDIDPIGRIYLNFAELEFATFSSLMAEIRRIAGVTDVRTVPWMPSEREHLALSALLVAMPEPVLSLDTKGRVELANPASCLLFGQSQAKLRNHPVAQLIADFNVQRWLESSPQETHAEHVVVNGQNYLLEVTPVYLEGEHNERVLTGAVAMLRSTVRMGRQLQTMTSQDTSAFSQILAVGPKMRHVVEQARKLAMLSAPLLIVGDTGTGKDLLAHACHLASPRAGKPYLALNCGSIPEDAVESELFGDALQGKKGFFEQANGGSVLLDEIGEMSPRMQTKLLRFLNDGTFRRVGEDHEVHVDVRVICATQKNLIELVQKGLFREDLYYRLNVLTLYLPPLRDCPQDIMPLTELFVARFADEQGIPRPKLSADLSTVLTRYSWPGNVRQLKNAVYRALTQLEGFELRPQDILLPDHDVASLPVGEEAMEGSLDDITRRFERSVLTQLYRSYPSTRKLAKRLGVSHTAIANKLREYGLSQKKGDE

SEQ ID NO: 7721 - protein, 433 aa, Klebsiella pneumoniae
KERNKMPHIEELRRQRAGINEQVQALATIDASGSTLTAEQLTEFANLQQQFTDISAKIERLEAAERAAALVAKPVKATQQAPGIIVKQEPKQYTGAGMTRLVMSVAAGAGNLQDAAKFASEELNDQSVSMAISTAAASGGVLIPQNLHSEVIELLSDRTIVRKLGARPVPLPNGNMTLPRVAGGATASYTGENKDAKTSETRFDDVKLTAKTLIAMVPISNALIGRAGFNVEQLVLQDILTAISVREDKAFMRDDGTGDTPIGMKARATQWNRLLPWEADAAINLNTVDEYLDKIILMAMDGNSNMISSGWGMSNRTYMKLFGLRDGNGNKVYPEMAQGLLKGYPVQRTSAIPANLGTGGKETEIYFADFNDVVIAEDGNMKVDFSKEASYIDADGTLVSAFSRNQSLIRVVTEHDIGFRHPEGLVLGTGVLF

SEQ ID NO: 7722 - protein, 275 aa, Klebsiella pneumoniae
TWRKSEMVETLLEVRQLSKTFRYRTGWFHRQTVEAVKPLSFTLRERQTLAIIGENGSGKSTLAKMLAGMVEPTSGELLIDDHPLTFGDYSYRSQKIRMIFQDPSTSLNPRQRISQILDFPLRLNTDLDAEARQKQIIDTLRMVGLLPDHVSYYPHMLAPGQKQRLGLARALILRPKVIVCDEALASLDMSMRSQLINLMLELQEKQGISYIYVTQHLGMMKHISDQVLVMHNGEVVERGSTADVLASPLHDLTRRLIAGHFGEPLTADAWRKDGK

SEQ ID NO: 7723 - protein, 216 aa, Klebsiella pneumoniae
WRRKYWGPGKNRAWRFTPDVTAGFTPQPSQFESMNQAELNAQAKALLAAAGYGPNRPLKLTLLYNTSENHQKIAIAVASMWKKNLGVEVKLQNQEWKTYIDSRNTGNFDVIRASWVGDYNEPSTFLSLLTSTHSGNISRFNDPAYDKILAQAAVENSAKARNDDYNAAEKIIMVKAPIAPIYQYTNGRLIKPWLKGYPITNPEDVAYSRTMYIVKH

SEQ ID NO: 7724 - protein, 1154 aa, Klebsiella pneumoniae
EIMKPSMPEQYRYSLPVKAGDQRQLGELTGAACATLVAEMAERHSGPVVLVAPDMQNALRLNDEIRQFTDSMVMGLADWETLPYDSFSPHQDIISSRLATLYQLPTMQRGVLIVPVSTLMQRVCPHSFLHGHALVMKKGQRLSRDALRDQLEGAGYRHVDQVMEHGEYATRGALLDLFPMGSDQPYRLDFFDDEIDSLRLFDVDSQRTLEEVAAINLLPAHEFPTDQTAIELFRSQWRDRFEVKRDAEHIYQQVSKGTLPAGIEYWQPLFFSEPLPPLFSYFPASTLIVNTGDLEASAERFQNEARARFENRGVDPMRPLLPPELLWLRSDELFSELKKWPRVQLKTERLADKAANTNLGYQTLPDLAVQAQSKAPLDNLRRFLESFTGPVIFSVESEGRREALSEMLARIKVAPKHVLRLEEATGNGRYLMIGAAEHGFIDSQRGLALICESDLLGERVARRRQDSRRTINPDTLIRNLAELHIGQPVVHLEHGVGRYAGMTTLEAGGITGEYLMLTYANDAKLYVPVSSLHLISRYAGGAEENAPLHKLGGDAWTRARQKAAEKVRDVAAELLDIYAQRAAKAGFAFKHDREQYQLFCDGFPFETTPDQAQAINAVLSDMCQPLAMDRLVCGDVGFGKTEVAMRAAFLAVENHKQVAVLVPTTLLAQQHYDNFRDRFANWPVRIEMLSRFRSAKEQAQILEQAAEGKIDILIGTHKLLQSEVKLRDLGLLIVDEEHRFGVRHKERIKAMRADVDILTLTATPIPRTLNMAMSGMRDLSIIATPPARRLAVKTFVREYDALVVREAILRETLRGGQVYYLFNDVENIQKAADKLAELVPEARIAIGHGQMRERELERVMNDFHHQRFNVLVCTTIIETGIDIPTANTIIIERADHFGLAQLHQLRGRVGRSHHQAYAWLLTPHPKAMTTDAQKRLEAIASLEDLGAGFALATHDLEIRGAGELLGEDQSGQMETIGFSLYMELLENAVDALKAGREPSLEDLTSQQTEVELRMPSLLPDDFIPDVNTRLSFYKRIASAKNEQDLEEIKVELIDRFGRLPDAARNLLDIARLRQQAQKLGIRKLESNEKGGVIEFNEKNNVNPVWLIGLLQKQPQHFRLDGPTRLKFMQDLEERKTRMDWVRQFMRQLEENAVA

SEQ ID NO: 7725 - protein, 69 aa, Klebsiella pneumoniae
SAMKKSWFLHEQLSEAEATELVERYRKNNCVVEKSLSRDFASWEIRVLLPESKKPPRIDRTYIQKMWRD

SEQ ID NO: 7726 - protein, 64 aa, Klebsiella pneumoniae
RAVKRKYMIPLALMLLMLIASAWLEPAPRPVARGLCVWFDGAMVNCLQRQRLGERLPIHSLARR

SEQ ID NO: 7727 - protein, 869 aa, Klebsiella pneumoniae
VKVNMGKALVIVESPAKAKTINKYLGNDYVVKSSVGHIRDLPTSGSASKKSADSTATKGAKKPKKDERSALVNRMGVDPWHDWNAHYEVLPGKEKVVSELKQLAEKADHIYLATDLDREGEAIAWHLREVIGGDEQRYSRVVFNEITKNAIRQAFEKPGELNIDRVNAQQARRFMDRVVGYMVSPLLWKKIARGLSAGRVQSVAVRLVVEREREIKAFVPEEYWEVDASTTTPGGDALPLQVTHKDDKPFRPVSRDETMAAVSLLEKASYSVLEREDKPTSSKPGAPFITSTLQQAASTRLGFGVKKTMMMAQRLYEAGHITYMRTDSTNLSQDALNMVRGYISDKFGKKYLPDSANQYASKENSQEAHEAIRPSDVNVLAETLKDMEADAQKLYQLIWRQFVACQMTPAQYDSTTLTVAAGDFKLKARGRTLRFDGWTKVMPALRKGDEDRTLPLVKQGDRLSLVELTPAQHFTKPPARFSEASLVKELEKRGIGRPSTYASIISTIQDRGYVRVENRRFYAEKMGEIVTDRLEENFRDLMNYDFTAQMEDRLDQVANHQAEWKEVLNHFFGDFTTQLATAEKDPEEGGMQPNPMVLTSIDCPTCGRKMGIRTASTGVFLGCSGYALPPKERCKTTINLVPENEVLNVLEGDDAETNALRAKRRCQKCGTAMDSYLIDPKRKLHVCGNNPTCDGYEIEEGEFRIKGYDGPVVECEKCGSEMHLKMGRFGKYMACTNDECKNTRKILRNGEVAPPKEDPVPLPELPCEKSDAYFVLRDGAAGVFLAANTFPKSRETRAPLVEELYRFRDRLPEKLRYLADAPQQDPEGNKTLVRFSRKTKQQYVASEKEGKATGWSAFFIDGKWTEAKK

SEQ ID NO: 7728 - protein, 120 aa, Klebsiella pneumoniae
PPPKAMSALPPPCLRSVNCPSTPRDCPPLSTMPTRCRSSATRTPPPSVWDACSPPCKRCSGAILSTPPRCGICLISGGSARSSATAPPARPRRRCTTGRWRRMNRGTALATGCMPAIRCG

SEQ ID NO: 7729 - protein, 73 aa, Klebsiella pneumoniae
NFANLSAGPLPLIRFALTCIQASLMGCHELQRCDMSQQSTAKPDPRYFQKLLPRSIRYDPISGIFYLIAKRAE

SEQ ID NO: 7730 - protein, 327 aa, Klebsiella pneumoniae
SSAKFIVAICPFLARHARKRGTHGTLMRSDWQNDASGGSQPGEFLLPSLHYSPCTVAATMKFVSFNINGLRARPHQLAAIVEKHQPDVIGLQETKVHDDMFPLEEVARLGYNVFYHGQKGHYGVALLTKETPIAVRRGFPDDGEEAQRRIIMAEIPSPFGNVTVINGYFPQGESRDHETKFPAKAAFYQNLQNYLETELNKENPVLIMGDMNISPTDLDIGIGEENRKRWLRTGKCSFLPEEREWMDRLLGWGLVDTWRQANPDNHEHFSWFDYRSKGFDDNRGLRIDLLLASQPLAQRCVETGIDYEIRGMEKPSDHAPVWATFRP

SEQ ID NO: 7731 - protein, 219 aa, Klebsiella pneumoniae
SCAKECRVFAEFGVLNYLTYLVGAVFIILVPGPNTFFVLKTGIAHGVKKGYLAAAGVFIGDAVLMFLAFAGVATLIKTTPVLFNVVRYLGAIYLLWLGGKMLYAVLTQRDGQSDASAEPASAILKRSLTLSLTNPKAILFYVSFFVQFIDVNAKTPGVAFFILALTLEVISFCYMSFLILSGSFVTRYVKTRKKLAKLGNSLIGLVFVGFAARLATLQS

SEQ ID NO: 7732 - protein, 161 aa, Klebsiella pneumoniae
MMKKLTALFVASTLALGAANLAHAADTTTAPSDSKPMMMHHKGGPGQHDMMFKGLNLTDAQKQQIRDIMKSQRENMKRPSLEERRAMHDLIASDTFDKAKAEAQIDKMEAQHKAMALSRLETQNKIYNILTPEQKKQFNANFEKHLTERNAPAGKMPAPAE

SEQ ID NO: 7733 - protein, 72 aa, Klebsiella pneumoniae
PVEKQPFTGGICFCMLIKLRNEFYQVQCDAFGDLATDLLDIRPKILRAMSPDEKKSANSSAWFYGDETGVQG

SEQ ID NO: 7734 - protein, 812 aa, Klebsiella pneumoniae
PGWNTSLKQQATRGANVLPDGSFESYAVGDVLSNARAVITSEAAHSGTKSLRVTRSTEYNPNATDNNDTHIFSGMQVRDNAVYYVEAWVKLPAGSTADPTVYMVLGFSFQDSANGWSWPGLNVKVSELSVDNWTKVSGYLTNNRTALKQAMVRISIPNTPKVRLGDAFLIDDLIITDVTDAKAALDAADANAQALSSLSASVTQNGKNITSQGSAITKLQSDVTQLGKDISGKADASALTNLTTRVTATEGSLKSQGDSLTNLQNSLNTTNNNVAQKASAQSVSDLTSRVTSAEGKITSQGQAITKLQGDLSSTTDKVNTKADQTALNALTGRVEKTEAGLTAANSNIVSLTAAVNAGNAAGDDYIPNPSFDPAYDRMGYDVVETTAAGVPADCPFRYAVRLAGRDHVPKINNIAVTPGDVYEMSALVACGTGSADFNFYIGRATTATGGIGARASGGNTKTTTAWKRATWRFTVPADTNFLRPFLQVNQSSPFGTVWYAADWHMRNVTAANSAQKTADATAKAVDSLTTTVSQQGDTLSSIGTRTTSLENSLRSTNDTVSKKADTTAVTQLQGTVTQQGNDIAAANSALTKLSSDLATTNANVNKKADASAMNTLQNQVTEQGKTLSAQGDSLTQLSNSLSQTAADIDASGKMPGNLIVNGSFERGAAGFTGWSSTATVADLQVPHSGNKALKMSAGQSNLVGQEISITQGRTYRMGVWAKQDPGTTIKDAGNTKFRVADSTGLLVGSNYGPFSSGWQLVTFDWKATKTTTASFQLTTFLSAGAMYFDDFHVLDVTDEKDIADNAGAHFFK

SEQ ID NO: 7735 - protein, 60 aa, Klebsiella pneumoniae
WVWNMFEFDAFHLARLQFAFTVSFHILFPAITIGLASYLVVLEGMWLRTRDNVWRSLYNF

SEQ ID NO: 7736 - protein, 301 aa, Klebsiella pneumoniae
NIRNGMPYDSVYLEKRPPGALRTVWRKFYGDTTAMIGLYGCAGLLLLCVFGGWFAPYGIDQQFLGYQLLPPSWSRYGEVSFFLGTDDLGRDVLSRLLSGAAPTVGGAFVVTLGATLFGLVLGVIAGSTHGLRSAVMNHILDTLLSIPSLLLAIIVVAFAGPHLSHAMFAVWLALLPRMVRSVYSMVHDELEKEYIIAARLDGASTLNILLFAILPNIASGLVTEITRALSMAILDIAALGFLDLGAQLPSPEWGAMLGDALELIYVAPWTVMLPGAAIMLSVLLVNLLGDGIRRAIIAGVE

SEQ ID NO: 7737 - protein, 424 aa, Klebsiella pneumoniae
LVFDPQRFRQLTGQLILVIGAIFPEHGPGEALRLDIVRLNGYRARVLIGEGEQRLALRGLHRQPRNLRLIVPVLGKTLLRIVEQFAHDIIVFHVGVFAQVIAQRGKQRDLLWPKIGLGDRIVLRIRFRPVNPRLDRPFRYPAIKTNPEVHLAGFKPGGQVIVDHKIGAVFIRCGDRRPVAGVIQIRVEVLRAVGHVVGHQVDVVQHRGHRFDVHPAFRALGIGAYGDSHQLLLTDCLTQRFQQGSEVVAVSRLAGHQSPGAVDRKLPVEVNAVQTILLDDFLRGTNKDGATFCGRRRAGETTRAPAADRQQDFEVRILFTQGGELLQIRLHLRRQPDLVQMSRILQGRIGLVFFIVIDKAKRVVEMGDLPDVQLIDITARPGGHVAAAVKIADGHQRLGRERGSAKQGQGCQQGQTFHSGSSLT

SEQ ID NO: 7738 - protein, 95 aa, Klebsiella pneumoniae
NAFDNRYASSLLVRHEFPLLKTRWWFACCLLRGAGFPRSPEYVGYKSICHGEFHPIMRGMIYHDCRFVYLITQQEKDICQRSAALRPRYLIWTGC

SEQ ID NO: 7739 - protein, 395 aa, Klebsiella pneumoniae
IWSESEKGRRIIPPGRRLTSPASRPAKRAKPVYTGFLILFPGWCILASRRAIGHWLILLLLSVLFSSLLLRIHLPAALLLGPLIAGLILSLRGVKLSIPRPCYLAAQAIVGCMIARAINPSVFGVLFNNWALVLAILLTTLAISGLTGWLLVRYSALPGATGAWGSSPGGASAMVVMAQEYGADVRLVALMQYLRVLFVVGAAALVVRYALGNEAQEMTQDIVWFPSLTLNFPFTLLLTAVACWLGMRLRIPSGAMLLPMLLGALAQGGGWLMLELPEWLLAMAYAVLGWTVGLQFNKAIFLLALKTLPQIIASILGLILMCALMALALTHILQMDFMTAYLATSPGGLDTVAIIAAGTRADMSFIMALQTLRLFTILLTGPAMARAISRYAPRQ

SEQ ID NO: 7740 - protein, 102 aa, Klebsiella pneumoniae
CKTDFVFSDTGPAMGHDEVKHMLQMLTLEEWANEKYRSNPPSVSTLRNYAKQNMFSPPAKKEGRFWRVREDAELVGTLTTPVVKKSDPVLLQRILNDGCQTT

SEQ ID NO: 7741 - protein, 158 aa, Klebsiella pneumoniae
KPADESSHSVSPDPRFHHSLRGGLLVIRMEVKGLDELERQLMALGEKVATKVLRDAGREALKVVEEDMKQHAGFDETSAGPHMRDSIKIRSSTRKGKGNAVVTLRVGPSKQHHMKALAQELGTVKQVADPFIRPALDYNLQTVLRVLTVEIRNGIENR

SEQ ID NO: 7742 - protein, 240 aa, Klebsiella pneumoniae
SGADMRQKTIKAIQEHAAAEYPREACGLVAQRGRAERYFPCRNLATESKDNFVLAPEDYAEVEEWGTITGIVHSHPDATTQPSELDKAQCDATLLPWHIISWPEGDLRTIHPRGELPLLERPFVLGHYDCWGLVMSYFRQTHGIELHDYRVDYPWWEKEYPDNFYQDCWYECGFREFDGPPQPGDMVIMQVQADKWNHAGILLEENMLLHHLYGHLSNRVPYGGYWMERTMKIVRHHSLF

SEQ ID NO: 7743 - protein, 70 aa, Klebsiella pneumoniae
KWYEVGYMVDIEMIDEEEAMRMIRVSSRVTIRKYTERYNFPKPVRTYPKQYLRSAIVEWILNGGINQKSS

SEQ ID NO: 7744 - protein, 423 aa, Klebsiella pneumoniae
FIGDDSSRSPGRRTACCQPFSRGEYSMKALTYHGPHHVSVDNMPDPALEAADDIILRVTATAICGSDLHLYRGKIPGTHHGDIFGHEFMGEVVEAGSEVTAVRKGDRVVIPFVIACGDCFFCRLQQYAACESTNSGQGATLNRKGISPPAALFGYSDLYGGIPGGQAEYVRVPKANTGPFKVPDTLPDEKVLFLSDILPTAWQAVKNAEVKPGSSVAIFGAGPVGLLCASCARLNGAEQIFIIDHNDYRLDFAQQRYGAIPINFDHHDDPAQWIIDNTPGHRGVDSVIDAVGFEAKGSLTETVLSTLKIEGSSGKALRQCIAAVRRGGIVSVPGVYAGFIHGFMFGDAFDKGLTFRMGQTHVHAWLPDLLALIEQGLLTPEEIVTHHMPLEEAARGYQIFEKREEACRKVILVPGMQPGKATL

SEQ ID NO: 7745 - protein, 388 aa, Klebsiella pneumoniae
MNGERVLEYAASKFNVASISMSESQKKVIVGMSGGVDSSVSAYLLLQQGYKVEGLFMKNWEEDDGEEYCTAAADLADAQAVCDKLGIELHTVNFAAEYWDNVFELFLEEYKAGRTPNPDILCNKEIKFKAFLEFAAEDLGADYIATGHYVRRADVDGKSQLLRGLDGNKDQSYFLYTLSHEQIAQSLFPVGELEKPQVRKIAEELDLITAKKKDSTGICFIGERKFRDFLGRYLPAQPGKILTVDGEEIGTHQGLMYHTLGQRKGLGIGGTKEGSEDPWYVVDKDVENNILIVAQGHDHPRLMSVGLIAQQLHWVNREPLQGTLRCTVKTRYRQTDIPCTVTALDEDRIEVRFDEPVAAVTPGQSAVFYLGEVCLGGGIIEQRLPLQS

SEQ ID NO: 7746 - protein, 367 aa, Klebsiella pneumoniae
RRGEQRAGSRRAGLRAFRGRSLIMMVIRPVEPGDLPGLLKLAAETGGGLTSLPVDEATLAARIARSQQTWRGELPKSEQGYVFVLEESESGAVVGICAIEVAVGLNDPWYNYRVGTQVHASKELNVYQALPTLFLSNDHTGSSELCTLFLDPQWRKEGNGYLLSKSRFLFMAAFRERFNEKVVAEMRGVIDEQGYSPFWESLGKRFFAMEFSRADYLCGTGQKAFIAALMPKHPLYIDFLSPEAQAVIGKVHPQTAPARTVLEKEGFRYLNYIDIFDGGPTLECDIDRVRAIRKSRLVTTEAGETPPGDWPLCLVANEQYHQFRALLVHADPDGDTLTLSARELDMLKCHAGDQVRMVRLIPEEKTA

SEQ ID NO: 7747 - protein, 164 aa, Klebsiella pneumoniae
ETRFIEMPDGKKWRAYSPLARRRFLCGNAGLHAIVLHCQRSIARQRPVGGQSSRSWVTRIAGMAWRSSSSKTQRRNPARRLASRRLKGSSSSNASGRASRARSRLTRARCPPESVAGSRGAKPASPARLSASSTAVFRASPRTFSGSASCKFCPTLKWSNSNGS

SEQ ID NO: 7748 - protein, 402 aa, Klebsiella pneumoniae
IEIESGTAAFGRFHTVIGAEAARQHDVAQILALQQAPVKALAAAALAVVEQVLVDMAERTGREGFADAQRFPDADVVREGVAQRVDIGLVFITVQLHGGQPQSLRAGDHLLQRRIAEDADVLQRRSGDHRFGLGVIYRSRRGRDEDQPTVDGAGLPGHLGILRARQAAHFVLAEQHAFNRRFQIRLLHQGGADQEAVGEVAQLAHFGIGMDAGFADHRDIRAETRRQLTGAVKVNRHIAQVAVVNAHHLRLQGDGALQFLFIADFGQHAHIQAVRHRRELTILFIVEHREHQQAGVGLIVARQVDLVRVDGEVLAQDRLRRDLADDRQEIEAALEIFLITQHRDRRGVVLVDAGDRCRIEILANQPLRRRGLLALENKRGAGAGQRVIEIALRRNDLILKTG

SEQ ID NO: 7749 - protein, 76 aa, Klebsiella pneumoniae
SFTEGAFKDWGYQLAREEFGGELIDGGPWVKIKNPNTGKEIVVKDVIADAFLQQILLRPAEYDVIVLYEPERRLYL

SEQ ID NO: 7750 - protein, 81 aa, Klebsiella pneumoniae
SSAERDSSSSSRRGLLTTARAMATRCCWPPESWCGLRWANASSCTIFKASITRGVISAAGVFCIRRPKATFSNTVICGNRA

SEQ ID NO: 7751 - protein, 78 aa, Klebsiella pneumoniae
FMNEEIRVKLCAITSQRAIAQGLGVTPQAVNQWFAKSVIPARFVLKLCEFVGWAITPHQVRPDLYPSELDGMPRAAEV

SEQ ID NO: 7752 - protein, 300 aa, Klebsiella pneumoniae
KSCDIIHYFKVPVYYAPNSIYRSMRMNEPITEQLYNKVVNFVNKMDGSVRFDYISKSLRIPPDTLDEIVDRMIADGVVVNTGTVGEYLPVKHASSKNTDKDNRCCTSQKNNDSSGLKFLVGRVALVIAIIFFIITCFYAYRAPISFVFLIPAIMAAFVFTNQNHGGEGFLGLSSISACLIFLLLTNAQTPIFGEAYELRKQRDEIKNEVTRKSKEEDQQQLNDILNAREHIKGMLKDPSSAKFFGEFIGKNGAICGHVNAKNSFGGYTGESRYIFSVNFSAIDEGTTSFNKEWERQCYLN

SEQ ID NO: 7753 - protein, 135 aa, Klebsiella pneumoniae
ENGEGDIMKVLNILIRRCVLIARFEETVSFYEHLISQKARLRFDYPEYDLKLAQVGSVLLIGGTEQSLAPFRATEATFLVNDITAWEKHLPSTGATIINPVKAVPTGWNMLVRHPDGMIAEYVEHHDKNPADEIF

SEQ ID NO: 7754 - protein, 88 aa, Klebsiella pneumoniae
ADSLSLGYSTFSPNGPGLSRSGHQYDAWRAIRFHASSYGKWISPCHEVYSFVERCAAGHSPSPNASSVRQINCLKAKKNGSPSAPAFT

SEQ ID NO: 7755 - protein, 252 aa, Klebsiella pneumoniae
TMSLNANYQKLEPGDEVRLLEIDGQAFGLDEVLYFHGYNVPHTAAEILAADGDLDKLPAKSIWWQGREYKAWPCVIEGIESSTTGSDAQPTLRVGNIDGKISALCLHYDDLALARVVIHDTQKQYLDAKNFPDGNASADPTQEKRRLFFIDVKHYEDDEKVEFTLSSPFALQGMMIPTRQLHAICTWCIRNQYRSGNGCDYAGTRYFDRNNQPVDDPSQDVCNGTLTACKLRHGENSELPFGGFPGTSLIRS

SEQ ID NO: 7756 - protein, 152 aa, Klebsiella pneumoniae
RCADPGPAAGSSQSAGRCRPGRCRAGTCRHGGAYGPGRFRRRSALSRCGRCPRGRRAARRYRPGLHHRAAARRPAPEPARGRPPPPAAHCGRRRRTAAAQRRSPLWPGRHLPLAARSGRRSAHRRWRRTPRPPGHPAGASGRTLCSRRAARV

SEQ ID NO: 7757 - protein, 62 aa, Klebsiella pneumoniae
NMAEHRGGSGNFAEDREKASEAGRKGGQHSGGNFKNDPQRASEAGKKGGQNSHGGGRKSDNS

SEQ ID NO: 7758 - protein, 72 aa, Klebsiella pneumoniae
HGQESFREFAAFTKNQFAARLWGRDYFITIIKHTANECSGCALHDSGLASTGNNSGLAAISIYNLVTYPSNL

SEQ ID NO: 7759 - protein, 153 aa, Klebsiella pneumoniae
YMQDAHNDYDITDFHGALLDIISVMNQPLRDEQILQAAGVQLEQMLFPLLVAVGRHGPVGVVELADHLGRDYTTVSRQVKKLEAQGLACKQPNRHDRRISEVTLSASGQQMIDSIAVARRQLMNQVLAQWPEEEVQALFRLTRKYADSLQQPG

SEQ ID NO: 7760 - protein, 198 aa, Klebsiella pneumoniae
SMQETMTRIELSGVLGKTFGKVHYRLIKNINEAGEALSATIPGFERFMISSEERGLTYAVFKGNKNIGHDDLGFPVSGEIIRIVPVIIGSKKAGILQTILGAVIVAASVAYGFFTEDWANAAYGIQAGGAMMLGGVVQMLSPQPAGLARKESADNKASYAFGGVTNTASQGYPVPLLYGKRRIGGAIISAGIYVEDQQ

SEQ ID NO: 7761 - protein, 228 aa, Klebsiella pneumoniae
MVEENAKNTSYRFVLEPAISDDGSCYSWELLTKDIIAPARNNASAPAFSFSTLTESDKLALFTRQIELLSVFDFSLVDNKPISLNIDDLLSHFILTDRYLCDFLRSCKHIALEINENFHEFIAGRELTALSTLAALCPVWLDDFGRGRTSFPLLERFRFDCVKVDKDYFWDKENDPALPGLLQSIHTLTGHVIVEGIETEKQKRLITSAGDIIGQGRYWKEEYIFLCG

SEQ ID NO: 7762 - protein, 426 aa, Klebsiella pneumoniae
HCRDRINMNNEQAAEILQDIFQHAVNSARAGPVTLANLPEKPRGRCVVIGAGKASAAMAAAVDAAWPDVAVSGVVVTRYGYAVPAGRIRIIEAAHPVSDAMSEVAAMLIVETLRGLTADDLVLALISGGGSALMALPAPGLTLADKQTITRALLHSGASIKEMNLVRRHLSAVKGGKLATMAQPARIVSLIISDVPGDNPTDVASGPTVADNSAPRDALRVLQRYGIAIPKPVSERLNQPAGPVENAATGEVRLIATPAMALAAAALAARQHGFTPLILGDAIEGESREVAVVMAGMARSAKQYGHPISGPAVLLSGGETTVTVNNTQPGKGGRNTEFLLSLACALQGEHGIWAMAGDSDGIDGTEDAAGAIVFPDTLARGKLSGLNAVQYLDGHDSYCYFHALNDLLITGPTLTNVNDIRAILIA

SEQ ID NO: 7763 - protein, 346 aa, Klebsiella pneumoniae
RIREVSVGPVMLDVEGYELDAEEREILAHPLVGGLILFTRNYHDPAQLRELVRQIRDASRNHLVVAVDQEGGRVQRFREGFTRLPAAQSFAALLGMEEGGKLAAEAGWLMASEMIAMDIDISFAPVLDVGHISAAIGERSYHEDPQKALTMARHFIDGMHAAGMKTTGKHFPGHGAVTADSHKETPFDPRAASVIRDHDMAVFKSLIAEQRLDAIMPAHVIYPELDPRPASGSAYWLKTVLRGELGFDGVIFSDDLSMEGAAIMGSYAERGQASLDAGCDMILVCNNRKGAVSVLDNLSPIKAERVTKLYHKGSFSRQELRDSARWKTVSAQLEQLHARWQEAKSA

SEQ ID NO: 7764 - protein, 206 aa, Klebsiella pneumoniae
QNLENHMQLKRVAEAKLPTPWGDFLMVGFEELATGQDHVALVYGDISGQSPVLARVHSECLTGDALFSLRCDCGFQLEAALSHIAEEGRGILLYHRQEGRNIGLLNKIRAYALQDQGYDTVEANHQLGFAADERDFTLCADMFKLLNVEQVRLLTNNPKKVEILTEAGINIVERVPLIVGRNPKNAHYLDTKAAKMGHLLNSKPTE

SEQ ID NO: 7765 - protein, 180 aa, Klebsiella pneumoniae
GILEKARKGERMKNKLLVSACLMGFQVRYNGSEKAQLAATLSRWQQAGRLVIHCPELAAGLPTPRLPAEILGGTGGDVLAGRARIVESDGRDVTGHYQLAAWLALSAAREAGCQAALLTDGSPTCGSQFVYDGSFRGRRKAGAGVAADLLRAHGITVFSDGQIPQLLAWMAQKEQDDDSV

SEQ ID NO: 7766 - protein, 145 aa, Klebsiella pneumoniae
READARTHSGAGSDPGRRTSELEGQIMAGLDLNKKLWRIPQRGMVKGVCAGIAQHLDVPVKLVRLITVLAMIFGLFFFVLVAYIILTFALDPIPDSELYGHKAPSNGDLLAAVDAELASGEQRLREMERYVTSDTFTLRSRFRQL

SEQ ID NO: 7767 - protein, 308 aa, Klebsiella pneumoniae
KRAENGEPFSINGKEMTAEFHWDDARIFLAIARAGTLSGAADKMNMGIATVSRRLDRLEQALNVPLFSRHQSGYRLTDDGEALLARAEALEYAGLAFGEAAQLQGHVAGVVRLATSDNLATHFILPSLKGLLDHYPELRVEVLSGVQPVNLHRRDADLAIRMVKPEAGHLTLKRLGTVGFGVYGAADCLVGEDGLSLSEADFVGWPETHQHLPAAQWITRTLRGRPCKVEANTLVAQVSAVSAGLGLGVLPHFMARASGLQCLQPEIGADQTLWLVMHSDLAGSRRVRVLADHLIALFADHQDRLAMP

SEQ ID NO: 7768 - protein, 216 aa, Klebsiella pneumoniae
FRKECAVAGRIDYDIEKYQFTEAGETPRLREQWREVYLECRQLRAGAEERLRIALLNVDYVTSFELPFRLLLVRAPQLIADVRETLQLSRKAAVFNGKRYGCVYSLKQDLQAVPEAFHYRLANRIRRVDATGLTAAPYQQIAREIKPARERLRQALNAGLPVTALDALFWFGSQRVAADIAQLRRSGMAIVTTEVEVSDNLFNTTRRVPVYRLASE

SEQ ID NO: 7769 - protein, 171 aa, Klebsiella pneumoniae
CQEDAMLEAVEGNIHQRLCALLDEHRARYRVMAHEAVGQCEAVSAIRGTALGQGAKALVCKVKGNGVNQHVLAILAADRQADLASLARHIGGSKASLASPAEVEALTACVFGAIPPFSFHPALRLVADPLLFERFPQIAFNAGRLDRSIILDTEDYLHIARPEIATFRRLS

SEQ ID NO: 7770 - protein, 80 aa, Klebsiella pneumoniae
SLREVIMGMQGRQDIQCVTIKAEQLNFLMQTIFTHHKDFDCHQLDGVLGLAYDLAGEVYSWMEKEEKIVQQNEEHKRRGN

SEQ ID NO: 7771 - protein, 354 aa, Klebsiella pneumoniae
NSGDVKMKKWSRHLLAASALAIGMGAAHADDSKTLYFYNWTEYVPPGLLEQFTKETGIKVIYSTYESNETMYAKLKTYKDGAYDLVVPSTYFVDKMRKEGMLQKIDKSKLTNFSNLDPQMLNKPFDPNNDYSIPYIWGATAIGVNSEAIDPKTITSWADLWKPEYKSSLLLTDDAREVFQMALRKLGYSGNTTDPKEIEAAYNELKKLMPNVAAFNSDNPANPYMEGEVNLGMVWNGSAYVARQAGTPLEVIWPKEGGIFWMDSLSIPANAKNVDGALKLINFLLRPDVAKQVAETIGYPTPNLAARKMLSPAVANDKSLYPDAATIEKGEWQNDVGSASAIYEEYYQKLKAGR

SEQ ID NO: 7772 - protein, 204 aa, Klebsiella pneumoniae
IDSLGCVIMTAEGHLFFSIACAVFAKNAELTPVLAQGDWWHIVPSAVLTCLLPDIDHPKSFLGQRLSWISKPVARAFGHRGFTHSLLAVFGALTLFYLKVPDSWIVPADALQGLVLGYLSHILADMLTPAGVPLLWPCRWRFRLPILAPRKGNQLERALCMALFVYAVWMPQTLADNSAIRWSSGVINSLQITFNRFISHQSGR

SEQ ID NO: 7773 - protein, 277 aa, Klebsiella pneumoniae
MESLISSIWNFDGLINSALIFVTFGLLGVFIWKRAGSAYSLLNRLWEFCLGGKTFHDGKINAYFNERNDVERFNVLFNVGARNKEEIKSLINWTKKKNIDIRHVTAAKGWFEISTLKAIKPLFIANVGVFVSCVLTMLLLSNFMLLALKPSALVRLGDDKSWVWINDHIAESSIWTNNYLPLNWTEWKLDKKQCESEDFDKTVFSEKAGISVRSVDRICENFSSGSLSDTINNIIKNQKLAWVLAIYPFIFTIICFFSLLRRGAASKLYNEVHNSQN

SEQ ID NO: 7774 - protein, 254 aa, Klebsiella pneumoniae
ANGLPAPVAWRRAVRRCAMTQPDRRHLRRARLALAVVVAAALAAWLWFPGGRTFLQQSLTALASLDPQQVRGFIAAWGPQAALVSFALMILQAIVAPLPAFLITLANAALFGAFWGGALSWFSAMAGAGLCFCIARALGREVVEKLTGRAVLRSADGYFTRFGPQTILVCRLLPFVPFDPVSYAAGLTSLRFWPFMLATGVGQLPATIVYSWAGSLLTGGTFWLATGLSLLFALAVVISIAKNIYRERHKRSSP

SEQ ID NO: 7775 - protein, 73 aa, Klebsiella pneumoniae
LVALTAIRIPERVHLQALQVLLRYRRRRIFPRRMRRTGYLSLKVNPRWRLLSKDDGRNWEIMSHETYNREKDK

SEQ ID NO: 7776 - protein, 430 aa, Klebsiella pneumoniae
RNICLFWLMNNVVTKEEGGYMDKLLERFLQYVSLDTQSKPGVRQVPSTEGQWKLLRLLQAQLEEMGLVKVTLSEKGTVMGTLPANVEGDIPAIGFISHVDTSPDFSGKNVNPQIVENYRGGDIALGIGDEVLSPVMFPVLHQLLGQTLITTDGKTLLGADDKAGIAEIMTALATLQAKNIPHGDIRVAFTPDEEVGKGAKHFDVEAFDARWAYTVDGGGVGELEFENFNAASVTIKIVGNNVHPGTAKGVMVNALSLAARIHAEVPADEAPETTEGYEGFYHLTSMKGSVDRAEMHYIIRDFDRKHFEARKRKMMEIAKKVGKGLHPDCYIELVIEDSYYNMHEQVIAHPHVVDIARQAMVDCDIEPQMKPIRGGTDGAQLSFMGLPCPNLFTGGYNYHGKHEFVTLEGMEKAVQVIVRIAELTAARKGH

SEQ ID NO: 7777 - protein, 102 aa, Klebsiella pneumoniae
VNACDPTIKFICTGIIIMKTVNTLAIAAVLSSLSFASFAAVEVQSTPAGQHKVGTISASAGTNLGSLEDQLAQKADEMGATSYRITSVTGPNTLHGTAVIYK

SEQ ID NO: 7778 - protein, 221 aa, Klebsiella pneumoniae
LLNCWTGHTRSAFWRSKEKNRMTPRQRRLHRAGLATVAAAPRKSWLGRFTPLNGIQSAWIKSLLTVWGEGMRGGAAPRKPSGHSCWRGMKGDHWSDKALERFTAAIEQARSEGYRGRQALSRAHAILWPKPATVAIDAAITEDDVEFVERCVLAIFETGDPVYLVGVNYYTTRKKISDITREIQLVAPWLTDSEARKRVRWCLEIFRAKAFLSVHKAIHAD

SEQ ID NO: 7779 - protein, 182 aa, Klebsiella pneumoniae
QGELMTYQQAGRIAVIKRILGWVIFIPAVLSTLISVLKFMYEHSEKKPGIDAVMMDFAHVMIEMMRFNTPFLNFFWYNSPLPDFHHSLNIGFWIIFILVFVGMALQASGARMARQAKFLREGIEDQLILEQAKGADGLTREQLAERIVVPRHTILVQYFPLYVLPVIVIVIGYFFFSLLGFL

SEQ ID NO: 7780 - protein, 201 aa, Klebsiella pneumoniae
TRNCPMSDERYRERQQRLKDKVDARVAAAQDERGIVMVFTGNGKGKTTAAFGTATRAVGHGKKVGVIQFIKGTWPNGERNLLEPHGVEFQVMATGFTWNTQDRDSDTAACQAVWEHARRMLADDQLDLVLLDELTYMVAYDYLPLESVLSALRERPAHQSVIITGRGCHRDIIELADTVSELRPVKHAFDAGIKAQMGIDY

SEQ ID NO: 7781 - protein, 418 aa, Klebsiella pneumoniae
TMRWILRLLHGDKYNEGVSALAAVVAYGIMVKTMAVVAPLVLHLPADEIAAKHLADTGVLGGIISGAIAAYMFNRFYRIKLPEYLGFFAGKRFVPIISGLAAIFTGVILSFIWPPIGSAIQTFSQWAAYQNPVVAFGIYGFIERCLVPFGLHHIWNVPFQMQIGEYTNAAGQVFHGDIPRYMAGDPTAGKLSGGFLFKMYGLPAAAIAIWHSAKPENRAKVGGIMISAALTSFLTGITEPIEFSFMFVAPILYVIHAILAGLAFPICILLGMRDGTSFSHGLIDFIVLSGNSSKLWLFPIVGICYAIVYYIIFRVLIKALDLKTPGREDTTEESKAGATSEMAPALVAAFGGKENITNLDACITRLRVSVADVAKVDQAGLKKLGAAGVVVAGSGVQAIFGTKSDNLKTEMDEYIRNS

SEQ ID NO: 7782 - protein, 118 aa, Klebsiella pneumoniae
SVLWSVREQGYSTGEKCRQDGENVEIQAKIPGHSGKGGTMKKLLAILPLVLAGCAQPQPTAPTKTIGMPNPAAVYCQQSGGTRVPVQTPQGVSTQCKLPSGETLDEWALWRRDHPAKS

SEQ ID NO: 7783 - protein, 368 aa, Klebsiella pneumoniae
LSLCWRYFFHFKGDLMKYPVALTCGALWLASVSSLAWAADLPPGTVLAEKQLLVRHIKDEPASLDPAKAVGLPEIQVIRDLFEGLVNQDAKGNLVPGVATRWQSNDNRVWTFTLRDNARWSDGTPVTAEDFVYSWQRLVDPKTTSPFAWFAALAGIANAQNIIDGKAAPETLGVTAVDAHTLRVQLDKPLPWFSNLTASFAFYPVQKANVDSGANWTRPGSLVGNGAYVLKDRVVNEKLVVVPNTHYWDNAKTVIQQVTFVPINQESAATKRYLAGDIDITESFPKNMYQKLLKDIPGQVYTPPQLGTYYYAFNTQKGPTADERVRLALSMTIDRRVMAEKVLGTGEKPGLALHAGRDGGLHPPAVTV

SEQ ID NO: 7784 - protein, 67 aa, Klebsiella pneumoniae
PRICGAFLFAKGNAMKNLKIAYIDEKLVAIECDGLSCSSLPFSQFPFDSTALTLPQLMLEDAYAATS

SEQ ID NO: 7785 - protein, 519 aa, Klebsiella pneumoniae
PLACEAYCAHRYAKENIMTAPIQDLRDAIALLQQHDNQYLETDHPVDPNAELAGVYRHIGAGGTVKRPTRIGPAMMFNNIKGYPHSRILVGMHASRQRAALLLGCEASQLALEVGKAVKKPVAPVVVPASSAPCQEQIFLADDPDFDLRTLLPAPTNTPIDAGPFFCLGLALASDPDDASLTDVTIHRLCVQGRDELSMFLAAGRHIEVFRQKAEAAGKPLPITINMGLDPAIYIGACFEAPTTPFGYNELGVAGALRQRPVELVQGVSVPEKAIARAEIVIEGELLPGVRVREDQHTNSGHAMPEFPGYCGGANPSLPVIKVKAVTMRNNAILQTLVGPGEEHTTLAGLPTEASIWNAVEAAIPGFLQNVYAHTAGGGKFLGILQVKKRQPADEGRQGQAALLALATYSELKNIILVDEDVDIFDSDDILWAMTTRMQGDVSITTIPGIRGHQLDPSQTPEYSPSIRGNGISCKTIFDCTVPWALKSHFERAPFADVYPRPFAPEYFARLEKNQGSAK

SEQ ID NO: 7786 - protein, 92 aa, Klebsiella pneumoniae
QVYCLFIQYLHEELVMKVEITIDRQKKLPDGAVPALEKELLRRLDKNFNNCSLVIRRASSDGLTVLGGMDGDKKRVEEILQDTWESADDWFC

SEQ ID NO: 7787 - protein, 496 aa, Klebsiella pneumoniae
GENCMSLWINGEWRPGRGPGFSKQDPVNLKVVWQGEAADAGQVAEAVAAARQAFPSWARLPFAARQAIVEKFAALLEASKAELTAVIGAETGKPRWEAAGEVTAMINKVAISVKAYHVRTGEQHSDLPDGAATLRHRPHGVLAVFGPYNFPGHLPNGHIVPALLAGNTVVFKPSELTPRSGEAVVKLWQQAGLPAGVLNLVQGGRETGEALSGQADIDGLLFTGSSTTGFHLHRQLAGQPQKILALEMGGNNPLIVDDPRDVDAAVHLTIQSAFITAGQRCTCARRLLVRRGEAGDAFLSRLVTVSQRLIPAAWDAEPQPFLGGLISEQAAQKVHQAWLQRVAAGAVTLLEPRLLQAGTSLLTPGIVDMSDVANVEDEEVFGPLLGVWRYDTFEEAIALANATRFGLSCGLISPEREKFDRLLLEARAGIVNWNKPLTGAASTAPFGGTGASGNHRPGAWYAADYCAWPMASLESPTLTLPASLSPGLDFLAGEAS

SEQ ID NO: 7788 - protein, 135 aa, Klebsiella pneumoniae
RVGCSFSADLFKGCAFAWPFSFQAHGNHHRYGLLLNQPDGPVPIKHTHSTRTQRGESMYRMDKLTTGIAYGASAGNAGFWMLQVLDKVSPSQWAAIGVLGSLLFGLLTYLTNLYFKIKDDRRKAARSGDGKQSET

SEQ ID NO: 7789 - protein, 217 aa, Klebsiella pneumoniae
QGVCVAKNYYDITLALAGVCQAARLVQQLAHQGHCDSDALHVSLNSIIDLDPESTLAVFGGSEANLRLGLETLLGVLNTSSRQGLNAELTRYTLSLMVLERKLAASKGAMDTLGNRIAGLHRQLEHFDLQSETLLSAMAGIYVDVISPLGPRIQVTGSPAVLQSPQVQAKVRSALLAGIRAAVLWHQVGGGRLQLMFSRNRLVNQAKQILAHLTPEL

SEQ ID NO: 7790 - protein, 467 aa, Klebsiella pneumoniae
LSSCIGRFNSFVRPVLPVLNSYIVTKPRYTMSGLKIVVIGGGSSYTPELIEGLLNRYHEMPVASLWLVDIEEGKEKVEIIAGLARRMIAKAGLTIEVVATLDRESALRDADFVCSQFRAGCLDARISDERISLKYGLIGQETNGLGGFANACRTIPIALEIAADMERLCPDAWLLNFTNPSGMVTEAILRHSRIKAVGLCNVPVIMQKGITTLLQCADEKEVVIQVAGLNHFIFVRQILHKGKEWLPEVIAEINAGRDPLVPRNIPPFRWPSHLLQGLGMIPCAYLRYYYMKDDLLRQELAEAGGEGTRGEVVKQLEKILFDQYRDPHLAVKPKALEGRGGQYYSEAACELMNAIYNDKRIIMHVNTRNNGAINGLPDDCAVEVSSLITASGPLPLNVAPFPEDTLRLLQLMKSFERLTIEAALTGNRHTAWRALMLNPLIVSGEMLELALDEVIAENRQWLPAFHA

SEQ ID NO: 7791 - protein, 254 aa, Klebsiella pneumoniae
PRKCTMSKKLADKVALVTGGSAGIGLASAKALAEQGAKVYITGRRQEELDAAVRFIGPAARAIRADAAVLSDLDAVFATIAEESGRLDVLFANAGGGDMLPLSAITEAHVDRIFATNVRGVVFTVQKALPLLADGASVILTGSTAAVKGTANFSIYSSSKAAVRSLARSWALEVSDRGIRINVVSPGPVRTPGLGGLVAEADRQGLFDALAAGVPLGRLGEPEEIGRTVVFLASDESSFINAAEIYVDGGLAQI

SEQ ID NO: 7792 - protein, 73 aa, Klebsiella pneumoniae
SSRWIRPLSTFSRPAIRRRTVVLPQPEGPSRVRNSPLLMVRLRLSMTVLPSKLLRIPARCTSGERERGCIFNF

SEQ ID NO: 7793 - protein, 183 aa, Klebsiella pneumoniae
NIGCHKMTNKRLYNNPKYTTKRGNTFYINFRLPSGAFFRQSLGTDSLKAVEVTMSRLIPFIPLVQSGVMNVDDFKLRLNGMREMTRDGLNKLLLNVLEITIEDASFSSSNSRYYQRTQPLDVQANHAKAMAEAMRRKMMSIDAEEALKFWGLDMEYIIPEDLKPALLENAKRLHISTICNFKR

SEQ ID NO: 7794 - protein, 142 aa, Klebsiella pneumoniae
RNLCVRVYLQKQASARDKTYKESVMAEETIFSKIIRREIPSDIVYQDELVTAFRDISPQAPTHILIVPNVLIPTVNDVTAEHELALGRMMTVAAKIASDEGLADDGYRLIVNCNRHGGQEVYHIHMHLLGGRPLGPMLAHKG

SEQ ID NO: 7795 - protein, 241 aa, Klebsiella pneumoniae
VCAWGRCAPPFRENTAMMYHIPDVLSTDQVAEFTRQLAQAEWVDGRVTVGSQGAAVKQNQQIDTRTPLYARLQAAVLDMLRGHPQFFSAALPRTISAPLFNRYGPGETYGFHVDGAVRQNGEAGWMRTDLSATLFLCDPESYEGGELVIEDTYGQHRVKLPAGHLVLYPASSLHCVTPVTRGVRQASFLWIQSMVRDDKQRAMLYDLDRTIQSLKARFGDGEEVLSLLNMYHNLLRQWTEV

SEQ ID NO: 7796 - protein, 123 aa, Klebsiella pneumoniae
RRWWNRSPAPEPSAAPSARGSAAAARGSAAADGASGESSAPFRALPGGPDSARSSQTPPPTGSGSASAPDPQPSSSPFDEFSGGLIPAAAGAPAAGGAAHQTEPAPAGPWRGRPGTLRRAPPE

SEQ ID NO: 7797 - protein, 108 aa, Klebsiella pneumoniae
TGGCAPDIQLRRAAWWCARHGRSRESALQPGLPTAYRSAPASAGHPYPPAGQGVFSPRRRAACPPLRCPPGRGEPRIPTRQAVGRPRCWSGALQSRSPAAGGTDDAER

SEQ ID NO: 7798 - protein, 65 aa, Klebsiella pneumoniae
PLLRALLVLLFPLHASLVLAESASFGVPGLPANRSYRVRVAFLPVVRIGLSNFLLIICNEHVNTT

SEQ ID NO: 7799 - protein, 65 aa, Klebsiella pneumoniae
SVLRWRGGIYPADSPPSDAPGHPANRRRDTPSPRSPPTSPRPNSPPTADPAPAAPPGPPPAHRCR

SEQ ID NO: 7800 - protein, 236 aa, Klebsiella pneumoniae
LPIRLSDYATGEGHMSAKRRIEAAIFDMDGLLIDSEPLWDQAEVEVMESLGVDTRRRDELPDLLGLRIDLVVDLWYAQQPWHGVNRAEATARIIRRAIELVEASRPLLPGVREAVALCKAQGLKVGLASASPLMMLEKVLDMFELRDQFDALASAEHLPWSKPHPQVYLNCAAALGVDPQRCVALEDSVNGMIASKAARMRSIVVPEAENSRDPRFALADVKLPSLLALTAENLLG

SEQ ID NO: 7801 - protein, 338 aa, Klebsiella pneumoniae
RFVRWRIAGKYRRGEKAMIIFTLRRLLLLLITLFFLTFVGFSLSYFTPHAPLQGASLWNAWLFWFEGVLHWDFGVSSINGQLISEQLREVFPATMELCILAFGFALLIGIPVGMIAGVMRNKWPDTLISAVALVGFSIPVFWLALLLTLFFSLTLGWLPVSGRFDLLYEVKNVTGFALIDAWLSDSPWRHEMIVSAARHMVLPVLTLAVAPTTEVIRLMRISTSEVYDTNYVKAAATRGVSRRKILLRHVLHNALPPVIPRLGLQFSTMLTLAMITEMVFSWPGLGRWLINAIRQQDYAAISAGVMVIGALVIIVNVISDILGAMANPLKHKEWYALR

SEQ ID NO: 7802 - protein, 308 aa, Klebsiella pneumoniae
ELARLRPLAGATIAVTPPAIKSKHCFILIVILFSSLYAGHRWRHRTPVDQLTEVNMVLNAFDLTGKVAIVTGCDTGLGQGMTLGLAQAGCDIVGINRKIPHDTAAQVLALGRRFHAIQADLSQENDMSGLVDQAVAAMGRVDILVNNAGIIRRHDALTFTESDWDAVIDLNLKAIFFLSQAVARQFIRQGEGGKIINIASMLSFQGGIRVPSYTASKSGVLGLTRLLANEWAGQGINVNAIAPGYMATNNTQALREDEERNQAILERIPAGRWGAPKDLQGPVVFLASSAADYINGYTLAVDGGWLAR

SEQ ID NO: 7803 - protein, 324 aa, Klebsiella pneumoniae
RVCRTLHVGSTVDFLRDYKESIMRVIDYGRLLLLAALWGASFLFMRITTPAFGALNSAFLRVLFAAIALGLLLGVQGKWSGYQGKFTSTLQLGVINSGLPFLMYCLAAQWLPAGYSATLNATAPMMGVLIGALCFAEPLTLRKGGGAILGAIGVAVIARPTSGLSAALLLPGIGACLTATACYGLAGFLTRRWIQQRGGLEAERVALGSQVGATLFLFPFFLWSCWHGPAVDWRQSLPWIAIVMLGVVCTAAGYILYFRLIADIGPLRSLSVTFLIPPFAALWGYLCLGETVEEGLILGALLVCVALWMIIVPSGRKRGVPDGA

SEQ ID NO: 7804 - protein, 391 aa, Klebsiella pneumoniae
PLMLELLFLLLPVAAAYGWYMGRRSAQQSKQDDASRLSRDYVAGVNFLLSNQQDKAVDLFLDMLKEDTGTVEAHLTLGNLFRSRGEVDRAIRIHQSLMESASLTYDQRLLAVQQLGRDYMAAGLYDRAEDMFKQLVDETDFRLGALQQLLQIYQATSDWQSAIEVAERLVKLGKEKHRGEIANFWCELALQQMAANDLDKAMALLRKGAAADRNSARVSIMMGRVWMEKGDYAKAVESLERVIDQDKELVGETLEMLQTCYQQLGKTDEWEVFLRRCVEENAGATAELMLAQILEQREGVEAAQNYVTRQLERHPTMRVFHKLMDYHLNEAEEGRAKESLGVLRNMVGEQVRSKPRYRCQKCGFTAHTLYWHCPSCRSWATIKPIRGLDGQ

SEQ ID NO: 7805 - protein, 481 aa, Klebsiella pneumoniae
RPLRVRHQHFLGRGEYCRHAAAYLCRHVDAPRRAGGEPMRIRDALLSARSYLTILIGFLLGFAIVVWVEKQMPARVESSSGMTLSQDFPPLPAPRELTFDEAIWARVAWQYYVNNTQPNGLANAQDDEPWLSLWSVGSYFFAVVAAEQLHIVTAAEGDERIAAALFTLGQLPLNAQGLPAAQYHADTLQILGNPDSSAIGMGRLLTALQTLLWRYPQHAAAVRDLFNQWRVGALISNSPASQAAAPMHHWTLAADEPRDSFGYRLYASHTLRLIDSAAGLAVTNPPQGQQMIDIDGIMVPDEGLRTPWGRQPSLISLPYLLTGLELGFDAQSAEIAWRIMQIQQRRHSLRVSKPPISTDYAEPAPDYASALADRQPQSAFAPRSATPEQTAITSTRTAFAWYALFRNSWSEALRQQVQTLQVPGKGWQRGLNLNRSVNDVVDGDTNAIVLESLAYISQGQMLCLACLSPAPLPSSSAGATP

SEQ ID NO: 7806 - protein, 392 aa, Klebsiella pneumoniae
VFPRRPRRGFFSHRVDKYSPDRCDKFKNITVYLTLMSVCSPICWGDVWRAGAVLFMSDFILARVSQTLAAEQSLETLVRQLLEMLEAVTRMESTYLTRIDINAQRQQIMFAHNSSEMQIPEGFSVPWDESLCKRALEDQCTFSNDVANRWHSCIAAQELGIATFLSIPVRLADGSLFGTLCATSRQQQPYNLEGEQVMGLFAKLISHYVEKDTLVQQLQAANVALELHSSTDELTQLPNRRALFKQLALRFASARAQQQQVSLIFIDLDGFKAINDRFGHPCGDSFLVQVGKRLTAVARREDIVGRLGGDEFLIVGSAQQPAAQQAYVTSLRQALCGVYFLGEQRIDYEGASFGVVTCDPQSIDVEAALRAADEAMYQDKKSRRQENFIHID

SEQ ID NO: 7807 - protein, 243 aa, Klebsiella pneumoniae
STARSWRPVCLRPDCRRRSSAVPAAMCLPDGRGSWKATAATSPDIISWPPGWRSAPPGKRAVRQRYSPTAALPAAASLSMTVPFADGAKRAPAWPPTYSAPTASRYFPTGKSRSCSPGWHRRSRMMIQCKRVYDPQESSDGYRVLVDRLWPRGIKKEALACDEWCKELTPSAELRKAFHGEAIDFAHFSQRYRQELDAHRETGLRLAALAQRQPLTLLYAAKNTEQNHARVLAAWLAALPVTI

SEQ ID NO: 7808 - protein, 70 aa, Klebsiella pneumoniae
SVYRLVTCKSTIFRGRYYFSIHDVISFLFTIIHLIEINSQEQNLAILFTPNQYHQLHKKLRIRETYAISA

SEQ ID NO: 7809 - protein, 67 aa, Klebsiella pneumoniae
GSDRSRFGFLRQRGICRAQIARQFRDGLTLAGYPVALLGNNRLQPAQCLIRTSQARFRLANPVSERC

SEQ ID NO: 7810 - protein, 347 aa, Klebsiella pneumoniae
LVDRPVGPSAVGGALDAVYFAPGLAPARSAADGCRPHARLGIHAYFLVADPAFANSPTADRPGGGLLSEHRAVSANAMAGGWPNSDAHQPGGGAQQRRRGADARRSGAVAITAAGGMLYPDGSAGLAGRPLSTRTSLVLTVNHLTLSVRRQPLLREVAFSVAPGEVLTLMGPSGSGKSTLFAWMIGALSGDFRARGELWLNERRCDTLPTEHRRIGILFQDPLLFDHFSVGQNLQLALPENVRGEARKTAVEEALSRAGLAGFAPRDPATLSGGQRARVSLLRALLARPEALLLDEPFSRLDASLRAGFRRWVFEELDRQAIPAILVTHDREDCPPTGRCLAMERWQ

SEQ ID NO: 7811 - protein, 402 aa, Klebsiella pneumoniae
CPCRPGSSPTGGRKRWRSGWWIFTIGRAGANCRRSSGARCGAKVRAKKRAEPRFRPAGLTARFQLLVILFINGAGAADVILPFAFLNGCGVRIERFIVGHCRAEHLARRKVRRRITDGFSDLFGDIRAQQEVNQLQRAVDVFGVRRDRQAVHPEDAALFRPDHFQRSTCLAGDVSRAVPYHPEVHFAFHIRVRRVIRVKRCDVGHQLFQLVIGGFNLFRVGGVAGIAQLTQRHLEHFARVVGQQQAAFVFRLPQVGPAGDSFRVNRLAVDADGRRPPDIGDGVVVIRIERFIQHLRIEVAEVSQLALIDLLQHTFFAHLVDKVGRRDDQVVRAVFIGFELGVHGFVRLVGRIDNLDAGLFGELLQQARRHILGPVIEIERFAIVRVRSAHADCQSARREQVA

SEQ ID NO: 7812 - protein, 122 aa, Klebsiella pneumoniae
PARRLLFCPVTKTLHFLLHWCYIYSRLSLSKKEAPMILQKLLSNKNCKKYCLSLAVVFAIALAVVGRATFGGVVSEYNMPYSEWTTSMFFLQGAMVTVYSIVFTALFAIPLGFIFLGADRQD

SEQ ID NO: 7813 - protein, 113 aa, Klebsiella pneumoniae
NRSRETAILILTLDDVKTQLRLELDFTEHDAMLTQMVNAAQRSIERDYYCKLVTSDEELQALPETVRGFIADEDIRLAIQFLVSDAYLNGHTGQWLETAAVRHLLFPLQEHTL

SEQ ID NO: 7814 - protein, 399 aa, Klebsiella pneumoniae
DFSRRLHRQGAASVIIPVRHLQWNINMDYQLTLNWPDFIERYWQKRPVVLKRGFANFIDPLSPDELAGLAMESEVDSRLVSHQDGKWQVSHGPFESYDHLSENNWSLLVQAVNHWHEPSAALMHPFRALPDWRIDDLMISFSVPGGGVGPHLDQYDVFIIQGTGRRRWRVGEKVPMKQHCPHPDLLQVDPFEAIIDEEMEPGDILYIPPGFPHEGYSLENSLNYSVGYRAPNARELFSGFADYVLQRELGSQRYADPDVPSRDHPADILPTELDRLREMMLGLINQPEHFKQWFGEFITQSRHELDVAPPEPPYQPDEIYDALQQGDTLERLGGLRVLRIDGEVFVNGEKINSPHRPVLDALATHLTLRADHFGDALEDPSFLAMLAALVNSGYWFFGD

SEQ ID NO: 7815 - protein, 153 aa, Klebsiella pneumoniae
PSKRVLTMTKQSKTKVTKAQIVLAIVSRTPECVLQDVCDALDLQASTAGNLLRQLHAAGKLHRTHNGYQYVYRVVAGVEVPVIALPQTATPLSEEDVKKVQNALSLAKTLEDKKLWRRAATVYTSMLGMTTTANELWLLAKMRNRCLRNAARC

SEQ ID NO: 7816 - protein, 253 aa, Klebsiella pneumoniae
QMERVLIVNADDFGLSKGQNYGIIEACRNGVVTSTTALVNGAAIDHAAQLSRSTPELAVGMHFVLTLGEPLSAMPGLTRDGRLGKWIWQQAEEDSLPLEEIAHELACQYHRFVELFGHEPTHIDSHHHVHMFAQIYPIVAAFAREKGIALRIDRQVAAQSGLDQQAARSSAGFSSEFYGEAVSEELFLQTLDASIARGERSLEVMCHPAYVDRIIMGSAYCYPRLDELDVLTSASLKAAVADRGYRLGTYRDV

SEQ ID NO: 7817 - protein, 266 aa, Klebsiella pneumoniae
DLRRYTARADYLTTGIWIVTKIKLLALGVLIATSASAAHADGKFTLGAGVGVVEHPYKQYDADVYPVPVISYESENFWFHGLGGGYYLWNDTNDKLSITAYWSPMYFKPGDSDSEQMRRLDKRKSTVMAGLSYVHNTPYGFLRTTIAGDTLDNSNGINWDLAWLYRYTNGNLTLTPGIGVEWNSDNQNEYYYGVSRHESRRSGMRSYDPDSSWNPYLELSANYRFLGDWSVYGVARYTRLSDEITDSPMVDKSWSGLISTGITYTF

SEQ ID NO: 7818 - protein, 402 aa, Klebsiella pneumoniae
SVRRKWLDREERSSGSRRNRCEGASDRRTRNNAAGFHANFSDSDIDNVSHFIDYFTFDLHGTVLLAAHQFVAHGVEERGRNKGDRAIVHQTHAHPAAADVDDLRREAGIGPGFIVEETGVQPVGDVALGHPVETTALRHLHGGFILGTRNGLAFNDGFQQTVVDHVAILTDRRGPGGIGFKPKTKVRARLGADFRKRLEAANAAVEETGRLSVQFPAQLAEPFQGEHFRRVDVHIMGFQQGGQLLGVRRVETGMNVINAEAELVAQNAGGTDVGGDHRLFDNAVGNATRFRDDIQHFAFFAENKTVVRTVFEHQRMGLTPFATTLAHVLQQRNLLRDRLAVRLPAAAAFQPVRDVVIGQLGFRFDGGGKKLDIVFDGAIGPQSHPAGQHRAHFVSAHGAEIV

SEQ ID NO: 7819 - protein, 238 aa, Klebsiella pneumoniae
PAGRSGLNQSGHYSVQPDYRIRRLPGADDCRPAGGPGLFPVRWIPGMPQQEEAPAELFAPPPGAWQADIADPDLQYADDERQRRIAGWQSLPGLGELAPLLACDPQLFAPLETLIRQLSTDDTFGPQVALLTARTNGSPTCFDAWLPHWQGEEEFASHLREGDQALHHWLQQHPQARSLVNAVQLLTRSPDRFSAAQLTPLAEYRLSEQQAIDLLIWSGLCGWMNRLKIALGNVRQQT

SEQ ID NO: 7820 - protein, 126 aa, Klebsiella pneumoniae
NITLSAPGEGAGSYPKMRIGGEGATNGATIGYDRGFCFPLCLVNPFVMKPLRQQNRPVISYVPRVEPAPPEHAVKMDHFRDVWILRGKYVAFLLMGEHFRRSPAFSVPESAQRWANQVRQEGEIEA

SEQ ID NO: 7821 - protein, 116 aa, Klebsiella pneumoniae
RATLMAIEIFTWSPRVNPQQTVNFRVRKAQFGDGYTQVSGDGINTRSQDWELSFVGTEDYIRPIKQFFDRHAGTRAFQWTPPLEEVGLYRCEQYKPVPLGGGNYSLSATFIQAFKP

SEQ ID NO: 7822 - protein, 218 aa, Klebsiella pneumoniae
AIMRQLIKPENTMQKTSFRKHRVERFSTQQVTRQRKERQPKTVILFNKPYDVLPQFTDEAGRSTLKDFIPVAGVYAAGRLDRDSEGLLVLTNDGALQAKLTQPGKRTGKIYYVQVEGEPTPEALTALRDGVTLNDGPTLPAGVELVEEPVWLWPRNPPIRERKSIPTRWLKITLYEGRNRQVRRMTAHVGFPTLRLIRYAMGGYTLDGLANGDWRKAE

SEQ ID NO: 7823 - protein, 136 aa, Klebsiella pneumoniae
SPMRSCSRSCCVRRNTTLSSCMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLKCSEFGDAIIANM

SEQ ID NO: 7824 - protein, 347 aa, Klebsiella pneumoniae
LTSRVVYDIRQLHGKPYLTFTREDKGMRNVRVYEEAWPLHTPFVIARGSRSEAKVVVVELEEDGVKGVGECTPYPRYGESIASVMAQVMAIGEQLEAGLTREQLQRLLPAGAARNAIDCALWDLQARREGKTLAQLLGVALPDRVITAQTVVIGTPDQMAASAAALWQAGAQLLKVKLDDRLISERLIAIRQAAPEATLIVDANESWHSEGLAARCQLLADLGVAMLEQPLPADDDSALENFVHPLPICADESCHTRESLPRLRGRYEMVNIKLDKTGGLTEALALAGEAERQGFERMLGCMLCTSRGIAAALPLAPLARFADLDGPTWLAVDVEPALRFSTGVLHL

SEQ ID NO: 7825 - protein, 260 aa, Klebsiella pneumoniae
VHWRRLPPALGPDYSEDLLSAARDIMKSDQHNTILIVGASRGLGHAMAATFLQHGWEVIGTVRDLSSHTPLHDLAKTHPLRLRLATLDIRDEAQLAALQATLPPASLDMLFVNAGTTNRDPSQTIGDVSTEEFYQVMLTNALAPMRVIERLQQAVKPQGLLGVMSSGQGSLTNNLTGQRELYRGSKAALNMFMRSFAARPSSASHPLVVMAPGWIRTELGGADAPLTIEETIPRLVNVLLDKRLRPGLEYLDYQGRTVPW

SEQ ID NO: 7826 - protein, 67 aa, Klebsiella pneumoniae
RAWRSGKRSALTAVVLAFALPFFGSPLHKIFNDADNPVERFPQHHQQQQRTVYSHTARRDLTGEQQG

SEQ ID NO: 7827 - protein, 606 aa, Klebsiella pneumoniae
SKQLHLHARKFTVRIATITNWAYGITVGLTLASGSAMLMASSADRVERQAVQQRQVFDTLSDEVENDAWALSDLARLYVIKPSPETLTQYQQLQQTDKSIEQRLGGLKDNGASREELALLQDGLRIANELQDEQQAALAHVARGDAPAAIAVLYGTAYETELERMQTQIDRFRQMLEHRAAVAIDQATERSRIWRTLSEIMVGLTALMFLFVLGFILKRRVLYPVVRLSDVVQRLASQDYAVETPHFTQVDEIGDMAQAIRIFRENGLARQRLEQQRDADWAIRELLARMTQRLQGCETIEDVIKVAERFAPNIAPTIPGKLYVLDTDPWQLRCVAQWLSPAGETTPFSPDDCWAIRRGLSHPPVQGEPDITCYHLPETHAGQSLCVPLIAQGEAIGLLTFQNVTAGDAPSRAYLELMAEALGLALANQRLRSALLEKALFDSLTGLRNRHHLDEALHSQMALAVHTHTPLSCLMIDIDHFKTINDRYGHEAGDLVIKSVATIVQRAVRDIGMAFRYGGEEFLVLLPGIDEAGAHQCASEIYTQVRNMTLRDGLTEIGQVDVSIGIASYPQHTQSDSLLRAADAALYRAKELGRSRIVSFGRLKTS

SEQ ID NO: 7828 - protein, 155 aa, Klebsiella pneumoniae
CFVRIGAKVVHCKARCKPMANKPTPEELKNGLSEMQFYVTQHHGTEPPFTGRLLHNKKNGVYHCLVCDAPLFNSQTKYDSGCGWPSFYEPVSAEAIRYLTDNSHGMQRIEIRCGNCDAHLGHVFPDGPQPTGERYCVNSASLSFTDEQNGEQIKG

SEQ ID NO: 7829 - protein, 92 aa, Klebsiella pneumoniae
YPSSFAIIGESVQHIDFQLPVFGFLSALDKAKDRIWKMLVNLVEFYSGINEFLSQLGQLIIDAHFIFSVLFQLIQGNLSINFFSNTLPLECK

SEQ ID NO: 7830 - protein, 120 aa, Klebsiella pneumoniae
ITYREATLCFALTPPAFNPPSIGERKKLVSILKRSGLTLTTARINLLHHLTQNQIPLTAFDLSKLVNLPLSTVHRNLSMFADFGLVDYIVDRSSVCRWYLLTAGRPNFCPTCNQAFNTAY

SEQ ID NO: 7831 - protein, 63 aa, Klebsiella pneumoniae
GRYSMLISVLSFIVGLTGAGLLSAGAWLISPSVGLITGGIICLGWSYMTTRAFSSGVSNGGGE

SEQ ID NO: 7832 - protein, 83 aa, Klebsiella pneumoniae
SMNRLFRRKKMMTSTSKKMAAVVLAVTVAMSLSACSNMSKRDRNTAIGAGAGAIGGAVLTDGSALGTLGGAAVGGIIGHQVGK

SEQ ID NO: 7833 - protein, 474 aa, Klebsiella pneumoniae
VGRRQAQYKETQEKIQRRSRALWQCWQEREKGCPGRRGSRCVLTDVSAGQAEGIAILRVVKRRQLVALRFHRLGRRGDRRRQPGLNGRRQRGAYRAGQAIQHHREEGRLFLIVVEVPGFQLRQLGGFGYRVVEVAEAVDQAVGFGIFPGPDVALGDLVDFLRRALAGVSHQGDKALIAILNAQLHQLLHFRRQRFGAGDIRQRRRGDAVGVDANRPEGIFHGVDHPKDANGAGEGAWVRHDVIRWGGDPVAAGRRHAAHRDHYRFTGGFGCRQLFTNDFRSGYAAARAVYAQNDGLNFRIEARIANLRCGGVAADVARGLFTVHDGAVGEDYRDGGTLVRRRLHVVVVIADCPVIVIRFAPAKLFGQRLFHFRGGRQLIHQLIVQRIFRRIAAHLTQAIDNALGAREELLGGDLAVGGNGVEVVLPQFANPAAIRFAGGRGHIIADEWLDGGFIGADAEDMGGDLQLIQQRFVI

SEQ ID NO: 7834 - protein, 423 aa, Klebsiella pneumoniae
PVGSEAVQVYLALRREPDFVGEARQVVLALAVAAADGIHRFAAIAEFAQRFADVLHGWLVAADEVFQIQHNTGDIAVILRLANGLHDIEQGILLQTVRAGAKQLAANHAELAAGGWLIHHHAGNIQQQRAARGMFAGGAAELAPDADTHQHQHQEDRIEGQFANKVEYPPRPFKKAGNQSPKGSHVFSLTLSKKGRPQGPPRLAILKSEPSVVSRNHRPRCNKILVHVNFMKNDITGVIQMDALDLLLNRRSASRLAEPAPAGEQLENILRAGLRAPDHGTLQPWRFFIIADDGRERFSQLLEKGAREAGQDEKGIEKARNAPFRAPLIITVVARCEDHPKVPRWEQEMSAGCAVMAMQMAALAQGFNGIWRSGALTESPVVRAGFECREQDKIVGFLYLGTPQLKASTTIALPDTAPFVTRF

SEQ ID NO: 7835 - protein, 168 aa, Klebsiella pneumoniae
NPFRRSMMRIFLTGASGFIGSRILPALQASGHQVIGLARSESTAQALKAAGAEVHRGTLDAPESLLAGVGNADAVIHTAFDHDFSRFAANCEKDRQAILALGQALRGSTRPLVITSGTLMGDDGSGAPARESFFNSGHPSPRTASELAGPAVAGGGSGCQGGPLTAGA

SEQ ID NO: 7836 - protein, 491 aa, Klebsiella pneumoniae
TASRAPPTADGPTGRSTSHRQARHTAPTGTGRRPAAGPAGPAVARPSHRLAPGRRPATAGRQPRRGRRPPAPAQGCCRGHPSAAAPSAPAPPAIARPADRSAAAAPPAGGRAGHEDAGDEHRADRAGTGAVAAIRPRRPAPARRGSPSAAGWPAPLWPAAAHRPGLTIATPARRGWADCRAPAPGRRLPPTGSRRWWPAAPCRGRAAGRAAPANAGTASGRSRGSSGRSPGRRGVSLPAGHRSPTAQRRSLSGPSSGQAQCRTGRPAASETATAARASPLRRTAAAPPSPGRDGAPPAAAADGKPAAASGPKARGRRRWSGRSAARRRRTTAWRRAWRPAPGPAAGRRTAPASGPGSAQRPPVPRRRGAAADRSPPSPPRPAGSVGTVAAQPFLLQRVNPCRVRLGKHRRQILRQGCRQRLALAVRQTLRIQYARIAPDGGIGLAQLRLRGEQEIGHYFGASDSAGVSRDGNEMDVAEGPHGKAEAVAVRR

SEQ ID NO: 7837 - protein, 145 aa, Klebsiella pneumoniae
RRPSGGSCPRPPASPSPQPSPAAGYPRASAGDTCPDSRSAAGAGCFHRRGASPLCRHARDRLWRPALPGRADRGSPGPPLPPPRRRRTFPPYRSPSVHGRCPPAVQPLPADAAPHVRPYTRCPARWPALPPARRSVLFFSPSSPP

SEQ ID NO: 7838 - protein, 73 aa, Klebsiella pneumoniae
RRTRFISLMLAPLWSRARVMVCLSASVNPGAGSAISADPPPEINASTRSSAVKPRSVSTISIAATSLMASDTG

SEQ ID NO: 7839 - protein, 202 aa, Klebsiella pneumoniae
TQTRSLPKPNGWITEGVSMQTISFKNHNPVMGLQLNSENQFSGLRRARMKSRAIFAAVQEWESTLPGRAQDHIAQLVDEQWRKQNGRGINVNKQNLYRYLKNESGSEKYTSYVMQLSGAIADAMPIEIARKHGLKRGLTESELVAQAIKECIEAHQAKLLGAPLQKLEREIREAAIALFNMLPADAAGPLLASISAVAPQFF

SEQ ID NO: 7840 - protein, 203 aa, Klebsiella pneumoniae
KNARCHRENREQERLKMMKYVLSLVVVAILAGCTSTPNLPPRDTIVAMKPTESGIVASSAKYSYRFVRDGVPQEYQRYKTFYERFHQQASGVRVNFVVVQHEVTAEYLVVMDQRKLDAGQHSELVNQYHAVQIDNDRLGVLFKATGFWTASDASDLAAAYQLAHPVVVSINDKTKTISSLGAVALAPLFPFYMMYGCATGPCV

SEQ ID NO: 7841 - protein, 171 aa, Klebsiella pneumoniae
NSASPVRSGCRIAWLAFFFIHHRNNAGSISVAIVDLLPGIFRCTPKLPALAVSRLPGNSPWSRLMIAVLFEADALPQAQERYLQLAAGLTPLLSDTPGFIAIERFQSLSTPGKILSLSWWEDEASVANWQQNERHLAAQREGKASIFSYYRIRVARVFRDYASDRGAQSDV

SEQ ID NO: 7842 - protein, 393 aa, Klebsiella pneumoniae
RLYSVDINDIVVIVNAFFIIKTSYTSSLSGCIAAPLWPTAGSPGPSSATSCLNVKCIKRLHFTRKRISAMKLQQLRYIVEVVNHNLNVSSTAEGLYTSQPGISKQVRMLEDELGIQIFARSGKHLTQVTPAGQEIIRIAREVLSKVDAIKSVAGEHTWPDKGSLYVATTHTQARYALPGVIKGFIERYPRVSLHMHQGSPTQIAEAVSKGNADFAIATEALHLYDDLVMLPCYHWNRSIVVTPEHPLATKGSVSIEELAQYPLVTYTFGFTGRSELDTAFNRAGLTPRIVFTATDADVIKTYVRLGLGVGVIASMAVDPVSDPDLVKLDANGIFSHSTTKIGFRRSTFLRSYMYDFIQRFAPHLTRDVVDTAVALRSNEDIEAMFKDIKLPEK

SEQ ID NO: 7843 - protein, 256 aa, Klebsiella pneumoniae
PPNSDVAMNARQQSILQVVIDKGRMSVADLAKMTGVSEVTIRQDLNLLEKQSYLRRTHGYAVPLDSEDVETRMMTHFAIKRELASRAAALVNTGETVFIENGSSNALLARTLAERGDITIITVSSYIAHLLKETPGEVILLGGIYQKRSESMVGPLTRQFIQQVHFSKAFIGIDGWQAETGFTGRDMMRADVVNAVLEKHCEAIILSDSSKFSAVHPYPLGPAGRFNRVITDDRLPDACREQLLRSGLTVDIVPYI

SEQ ID NO: 7844 - protein, 122 aa, Klebsiella pneumoniae
PFDRRQGAMAYIPKNYARLEVGYREKALKLFPWVCGRCSREFVYSNLRELTVHHIDHDHSNNPEDGSNWEMLCLYCHDHEHSKYTEADQYGSTVVAGEDAQKSVGEATYNPFADLKAMMNKK

SEQ ID NO: 7845 - protein, 79 aa, Klebsiella pneumoniae
WCCSLRQGNNGNLNACNHSIDILVAVMGTMEFSRGMELPQQVTCCTGLQVERIADILQDAFWRPANDGKHNLCFGYFGF

SEQ ID NO: 7846 - protein, 60 aa, Klebsiella pneumoniae
ERCRELLLRHMQWFEAADLIVKGMEGAIAAKTVTYDFERLMEGAKLLKCSEFGDAIIANM

SEQ ID NO: 7847 - protein, 66 aa, Klebsiella pneumoniae
RLRLSMKAIADGQYGRESRFTDMQNMNPETLARTSEAPPGDNRKSTLSATGHAFRLRALLGREFLP

SEQ ID NO: 7848 - protein, 137 aa, Klebsiella pneumoniae
PGRSPRPPAALLTRMSRHDRSQTMHNPLVIEAIMLIAAIIVGVWSQRALPLHVDSRPILFLLCLFLGTGSALCLLLDILALLFTGQVATGGVRIYGPLLLLVVLWKPLNWVVGIIEDFVQRRAEKGKGKGQHDGGQR

SEQ ID NO: 7849 - protein, 589 aa, Klebsiella pneumoniae
SASSRALTPGSTARPASAAPGRARGTLDLNQAFTDNAWFRLNLMGEKTHDAGRDRIENERYGIAPSLAFGLDTPTRLYLNYLHVRQNNTPDGGIPTVGLPGYSAPSPKYAALNSAGKVDTSNFYGTDSDYDKSTTDSGTLRFEHDLTENTTVRNTTRWSRVKQEYLLTAVMGGANNITAPDINDVNTWSWSRLVNTKDVSNRILTNQTNITSTFNTGSIGHDVSAGVEFTRENQTNYGVNARTAPAVNLYHPVSNLSIGGLDRNGANANGQTDTFGIYAFDTLTLTERIEINGGLRLDNYHTKYDSATACGGSGRGAIACPPGQSTGSPVTTVDTAKSGNLVNWKAGALYRLTEQGNVYVNYAISQQPPGGSSFALAASGSGNSANRTDFKPQKAKSSELGTKWQIFDNRLLLSAALFRTDIENEVAANDDGTWSQYGKKRVEGYELSATGNLTPDWTIIAGYTQQHATVTEGQNVAQDGSSALAYTPKHAFTLWTQYQATSDLSAGGGVRYVGSLRRGSDGAVGTPDHTEGYWVADAKLGYRVNSNLDLQLNMYNLFDTDYVASINKSGYRYHPGEPRTFMLTANVHF

SEQ ID NO: 7850 - protein, 162 aa, Klebsiella pneumoniae
KGGSMMNNNNLQHNQFFTIEQDFSPDKITDAERLVMERFSHIYANWADEKNLSREAEELRVREIKGFKNILLSPWTLSDVTIEWDYWESVLRHRYKTQNGDGYVQIIWDRRGWLTDLLCAMKPVTRAEALTVCKWLLACDYFEERDSLFDRIILNLVGECEE

SEQ ID NO: 7851 - protein, 1121 aa, Klebsiella pneumoniae
MRGSHEGINVMADVASLAVGLHLNAASFKSQLLGAYGDAENQSRRFNRNAQADAKKTEDAYKKVGLSISGMASRLAGLAGAGLSIGTIVTTSRQYGQALSDLQAITGATAAEMKALDLAAQEMGRTTEYSASQAAEALKLMASAKPELLKTSDGLQKATNSALILAQAAGTTLPDATRTLALSLNQYGASAQEADRYINVLAAGAKYGSSEIVDTAAAIKNGGVAAAQAGVGFEQLNAAIQVLAEREIKGGEAGTALRNVILNLEKGTDKSLKPSVVGLSQALTTLSGKNLSTAQAVKLFGVENLNAASILVQNRSKLDELTASLTGTKTAHEQASIRVNNLNGDLLGLSSAFEGMVIKIGQSSNGPLRSGIQVATEALNSLADNFNTVSSVALYSLIPVLSTKLTAGLRENIAAWRESQAAVKARAQADADIARKTLDSTAAILKQNDAEFGHYRQMERTAKQYGMNISYQDEFTRLIRQETEQTNLASQAKLKLAAANRQLSISARAASVAVGLARGALNLIGGPFGAAMLAGSGLLYFHEKAKEARQSAIDLKDAVVETSEALMRLSLNQLNVKQFDLEDQYENQVVQRNQLMKEIQDADSRIDSLKGFDPFGQLEGVTKGQARARADLDSVNEGLRKTEENIKRVSDAKTLAQLGLSGKITSLTDDLKGALSTPPKETGDGNPWGGDGGTGTGKGSKSKVDQFKTLRQQIEEAHASSLARINLQEKDSNRELQEAAKKNGASDADLQRALLMNAENYQKQRLDLAAQYSPAQETLRKEQEASRDLAELFKARLLDEKEYQAARITLARDTAKELLQAHADEIAAPALDIAGEVDPLVSLRNQLAQRQALLQAYYQGSAISKEQYEMLMQKATKESADAQYQTSLELYRSQGEFQSLAVGLFETAHERSSNFLTSMLTRTRSFKENMADLFSSLTQSIIKNLVDMAAQALVTSSVMQTIMGVVGVGTSVVTGAAGAGSGTAIQNAASNFQFNAKGGVYDSPSLSAYSNQVYDSPQFFAFAKGAGVFGEAGPEAIMPLTRAGDGSLGVRAVGGGQNAGASEGPKVYITIEGGNTSTQAPSGFEQFGQQIGSFVEKKYRELMAQDMRPGGMVWNAVKGQR

SEQ ID NO: 7852 - protein, 165 aa, Klebsiella pneumoniae
LKRLSLELVTRFPQVLLQSRHRPEQPIPAASRRETMTQTPEVSKSHQTGAPSSSAGLLSSSKLTFRQQEVFDLLVAYINQHGYPPTLSELADMLGVSSSNAVLLHLRALERKNFIKLSRRVSRGISIVGRKEPMLAVQLLQEMIAEEPGARERAIEFLRLFGDQP

SEQ ID NO: 7853 - protein, 94 aa, Klebsiella pneumoniae
ASLRCRLPRRRCENKISFIFNDLLDFLVVIIQPFHHCVTLFVVHLNDQITIIKSKMSHPHLVLIFLYRVRYDSHYNKLIENYSHLHRFMVKYSL

SEQ ID NO: 7854 - protein, 741 aa, Klebsiella pneumoniae
QRQSNLLIKGMDMKKRLWVLHPLLLASTLPALAAQSDEDNIIVSANRTHRTVAEMAQTTWVIEGQEIEQQVQGGKEFKDVLAQLIPGIDVSSQGRTNYGMNMRGRAIVVLIDGVRLNSSRTDSRQLDAIDPFNIEHIEVISGATSLYGGGSTGGLINIVTKKGQQDRQVDLEVGSKSGFANSNDHDERVAAAVSGGTDHASGRLSVAYQRFGGWYDGNNDALILDNTQTGLQHSDRLDVMGTGTIEIDDNRQLQLVTQYYKSQGDDDYGLWLGKNMSAVTSGGKAYTTDGLNSDRIPGTERHLISLQYSDADFFGQNLVSQVYYRDESLTFYPFPTLTKGQVSSFSSSQQDTDQYGAKLTLNSQPLAGWDLTWGLDADHETFNANQMFFDLPQSMASGGLHNESIYTTGRYPGYSISNVAPFLQSSYDLNDIFTVSGGVRYQWTENRVDDFVGYAQQQDIANGKARSADAIKGGKTDYDNFLFNAGIVAHLTERQQTWFNFSQGVELPDPGKYYGIGKYGAAVNGHLPLISSVNVDDSPLQGIKVNSYELGWRYTGDVLRTQLAAYYSTSDKTIVVNRTDMTIDVQSDKQRIYCVEGAVDYFIPDSYWSVGGNFNVLKSQVQTDGRWQKWDVTLASPSKATAWVGWAPDPWSLRVQSQQVFDLSDAAGNKLEGYNTVDFIGSYALPVGKLTFSIENLLNEDYVTIWGQRAPLLYSPTYGSSSLYEYKGRGRTFGLKYALTF

SEQ ID NO: 7855 - protein, 274 aa, Klebsiella pneumoniae
QRKSEIPKMKRDREPIAQGVAVHYQPQRHLLKDRIILVTGASDGIGREAALTYARYSASVILLGRNDDKLRTVAQEIEREGGIPPRWFTLDLLTCTPQACQQLAQQISMHYPRLDGVLHNAGLLGDICPMEEQKPEVWQQVMQVNVNGTFMLTQALLPLLLRSESGSLVFTSSSVGRQGRANWGAYAVSKFATEGMMQVLADEYQSRHLRVNCINPGGTRTGMRASAFPTEDPLKLKTPADIMPVYLWLMGDDSRRKTGMTFDAQPGRKPGIAQ

SEQ ID NO: 7856 - protein, 413 aa, Klebsiella pneumoniae
IKKRMIFIFNRTFFISLSLYRTTQNINNCRNEVRMMHDATMQGSPRKKFNKIRELNRRRNYFTKKVRNALRVGVAKALWDRRRRQPVDLSSAKTVLLMRNEGAVGDVVVDSALVKCLHQSGYIVDFLLTTSNSQVMRYNPRIRHIYEADPVTSADFLRKFNHNVPRDVINELANNKYDIIIDPSLFDIPVHRLRLFRQIKAKSVLGFNKWPSIKHYSHSFDFDCQRWHVTKTFELIADYLQLDTRGLDAYDLVVPGPIMQEVAQYLASLSGKAVVINIFAGHADRSLSQTQLAELLDKLLARHPGSAVILLDHRREIRIPLPPEVVINPFNTLHHAMALIAQAELIISPDTSVVHMAAAWNKPLIAVYKDVLLNNRLWAPGYDNARQIIVKCGKVHQHRGLVDRIIAALPETL

SEQ ID NO: 7857 - protein, 278 aa, Klebsiella pneumoniae
HPESARGNLMERYETLFAQLKNRQEGAFVPFVTLGDPGPEQTLKIIDTLIEGGADALELGIPFSDPLADGPTIQGAALRAFAAGVTPAQCFEMLAAIRQKHPTIPIGLLMYANLVFSPGIDAFYAQCARVGVDSVLVADVPVEESAPFRQAAMRHNIAPIFICPPNADDDLLRQIASYGRGYTYLLSRAGVTGAENRAALPLHHLVEKLAEYHAAPPLQGFGISAPEQVSAAIDAGAAGAISGSAIVKIIERHLDEPQTMLDELKAFVQSLKAATKTA

SEQ ID NO: 7858 - protein, 146 aa, Klebsiella pneumoniae
PGERQMIDNRTVSAIDLALQKHPTPVGDLFAAIRHGRMKRCFSRDTAIRYLAFFMTSRAFGRSGFKQRYPDVQVIHPLNPELSSWQRGAVTTEYFNAHQRTVRRLRRILARKREMQNWCKKWDAMHDRYVKEREELQACKPGGLSR

SEQ ID NO: 7859 - protein, 576 aa, Klebsiella pneumoniae
GKMSHARPGLTTCSQYDAALHALSAARQRWAETSVNRRLALLRQIKDALAGIAPAWVAAAAAAKGLPAGDPLAGEEWLAGPCALMVGCNGLIATLEQLEEKTFLRRIPLRTLADGRLALRVVPGTLWDRLLLSGVRAEIWMQPGVNRAHLDRYASRAYDIPPAARQGKLALVLGAGNVASIAPLDVLHKLFIENQVCLLKLNPVNDYLHDLLAQALAPLIAMDALRIVTGDARAGAWLTTHPAVDEIHITGSRETHDVIVWGEGETARQRRAAGTPLNPRRVTSELGGVSPTIIVPGPWSEADIAFQAQQLATQKMNNGGFNCVASQVLILQQGWEPATALLNQLYRLIAANTRPDYYPGAENRLTDFRLRARQPLEIARGDALPLIVANTDDDPGFCQQEVFGPGLSVTRLEADSAESFLRQAIGYANQRLQGTLGANIVIHPRTRKAIGRKRFNALIAELRYGTVAINCWSGVAFLLAPCPWGAFPGHTLDDIQSGRGKVHNSFMLEKTERTVIEAPFRPFPRSLWHGELTLMPLPPWFITHRGQEAVAQRLVDFYHRPRWRKLPALLWRALRG

SEQ ID NO: 7860 - protein, 355 aa, Klebsiella pneumoniae
TAMSEPLKPRIDFDGPLQAEKIPPLKGARAFDTLEADNFAPARLVTGEEEEGAAEAVVESVLRPKRSLWRRMVSAGLAIFGVSVVAQGVQWTANAWQTQDWIALGGCVAGALIVGAGVGSVATEWRRLWRLRQRAHERDEARDMLHSHAVGKAKAFCEKLAQQAGLDQSHPALQRWYAAIHETQSDREVVSLYAQLVQPVLDAQARREISRSAAESTLMIAVSPLALVDMAFIAWRNLRLINRIATLYGIELGYYSRLRLFRLVLLNIAFAGASELVREVGMDWMSQDLAARLSARAAQGIGAGLLTAVLGIKAMELCRPLPWIADDKPRLGDFRRELIGQLKETVQKSKTRPEN

SEQ ID NO: 7861 - protein, 122 aa, Klebsiella pneumoniae
RSPSCLLTDRGITEQLITASKAVAKQIPFTTAAANLSETFSQLRQQAKKLATRMDAASHTASLAATVRIKTTGATAGVLADMLGNLAEEARRYAAIADERYTAGMTGERIYESVRTSIPSKG

SEQ ID NO: 7862 - protein, 117 aa, Klebsiella pneumoniae
SGPRAGGRRRQCTHILQQTPCLATGAIMNDPDFNLLAALDPLPVSTEVITVSQAWHPRLEQAPATAGCGSGYVRCVASKKSPHKCGQKYWKQCEQCRTEYPSDLLNYSVMRKIIFLI

SEQ ID NO: 7863 - protein, 267 aa, Klebsiella pneumoniae
RATSFVRDSIPHYHPVASLSQSGFSGGSVIISDGDRRHVLSQPHDPSAATYHFRRQYHALRRLPARLAPTPLFYSPCWMVVEYCAGEVKSELPASPQLSGLLYDLHQQPRFGWRVSLTPLLAQYWQRCDPARRKPRWLRWHQRLRRQGEPRPLRLAPLHMDVHAGNIIHNESGLRLIDWEYAGDGDIALELAAVWITPGERRRLVEAYARRAAIDAQLLWRQVALWRPWVLLLMAGWYEMRWRQSGDRQFITLADETWCQLDNERKG

SEQ ID NO: 7864 - protein, 319 aa, Klebsiella pneumoniae
WSASSLTKTTRISTTLLTRKCLSIGWKAGRWCWPMKNTSKFQNVVIATIVGWLVLFVFLPNLMIIATSFLTRDDANFVKLVFTLDNYSRLLDPLYYDVLLHSLNMALLATLACLALGYPFAWFLARLPQKVRPLLLFLLIVPFWTNSLIRIYGLKIFLSTKGYLNEFLLWLGVIDTPIRIMFTPSAVIIGLVYILLPFMVMPLYSSIEKLDRPLLEAAKDLGASKLQTFIRIIIPLTMPGIIAGCLLVMLPAMGLFYVSDLMGGAKNLLIGNVIKSQFLNIRDWPFGAATSITLTLVMGLMLLIYWRAARLLNKKVELE

SEQ ID NO: 7865 - protein, 73 aa, Klebsiella pneumoniae
NVQSLATRLSRTCNLAPRLCQNGNLVVPVFIISFRTVIKILSKQVIKTPPEKPHKATVVHPFPRSSWYLSVCC

SEQ ID NO: 7866 - protein, 274 aa, Klebsiella pneumoniae
  UNSURE (50): Identity of amino acid at the above locations are unknown.
PAQRVLRRNDLRYNRRLVNTCDTQGECMSITAKSVYRDTGNFFRNQFITXLLIALLCAFITVVLGHAFSPSDEQLSILSEGDNLADSAGLFELVQNMTPEQQQVLLRASAASTFSGLVGNAILVGGVLLLIQLVSAGHRVSALRAIGASAPVLPKLLLLILFTTFLVQMGMMLVLVPGVLLAIVLAFAPIMLVQDKMGILGAMRSSMRLAWANLRLVAPAIIGWLVAKTLLLLFASSFAALTPNVGAVVINTISNLISALLLIYLFRVYMLIRS

SEQ ID NO: 7867 - protein, 449 aa, Klebsiella pneumoniae
NGQSYEPKHSEDLPVQQHTTRIAIRLSTLPSPARAFLPARSRERRTEMRIALKSALMLTTRVIQIINPELHRHMQRTALIALTLAQRLELPDERQQTIFCAALLHDIGVLGDKRTIHSLDAIDNIHDPHQRQGVAMLEGLATFQPIVPFIRDHHFSPNHRGSREQHIVYFADAFERLLPADSHVAAWPTRAVVEQFVALHREIDPPLCDILCEVAENANFWQHLHPGHIQRLLEIIGPINTRYLDIHGLKDVCLLIAKIVDTYSSFTATHSIMVGEIARQLARWMQLPEPTCQQIQIAGYLHDIGKVYIPLSILEKEGELDDEELSQVREHSYMTGELLSDYSELGDIINWASNHHEKMDGSGYPLHLEKEHLTLADRIISIADIFTALTEDRPYRKGMAWQEALQIMEADVINGALDSDVFLVLRRHAETLHAIILQTLAPLHSERRL

SEQ ID NO: 7868 - protein, 230 aa, Klebsiella pneumoniae
NFWRDTVATANMIQELLKEKGWSKAELARQLGVSTQTVVYWTKGDTVPRGKRLAQLSEISGYPQSWFLGEGQPATFPASAQKGDTDSVKFKVLDIEFSCGDGVSVKSDFIDVVRSIELDPEYARQVVGNRPFKNIEIGNARGDSMSPTIAPGDLLFLDKTITYFDGDGIYAFCFEGECYVKRLQKIGSKIVVLSDNSNYQSWSIEKDALDMLYIQSKVISSVPFNINRFG

SEQ ID NO: 7869 - protein, 298 aa, Klebsiella pneumoniae
RGRRMAKRENYNDLYLFMQVVREGSFTAAAQRLGLAQSGVSRAVRELEERLGVQLLVRTTRRLSLTQAGEQLYHNVESGFDALDMGLATLAHYRQTPSGTVRINASQHTIDKVLLPKLAVFKQRYPDIRLELISESRFVDIIAQRFDAGVRLGPEVGSGMIAVRISPDMEMAVVGTPEHFRRYGFPQTPADLVAHPCIAYQFGDGSLYAWELNVDGKKITHPPQGQWAFADSYMEAKAARLGLGLAYVPEELITDDLAQGTLIRVLQRYSQRLEGSYLYYPHRNVSPALRAVIDTLRM

SEQ ID NO: 7870 - protein, 295 aa, Klebsiella pneumoniae
QEGSFTVEYSVLSNARKMPMLGFGVFKVTDKAECKQAVLNAIRTGYRLIDTAAVYDNEDAVGEAVREAIAEGLCTREALFITSKLWVQDMANTGMAKAGIAASLKKSGLEYFDLYLLHQAMGDYFSAWRALEEAYEAGTLKAIGVSNFYPHVLANFCETVRVKPMVNQVELHPYFAQPAALEAMKHYHVQPEAWAPLGGGRHNPYQDALLRGIADAHQKTIAQVVLRWNVQRGVTVIPKSTRQERIEENFAIWDFVLTDNEMAQISALDLGYVGEAVKHFNPEFVRGCLGVKIHD

SEQ ID NO: 7871 - protein, 308 aa, Klebsiella pneumoniae
SGFGEKMDINQLRCFVVLGDELHFGRAARKLEMMPASLSRFIKLLEDDLGIRLLNRSTRNVSLTPEGAAFLNEAKTVIADFDALRQRFRKNSLLQKRTLRIGAIDSAAKGLLPELLNLFVRRFPEADIHLTEDKSHKLIPRLISGWLDVVFVRPPEHIDATLTARFIANETCVLAVPAHHRLVSYDEVSIDDFRHEPVILPERRTRRHSHDLTMNIFKEGGSMPVIAQYAEEKQTILSFVAAGLGIALVPASYKDMNADGVKYLALTPKKHVEGLPLSAMWHQGNNTLYVRSLLEILSDNIDELTREL

SEQ ID NO: 7872 - protein, 770 aa, Klebsiella pneumoniae
KGFGLSTTTFSNESRRRVMSDKHPNPHQQQAPVHDSEEAQPGLDSLAPDDREWRPTPKPTAPGVEPTAPGSLKAPDTHNSKLDSLEAQRKGGEDFPLTTNQGVRIADDQNSLRAGSRGPTLLEDFILREKITHFDHERIPERIVHARGSAAHGYFQPYKSLAALTKADFLSSADKITPVFVRFSTVQGGAGSADTVRDIRGFATKFYTDEGIFDLVGNNTPVFFIQDAMKFPDFVHAVKPEPHWAIPQGQSAHDTFWDYVSLQPETLHNVMWAMSDRGIPRSYRTMEGFGIHTFRLINAEGKATFVRFHWKPVAGKASLVWDEAQKLTGRDPDFHRRDLWEAIEAEDYPEFELGLQLIPEENEFAFDFDLLDPTKLIPEALVPVQRVGRMVLNRNPDNFFAENEQAAFHPGHIVPGIDFSNDPLLQGRLFSYTDTQISRLGGPNFHEIPINRPTCPYHNFQRDGMHRMDIDTNPANYEPNSINDNWPRETPPAAKRGGFESLAERVDGEKIRQRSPSFGEYYAQPRLFWLSQTPIEQQHIIDGFSFELSKVVRTWIRERVVDHLAHIDTKLAEAVGANLGIELSDDQRNITLPAPVNGVEKDPSLSLYADAEGDVKGRVVAVLLNERTSAQDLVQLLQALQAQGVHSKLLYSRMGEVIADDGSPLPIAGTFAGSPSLTVDAVVVPGGDLSALSQSGDARYYLLEAYKHLKPILLAGDARQLTSVLHVPTQGEEGVIVTDALDTPAADKLLALMTAHRVWSRSPKIAAIPA

SEQ ID NO: 7873 - protein, 319 aa, Klebsiella pneumoniae
DRVGRQDSFASWNNVMDKLDTLTLFVRIVERGSFSAAAADLGVSRPVATAAIKALEVSLGARLLHRTTRHVRPTAEGSLYYQRCVSILAALEEANRSAGGSISGTIRVDVAGNLARTLLLPALPQFLARYPDITLQIGESERDVDLVHEGVDCVIRGGHLPDSEMICRPLAGLQEITCASPTYLARYGTPHTIEGLTGHVMIGFVSSRTQRTLPLSFTQDGRQSEVSLPCRLLTSDADVGAEAARLGFGLYQAPLPRLEADLASGALTEVLADFRPAPLPLSLLYPSNRQLSARVQVFIDWVTALMKPPLAQQASGRLK

SEQ ID NO: 7874 - protein, 759 aa, Klebsiella pneumoniae
GFYGDSSRYIVMIIVIINILDLILHCFEKDIYMRSPQYSVPTTLALVISSLLAPNAFAEESEQDTETMIVRSTAEEALKQQPGVSIITAEDIAKQPPVNDLSDIIRKMPGVNLTGNSASGSRGNNRQIDIRGMGPENTLILIDGVPVTSRNAVRYSWRGERDTRGDSNWVPAEMVERIEVLRGPAAARYGSGAAGGVVNIITKRPTNTWHGSLSFFTNQPENNKEGTTNRANFNLSGPLAGEALTMRLYGNINKTEPDAWDINHAQNGSYAAGREGVRNKDINALLSWKMTPQQILDFSYAYSRQGNIYAGDTQYSNGSLSPNGLVDSLYGHETNRLYRQSWGLTYNGLWDWGQSKAGVYYEKTNNTRLQEGSTGRVEGMINSEDYATSRLESWRTTSEFNVPFFWLADQTLTLGMEWNHDQLDDPASMQATNSNGETIPGTSGDPTQRSTKNSATLTGIYLEDNIEAVPGTNLIPGIRFDYHNQFGSNWSPSLNLSQELGDMFTLKAGIARVFKAPNLYQSSKGYLLSTRGNGCPNTIAEGSCYLLGNPDLDPEISINKEIGIEFNLNGYAAGVTWFRNDYKNKIVSGTEVLGYTSSGNNILQWQNGGKAVVEGLEGNLLIPVLRDVLSWRTNATWMLKSESKETGNPLSVIPKYTVNTMLDWQVNDALSANVNWTLYGRQKPRQYAEIRNETGTLATTEVGAYSIVGIGTQYQLNRDIRLNAGISNLFDKQLYRENAGASTYNEPGRAYYAGVTLSF

SEQ ID NO: 7875 - protein, 127 aa, Klebsiella pneumoniae
SSHGNPQHYCASGGLTPLHSGSCGNRCFFPLYPAISVAPIKVVRFFRFSFSFIFSIIDFIRFCYQDNAMSDVNAHLLAQRIDTVLDILVAGDYHSAIHNLEILKAELLALAADDTEQQNQPKAPWEI

SEQ ID NO: 7876 - protein, 61 aa, Klebsiella pneumoniae
AIGGDNMISNIDYMKLAMSYENDKTEIDPVLRSRVWGVVLVGLAMFWSIIALTICNIWIVS

SEQ ID NO: 7877 - protein, 118 aa, Klebsiella pneumoniae
TDSGFALLHLGNHRPAERGIEHPSFAGPARPERQPAGRRRHIGEGQPVAGGADVPCQRVGDAVYRRHGRRAAGAAGAAPRWRQPAAAAGRREGDGGVWRAGDLGRLAGGDAPDRGPAA

SEQ ID NO: 7878 - protein, 471 aa, Klebsiella pneumoniae
TSAGDRAMLKTLARWLTVAILLLLIALALFSREGAWWRWLTKGGWHTTARISSLTPQERTWAQIAWRYVENNTQPQTGLVNGSDKQPRATLWQMGDTLIALLAARELELVKEAEFDARLTPLLGTLNRLTLTDDGSPGRLYSTQTATPVDFSGKPAASGWSAKDMARLMLALRLTAERAPQYGEYIDKIILRWNFCPVIDKDGELWSASLQNGQRTIREELRLGDSEYAASAFRLWGFPAGKAFSPPTRNVIMYQRRLAVDDRDPRTTWQPVALSTLPAMLPGLEFGWQPPGVPEEVQKAMRERAEGIWLSQKTRWTQDKVLTARADFSLTQAPWHVEDTVWGNGYAWNTLGDDGKYYPRLAQVTTKAVFVLWTLWETEYTDALMAVTTHLNDPQRGWFEGRVEATGDVNATLTLSTNAMVLEALFYKHNAGPLFKNGLADDNSYFARRATDEFNPPRRCLPGERVMRSAP

SEQ ID NO: 7879 - protein, 550 aa, Klebsiella pneumoniae
SPRGAARHCPGPSREGDFLMADILLLDNIDSFTYNLADQLRANGHNVVIYRNSVPAQALIERLGTMDNPVLMLSPGPGTPSEAGCMPELLTRMRGKLPIIGICLGHQAIVEAYGGYVGQAGEILHGKASSIEHDGQAMFAGLANPLPVARYHSLVGSNIPAGLTINANFNGMVMAVRHDADRVCGFQFHPESILTTQGARLLEQTLAWALQKLEHTNTLQPILEKLYQAETLSQQESHQLFSAVVRGEVKPEQLAAALVSMKVRGEQPQEIAGAATALLENAAPFPRPDYLFADIVGTGGDGSNSINISTASAFVAAACGLKVAKHGNRSVSSKSGSSDLLAAFGINLDMNADKSRAALDELGVCFLFAPKYHTGFRHAMPVRQQLKTRTLFNVLGPLINPAHPPLALIGVYSPELVLPIAETLRVLGYQRAAVVHSGGMDEVSLHAPTVVAELHNGEIKSYQLTADDFGLTPYHQAQLAGGTPEENRDILTRLLQGKGEAAHEAAVAANVAMLMRLHGHEDLKANAQQVLDVLHSGAAYDRVTALAARG

SEQ ID NO: 7880 - protein, 93 aa, Klebsiella pneumoniae
TTRGEKEESVMQGTTQPIDRQTLLEKANKLIREHEDTLAGIEATDVVQRNNVLVFSGEFYLDEQGLPTPKSTAVFNMFKYLAHELSDKYHLVD

SEQ ID NO: 7881 - protein, 254 aa, Klebsiella pneumoniae
LSGGGEGPGVYSCLFYAGYDPRHPVAGQRPGPLEPEPGFQNAVRHQPVALRHDASARFLPPADARRGTSGGYCRRRGLCRSEPHDAPVYQPLWSLSGPLAAGDPRLARFRLHNRSSVTAARRTMLTAFITRRQPMYQLVNLAHKFSLFSDQWQPKVVAEMNDYQFKVVRIVGDFIWHSHPETDETLMVVEGVLRVDFRDGHVLVKAGEMIVVPRGVEHKTSAETEAKLMLIEPRGVLNTGHEGGERTAVNDVWI

SEQ ID NO: 7882 - protein, 146 aa, Klebsiella pneumoniae
AGSGSWGRLYGDWSPGYSVGGSSRDAAGDQRFSAQGGIMSDSNSRLVYSTETGRIDEAKPAPVRPKGDGIVRIQRQTSGRKGKGVCLISGIDADDAALTALAAELKKKCGCGGAVKDGVIEIQGDKRDLLKSLLEAKGMKVKLAGG

SEQ ID NO: 7883 - protein, 136 aa, Klebsiella pneumoniae
RRSGWVMAHLLTARRHATGAGKPFAYLHQGKQQPAGEAQFEREGEGRPLAGQFAGHHRIDDQTRQGGHGRDQGKGPEADRRQAVGVILNVVGKERHQAGEDQEIAAAAGDTALNRLKDGGMADIALQQIASKPAGD

SEQ ID NO: 7884 - protein, 293 aa, Klebsiella pneumoniae
TVPGVIVARKQSAPRLEFEAAAIYEYPEHLRPWLEALPKLPGVYQFHGDSDTMPLYIGKSVNLRSRVLSHLRTPEEAAMLRQSRRITWQRTAGELGALLLEARLIKEQQPLFNKRLRRNKQLCAWLLADDRPQIVYAREVDFSHQQHLYGLFANRRAALQMLQSLADEQRLCYGLLGLEPLSRGRACFRSALGRCAGACCGKESVEAHKERLLAQMSRLQLVCWPWAGPVALEERGPDMTQYHVIHNWLWLGAVESLDQAAELTRLPAGFDQDGYKILCKPLLSGDYPLHPLG

SEQ ID NO: 7885 - protein, 733 aa, Klebsiella pneumoniae
  UNSURE (425): Identity of amino acid at the above locations are unknown.
PPPGRLPSAAGYLTIQRSPNAMNNYPYLIKAKAKANEAKSLFCWFSAKSDSRAERKILDILEDAEINVGRGASHQLPIRTNWLIVDDLPEEGVLDDTWCDRYELGGEDGLTWQKIVAPAAAEPQPSSKPENDISPANSDEEDYSNNEEALFNLAEMSFRTQLLAQYMADERHVYHISIPHRNRLSAMEMDTDNHGVQNLLLTAENIPELKKYDMPGLWKFTSAFKSVFPVGKRHELGKQIQFAKLWLETSHIDRGILTKEWAAGNYITSINKTDAGANAGGGNKTDRNPDYQHSLDTLDIEIALATMPMDFDIYNFPASVHRRAKEIVQKKESPFKEWSAALRSTPGILDYSRAAIFALIREASSGITPFPDRLRGYINANLTEHKHDTPSAETLTKAGHIPSAAVTLDATTQVIAGEDSSAKLXTLSSDIKAVGAELVKEAQKQRPDANQVLPAERGEYVEGVSDPTDPKWVTEDLTKTRQPEVSKIGDGVFSIEGLVDVTGKVNQKEKTDEVIHQTDAVDIKPGHHNKEEDQPIDYVHVMVDLETMGKKHNAPIVAIGAVVFDPATGSIGESFYKVVCLESSVNWGAVIDPSTVIWWLKQSSEARSAIVNDDAIPLQDALLQFREFVSDNVAGGSKKAQVWGNGASFDNSILRSSYDCIAEDYPWEYWNDRDVRTMVELGQAISFDPKTTIQFEGSRHNALADAIHQARYVSAIWQRIIAGNQVLQKLMQN

SEQ ID NO: 7886 - protein, 434 aa, Klebsiella pneumoniae
CSTGGHMTWFIDRRLNGKNKSAVNRQRFLRRYKAQIKQSISEAINKRSVTDIESGESVSIPTDDINEPMFHQGRGGLRNRVHPGNDHFVQNDRIERPQGGGGGGGGSGQGQASADGEGKDEFVFQISKDEYLDLLFEDLALPNLKKNQHRQLNEFKTHRAGFTSNGVPANISVVRSLQNSLARRTAMTAGKRRELRALEEDLEAISRSEPVQLLEEERLRKEIAELRAKIERVPFIDTFDLRYKNYEKRPEPSSQAVMFCLMDVSGSMDQATKDMAKRFYILLYLFLSRTYKNVDVVYIRHHTQAKEVDEHEFFYSQETGGTIVSSALKLMDEVVQARYDPAQWNIYAAQASDGDNWADDSPLCHELLAKKILPVVRYYSYIEITRRAHQTLWREYEHLQATFDNFAMQHIRDQEDIYPVFRELFHKQSSKSEA

SEQ ID NO: 7887 - protein, 508 aa, Klebsiella pneumoniae
IPTGRHHHGARPGLSVRIALMKGLLRHIFPLSLRVRFLLATAGVVLVLTLDYGMVALVGYSVSFDKTTFRLLRGESNLFYMLARWENGAIDVDIPENLNMESPTVTLIYDEQGKLLWAQRDVPWLAKRIQPEWLKRNGFHEIEADVDSSSMLLRNNHEIQEQLDAIREQGDDSEMTHSVAINLYPATSKMPQLSIVVVDTIPVELKRSYMVWSWFVYVLAANLLLVIPLLWVAAWWSLRPIESLAKEVRELEEHHREKLNPNTTRELTRLVSNLNRLVRSERERYDKYRTTLTDLTHSLKTPLAVMQSTLRSLRGEKISVDEAEPVMLEQISRISQQIGYYLHRASMRSGGTLLSRELHPIAPLLDSLTSALNKVYQRKGVNISLDISPEITFVGEQNDFMEVMGNVLDNACKYCLEFVEVSVRQTTDSHLHILVEDDGPGIPQSQRRAVFDRGQRADTLRPGQGVGLSVAREIVEQYDGEIIAGESLLGGACMEVVFGRQQMEDKQS

SEQ ID NO: 7888 - protein, 241 aa, Klebsiella pneumoniae
RHTGSPMSISRPRPQRGDFPPGTRQYGSSELGAPLLWFPAPQADSRSGLIIAGTHGDENSSIVTLSCALRTLKPELRRHHVVLTVNPDGCQLGLRANARGVDLNRNFPAANWKQGETVYRWNSAAAERDVVLLTGEQPGSERETEALCQLIHQIHPAWVVSFHDPLACIEDPGHSPLGRWLADAFSLPLVGSVGYDTPGSFGSWCADIGLPCITAEFPPVSADEATERYLPAMTDLLRWQA

SEQ ID NO: 7889 - protein, 290 aa, Klebsiella pneumoniae
ILTGRIHRQMMNTSDNHALGDFLRARRQRLDPATFGFPAGRRRTPGLRREEVAQLASISPTWYTWLEQGRGGAPSREVLERIARGLRLTTPEREHLFILAFGHPPQTRLTVTDDMTPRLQRVLDAFTIPAIIRTASWDVIAWNAPAARVLTDYSQLPLAERNVLRRLFTRPEARCTLEDWQRVGQLIVNAFRADVTRMGATKETDQLIAELSQQSVEFARFWQSHDVAGHGEGYKRINHPQMGPLDLEFTSFAVEGRPDLSLLVFNPATTESQRKIHGLLQGAGSAPEES

SEQ ID NO: 7890 - protein, 293 aa, Klebsiella pneumoniae
CPAGVLLSDSQYAVIYDLHSHTTASDGRLTPQELVHRAHEMRVGTLAITDHDSVAAIPAAREEIARAGLPLTLVNGVEISTLWENHEIHIVGLNIDIAHPTMTALLEEQKARRQQRGQMIAERLEKARIPGAWEGALRLADGGAVTRGHFARFLVEAGHAKNMAEVFKKYLARGKTGYVPPQWCTIKQAIDVIHHSGGKAVIAHPGRYDLSAKWLKRLLAHFSEQGGDAMEVAQCQQAPHERAQLATLAVQFGLLASQGSDFHQPCAWIELGRKLWLPAGVEGVWHSWEAAAE

SEQ ID NO: 7891 - protein, 140 aa, Klebsiella pneumoniae
AAAGQRGAGQPAADGDPRRAGAGRLGRMAATAPVPARSARCSSPASSCPARPPAGGAAAAERSAGRAIAGGAGALGAAADGCPRQQPWAGAGGLRPRRGCLPAVAGLRPGARRWLGLATAGPAGPAAGRRPVPVGAVCLA

SEQ ID NO: 7892 - protein, 651 aa, Klebsiella pneumoniae
KTKGRHAMNIFDHYRQRYEAAKDEEFTLQEFLTICRQDRSAYANAAERLLMAIGEPVMVDTALEPRLSRLFSNRVIARYPAFEEFYGMEDAIEQIVSYLKHAAQGLEEKKQILYLLGPVGGGKSSLAERLKALMQRVPIYVLSANGERSPVNDHPLCLFNPQEDAQILQKEYGIPTRYLGTIMSPWAAKRLHEFGGDITKFRVVKVWPSILEQVAIAKTEPGDENNQDISALVGKVDIRKLEHYAQNDPDAYGYSGALCRANQGIMEFVEMFKAPIKVLHPLLTATQEGNYNGTEGISALPFNGIILAHSNESEWVTFRNNKNNEAFLDRVYIVKVPYCLRISEEIRIYEKLLNNSELTHAPCAPGTLETLARFSILSRLKEPENSSIYSKMRVYDGESLKDTDPKAKSYQEYRDYAGVDEGMNGLSTRFAFKILSRVFNFDHVEVAANPVHLFYVLEQQIEREQFPQEQAERYLEFLKGYLIPKYAEFIGKEIQTAYLESYSEYGQNIFDRYVTYADFWIQDQEYRDPDTGQLFDRESLNAELEKIEKPAGISNPKDFRNEIVNFVLRARANNSGRNPNWTSYEKLRTVIEKKMFSNTEELLPVISFNAKTSTDEQKKHDDFVDRMMEKGYTRKQVRLLCEWYLRVRKSS

SEQ ID NO: 7893 - protein, 895 aa, Klebsiella pneumoniae
DKGGAMSSTLREASKDTLQVNDKTWHYYSLPLAEKQLGEISRLPKSLKVLMENLLRWQDGDSVTEEDIRALAGWLQQAHADREIAYRPARVLMQDFTGVPAVVDLAAMREAVKRLGGDTAKVNPLSPVDLVIDHSVTVDRFGDDEAFEDNVRLEMERNHERYAFLRWGQQAFSRFSVVPPGTGICHQVNLEYLGRAVWSEEVNGQWMAWPDTLVGTDSHTTMINGLGVLGWGVGGIEAEAAMLGQPVSMLIPDVVGFKLSGKLREGITATDLVLTVTQMLRQHGVVGKFVEFYGDGLDTLPLADRATIANMAPEYGATCGFFPIDDVTLSYMRLSGRSEEQVALVEAYAKAQGMWRQPGDEPVFTSTLALDMSSVEASLAGPKRPQDRVALGDVPKAFAASGELEVNHLQRQRQPVDYTLNGHHYSLPDGAVAIAAITSCTNTSNPSVLMAAGLLAKKAVERGLQPQPWVKASLAPGSKVVSDYLAHAGLTPYLDQLGFNLVGYGCTTCIGNSGPLPEPIEEAIKKGDLTVGAVLSGNRNFEGRIHPLVKTNWLASPPLVVAYALAGNMNIDLTREPLGQGKNGEPVYLKGIWPSGEEIARAVEQVSTEMFRKEYAEVFSGTEEWKAIKVEASDTYDWQEDSTYIRLSPFFDEMGAEPLPVEDIRGARILAMLGDSVTTDHISPAGSIKADSPAGRYLQEHGVARRDFNSYGSRRGNHEVMMRGTFANIRIRNEMVPGVEGGMTRHLPDPEPMAIYDAAMLYKAEGTPLAVIAGKEYGSGSSRDWAAKGPRLLGIRVVIAESFERIHRSNLIGMGILPLEFPQGVTRKTLRLTGEERIDISNLQSLQPGATVPVTLTRADGSQEAIPCRCRIDTATELTYYRNDGILHYVIRNML

SEQ ID NO: 7894 - protein, 408 aa, Klebsiella pneumoniae
LQLGPVLCRRIAGALGPRGHDSFCQSEQIADGRASTSSYSLTGEVTMRHYKIAAIPADGIGPEVISAGIEVLHALTRHDPQLKFDIETFDWGSDYYKKHGVMMPEEGLNMLKAFDAIYFGAVGAPDVPDHITLWGLRLPICQGFDQYANVRPTKILPGVTSPLRNRGPGDLDWVIVRENSEGEYSGNGGRTHRGLPEEVGTEVAIFTRVGVTRIMRYAFRLAQSRPRKLLTVVTKSNAQRHGMVMWDEIAAEVAQEFPDVQWDKMLVDAMTHRMTLHPQTLDTIVATNLHADILSDLAGALAGSLGVAPTANIDPERRFPSMFEPIHGSAFDITGKGIANPIATFWTAVQMLEHLGERHAAALIMESIEYVCEKGILTPDVGGSANTAEVTRAVVHYIDAKADIAETA

SEQ ID NO: 7895 - protein, 460 aa, Klebsiella pneumoniae
ALMGVKGYYLFRGDKTRCGGVITEGWSDHQHFDRDMSCEGHKVTCGKHPGLYRICGGLDDDIHGKRIAGTLHSYSSCPCKSKFINSNWDDDYELGGEATVTHTDLPHLVKMPELPGPIESEPEQNAQTAKKKTGIDAGFAVITYGGTTEAWQRLLFTENPPAGAKELFSILNGPDERYKAGSIMLLVDPEKQDDEQIAHMKAAKARVDAALEPLTIQEANLLHKHYATIANFTSYADTGIGLAADPVGKYFESIEKILREIQETYKNTYITRGSLIGEQFYVQRSQLFKELESILKVRFLNKAMKFGEYTKIKKALGLSSSSITHKWNETGISDIEGYATHIERAAKYVKAMRYTGYLGIGFSGLHSLNEINEACSVGREAECTKKKYTEIGSFAVGTGVGVAGGYLAIPLCIAIGVGTAGVGGLACSVIARAGLGYVGSSAGGAFGEWGGEQLYETFGN

SEQ ID NO: 7896 - protein, 324 aa, Klebsiella pneumoniae
SPPGSPTPSDCAFLQCASCIKTGPCALFCFMVVHTVKEEKMVKKTVRFGEQAAVPAIGLGTWYMGEHAAQRQQEVAALRVGIDHGLTVIDTAEMYADGGAEEVVGQAIRGLRDRVVLVSKVYPWHAGKAAMHRACENSLRRLQTDYLDMYLLHWRGDIPLQETVEAMEKLVAEGKIRRWGVSNLDTEDMQALWRTADGEHCATNQVLYHLASRGIEYDLLPWCQQHSLPVMAYCPLAQAGRLRDGLFQHSDIINMANARGITVAQLLLAWVIRHPGVLAIPKAASIEHVVQNAAALDIVLSGEELAQLDRLYPPPQRKTRLDMV

SEQ ID NO: 7897 - protein, 195 aa, Klebsiella pneumoniae
PGPGPSPVRPERRDRCMKQFLDFLPLVVFFAFYKLYDIYAATTALIVATAVVLIYSWVRYRKVEKMALITFVLVAVFGGLTIFFHNDEFIKWKVTVIYALFAGALLFSQWVMKKPLIQRMLGKELSLPQQVWSRLNLAWALFFILCGLANIYIAFWLPQNIWVNFKVFGLTALTLVFTLLSGIYIYRHMPQDDHH

SEQ ID NO: 7898 - protein, 423 aa, Klebsiella pneumoniae
LIFINIIATFNLPEEVDMSQSITRNHFDEWMMPVYAPAAFIPVRGAGSRLWDQQGKEYIDFAGGIAVNALGHAHPRLVQALTDQAGKFWHTGNGYTNEPILRLAKMLIDATFADRVFFCNSGAEANEAALKLARKYAHDRFGSEKSGIVAFQNAFHGRTLFTVSAGGQPAYSRDFAPLPPQIQHAVFNDLESAKALINDQTCAVIVEPVQGEGGVVPASVEFLRGLRQLCDQHNALLIFDEVQTGVGRTGELYAYMHYGVTPDVLTTAKALGGGFPIGALLATEACASVMTVGTHGTTYGGNPLAGAVAGELLSIVNTPEVLSGVRQRHQWFCERLQAINARYGLFKEIRGLGLLLGCVLNDAWAGKAKTLSNLAAEEGVMILIAGANVVRFAPALNVSEEEVNSGLDRVERACARFVAGVSS

SEQ ID NO: 7899 - protein, 219 aa, Klebsiella pneumoniae
GVIIMMKMCRYALITALAIFLAGCAGLREQPAPVEEAKPQPQQPAQPQPTVPTVPAVPSVPAQPGPIEHQDQQSGQPAPRVRHYDWNGAVQPLVGQMLQASGVNAGSILLVDSVNNRTNGSLNAGEATTALRSALAGNGKFTLVSAQQLAVAKQQLGLSPQDSLGSRSKAMGIARNVGAQYVLYSNATGNVNAPELKMQLMLVQTGEIIWSSKSAVQQQ

SEQ ID NO: 7900 - protein, 197 aa, Klebsiella pneumoniae
EDVMSRTFAYCRVSTSEQTPENQIMAIRQAGYDILDSRIVSEIVSGGVQAMKRKGFADMITHKLEKGDQLVVLKLDRLGRDNIDVQQTIAMLVEKGIDIVSLDLPVRNLASTEGKLMLQMFSAFAEFEKSRIIERTKEGLARAKKEGKKLGRPVATDTLKRVQEAKAGGLSQSKAARELGLSLPTIKRNWNTKKESP

SEQ ID NO: 7901 - protein, 356 aa, Klebsiella pneumoniae
LMSMKGVTCMNFRALLAIALLTMSSLAFSETRLPHIVILATGGTIAGSAASNTQTTGYKAGAIGVQTLINAVPEMSKIAHVEGEQVANIGSENMTSDIILQLSKRVNALLARDDVDGVVITHGTDTLDETPYFLNLTVKSNKPVVFTAAMRPATAISADGPMNLLEAVTVAADPDARGRGVMVVLNDRIGAARFVTKTNATSLDTFRAPEEGYLGVVVGGKPQFETRVDKIHTLRSVFDVRQLKVLPKVVIIYGYQDDPEYMYDAAIAHHADGIIYAGTGAGSVSVRSAAGIKKAQQAGIVVVRASRTGSGVVPPDDSQPGLVADSLNPAKARILLMTALTQTKDPQLIQQYFHTY

SEQ ID NO: 7902 - protein, 478 aa, Klebsiella pneumoniae
RNAICANHEKREGHAMSTVTISDTPFVGNDRLLVGIVLSVLTFWLFAQSVINVVPAMKSSLDISLEILTLAVSLSALFSGCFVVASGGLADKFGRMRMTTLGLGLSIVGSAMLVVAQGSGLFLAGRVLQGLSAACIMPATLALIKTWYEGRARQRAVSFWVIGSWGGSGLCSFVGGAIATGLGWRWIFVFSIAVALLALFLLRGTPESRSASASQHKLDVGGLLSLIVALVLVNLFISKGHGWGWSSPLSLTMLAGALAAGTIFIRNGMRKGEAALIDFALFRNRAYGAAVLSNFLLNGAIGTMMIASIWLQQGHHLTPLESGMMTLGYLVTVLAMIRVGEKLLQRYGARLPMMAGPVLTAIAIALISCTFLEKALYIGVVFASNVLFGLGLGCYATPSTDTAVANAPENKIGVASGIYKMGSSLGGAMGIAVTASLFTLFLPLGMAHAAQYALWFNAVLCLGAMAVSALLLPRASHS

SEQ ID NO: 7903 - protein, 99 aa, Klebsiella pneumoniae
GPHMRAFPFQENVMAAKNKAVEPEETVAQDNHATVVAQAERKSVVFLGPHHRYSRGDIACFEGTRAEELVKRRIAVWPEDAERALKPKPGDSDFDTDIG

SEQ ID NO: 7904 - protein, 97 aa, Klebsiella pneumoniae
SVNISWHTAWQTTYHTSCHTMIRGRTYYTNFRLNDSTSFVRLSLSELRRITMSNPEQSSTANGKTLCVYSNSIYTFTFVTESQHCPYSKSFDIVDSK

SEQ ID NO: 7905 - protein, 72 aa, Klebsiella pneumoniae
GGDMRGILLICGMLLAFNTAASKITMSNPDEKELKGGKRLCTYENNIYLFTLVTRSQTCPYSKTFDTTENEK

SEQ ID NO: 7906 - protein, 74 aa, Klebsiella pneumoniae
VLLFQEETFLTSCRDTVYQFASAPLFYGSAFKIGTYLTHVPVCWKRTLFLPKLPTPPKPPSSLFPILCTRKLIQ

SEQ ID NO: 7907 - protein, 97 aa, Klebsiella pneumoniae
RICISKLKMTGAKRHGVVMGNRAKLSAAMLALMAAGASAPTLMDQFLDEKEGNSLTAYRDGSQGIWTICRGATRIDGKPVTQGMKLTQAKCDQVNAI

SEQ ID NO: 7908 - protein, 216 aa, Klebsiella pneumoniae
GGRMAHRALLLVDLQNDFCAGGALAVPEGDSTVDVANALIDWSLARGEPIVASQDWHPADHGSFASQHQVEPYTEGELDGLAQTFWPDHCVQHSEGAALHPLLKQQAIAAVFHKGQNRIIDSYSAFFDNGHRQKTELDGWLRGQGIVELTVLGLATDYCVKFTVLDALALGYAVNVITDGCRGVNLQPQDSSQAFMEMAAAGATLYTLDDWRETQA

SEQ ID NO: 7909 - protein, 432 aa, Klebsiella pneumoniae
QARIDVRDEIIRQQGRHAQFNLRLLTGEIFQRGFTPGFQRIDCVLQQLHIQGETDGFHLTALIFPKQFPGPANLQIVGCQRKAGAEIFQRRNGLEALLRIGGHRFRMRRQQPGIGLVMRTANAAAQLVQLGEAKMVGAFDDDGVGGGNVDPGFDDGGAHQHIEALMMEVIHHPLQFALPHLTVTDGDPRLRHQLRQLVGGFLDVLNVIKQIVDLAAAQRFAQDRLAHHQGVIFANEGLHRQTSRRRRGDDRQIAHPAHRHVQRPRDRRGGEGQNIDIGAHRFDALFMPHAKPVLFVDDQQPEIAQLHLALQQLVGADQDIDFAFRGLLEDLRLLFSAAEAGEHFDAYRPVGETIAEIVIVLLSQQGGRHQHRHLLVVLHGEEGGAHGHFGLAEAHIAAYQAVHGQRLAHIAEDGVDRLRLIRRGFKWEAVAE

SEQ ID NO: 7910 - protein, 81 aa, Klebsiella pneumoniae
FKLFKQLATLNVKLFSYQRASRYVGILIRFLNLSEYFFDTLKVFSNRISSKANSCISVAGEISYGCVVFVQQVSFLDCQRF

SEQ ID NO: 7911 - protein, 209 aa, Klebsiella pneumoniae
EGSMSQFFYIHPDNPQARLINQAVEIVRKGGVIVYPTDSGYALGCKIEDKGAMERICRIRQLPDGHNFTLMCRDLSELSTYAFVDNVAFRLMKNNTPGNYTFILKGTKEVPRRLLQEKRKTIGMRVPSNPIAQALLETLGEPMLSTSLMLPGSDFTESDPEEIKDRLEKVVDLIIHGGFLGQQPTTVIDLTEDTPVVLREGVGDVRPFL

SEQ ID NO: 7912 - protein, 411 aa, Klebsiella pneumoniae
LKIFAVNFGMGVVSGLVMSYQFGTNWSGFSQFAGSITGPLLLYEVLTAFFLEAGFLGVMLFGWNKVPPALHFFTTCMVALGTLVSTFWILASNSWMQTPQGFIIENGHLIPQDWLAIIFNPSFPYRLFHMAIAAFLSSAMFVGASAAWHLLRGNDSPAIRKMLSMAMWMALLVAPIQAVVGDMHGLNTLEHQPAKIAAIEGHWENRPGEATPLLLFGLPDMEQERTRYGLEIPALGSLILTHSLHKQVPALKDFPKEDRPYSPAVFWSFRIMVGMGVLMIALGICSAWLRYRRRLYHSRPFQWFALCMGPAGLIALVAGWVTTEMGRQPWVIYGLLRTRDAVSLHSTLQMAISLLVFIVVYCAVFGVGYYYIFRLIKKGPQPVTELTSQTAGTPARPLSAAEPVRDEENAS

SEQ ID NO: 7913 - protein, 63 aa, Klebsiella pneumoniae
TVFIRQAEIDDGDIREMFAQIVVRFPGIFRRIDLMAQLLQLNFEVVTQQGIILNHEYAHGCSP

SEQ ID NO: 7914 - protein, 342 aa, Klebsiella pneumoniae
GGFMSIDAMRWAKKVKTGKSSAKAVLTWMADMCGADLCAFPSIPALAEATELDKKTVQSSLQYLVSIGLIEDTGERRGKTKQIPVYRLLGVEESVAEIEHTQKREHYQKRDRLNTPENGVVTAEKAPENGTVSCTQNNQTIPFFPSNDPKNGIRNLPEEPKDITPTHRDLVEPVVPAYPNQPGIVPGETQSFGKFAMYFGWKPSEDFSRLATIWGMPLRPGINLAAELSSFIAYWQAEGRVFHQVQWEQKLARHLNRAEVRQKKPVNGGIDHVGVRAEPAASRAVQQIRAAREQRLRVARSDGRRNGMAPMGSNGRNLFEPVDPEERRGTIRTLDRSDWIDE

SEQ ID NO: 7915 - protein, 191 aa, Klebsiella pneumoniae
YVLITKNKPAFIMEKNASLPFGSFNSLALFTGLCLGASPAAGIAAENSVKNSEETLVVEAAPPSLYSPGASADPKFNKPLVDTTRTITVIPEQVIKDQGVTNLTDALKNVPGVGAFYAGENGSSTTGDAIFMRGVDTSNSIYVDGIRDIGSVTRDTFNTQQVEVIKGPAGTDYGRSAPSGSMQYDQQAAAP

SEQ ID NO: 7916 - protein, 319 aa, Klebsiella pneumoniae
FIVIVGLADDTRGIAEMYYGFDIGGSKIALGVFNQERRLQWEKRVATPKSSYEDFLQAVEALVREADERFDQQGSVGIGIPGMPETADGTLYAANVPAASGRPLRADLSARLGRDVRLDNDANCFALSEAWDDEFTQYPLVMGLILGTGVGGGLVLNGKSITGHSYITGEFGHIRLPVDALEVVGRDFPLLRCGCGQLGCIENYLSGRGFAWLYEHFYQQPLSSPEIVAQWQQHDPRAQAHVERYLDLLAVCLGNILTIVDPDLLVLGGGLSNFTAISEGLAQRLPRHLLPVARVPRIERARHGDAGGMRGAAFLHLTH

SEQ ID NO: 7917 - protein, 109 aa, Klebsiella pneumoniae
SGVIVLDLPQQENSNRENPMKSFKIEYVDGVLTVLETDGQSRMNEAVHGIHFEHVQGGRPLLKLTIAHDIAPAPAAESAQEPLVGELVQEQQSPLPGGRRSRHRRGGKQ

SEQ ID NO: 7918 - protein, 248 aa, Klebsiella pneumoniae
GLVMTSTAIPSSRAVTSSPVVVALDYDNRDKALAFVDRIDPRDCRLKVGKEMFTLLGPQFVRDLHQRGFEVFLDLKFHDIPNTTARAVAAAAELGVWMVNVHASGGARMMTAAREALLPFGKDAPLLIAVTVLTSMESSDLQDLGITLSPADYAAKLAALTQRCGLDGVVCSAQEAVRFKHELGQAFKLVTPGIRPQGSDAGDQRRIMTPEQAQEAGVDYMVIGRPVTQSADPAATLRAINDSLRKGA

SEQ ID NO: 7919 - protein, 135 aa, Klebsiella pneumoniae
RVAMLFHSTAAAKMILYRAESGFFRATHITGSHVKYLLIFLLVLAILVISVTLGAQNDQQVTFNYLLAQGEFRISTLLAVLLPAGFAIGWLICGLFWLRVRVSLARAERKIKRLEHQIAPVSPAAVDAGVPAVKE

SEQ ID NO: 7920 - protein, 446 aa, Klebsiella pneumoniae
QPYITMEHPVMKNDLEKKVMRKVTLRIIPFIMLLYFIAFLDRVNIGFAALTMNQDLGFSPTVFGLGAGIFFLGYFLFEVPSNLILHKVGARIWIARVMITWGFVSGCMAFVQGTTSFYILRFLLGVAEAGFFPGIILYLSYWFPAARRAQVTAIFMAAAPLSTALGSPVSAALLEMHGFLGYAGWQWMFVLEALPALVLGVVVLFFLTDRPAKAKWLTDQERAWLENAMQDEERARAAKQSHSSAWRGLADIRVLALALVYFGTSAGLYTLGIWSPQIIRSFGASSLEIGFLNAFPAVIGVIAMILWARHSDRTKERSWHVIGACLLAVAGLIYAGNVSTLFTVMVALTLVTVGISASKPPLWSMPTLFLSGPAAAAGIAAINSIGNLGGFVGPMMIGVIREQTGSYSWGLYFVAGLLALSALVVMILSARANKSPTAELPHPHTH

SEQ ID NO: 7921 - protein, 247 aa, Klebsiella pneumoniae
ISYIYELFIFKPTALAPAIVYFYNGLSPNQHRYNGTMTTDVQSCAKKSRGRPKVFDRDAALDKAMTLFWQHGYEATSLADLVEATGAKAPTLYAEFVNKEGLFRAVLDRYISRFAAKHEAVLFAEGKSVDRALRDYFTAVATCFTSKETPAGCFIINTSAALAASSTDIANTIKSRHAMQEQALTQFLQQRQAQGELPAGRDVAQLAQFLNCVLQGMSISAREGADFDKLMQITDTTLRLWPQVLGS

SEQ ID NO: 7922 - protein, 77 aa, Klebsiella pneumoniae
GVHMSMLFLAIPLTLFVLFVLPVWLWLHYNNRGANGSLTQNEQQRLLQLTDDAKRMRERIQALEAILDAEHPNWRDK

SEQ ID NO: 7923 - protein, 620 aa, Klebsiella pneumoniae
GEDMRTLWRLIASFFKWTWRILNFIRKLALNAIFLVLVLVCIGIWSQFSSTTSEHAARGALLLDITGVVVDKPSASSKLGVIGRQLFGASSDRLQENSLFDIVQTIRQAKDDRNITGIVLDLKNFVGGDQPSMQYIGKALREFRDSGKPVYAVGSSYSQGQYYLASFANKIWLSPQGEVDLHGFATNGLYYKSLLDKLKVSTHVFRVGTYKSAVEPFIRDDMSPAAREADSRWIGELWQNYLNTIAANRQITAQQLFPGAQGIIDGLRKVGGDTAKYALDNKLVDELATSTEVEKALTKQFGWSKADNNYRAISYYDYNVKTPSDQGSAIAVIFANGAIMDGEETPGNVGGDTTAAQIRDARLDPKIKAIVLRVNSPGGSVTASEIIREELAAAKAAGKPVVVSMGGMAASGGYWISTPADYIVANPSTLTGSIGIFGVINTVENTLGSIGVHTDGVATSPLADVSSTKALPPEVQQLMQLSIENGYQRFITLVANARKSTPEKIDQIAQGHVWTGEDAKANGLVDSLGDFDDAVAKAAELAKLKTWHLNYYQEEPTFFSMVLDSLTGSIRASLPAAIQAWLPAPVAAAAETVKAESDKLAAFNDPQNRYAFCLTCANIR

SEQ ID NO: 7924 - protein, 407 aa, Klebsiella pneumoniae
ATRINSKVSCKHNTGITKMTHPLLEALQVNEAQFIALRRRFHQQPEIGFEEHQTSSEVARLLGEWGYEVHRGLAGTGVVGTLRVGEGKKRLGLRADMDALPMQERSGKPWASQVEGRFHGCGHDGHTTTLLYAAEYLARTRQFTGTLQLIFQPAEELLYGGRVMVEDGLFDQFPCDAIFGLHNMPGQPLGKIGLRDGAMMASSDTLHIEVKGVGGHGAVPEHTVDATLVACHITLALQSMVSRNITPFEPAVVTVGSIQAGHAPNIINDHVLMKLTVRTLNEQVRETVLQRIHDIAVAQAESFNATATLTHVNGSPVLRNDPATNAMVREVATALFGAEQVGEVKPFMGSEDFAFMLEQHPHGSYFTIGAGDEPDRCMVHNPGYDFNDALLLTGAALWCGLTERYLR

SEQ ID NO: 7925 - protein, 340 aa, Klebsiella pneumoniae
GERIMSIDISVIWFVIIVFATLMYIVMDGFDLGIGMLFSVVHDGEERDVMVNSVAPVWDGNETWLVLGGAGLFGAFPLAYAVITDALVIPLTAMLIGLIFRGVAFEFRFKAVPSHRIFWDYAFAGGSLLATFSQGIVVGAFINGFAVADRRFAGSTLDWLTPFNLFCGLGLVVAYLLLGTTWLIMKSEGALQQRMRELTRKVLLALMVVIAVVSVWTPLGWRYVAERWFTLPNFFWFVPVPILVLALSLWIWRLSARPASHARPFILTLGLIFLGFSGLGISVWPNIIPPHISLWDAAAPPSSQVFMLPGALLIIPVILMYTAWSYYVFRGKVSGSEGYH

SEQ ID NO: 7926 - protein, 400 aa, Klebsiella pneumoniae
GAIMSTLLNPYFGEFGGMYVPQILMPALRQLEEAFVSAQKDPAFQAEFTDLLKNYAGRPTALTKCRNLTEGTRTTLYLKREDLLHGGAHKTNQVLGQALLAKRMGKTEIIAETGAGQHGVASALASALLGLKCRIYMGAKDVERQSPNVFRMRLMGAEVIPVHSGSATLKDACNEALRDWSGSYEKAHYMLGTAAGPHPFPTIVREFQRMIGEETKAQILEKEGRLPDAVIACVGGGSNAIGMFADFIEETNVGLIGVEPAGHGIESGEHGAPLKHGRVGIYFGMKSPMMQTADGQIEESYSISAGLDFPSVGPQHAFLNSTGRADYVSITDDEALDAFKALSRHEGIIPALESSHALAHALKMMRENPEKEQLLVVNLSGRGDKDIFTVHDILKARGEI

SEQ ID NO: 7927 - protein, 303 aa, Klebsiella pneumoniae
GSSMSEKLQKVLARAGHGSRREIEAKIEAGRVSVDGKIATLGDRVEIVPGLKIRIDGHLISVKESAEQICRVLAYYKPEGELCTRNDPEGRPTVFDRLPKLRGARWIAVGRLDVNTCGLLLFTTDGELANRLMHPSREVEREYAVRVFGQLDDDKLRQLSRGVQLEDGPAAFKTIKFTGGEGINQWYNVTLTEGRNREVRRLWEAVGVQVSRLIRVRYGDILLPKGLPRGGYTELDLAQTNYLRELVELTPETSSKVAVEKDRRRLKANQIRRAVKRHSQTSANPRQGNNSNRRSSTRNKTNG

SEQ ID NO: 7928 - protein, 334 aa, Klebsiella pneumoniae
GGSMAAKSEFFSSFVDIEKRPRFSSECEISPENFKALVGEYRLGEDVICQVKGHKGICHQKHRSGWLGVTSDGFEVLIGGHCARNYFKADKSFALERKRVRKEIDRKIALYKLEEYRKNKMSINDELSQLRQELIDTRVKLDQVHKHFPNAVLSFIESAQKTKNWELKIDVLDGFADDGEARWVSGSLGKRKTLPYSYEVFGLINNVKTLSATFDEACQVNPDDIKTPKLKRIIEILNEKEEFKKTSSALHRDVFAFVDPRNLEPLIYTCDDYEEEFLVAKAIMAVTGAKVSSEGHINLRLRRIKERIEKQFDGKLIRKNQISERFQRRNAFVG

SEQ ID NO: 7929 - protein, 297 aa, Klebsiella pneumoniae
DCTMINKIFALPVNETISPVISRRQLDDLELIVIDHPQVKASVALQGAHLLSWKPAGEEEVLWLSNNTPFKQGVALRGGVPICWPWFGPSAQQGLPSHGFARNLPWTLEGHDEDDSGVMLTFALQHSAETMKLWPHEFTLYARFKLGKTCEIELEAHGEFETTSALHSYFNVGDIAAVKVSGLGERYIDKVNNAEEGVLSNGVQTFPDRTDRVYLNADSCSVIHDDALNRTIDVVHHHQHNVVAWNPGPALSVSMGDMPDDGYKTFVCVETCCVTQPQKASEETPSRLAQTIRVKKR

SEQ ID NO: 7930 - protein, 151 aa, Klebsiella pneumoniae
LPTICVDAFFSGVIMSEINPCMTCGACCAYFRVSFYWAEADDAGGLVPSALTEPLTPFLRCMSGTNQRQSRCAALSGDIGDAVHCTIYENRPSPCREFAMSGENGEENDACNRARARYGLPPLRPLYKDIPALTGAESATTERFAVQSPAS

SEQ ID NO: 7931 - protein, 482 aa, Klebsiella pneumoniae
CQKMFHRAPLLLKWINRTELQDLGQPIQRVAPFPQQLRVGEVGLGETIAIVAIHPVIEGDKQRIVHQDVRIDRLILLGRQHHPQAQARRTAAVGHALAQIEHPQVGDRVIPGQQLIEVFPHAGMLLRFLRQDKRHAAIRPAHQLAVEQIGGNRLCHRDPAGGNHQRRKTRHPLRQLLEKRGLVGKGLLMAEQDLTVAHRDDVVMKNPRVDRRRMLADEDQLAGIDLIEARYRLAGLKGLPRRIATRRLLAPPAAAIDKELDAGSAILAAETIMVRRPFVAKPGRGGQRRVDSKSRAVGENRLQQRLCSRCFAGAVEFILQIRHRQMHQAIQRIGGGTHRRRVRHPHRRGRTHRRQQIRLLLRHPGHHLLIAAAKAQLAQKRHVGTLLRRDHRLRVASVGEGFHFFQPLLCRQLRVRHPIAMPGGSLIAKGEPGVVMGQPGQTVKVDFAGGHDASPARKSRPGLRLAGSVRVGDSRLAIGQAQ

SEQ ID NO: 7932 - protein, 138 aa, Klebsiella pneumoniae
RTEILIPRGTGSVPYRLINEGNIMFDLDNIDAVETPENDLEEVVMGLIINSGQARSLAYGALKQAKQGDFAAAKAMMEQSRQALSEAHRVQTQLIESDEGEGKMKVSLVLVHAQDHLMTSMLARELVAELIELHEKVQ

SEQ ID NO: 7933 - protein, 253 aa, Klebsiella pneumoniae
RKEILMKKRVLALCLASFFSVNAFALVPPGNDVTTKPDLYYLTNAQAIDSLALLPPPPAVGSIAFLNDQAMYEQGRLLRNTERGKLAAEDANLSAGGVANAFSSAFGSPITEKDAPQLHKLLTNMIEDAGDLATRSAKEKYMRIRPFAFYGVSTCNTTEQDKLAKNGSYPSGHTSIGWATALVLAEINPQRQNEILKRGYELGESRVICGYHWQSDVDAARIVGSAVVATLHTNPAFQQQLQKAKDEFAKRQK

SEQ ID NO: 7934 - protein, 173 aa, Klebsiella pneumoniae
HEEITMNHVEHYHDWLRDAHAMEKQAESMLESMAGRIDNYPDLRARIEQHVNETKRQITVLEEILDRNEISRSVIKDSMSKMAALGQSIGGMFPSDEIVKGSISGYVFEQFEIACYTSLLAAAEKAGDTASIPAIEAILAEEREMADWLIKHIPQTTEQFLLRSDADGVEAKK

SEQ ID NO: 7935 - protein, 289 aa, Klebsiella pneumoniae
FTPFSRLPLCGGQNFLSKINKATVNHCDGRRNRILSRALFDVHCVQTVQEHLSCKRSRHPAIGKGLGLLALVATLAVISHRVGLHDLLTHLHLLQDTLRHQGAWGYLVYAALFIIATLCLIPGSLLVIAGGMLFGPLTGSLLSFAAATLASSLSFLIARWLGRDLLQRYVGHTTVFQAIERGIARSGCDFLILTRLVPLFPYNIQNYAYGLTAIRFWPFTLISAVTTLPGLVIYSVMASELAREGATLAFALKLSLAGGLLFALVQIGKRFARARRVAACSEEVRHDPT

SEQ ID NO: 7936 - protein, 79 aa, Klebsiella pneumoniae
HSLISGKYEVSKMLSTDNQRISEIFERLAEIAAKTAELTSNPNLSPAQKQAACDSYFSEHDQLTTEALEIFKKITKNPQ

SEQ ID NO: 7937 - protein, 452 aa, Klebsiella pneumoniae
GELISMDQTCTLEGFLTRVQQRDPHQTEFAQAVREVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTELYRHLGPDTDVPAGDIGVGGREVGFMAGMMRKLSNNSACVFTGKGLSFGGSLIRPEATGYGLIYFTEAMLKRHGLGFEGARVAVSGSGNVAQYAIEKAMELGARVVTASDSNGTVVDEAGFTKEKLARLIDIKERAHGRVADYAREFGLTYLEGQQPWSVPVDIALPCATQNELDVDAARQLIANGVKAVAEGANMPTTIAATDLFLEAGVLFAPGKAANAGGVATSGLEMAQNAARMGWKAEKVDARLHHIMLDIHHACVQYGGEAKQTNYVRGANIAGFVKVADAMLAQGVI

SEQ ID NO: 7938 - protein, 120 aa, Klebsiella pneumoniae
ASPMSKMASKSRVEETIQQIIPGGGERKMDIEQIIDSMTPEVYQRLATAVELGKWPDGVALTPEQKENSLQLVMLWQARYNTDAQHMTIDTSGQMVMKSKQQLKEDFGIVPKPIATVKLQ

SEQ ID NO: 7939 - protein, 270 aa, Klebsiella pneumoniae
AITIRIKAMGFLSGKRILITGVASKLSIAYGIAQAMHREGAELAFTYQNEKLKGRVEEFAAALGSDIVLPCDVAEDESITALFTELEKVWPKFDGFVHSIGFAPADQLDGDYVDVVTRDGFKIAHDISAYSFVAMAKACRGMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSNLSAGISGEVVHVDGGFNIAAMNELELK

SEQ ID NO: 7940 - protein, 395 aa, Klebsiella pneumoniae
GVTMRRLRDYSLCLCLLLLWPLAVNADDSWRQIQTEARGQTVWFNAWGGDPAVNRYLAWVSEEVKRYYAIDLRIVPVADAADAVKRIQTEAQAGRRQGGSVDLLWINGENFRTLKQANLLLTGWAASLPNWRYVDLQKPVREDFSVATEGAESPWGSAQLTFIARRGQTPQPPTSPQALLAFARAHPGSVTYPRPPDFTGTALLEQLLIALTDQPAALRQPPQPATFAAVTAPLWRYLDALHPALWRAGKDFPASPARMDAMLNQGTLRLSLTFNPLHARQKAASGELPTDSYSFGFTVGTLGNVHFVTIPANARAIAGAKVVANFLLSPEAQLRKADAAVWGDPSVLDPQRLPDGQRQALAAALPQDLPPVLAEPHAAWVDALEQEWLRRYGTH

SEQ ID NO: 7941 - protein, 333 aa, Klebsiella pneumoniae
LHYLMAKFIMAQYKDNLLGEANSFLEVLEQVSRLAPLDKPVLVIGERGTGKELIANRLHYLSSRWQGPFISLNCAALNDNLLDSELFGHEAGAFTGASKRHPGRFERADGGTLFLDELATAPMLVQEKLLRVIEYGELERVGGSQPLQVNVRLVCATNADLPQMVEEGHFRADLLDRLAFDVVQLPPLRDRQSDIMLLANQFAIQMCRELGLPLFPGFSERATATLLGYRWPGNIRELKNVVERSVYRHGDSEHELDAIIINPFRQSPGSPPEAAPGDELPALPLDLRDFQFQQEKRLLQRSLEQAKYHQKQAAELLGLTYHQLRALLKKHQL

SEQ ID NO: 7942 - protein, 121 aa, Klebsiella pneumoniae
MSNLITTYRRRILKAALLRHQRKTGSSLLVIKLNKGGISTIELTEILLDGLLRKFERLALGEYGNVEGVKALKGIYSNSVDVNGSGEFLTESGKELIDELISELVEFVKKQKPVTAESGNE

SEQ ID NO: 7943 - protein, 124 aa, Klebsiella pneumoniae
GLPVKDKDYLSTLKSALLKSEPTVIKTELFGATVFIRRLTGDYLISYEEKMAETAKAGAAREASEQVIQIVIDALVQPDGTAIPDEFKPTAAELLKAHENPELLAAVEKVKQHAIGKLEEAEKN

SEQ ID NO: 7944 - protein, 426 aa, Klebsiella pneumoniae
SRHVSVVYAASNRLYTRASAISNQMDDMYQPAALFIGLRYMRGRAADRFGRFVSWLSTIGITLGVMALVTVLSVMNGFERELQNNILGLMPQAILSAKQGSVNPQQLPEREAKLNGVTRVAPITTGDVVLQSARSVAVGVMLGIDPAQNDPLTPYLVNVKQSDLQAGKYNVILGEQLAGQLGVNRGDKIRVMVPSASQFTPMGRVPSQRLFTVIGTFAANSEVDGYQMLTNIDDASRLMRYPLGNITGWRLWLDQPLQVDTLSQQTLPPGTQWQDWRERKGELFQAVRMEKNMMGLLLSLIVAVAAFNIITSLGMMVMEKQGEVAILQTQGLTPRQIMAVFMVQGASAGIVGALLGAVLGALLASQLNNLMPIIGAFLDGAALPVAIEPLQVIVIALVAMVLALLSTLYPSWRAAATQPAEALRYE

SEQ ID NO: 7945 - protein, 63 aa, Klebsiella pneumoniae
SINVGADAPAAMRASIAALSFALFPITTPCRFAPVIFNFEIQIRQVRKQTKKKAAKHANGCPL

SEQ ID NO: 7946 - protein, 146 aa, Klebsiella pneumoniae
AIFVLLTLMLMLKMIDVVAAIIEQDGQILLAQRPPHADQPGMWEFAGGKVEPGESQPQALARELQEEMGIIARPACYIASHQREVSGRRIHLHAWWVPHFQGTPLAHYHTQLRWCLPTEALALDLAPADIPLLHAFIAQRPTLSVR

SEQ ID NO: 7947 - protein, 60 aa, Klebsiella pneumoniae
KIVVKLVTCASGLVKLGDVGMQTDNSTIRQPLMLNVNLAVARLADFAMVRLAAVADNRLA

SEQ ID NO: 7948 - protein, 654 aa, Klebsiella pneumoniae
SRSVDSMRLFIAEKPSLGRAIADVLPKPHRKGDGYIECGNGQVVTWCIGHLLEQAQPDIYDSRYARWNLNDLPIVPEKWQLQPKPSVTKQLNVIKRLLGDAEEVIHAGDPDREGQLLVDEVLDYLQLAPEKRQQVQRCLINDLNPQAVERAINRLRANSEFVPLCVSALARARADWLYGINMTRAYTLLGRNAGYQGVLSVGRVQTPVLGLVVRRDEEIENFVAKDFFDVKAHIVTPQEERFVATWVPSEACEPYQDEEGRLLHRPLAEHVVKRIEGQPAIVTGYNDKRDSEPAPLPFSLSALQIEAAKRFGFSAQNVLDICQKLYETHKLITYPRSDSRYLPEEHFAGRHAVLNAIAVHAADLLPQPVVDPEIRNRCWDDKKVDAHHAIIPTARSSQVKLTDNEAKVYTLIARQYLMQFCPDAVFRKCQIDLEIANGKFVAKARFLAEAGWRTLLGSKERDEENDGTPLPVVAKGDELLCERGEVVERQTQPPRHFTDATLLSAMTGIARFVQDKDLKKILRATDGLGTEATRAGIIELLFKRGFLSKKGRYIHSSEAGRALIHSLPEMAGRPDMTAHWESVLTQISEKQCRYQDFMQPLVGTLYQLIDQARSTPVRQFRGLVAPGGAKKSFSKGKGKPKGKKAADDTAPPPQ

SEQ ID NO: 7949 - protein, 329 aa, Klebsiella pneumoniae
GGPVKYIAISQPGGPEVLQIREGEIPTIGEHEVLIEVKAAGVNRPDILQRQGLYPMPEGVTPVPGLEVAGVVVKVGAQVTAFMPGDRVCALTNGGGYAEYCAVPAGQTLPIPAGLSFSEAAAIPETFFTVWANVFQLGKLQPGESILVHGGASGIGTTAVQLCHALGMTVYATVGQDEKIVALRPYATAINYKTDDFAEKIGQLTNDEGVDVILDIVGGPYFKRNLGLLKKDGRLVIIGFMGGRIAHEVDIQTLMLKRATVTGSTMRGRTAAEKQQIAEALRRHVWPLLEAGKCKPLIYASYPMAEIAEAHACLDSGQHLGKVVITMTS

SEQ ID NO: 7950 - protein, 124 aa, Klebsiella pneumoniae
PMAVTAGEVIMEFGMKRVLASVQAAATLNKLYDGSPVSLTAISKESKLSTSYLEQIFKKLRAGNLVISQRGPGGGYSPRGDDITVTEVITAVSKLPAHKTFEPILRALDDVRVSQLLRGDSPAP

SEQ ID NO: 7951 - protein, 417 aa, Klebsiella pneumoniae
AVNVQRGTPHIDQRFDGDEQGYQGHRQAHRRQDDQRGEGRAAAHPGDARRADGDDAHEGGNPHRIQRVDAHGRRDHHRQHCRIDTGAAVLADGGAKGGGEAGNRLRYAETTGLRLNVQRNGGGAGAAGKGEGDHRPDFTEVLQRADAVNRQQQAVDDKHNTQRNVRGYHEAAKLDDVLQIRPGNHFGHQGQHTVRGQLHDQTNQLHYPALQGIDRGQHALAFFHILFQQLKRCDAEERRENDDADDGGWVSPGQVSKRVLRHEGKDQLRDAEIRYFPHIVALDGVQTGGLRAALDQTLGGEAEHIGHQHANQGGDQGGEQQSTDAQEANFPQLRGIVQAGHRAKDGGEDQRHNNHLQQLDVTVADDIEPLDGILQHLAVRPVDQLQRQTKYHASRQTDQHFSGQAPLFMTCLPQRKQ

SEQ ID NO: 7952 - protein, 120 aa, Klebsiella pneumoniae
LLNVQGTVMKIETERQASVTILTPAVRRLDASVAVAFKSAIAQEIGEAPGDLIVDFSEIDFIDSSGLGTLVSLMKMMNGRGEMTLCALNPGIRNMFTLTRMDRIFRICEDRTSALAQLNE

SEQ ID NO: 7953 - protein, 140 aa, Klebsiella pneumoniae
KMNVYTPVELRQIVSFPFFADLVQCGFPSPAQDYVEKRIDLNELLVQHPSATYFVKAAGDSMIDAGIDEGDLLVVDSARKAEHGDIVIAAVGGEFTVKKLQLLPRVQLNPMNPAYSPIVVGREETLDIFGVVTYIIKAAG

SEQ ID NO: 7954 - protein, 156 aa, Klebsiella pneumoniae
MSDVPVNSNMMFPAELTSLSPLAEWLAQQMASLPVADEWRFALDLAACETATNIIRYALHEDRESRFGVEFRVADRRVTLRFTDAGETFPAERLAMARGDEHFDVDPLAENGRGLRLILRAVDFFDVEMNAGKNITTLMKALPDPAVNYSTDKNGG

SEQ ID NO: 7955 - protein, 140 aa, Klebsiella pneumoniae
HPCVRDWLTCYIERAVANGAVAMRGEGSNRWSAAHVDDVARLYVSALLQGAAGERYHAVAEEGIALRAIAAVIAHGLNLPLTHLDESQVDAWFGWFAPFTALDLRASSAWTRERLQWQPVGPGLLEDLQNMDYHKVTLSQ

SEQ ID NO: 7956 - protein, 107 aa, Klebsiella pneumoniae
STSLFLNWWSSSKSRNQLLRSPAMNNQQTMLYQGVLIPRPVLNVDLHVLPDFTGRVVVHIENGRVICDRQLFVDEHICSLATFIEMAREMELRFEEVAGGTDSNTNS

SEQ ID NO: 7957 - protein, 153 aa, Klebsiella pneumoniae
MSRVTAIISTIVICLIASLGWLANHYHTNATEFKSQRDKATEQLSLANETISDMQVRQRDVAALDAKYTKELADAKSQLEDLQRCVSAGKCGLHVNARCPSNGAPGASGVGHASGPRLTDAAERDYFTLRERISLVTRQVGYLQEYIDTQCLK

SEQ ID NO: 7958 - protein, 326 aa, Klebsiella pneumoniae
IVRVSDMKTAEAAKGRWSEIFEYYGLPPITGKNHYKGECPVCKARGKYRVDDRDGQGTWICVCGSGDGMKLLTLTQSKSFSAICAEVDQLIGNNYQRINVPANSSAARQRQRVISKFSKLLDLRGTSAAGYLLQRGISRLPAEGIRFCDRQRHAGRVYQALYALATDDKAELCYLHQTLLDGDRKADIDSAKRLKSLQEDSYLDHARSVAIRMFPVSTTIGIAEGIETALSCYQVYGVNTWAVINSGFMKKFRVPAGVKHLIIFADMDKHSATGHAAAFECAHANLLAKNDLVKVSIRWPDNGDFNDMLMNGDQVREQVFYKKVAA

SEQ ID NO: 7959 - protein, 93 aa, Klebsiella pneumoniae
CGRVISSSLGPLSTVCPQYMTLILSAHLLSICRSWLISKMVVLLFWLSRVSRRIICAWVVGSMALVGSSAISRRGWLARAMAIITFWHSPSVS

SEQ ID NO: 7960 - protein, 109 aa, Klebsiella pneumoniae
CRGVRYRRTSCQRSPACRSPRCPPAAGRRRRPASDPAGCGPDLRCRPADRERRPPTPDESDGSTDTGPRSPVPNPAARRSTAPRRAPPPRYSSGKPFPLASSWLLESYG

SEQ ID NO: 7961 - protein, 159 aa, Klebsiella pneumoniae
AMSVVVQVAHSVNGVESSCMKLSVINFIMMHRNSIGLVLCLCLILTGVISIIYDRISKNKFITLCSLFVEKFGARPVEALIYQDGGFFFSFMRDAFFIKALYFKENSFHTRGMDNEQIRFIKELPNQYTDWLRVKVRFSVVGIIFLFMMLSVFYLPSFI

SEQ ID NO: 7962 - protein, 324 aa, Klebsiella pneumoniae
GGAVEHFLALTLAGRLPHHFHGETAHFRWHWLGEGILELTPHARCERGLVLSCAIHGNETAPVEIVDHLVQRLVREALPLRWRLLVIVGNPPALRANKRYLHSDMNRMFGERWRQFPLSEETQRAQRLEQAVARFYRDHDGPRWHLDLHTAIRGSLHPRFGVLPARDTPWEEDFLHWLGGAGLEALVFHRQPGGTFTHFSCERFAALACTLELGKALPLGENDLTQFAAVQRALSRLLVGDLAIADAPAPLRYRVVQQLTRHSDDFRLHMADQTLNFTPFEPGTLLAEEGETRYVVGPETEYVLFPNPTVAKGLRAGLMLEKLS

SEQ ID NO: 7963 - protein, 491 aa, Klebsiella pneumoniae
RLAVACCRTSKNNEFIFPSKSNFIHHRRNSLLRLLRVLTMSKVIDSLEKVLLPFAVKIGKQPHINAIKNGFIKLMPLTLAGAMFVLINNVFLSFGEGSFFYSMGIRLDASTIETLNGFKAIGGNVYNGTLGIMSLMAPFFIGSALAEERKVDPMAAGLLAVAAFMTVTPYSVGEAYAVGANWLGGQNIISGMIIGLVVAELFTFVIRRNWVIRLPDSVPGSVSRSFSALIPGFLILSIFGIISWALASYGSNFHQIIMDSISTPLAAMGSVVGWAYVIFNSLLWFFGVHGSLALTALDNGIMTPWALENIALYNQYGSVDAAIEAGKQFHFWAKPMLDSYILLGGSGATLGLIIAIFIASRRADHRQVAKLALPSGIFQINEPILFGLPIIMNPVMFIPFVLVQPILAAITLAAYSLGIIPPVTNLAPWTMPTGLGAFFNSNGSVAALLVALFNLGVATLVYLPFVVLSNKAQTVIEQEESEEDIANALKF

SEQ ID NO: 7964 - protein, 250 aa, Klebsiella pneumoniae
KALFNSRLYFAYIMSVRLLSKMLGRTAMRVLVVEDNALLRHHLKVQLQELGHQVDAAEDAREADYYLGEHLPDIAIVDLGLPDEDGLSLIRRWRSHDVSLPVLVLTAREGWQDKVEVLSAGADDYVTKPFHIEEVAARMQALLRRNSGLASQVISLPPFQVDLSRRELSVNDQPIKLTAFEYTIMETLIRNRGKVVSKDSLMLQLYPDAELRESHTIDVLMGRLRKKIQAEYPQDVITTVRGQGYLFELR

SEQ ID NO: 7965 - protein, 386 aa, Klebsiella pneumoniae
SRLFRGILMTVFTKKLTAAIPAMLLCASLTGVTTMSSAETTNPNAPVSMIEKWDKTFAESSKVDHRKVTFQNRYGITLVGDLYLPKDRGERKLAAIAVSGPFGAVKEQSSGLYAQTLAEQGFVTLAFDPSYTGESGGYPRNVASPDINTEDFSAAVDFLGLQKEVDRNRIGLLGICGWGGMALNDAAMDTRVKAVATSVMYDMSRAMGHGVGDGKDRYTTADRRAVLRYLNVQRWKDAANGTFVPGGHDIYVDDKGNVSAADRILPETLPANPNPVLKEFFDYYRMPRGFHARSVNSTGAWNATMPLSFMNMPLLSYASEVTIPTLIVTGEKAHSRYFAEDAFKAIGSSEKALVIVPGANHVDLYDNVAGKIPFATFAQFFKTNLK

SEQ ID NO: 7966 - protein, 64 aa, Klebsiella pneumoniae
IILLKIKNWHGFWLFTPSSLRLFAFLACYAEVLLLNFIMKYITHKINIYINSFPSGITVCIDRN

SEQ ID NO: 7967 - protein, 63 aa, Klebsiella pneumoniae
VSILFRHRRFHDLLGIRSADMEGNSLIFNSEIIRDWSGFANPNCHRVLGEERSALSISVKINK

SEQ ID NO: 7968 - protein, 270 aa, Klebsiella pneumoniae
LIVLRHLPMVYLIYSAMEAVLKKILVLPLMFFSFSSFSEGVPSTDVQPYPDYLAAYVKTIVTAGCEQALKGGSKDVLIERATQGMKKDTESYYTLHNAVVLGTAFGGELKEKGKFITKEKVAIDSCGGAAAYTLLQKDFMKKVIGTLISSAQSQASESKPKVATSDESVYRTTAKDLAALYDENEVAADDKIAGRKVEVTGVVQDITKNFANDVVLKLESGNRFMPVSLSMTDSEKSQASKLKRGQKITVTCEKMLLFIGAPSGGNCTFN

SEQ ID NO: 7969 - protein, 84 aa, Klebsiella pneumoniae
AVPFNPDLFVWWQVTENECRRFDVFNSLNQKGLKCSTHRYLPLSMFSFTISDKNVITPRLLIFTELLFTNGSNFTSSCSRINQS

SEQ ID NO: 7970 - protein, 227 aa, Klebsiella pneumoniae
TVALQLATFSPVVGRWANRSRKSRLNREKRGQNGSWYRGEKSARWISSRWWKPACLRSIRACWLILTGKSRRKIWFIPSGISTAKQTGSLSRGRLTGGMIELAIKGTLERITGMNAYPLLLPDTVQEGATFQRISDPEMVSGMLRTGIVSARIQVNLYLLDNYTSLLQLDKKIWAELKSVVHGQLEGIPVQYVERGGIHQDKNQLTNRRIQYRLTRDFIIHYVEDSS

SEQ ID NO: 7971 - protein, 468 aa, Klebsiella pneumoniae
LSALLRRAACVQAQRLREKKMSQKLKVVTIGGGSSYTPELLEGFLKRYHELPVSELWLVDVEEGQEKLDIIHALCQRMVEKAGVPMKVYKTLDRRAALQGADFVTTQLRVGQLKAREKDERIPLSHGYLGQETNGAGGLFKGLRTIPVIFDIVKDVQEICPDAWIINFTNPAGMVTEAVYRHTNFKRFIGVCNIPIGMKMFITDVLQLSPSDELNIDLFGLNHLVFVRDVLVNGVSRFDELLDGVASGRLTANSVKNIFDLPFSEGLIRSLRLIPCSYLLYYFKPKEMLAIEMGEYYKGGARAQVVQKVEKQLFELYKNPDLNVKPKELEQRGGAYYSDAACEVINAIYNDKQTEHYVNIPHHGHVDNIPADWAVEMSCTLGRDGAKPTPRITHFDEKVLGLIYTIKGFEVAASQAAISGELNDVLLALNLSPLIHSDRDAEQLAREMILAHEKWLPNFAATIEKLKS

SEQ ID NO: 7972 - protein, 158 aa, Klebsiella pneumoniae
ETFFRKVSSIKGTFMAGGIRSSGGGRKPTLPTGQKSKLTRIAPPAELMGEAAIRMWKTQSKILIDRGVFELEDAPLLLAYCNAFHLMLEAEKMLASGLTSESEMGGLKKHPAVNVRNDSVSQLARLGSLLGLDPLSRLRMTSGQKDPDDDGNEFDEFD

SEQ ID NO: 7973 - protein, 2680 aa, Klebsiella pneumoniae
TIQFRPPCGGFFYGRNMANNIIKGRKGGGSKQRTPTEQPDDLQSVAKAKILLALGEGEFAGGLTGKDIYLDGTPLENADGSQNFSGVSWEFRPGTQAQTYIQGIPGTENEISVGTEVSSKTAWTHTFTNTQLSAVRVRLKWPSLMKQEDDGDVVGNTVKYAIDLQTDGGAWQTVLETAVTGKTTSGYERSHRIDLPQAGSTWTLRLRKISPDANSVKVGDVMTLQSYTEVIDAKLRYPNTALLYIEFDSSQFNGSIPQISCEPRGRVIRVPDNYNPETREYTGVWTGGFKWAWTDNPAWIYYDIVIADRFGLGNRLSSANISKWTLYQIAQYCDQLVPDGRGGDGMEPRYTCNVYVQERNDAYTVLRDFAAIFRGMTCWNGEQIVVQADMPRDVDFTYTRANIVGKPRYSSSSSQVRYTNALVSWSDPDNAYADAMEPAFIPELVSRYSFNQLELTAIGCTRQSEAHRKGLWGILTNNKDRVVEFDVGLDGRIPQPGYIIALADELLAGRVNGGRISAVNGRVITLDRDVDAKPGDRLQLNLPSGISQSRTIQAVNGRRQITVTTAYSETPERECVWAVESNDLFLQQYRVTGVKENGDATLTITGVSHDPDKFARIDTGAIIDQRPVSVLPAGNQSPPDDIVITSRSVVNQGISVETMQVNWSAVSGAIAYEAQWRRNDGNWINVPRSSTTSFEVSGIYAGRYLVRVRAINAAEISSGWAYSEEKTLTGKVGEPLAPLALATRSLVHGVQVSWEFPTGSGDTLRTELQYSKNQDGSAPMPLSDVAYPGKSYQQMGLSMGAEFWYRARLVDRLGNESPWTGWVQGMASDNFDDYYENLTDAIKDTAAWEETQRTISETQEGIRNTQQELEQTAEALRKEAEDQAKQVSQDIDASAKSITADVDGKISAVNKTITDEITSVNEALDSGLAQANKGVQEAKSAVADANKQIATVNKSLTDSITQVRQSVTDTAAEINATIDLEIARVSKTLADGDAALNAQIKTAENGLKQSLSQVNTTLTNAVKQETADRIADVNAKASQAADELLAATQGIEASIESLTQVMKTADENLAREMSSLAAGANIQFDSQVIWHFNNQTTEGWTGSAGVPGVSQDGWLRPADSATDPYITSPGGLAVDGAAYRFIMLRFRKTGKPVWAGEIRWVSAGENFNNTKRYIVAEPEYADGVATLTVRDIPWTGNIDRIRLDLTNQQDASNFIEFDWIAVGRPAPGASTAALQDVRSTLSNALTAEAQARSTLAAQMRGSYDGSDLEKVTSGLLYQEKTARVTAISAEVKARESLQTQFNDNKAAVSGELSSLTTEQSAQASRIGGLETSLGKKADAAALTSLTQKVEQQGATLTSQGAALTSLTNRVGQTETGLAGTNEALSGLQSVVTQQGDRITSQGQSITKLTSDLGTTNAALAKKAEAAAVTALTQQVEQNGRDIRSNTDSITSLSNQLVNGQPNRWSRRLYPVQLANAGTVPSFSDVRAVAPTVVDEVADAAKLDFTSAGSYLIALYSCQVKVAADTTITLAPGARVFDDTGAIFVNGVQVAWGNASWNTVSFELKAGWNTVEFLVNQWTGQAYINLGLKLSDKVAEMYSGLGVSALANAAGVLSSNVSQIGNEVVSNSQSITQLRNALTQTDANVASKADQTAMNSLTGRVEKTESGLTAANANITSLKSAVRAGNASGGDLIPNPTFDPAYDQMGFSVVSTTAEEVPPSCPYGYAARIASRDHHPNFAAFPATLNDVIEISALVACGAGTANFNLYVGTAVRPDTSTGAPLMAGGGKSPSATWQRTTWRFKVTQAMVDRGYIRPFLQISQNSPYGTVWFVTDWHMRNVTAAQKVQDTADATAAAVDSLTTTVTQQGNLLTSTGNRTTQLENGLATTNAAVAKKADATAVQDLTNTVTQLGNDLTAANSAITKLTGNLANTDKALAQKADATALATLDTKVTQQGKTLESQSNSLTNLSNSLSQVAADIDASGQIPGNLVVNPSFERGLDGYTGRSTATSVVEVSAPHSGTRALKVDPGSVSPGQYIPFVQGRTYEIGVWVKEPGATTDNGAGNNKLRIGNSAGQPVFERPYNSGTVGTNWTLVSGRWKATETASLPVTLSNYLISGSRYFDDFYVTDVTDRVDIDATAGAVTGLTSRVSTAEGAITSQSQQLTNLQNSLNTTNSNVSKKADATALTSVDNRVTEAEGKLTTQSQQLTNLANVLTATRNAGDNLIPNFDFLQGSTAWDIQYPAGVTFGDFGDGKAGVRLNRTTNTSPGIFSNNNKPVPLNGQRKYRVVVKAKGVSGAMSLLIRRQNKIGQTDSTHEDKTVTLTTDWQTITWETGLTAAGADGQNFKLYSHPTNGEIWLDSVRVFDITDETNIKATSDAISSLTGTVTNQGNTLTSQGQSITALNNALEGVKGDVSKKADATALTSVDNRVTEAEGKLTTQSQQLTNLANVLTATRNAGDNLIPNFDFLQGSTAWDIQYPAGVTFGDFGDGKAGVRLNRTTNTSPGIFSNNNKPVPLNGQRKYRVVVKAKGVSGAMSLLIRRQNKIGQTDSTHEDKTVTLTTDWQTITWETGLTAAGADGQNFKLYSHPTNGEIWLDSVRVFDITDETNIKATSDAISSLTGTVTNQGNTLTSQGQSITALNNALEGVKGDVAKKADASAVSSLTQPGYPRLKRISVARPTA

SEQ ID NO: 7974 - protein, 194 aa, Klebsiella pneumoniae
LSFSLHPEVKVSPASLSQTRSYFLTPEGISMNMKSIEDVFIHLLSDTYSAEKQLTRGLAKLARAASSEKLSAAFNAHLEETQGQIERIDQIIEQESNLKIKRMKCVAMEGLIEEANEVVESTEKNEVRDAALIAAAQKVEHYEIASYGTLVTLAEQLGYKKAAKLLAETLEEEKQTDVKLTDLAVGNINKKAEK

SEQ ID NO: 7975 - protein, 295 aa, Klebsiella pneumoniae
WPISCSPLRRNCARPMPPSGAIRAYWIRSVCLTASARRWRQPCRRICRRCLPSLTRHGLTRWSRNGCAATVPTDPAGLGGDGGDLSAAAPRRRGTGGRCALPGPLAGAVRRPAAGPGAGRHARLHAVVRRRRAADRPDHRRRPLAFGPLAAAGFPSAAAAGGAPSRPGDGGAAAVRRRGLALAAVAVSDAAGRPVRHWAWPDDGPERERLCAVGDLWPAGRETPRRPGDRPEEPRLRPLAVPALAGAARPAARPRHGAAGHHRLEPVGGRRRPGAGARQSAHPRRAGVAMVKPGR

SEQ ID NO: 7976 - protein, 582 aa, Klebsiella pneumoniae
PLISVRFFVQTGKCRPDSIGARTIAPRPSIPPDVCKGDPAMPSPMIYQDLTTAALLGHAAQYHSETEIVSVSTGGEKERSCWGEVASRAQRLASALASLGLPPGARCATLAWNNRRHLEIYFAVASGGWVTHTVNPRLSVDHLRYILNDAADEVLFFDQTFLPLVAQLLPQLPTVKHVVLMESRSEAALSQLPSLLFYDDLLQQGMADYRWPQLNELTPASLCYTSGTTGRPKGVLNTHRSLVLHALSGNQPDAAGISAKDSLLPVVPMFHVNAWGTPFIAAMVGARLVLPGPHLDGDSLLQLLAAEKVTVGFGVPVIWAGLLAAMRRTEVRLPEFKRALVGGSALPPSMAEAFQRDYGIALTHAWGMTETSPIGTINTPLSKHDALPAQEQQKQRAGQGRPIFGIELQVVDVDGEPLPRDGQSQGYLQVRGHWVVEQYYGQDASALTAAGWFDTGDIGTLDANGYLVISDRAKDIIKSGGEWISTVELENIAIAHPGVRSAAAIAARHPRWDERPVLLCVRAEGGEVEETDLLSWFEKRVPKWQIPDRVIFVDALPVSATGKVLKNQLRQAYGEILMSEGK

SEQ ID NO: 7977 - protein, 457 aa, Klebsiella pneumoniae
SMELSSLTAVSPVDGRYGDKVSALRGIFSEFGLLKFRVQVEVRWLQKLAAHAAIKEVPAFAADANGFLDKIVADFSVEDAERIKTIERTTNHDVKAVEYFLKEKVADVAELHAVSEFIHFACTSEDINNLSHALMLKTARDEVVLPYWRKLIDAVKDLATQYRDVPLLSRTHGQPATPSTMGKEMANVAYRMERQYRQLNQVEILGKINGAVGNYNAHIAAYPEVDWHQFSEEFVTSLGIQWNPYTTQIEPHDYIAELFDCIARFNTILIDFDRDVWGYIALNHFKQKTIAGEIGSSTMPHKVNPIDFENSECNLGLANAVMQHLASKLPVSRWQRDLTDSTVLRNLGVGIGYALIAYQSTLKGISKLELNQDRLLDELDHNWEVLAEPIQTVMRRYGIEKPYEKLKELTRGKRVDAEGMKQFIDSLALPEEEKVRLKAMTPANYIGRATTMVDELK

SEQ ID NO: 7978 - protein, 530 aa, Klebsiella pneumoniae
QRNSRFINLITIYGPARGLFFFQGKPSRRNFIMAMYEVGTVTGAASQARVTGATTKWSQEALGILPGSILVVYRSGSADLYAIKSVDSDTQLTLTRNITTAFSGASYGIITAETASTSSFANQLASAFAFWSSVVEGWSMALTGSGNITLTDPITGKQVTVPAIAGMAKASDLNALAKLTGGNKLDGSQVITSDNAGFILGKNSDLALLKKQGQGGTIAVGSGTPFRVQRSRATTISPADTFDDILVIGTNNQTTLPGDLVVGGGFDNTAKGKLYSQALELSMGTPYIDFHHNKSANDYTARIITTAADQLSVQGSHLRVDRDLRVGQAADIGSWMQCRYDCVSQQTDFGSPAIGALVSGGRVRSRMTGRGGNGDTSGAWGGFYLEEYVGYNHRVVLYMDGFGQKDAWLFYTGGTISTPKGDVMTTGSDVRLKKDFTESQEGASRRINALGVCEFNMKGETRRRRGFIAQQAEKVDPIYTFQSGDVEIDGEKINILNVDHTAIIADLVLTVQELTKQVRDLNKQVQTKEY

SEQ ID NO: 7979 - protein, 749 aa, Klebsiella pneumoniae
IPHSVSSGMTRSYCWIQETDMLYKGDTLYLDWLEDGIAELVFDAPGSVNKLDTATVASLGHALDVLEKQSDLKGLLLRSEKAAFIVGADITEFLSLFLVPEEQLSQWLHFANSVFNRLEDLPVPTISAVNGYALGGGCECVLATDYRLATPDLRIGLPETKLGIMPGFGGSVRLPRLLGADSALEIIAAGKDVGADQALKIGLVDGVVAAEKLRDGALAILRQAMNGDLDWKAKRQPKLEPLKLSKIEAAMSFTIAKGMVAQTAGKHYPAPITAVKTIEAAARLGREEALVLENKSFVPLAHTNEARALVGIFLNDQYVKAKAKKLTKDVETPKHAAVLGAGIMGGGIAYQSAWKGVPVVMKDISDKSLTLGMTEAAKLLNKQLERGKIDGLKLAGVISTIQPTLEYSGFDRVDVVVEAVVENPKVKKAVLAETESKVRPDTVLASNTSTIPISELASVLQRPENFCGMHFFNPVHRMPLVEVIRGEKTSDNTIAKVVAWASKMGKTPIVVNDCPGFFVNRVLFPYFAGFSQLLRDGADFRKVDKVMEKQFGWPMGPAYLLDVVGIDTAHHAQAVMAAGFPQRMQKDYRDAIDALFDANRFGQKNGLGFWRYKDDSKGKPKKEEDAAVDSLLADVSQPKRDFSDEEIIARMMIPMVNEVVRCLEEGIIASPAEADMALVYGLGFPPFHGGAFRWLDTIGSAKYLDMAQQYQHLGPLYEVPAGLRDKARHNEAYYPQVEPARPVGALKTA

SEQ ID NO: 7980 - protein, 219 aa, Klebsiella pneumoniae
RRVSLLCIAVTSSDRRDAMPFTPLVTAGIETALNTFLWRDKALKPARQRLLGKVLRVQLQDFATPVVLVFSERRVDVLSAWDGEADCTVITRLSVLPKLRNRQQLTALIRSGDLEVQGDLQVVQNMVSLCDLAEFDPAELLAPYTGDIVAEGVGKVLRGGAQFLLKGAERQQRYVAEAITEEWRLAPGPLELAWFAEETTAIERALAALEKRLETLEGK

SEQ ID NO: 7981 - protein, 444 aa, Klebsiella pneumoniae
KMESLAALYKNHIVTLQERTRDVLARFQMDALLIHSGELVNVFLDDHPYPFKVNPQFKAWVPVTQVPNCWLLVDGVNKPKLWFYLPVDYWHNVEPLPTSFWTEEIDVIALPKADGIGSQLPAARGNIGYIGPVPERALGLGIAADKINPKGVIDYLHYYRAYKTDYELACMREAQKSAVNGHRAAYEAFQSGMSEFDINQAYLTATGHRDTDVPYSNIVALNEHASVLHYTKLDHRAPAEMRSFLLDAGAEYNGYAADLTRTWAAHGDNDFAHLIKDVNDEQQALISTMKAGTSYIDYHIQFHQRIAKLLRKHQLVTDMSEEAMVENDLTGPFMPHGIGHPLGLQVHDVAGFMQDDTGTHLAAPSKYPYLRCTRIIEPRMVLTIEPGIYFIESLLAPWREGPFSKHFNWQKIDAMKPFGGIRIEDNVVIHENSIENMTRDLKLA

SEQ ID NO: 7982 - protein, 336 aa, Klebsiella pneumoniae
ANWSTLPASRSSNPHHNKSAPERKGRKMTTKKADYIWFNGEMVPWGEAKVHVMSHALHYGTSVFEGIRCYDSHKGPVVFRHREHMQRLHDSAKIYRFPVSQSVDELMEACREVIRTNNLTSAYIRPLVFVGDVGMGVNPPPGYNTDVIIAAFPWGAYLGAEALEQGIDAMVSSWNRAAPNTIPTAAKAGGNYLSSLLVGSEARRHGYQEGIALDVNGYISEGAGENLFEVKDGVLFTPPFTSSALPGITRDAIIKLAKDLGIEVREQVLSRESLYLADEVFMSGTAAEITPVRSVDGIQVGAGRRGPVTKRIQEAFFGLFTGETEDKWGWLDPVSK

SEQ ID NO: 7983 - protein, 421 aa, Klebsiella pneumoniae
ATSPDMSLAKASLWTAASTLVKIGAGLLVVKLLAVSFGPAGVGQAGNFRQLVTVLGVLAGAGIFNGVTKLVAQHHDDPPRLKQVVGTSSAMVLGFSTLLALVFLLAAAPISQGLFGHTHYQGLVRLVALVQMGIAWANFLLALMKGFRDAAGNAFSLIAGSLIGVAAYYACYVLGGYQGALLGLALVPALVVVPAGIMLWRRGNIPLSALRPRWDNGLAGQLSKFTLMALITSVTLPVAYVMMRNLLAAHYGWEAVGIWQGVSSISDAYLQFITASFSVYLLPTLSRLSAKTDITREIGKSLKFVLPAVAAASLTVWLLRDFAIWLLFSDRFTAMRDLFAWQLVGDVLKVGAYVYGYLVIAKASLRFYILTEISQFALLTAFSHWLIPAHGAVGAAQAYMATYIVYFALCSGVFLLWRKRA

SEQ ID NO: 7984 - protein, 370 aa, Klebsiella pneumoniae
PRGPTGLCGWRWDSRRLPPIGVYVQFWFPEMAQWIPALIAVGLVALANLAAVRLYGEIEFWFAMIKVTTIIVMIVVGLGVIFFGFGNGGHSIGFGNLTEHGGFFAGGWKGFLTALCIVVASYQGVELIGITAGEAKNPQVTLRSAVGKVLWRILIFYVGAIFVIVTIFPWDQIGSNGSPFVLTFAKIGITAAAGIINFVVLTAALSGCNSGMYSCGRMLYALAKNRQLPAAIGKVSRNGVPSVGVALSILILLVGSCLNYIIPNPQRVFVYVYSASVLPGMVPWFVILISQLRFRRVHQAAIASHPFRSLLFPWANYFTMAFLICVLVGMGLNDETRMSLFVGIIFLAAVTLIYKVFGLGRQGQVNNTAE

SEQ ID NO: 7985 - protein, 498 aa, Klebsiella pneumoniae
RIIPSVFSLSKEAPEMHFRAITRIVGLLVILFSGTMIVPGLVALIYRDGAGRAFTQTFFVALASGSMLWWPNRKQKGELKSREGFLIVVLFWTVLGSVGALPFIFSEQPNLTVTDAFFESFSGLTTTGATTLVGLDSLPHAILFYRQMLQWFGGMGIIVLAVAILPILGVGGMQLYRAEMPGPLKDNKMRPRIAETAKTLWLIYVLLTIACALALWFAGMPAFDAIGHSFATIAIGGFSTHDASVGYFNSPMINSIIAIFLLISGCNYGLHFSLLSGRSLKVYWRDPEFRMFIGVQLTLVIVCTLVLWLHNVYGSVLTTLNQAFFQVVSMATTAGFTTDSIARWPLFLPVLLLCSAFIGGCAGSTGGGLKVIRILLLFKQGNRELKRLVHPNAVYSIKLGNRALPERILEAVWGFFSAYALVFIISMLAIIATGVDDFSAFASVVATLNNLGPGLGVVADNFATMNPVAKWILIANMLFGRLQVFTLLVLFTPTFWRE

SEQ ID NO: 7986 - protein, 110 aa, Klebsiella pneumoniae
RQHPLRRSDGTGLAVLTPVCRAPAGYSADANPRRGHRHAASCRQCGGVSGESAGDPRHSSASDQRRRRSAPDLPGCRPHHRRRRSAPGGRYRRRQHRAGDRDRRTNNLAV

SEQ ID NO: 7987 - protein, 251 aa, Klebsiella pneumoniae
WRSPAMSILVTRPLPQGEALVSRLRAMGRVAWSFPLIEFTPGRELPALGDALARLGPDDLLFALSQHAVEFAHARLQQQGLPWPTSPRYFAIGRTTALALHTVSGQHIHYPLDREISEVLLQLPELQNIAGKNALILRGNGGRELLGATLTERGARVTFCECYQRSAKHYDGAEEAMRWQSRGVTTLVVTSGEMLQQLWSLIPQWYREQWLLHCRVVVVSERLALQARELGWQEIQVADSADNDALLRALQ

SEQ ID NO: 7988 - protein, 393 aa, Klebsiella pneumoniae
CSAFPLLELGHHRYTSRINYAESTCVVNLLTAITELISIFLFTTLFIFVARKVAKKIGLVDKPNYRKRHQGLIPLVGGISVYAGICFTFAIADYYIPHASLYLACAGVLVLVGALDDRFDISVKIRAVIQAAIAVIMMMAGNLHLSSLGFIFGSWELVLGPFGFFLTLFAVWAAINAFNMVDGIDGLLGGLSSVSFAATGIILWFDGQYSLAMWCFAMIAAILPYILLNLGALGRRYKVFMGDAGSTMIGFTIIWILLETTQGKTHPISPVTALWIIAIPLMDMVAIMYRRLRKGMSPFSPDRQHIHHLIMRAGFTSRQAFVLITLAAALLALVGVVAEYTRIVPEWVMLILFLVAFFLYGYCIKRAWKVARLVKRIRRRIRRHSGNNPKLTK

SEQ ID NO: 7989 - protein, 277 aa, Klebsiella pneumoniae
RSSPCLEVNFFMYQVVASDLDGTLLSPDHFLTPYAKETLKLLTARGINFVFATGRHYIDVGQIRDNLGIRSYMITSNGARVHDSDGQQIFAHNLDRDIAADLFEIVRNDPKIVTNVYREDEWYMNRHRPEEMRFFKEAVFNYKLYEPGELDPQGISKVFFTCEDHEHLLPLEQAMNARWGDRVNVSFSTLTCLEVMAGGVSKGHALEAVAKMLGYTLSDCIAFGDGMNDAEMLSMAGKGCIMANAHQRLKDLHPELEVIGSNADDAVPHYLRKLYLD

SEQ ID NO: 7990 - protein, 568 aa, Klebsiella pneumoniae
RAWPARCGQNGGFPPDAERFSDRVNPRRVLPGFVFHKMQRDVVNISISAIKFLSYSKFILAKANRTISTTQHHGVTDMANYFNTLNLRQQLAQLGKCRFMARDEFADGASYLQGKKVVIVGCGAQGLNQGLNMRDSGLDISYALRKEAIAEKRASWRKATENGFKVGTYEELIPQADLVVNLTPDKQHSDVVRSVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVAEGTDPAYAEKLIQFGWETITEALKQGGITLMMDRLSNPAKLRAYAQSEQLKEIMAPLFQKHMDDIISGEFSSGMMADWANDDKKLLTWREETGKTAFETAPQYEGKIGEQEYFDKGVLMIAMVKAGVELAFETMVASGIIEESAYYESLHELPLIANTIARKRLYEMNVVISDTAEYGNYLFSYACVPLLKEFMTTLQTGDLGTAIAEGAVDNAQLRDVNEAIRSHAIEQVGKKLRGYMTDMKRIAVAS

SEQ ID NO: 7991 - protein, 275 aa, Klebsiella pneumoniae
MMQFSKMHGLGNDFMVVDAVTQNVFFSPELIRRLADRHLGVGFDQLLVVEPPYDPDLDFHYRIFNADGSEVSQCGNGARCFARFVRLKGLTNKRDIRVSTANGRMVLSVTEDDLVRVNMGEPNFEPSQVPFRANKAEKTYIMRAAEQTVLCGVVSMGNPHCVIQVDDVDTAAVETLGPVMESHERFPERANIGFMQVVGRSHIRLRVYERGAGETQACGSGACAAVAVGIQQGLLAETVRVELPGGRLDIAWKGPGQPLFMTGPAAHVYDGFIHL

SEQ ID NO: 7992 - protein, 123 aa, Klebsiella pneumoniae
GNSTRLTKKPGQSFTTIGVLPILLAQATTLAMVLSEVFSPRITSTSGMRCTGLKKCIPQKFSGRCRTLASSLMGIVEVLDASTVSGRTFDSVSASTAFFTFGFSTTASTTTSTRSKPLYSRVG

SEQ ID NO: 7993 - protein, 741 aa, Klebsiella pneumoniae
SPVTLYILTGVRGTPSLPAVPMDVSYLLDSLNDKQREAVAASRTNMLVLAGAGSGKTRVLVHRIAWLLSVENCSPYSIMAVTFTNKAAAEMRHRIGQLMGTTQGGMWVGTFHGLAHRLLRAHHLDANLPQDFQILDSEDQLRLLKRLIKAMNLDEKQWPPRQAMWYINSQKDEGLRPHHIQSYGNPVEQTWQKVYQAYQEACDRAGLVDFAELLLRAHELWLNKPHILQHYRERFTNILVDEFQDTNNIQYAWIRLLAGDTGKVMIVGDDDQSIYGWRGAQVENIQRFLNDFPGAETIRLEQNYRSTSNILSAANALIENNNGRLGKKLWTDGADGEPISLYCAFNDLDEARFVVNRIKTWQENGGALEQCAILYRSNAQSRVLEEALLQASMPYRIYGGMRFFERQEIKDALSYLRLIANRNDDAAFERVVNTPTRGIGDRTLDVVRQTSRDRQLTLWQASRELLKEKALAGRAASALQRFMELIDALAQETTDMPLHVQTDRVIKDSGLRAMYEQEKGEKGQTRIENLEELVTATRQFSYNEEDEDLMPLQAFLSHAALEAGEGQADTWQDAVQLMTLHSAKGLEFPQVFIVGVEEGMFPSQMALDEGGRLEEERRLAYVGVTRAMQKLTLTYAETRRLYGKEVYHRPSRFIGELPQECVEEVRLRATVSRPVNHQRLGAPIAESDTGYKLGQRVRHPKFGEGTIVNLEGSGEHSRLQVAFQGQGIKWLVAAYARLEAV

SEQ ID NO: 7994 - protein, 401 aa, Klebsiella pneumoniae
PLSTCRRAAPTVPVGICTTARRTWNRSSAISPLEYNRYLNKLVAWAWFNGLLTSRTRLFIKGNGIVDLAKLQEMVADVSHHFPLRLPAPTPKALYSPCEIRHLAIIVNLEYDPTAAFRNQVVHFDFRKLDVFSFGEEQKCLIGSVDLLYRNSWNEVRTLHFNGEQAMIEALKTILGKMHQDAAPPDSVEVFCYSQHLRGLIRTRVQQMISECIELRLSSTRQDTGRFKALRVSGQTWGLFFERLNVSVQKLENAIEFYGAISHNKLHGLSVQVETNHVKLPAVVDGFASEGIIQFFFEDADNNDSGFNIYILDESNRAEVYHHCEGSKEELVRDVSRFYSSSHDRFTYGSSFINFNLPQFYQIVEVDGRTQVIPFRTQAIAAAIPTSQDVTASPVLQQRYS

SEQ ID NO: 7995 - protein, 448 aa, Klebsiella pneumoniae
RPLTGMEVPAIPFTTLSSRFTPSLRTHTTMNLTELKNTPVSELITLGENMGLENLARMRKQDIIFAILKQHSKSGEDIFGDGVLEILQDGFGFLRSADSSYLAGPDDIYVSPSQIRRFNLRTGDTISGKIRPPKEGERYFALLKVNEVNYDKPENARNKILFENLTPLHANSRLRMERGNGSTEDLTARVLDLASPIGRGQRGLIVAPPKAGKTMLLQNIAQSIAYNHPDCVLMVLLIDERPEEVTEMQRLVKGEVVASTFDEPASRHVQVAEMVIEKAKRLVEHKKDVIILLDSITRLARAYNTVVPASGKVLTGGVDANALHRPKRFFGAARNVEEGGSLTIIATALIDTGSKMDEVIYEEFKGTGNMELHLSRKIAEKRVFPAIDYNRSGTRKEELLTTQEELQKMWILRKIIHPMGEIDAMEFLINKLAMTKTNDDFFDMMKRS

SEQ ID NO: 7996 - protein, 160 aa, Klebsiella pneumoniae
FDATRRTLPGLDIHRTFQRWIGAFGNCETGAAWLSSARVVKCWVKSRNERNPYPLLPAVRPGTQRRLPVINWRKVGMTSSHHGPYDQGYTRATMAYTKRSDLARASGPHKVCRSPDWSLQLDSMKSESLVIVDQNATVNTFPGLVHTGRHTMGVGCKRSK

SEQ ID NO: 7997 - protein, 261 aa, Klebsiella pneumoniae
ARKTAFATASLRRMDMTGTISAPLYLLRGLQLIGWRDMPHALDYLFADGALREGTLVPINAEKMLAVEDNPEVRALIEAAEFKYADGISVVRSLRKKYPQAQVSRVAGADLWEALMQRAGAEGTPVFLVGGKPEVLAQTESRLRQRWQVNIVGSQDGYFTPEQRQALFERIRDSGAKIVTVAMGSPRQEIFMRDCRRLYPHALYMGVGGTYDVFTGHVHRAPKFWQDLGLEWFYRLLLQPSRIKRQFRLLRYLRWHYSGKL

SEQ ID NO: 7998 - protein, 742 aa, Klebsiella pneumoniae
SKLTPRSSLARISSASFSSLTRICRAAALFAMTSFSGWFVWLTLYHQSVNLGSAFCYNPHPVRRLSKTPMRLNPGQQQAVEFVTGPCLVLAGAGSGKTRVITNKIAHLIRGCGYQARHIAAVTFTNKAAREMKERVGQTLGRKEARGLMISTFHTLGLDIIKREYAALGMKSNFSLFDDTDQVALLKELTEGLIEDDKVVLQQLISTISNWKNDLKTPAQAAAGAKGERDRIFAHCYGLYDAHMKACNVLDFDDLILLPTLLLQRNEEVRERWQNKIRYLLVDEYQDTNTSQYELVKLLVGQRARFTVVGDDDQSIYSWRGARPQNLVLLSQDFPALQVIKLEQNYRSSGRILKAANILIANNPHVFEKRLFSELGYGAELKVLSANNEDHEAERVAGELIAHHFINKTNYKDYAILYRGNHQSRVFEKMLMQNRIPYKISGGTSFFSRPEIKDLLAYLRVLTNPDDDSAFLRIVNTPKREIGPATLQKLGEWAMGRNKGLFTASFDMGLSQTLTGRGYESLTRFTHWLREIQQLAEREPVNAVRDLIRGIDYESWLYETSPSPKAAEMRMKNVNQLFTWMTEMLEGSEIDEPMTLTQVVTRFTLRDMMERGESDEELDQVQLMTLHASKGLEFPYVYLVGMEEGLLPHQSSIDEDNVDEERRLAYVGITRAQKELTFTLCKERRQYGELVRPEPSRFLLELPQDDLIWEQARKTITPEERMQKGQANVANIRAMLAKAKKA

SEQ ID NO: 7999 - protein, 302 aa, Klebsiella pneumoniae
TRMTDSPLFSAVARFLRHLGVERQLSPITLLNYQRQLDALIALADEAGLKSWSQCDAAQVRSFAVRSRRAGLGPASLALRLSALRSFFDWLVGQGELSANPAKGIAAPKIPRHLPKNIDVDDVNRLLDIDLNDPLAVRDRAMLEVMYGAGLRLSELVNLDIKHLDLESGEVWVMGKGSKERRLPIGRNAVAWIEHWLDLRGLFGTDDDALFLSKLGKRISARNVQKRFAEWGIKQGLNSHVHPHKLRHSFATHMLESSGDLRGVQELLGHANLSTTQIYTHLDFQHLASVYDAAHPRAKRGK

SEQ ID NO: 8000 - protein, 360 aa, Klebsiella pneumoniae
TGMTALIHVLGSDIPHHNQTVLRFFNDELAADPQARRFMIVGDEASVRDGYPALDVTCYPGKKALAQAVIATAKANRQQRFFFHGQFNTGLWLALLSGGIRPSQFNWHIWGADLYENSASLKFRLFYPLRRMAQGRVGRVFATRGDLSWFANRHPRVPGELLYFPTRMDPALNTLADNAPRGDTLTILVGNSGDRSNEHIAALKAIHQQFGDTVNVIVPMGYPAKNDAYINEVREAGAALFSGEHLQILSEKLEFHDYLALLRRCDLGYFLFARQQGIGTLCLLIQAGIPCVLNRENPFWQDMAEQHVPVLFTSDALDVSVVREAQRQLASVDKSAIAFFRPNYLTGWRRALRLAAEGQA

SEQ ID NO: 8001 - protein, 284 aa, Klebsiella pneumoniae
IITTNNFVENGVDTELLKTFLEVSRTRHFGRAAEALYLTQSAVSFRIRQLENQLGVNLFTRHRNNIRLTTAGEKLLPYAETLMNTWQAARKEVAHSSRHNEFSIGASASLWECMLNSWLGTLYSAPYNLQFEARIAQRQSLVKQLHERQLDLLITTESPKMDELSSQLLGNFTLALYCASPAKNRNELNYLRLEWGPDFQQNEVGLIGSDDVPLLTTSSAELIYQQLSRLNGCCWLPVRWAKEKHGLHTVMDSATLSRPLYAIWLQNSDKQAQIHEILKNPILE

SEQ ID NO: 8002 - protein, 554 aa, Klebsiella pneumoniae
LCFAIKRPFSAKCNDMPRKVWIRSSKFALFPFSLYVMPTIILLCPGGFMSLAIVYTRAALGIEAPLITVEVHLSNGLPGLTMVGLPETTVKEARDRVRSALINSGYAFPAKKITINLAPADLPKEGGRYDLPIALALLVASEQLNTTRLNQYEFVGELALTGGLRGVPGAIPSAMEAIKAGRRIVVSSDNAAEVGLIGGSDCLVADHLQEVCAFLAGQTSLSPPLAEAPARDERYEDLLDVIGQQQGKRALEIVAAGGHNLLLIGPPGTGKTMLASRLPGLLPPLSNQEALESAAIQSLVNLHTAKTRWRQRPFRAPHHSASLAAMVGGGSIPVPGEISLAHNGVLFLDELPEFERRVLDALREPIESGKIHISRSRAKIEYPARFQLIAAMNPSPTGHYQGKHNRASPEQTLRYLGRLSGPFLDRFDLSLEIPLPPPGILSQGSQGEESSATVRQRVLAARERQMLRQNKLNAHLENREMKNCCRLRREDAVWLEQTLTQLGLSIRAWQRLLKVARTIADLAEVEEIERCHLQEALSYRAIDRMLNHLQKMMA

SEQ ID NO: 8003 - protein, 131 aa, Klebsiella pneumoniae
HPTARAFVSRYTATHLQKSKKQNQIMNDSEFHRLADSLWMTIEERLDDWDGDSDIDCEINGGVLTISFENGSKIIINRQEPLHQVWLATKQGGYHFDLKGDEWICDRSGETFWDLLEQAASQQAGETVKFR

SEQ ID NO: 8004 - protein, 424 aa, Klebsiella pneumoniae
SGNAMSFSTISVIGLGYIGLPTAAAFASRQKRVVGVDVNQHAVETINRGEIHIVEPDLASVVKTAVEQGYLSATTTPVEADAYLIAVPTPFKDRHEPDMVFVESAAKSIAPTLKKGSLVILESTSPVGSTEQMAEWLAEMRPDLSFPQQVGEAADVNIAYCPERVLPGQVMVELIKNDRVIGGMSPVCSARACELYKIFLEGECVVTNSRTAEMCKLTENSFRDVNIAFANELSLICADQGINVWELIRLANRHPRVNILQPGPGVGGHCIAVDPWFIVAQNPQQARLIRTAREVNDHKPEWVIEQVKAQVADCLNATNKRASELTIACFGLAFKPNIDDLRESPAMEIAAQIARWHSGTTQVVEPNIHALPKKLDGLCTLATLEAALASADVLVMLVDHNQFKAVSGDSVTQAFIVDTKGVWR

SEQ ID NO: 8005 - protein, 280 aa, Klebsiella pneumoniae
SRPACSCRPSRSARALKSPVWKRSAGVTAGWTTTASNVRRSGWKKPATANICWICSVPVRASIDPLEWENRFFAVNSAIVRFDEHAPRLTPEALAGWSRVQAKIAASDTVRLDALQRLGFQLVEGEVDLALPVGSPADAGADVAVEADIAPLREQAAQAFAMSRFRAPWYAADASGRFYAQWIENAVRGTFDHQCLIYRHPEGDIRAFVSLRQITATEARIGLLAGRGAGAQLMQAARYWAASRGLSTLRVATQMGNTAALKRYILSGANVESTAYWLYR

SEQ ID NO: 8006 - protein, 353 aa, Klebsiella pneumoniae
YVKAFILLASSHTDTYRKENIMRGKIALEEHVSTPENNRLWDSSGEAGRNGTEYMKDVERRLLDRSIQLEEMAQRHIDHVILSLTSPGAQSILDKAKAVSFARDTNDFIVENYVKPNPDKFSAFATLALQNPEAAAEELERAVKKLGMKGALINGYTNVKDSEHGLYLDDESMLVFWDKVNELNVPVYLHPREPLEGPARGIYTGYESLIGSAWGFAQETAVHAIRLMMSGLFDRYPNLNLVLGHLGEGLVHMLPRTQHRLYRQRFGCGLGKAEKPLMHYLQNNFIVTTSGHFNTHSLNNAIEVMGADRVMFSVDYPYEDIHQACDWFDPLELEAGLKEKIAWGNASRVFNIK

SEQ ID NO: 8007 - protein, 355 aa, Klebsiella pneumoniae
PSRAGDVMTQPLPGAQAVNVENELDIRGLFRALWAGKGWIVGGAVLFAAIVLVYTFFARQEWSATAITDRPTVNMLGGYYSQQQFLRNLDIKADLASVDQPSAMDEAYKEFIMQLASWDTRRDFWLQTDYYKQRQSGNARADAAMLDDLINNIQFMPGDAAKSINDSVKLTAETGQDANNLLRQYVAFASQRAAGHLNDELKGAWAARTVQMKAQVKRQEEVAEAIFNRRTHSVEQALKVAQQHNISRSETDVPADQLPDSELFLLGRPMLQARLENLQAVGPEYDLDYDQNRAMLSTLNVGPTLDPRFQTYRYLRTPEEPVKRDSPRRVFLMVMWGIVGALIGAGVALSRRRVL

SEQ ID NO: 8008 - protein, 286 aa, Klebsiella pneumoniae
SRRAQRRVIPPTARQGGWHMGAIMFDIGVNLTSSQFSRDHDEVVARALAAGVNGMLLTGTNLAESQQAQKLASRYSGCWSTAGVHPHDGSSWTPAVAEAIYTLAGEPQVVAIGECGLDFNRNFSTPHEQEVAFSAQLALAAELSMPVFLHCRDAHDRFLTLLKPWLEKLPGAVLHCFTGSRSEVQECLDLGLFIGITGWVCDERRGLELRELLPAIPAERLLLETDAPYLLPRDLKPKPASRRNEPAYLPHILASVAAWRGEEAQWLEAQTDANVRALFGVDINGV

SEQ ID NO: 8009 - protein, 449 aa, Klebsiella pneumoniae
RQLAIARRLAHHVQRAVANAAGRRIDYALKGRVVVAVGDKAQVRERVFDFLTLEEAHAAVDTIRHAGLQEGLFQHTRLGVTAIENGALLQRAAVLLPGFNSVHHKARFVEIVEGAVQRNRLAVGAVGPQLFAQAPVVVFNQGVGSAKNIAGRAIVLLQADGFRAGEVVKEALNVLDLRAAPSIDRLIVIADDHHLAGIARQQADPGVLNVVGILEFIDEDIGEALAVVLQDMRFVQPQLVGAQQQLGEVHQPGAVAGFLIGLIDLLPGLLDRIAVALNMMRAQPFIFLAVDVPHRLARRPLFLIEVHRLNQTLQQTQLVFAVEDLKVLRQVGIQMVRAQQTVRQAVEGAHPHAALGGAHQLADTVTHLRRRFVGKGHRHNGIRGTVLHAQQPGDTVHQNARLTTARPCQNQHIGARGRYGFTLFVIKAVEQVRNVHWHRRKRRGSTNPC

SEQ ID NO: 8010 - protein, 304 aa, Klebsiella pneumoniae
TAMAETATPHDAIFKTFLSRVETARDFIELHLPPSLTQICKLDTLRLESGSFLEDDLRPYYSDILYSLETTRGAGYVHVLIEHQSAPDKLMAFRLMRYAIAAMQRHLESGHKTLPLVIPILFYQGRRSPYPWSMRWLDNFADPETASQLYSGAFPLVDITVIPDDDIMQHRSMAALTLVQKHIRQRDMAQLLDKLTHLLMLEQMSGQQITVLVNYMAQAGDAEDTRTLLYGLAQRVPQHGGLLMTLAETWLAEGMEKGVQQGIKEGKHQALVQVAEAMRSRGIDDQAIMEMTGLSEDELQRLRH

SEQ ID NO: 8011 - protein, 562 aa, Klebsiella pneumoniae
HKILFLPIYDGELTMNGAQWVVHALRTQGVDTVFGYPGGAIMPVYDALYDGGVEHLLCRHEQGAAMAAIGYARATGKTGVCIATSGPGATNLITGLADALLDSIPIVAITGQVAAPFIGTDAFQEVDVLGLSLACTKHSFLVQSLDELPRVIAEAFQVANSGRPGPVLVDIPKDIQMAQGDLDPHFSTVADEMAFPQAEVAQALQMLAQSQQPMLYVGGGVGMAQAVPALREFLAVTRMPATCTLKGLGVVDADYPYYLGMLGMHGTKAANLAVQECDLLIAVGARFDDRVTGKLNTFAPHAKVIHMDIDPAELNKLRQAHIGLTGDLNCLLPALQQPLAIDGWRERSAALRAEHAWRYDHPGEAIYAPLLLKQLSDRKPADSVVTTDVGQHQMWSAQHMTYTRPENFITSSGLGTMGFGLPAAVGAQVARPNDTVICISGDGSFMMNVQELGTVKRKQLPLKIVLLDNQRLGMVRQWQQLFFQERYSETTLTDNPDFLTLASAFGIPGQHITRKDQVEAALDTMLSSQGPYLLHVSIDELENVWPLVPPGASNSEMLEKLS

SEQ ID NO: 8012 - protein, 427 aa, Klebsiella pneumoniae
LIFYHTMSKTHLTEQKFSDFALHPAVIEALEKKGFHNCTPIQALALPLTLEGRDVAGQAQTGTGKTMAFLTSTFHYLLSHPAIADRQVNQPRALIMAPTRELAVQIHADAEPLAQATGLKLGLAYGGDGYDKQLKVLESGVDILIGTTGRLIDYAKQNHINLGAIQVVVLDEADRMYDLGFIKDIRWLFRRMPPATQRLNMLFSATLSYRVRELAFEQMNNAEYVEVEPEQKTGHRIKEELFYPSNEEKMRLLQTLLEEEWPDRAIVFANTKHRCEDIWGHLAADGHRVGLLTGDVAQKKRLRILEEFTRGDLDILVATDVAARGLHIPAVTHVFNYDLPDDCEDYVHRIGRTGRAGASGHSISLACEEYALNLPAIETYIGHSIPVSKYNPDALMTDLPKPLRLTRARPGNGPRRNGPPRNRRRSG

SEQ ID NO: 8013 - protein, 307 aa, Klebsiella pneumoniae
HHSLWQWILPMDAKQTRLGIILALAAYFIWGIAPAYFKLIYYVPADEILTHRVIWSFFFMVALISVSRQWPQVKKLLKTPRKIFLLALSAVLVGGNWLLFIWAVNNHHMLEASLGYFINPLVNILLGMIFLGERFRRLQWLAVILAFCGVLVQLWTFGSLPIIGLGLAFSFAFYGLVRKKIAVDAQTGMLVETLWLLPVAAIWLFGITDSPTSHMGENPWSLNLLLMAAGVVTTIPLLCFTGAATRLRLSTLGFFQYIGPTLMFLLAVTFYGEVPGKDKMVTFGFIWVALAVFIVDALYTQRRLRRG

SEQ ID NO: 8014 - protein, 316 aa, Klebsiella pneumoniae
NNIQPGGRMREELDFKSLRFFSALYRLGNVSPAADALDISQPTGSLLLKKLRDHFADPLFVRVGQRMIPTPRADAIAPTISTLLQLADNDLAVKPEFLPQQSQRNFTIGMTDISQMTLLPLLQIALQQQAADGITFTVQNLDEQTLNALESGKCDLAIGYLTQLPESVYQQHLFDQSYVCLAAENHPRIRAQLRAEDWRQEKHLAIRVEGTAHGDMDKLLDEHHMPRRIALTLPSFLGTGELVAESDMIAVVPEQVARHITRRYPCRSWPLPFPLAKIAIRQVWHQRLHRDPGHIWLRSLIATLADPAQQSTSIKI

SEQ ID NO: 8015 - protein, 105 aa, Klebsiella pneumoniae
SVSHTNHPENDVMAKSAAALHILVKEEKLALEILAKLERGVSFDHLAKRYSKCPSGRNGGDLGEFQQGAMVGPFDQAVFSCPLLKPYGPVKTKFGYHIIKVLYRR

SEQ ID NO: 8016 - protein, 320 aa, Klebsiella pneumoniae
IVIHITLTSYIHHHRTKDSRFQALCFITARTKGKGSIVTDALINKGTENTMTTTKQPGFAPAASPHAATAVHTPEEHIIAGETSIPSQGENMPAYHARPKNADGPLPIVIVVQEIFGVHEHIRDLCRRLAQEGYLAIAPELYFRQGDPNEYHDIPTLFKELVSKVPDAQVLADLDHVASWAARHGGDAHRLLITGFCWGGRITWLYAAHNPQLKAAVAWYGKLVGEKSLNSPKHPVDIAVDLNAPVLGLYGAKDASIPQDTVETMRQALRAANATAEIVVYPEADHAFNADYRASYHEESAKDGWQRMLAWFAQYGGKKG

SEQ ID NO: 8017 - protein, 124 aa, Klebsiella pneumoniae
WLRHQHTRLIPVELNMSDKIIHLTDDSFDTDVLKADGLTLVDFWAEWCGPCKMIAPILDEIAEEYQGKLTVAKLNIDQNPGTAPKYGIRGIPTLLLFKNGEVAATKVGALSKGQLKEFLDANLA

SEQ ID NO: 8018 - protein, 164 aa, Klebsiella pneumoniae
VIMQAWYLLYCKRGQLQRAQEHLERQSVNCLMPTIALEKIIRGKRTMVSEPLFPNYLFIEFDPEVIHTTTISATRGVNNFVRFGALPAIVPSAVIHQLSIYKPEGITDPETPHEGDSVLITDGAFEGLEAIFTEPDGEARSMLLLNLLNKQVLQSVKNTDFQKI

SEQ ID NO: 8019 - protein, 389 aa, Klebsiella pneumoniae
RGKHRLLAIQVTPMIPFNAPPVVGTELDYMQSAMNSGKLCGDGGFTRRCQQWMEQRFGTAKALLTPSCTASLEMAALLLDIQPGDEVIMPSYTFVSTANAFVLRGAKIVFVDIRRDTMNIDETLIEAAITDKTRAIVPVHYAGVACEMDTIMAIADKYNLFVVEDAAQGVMSTYKGRALGTIGHIGCFSFHETKNYTAGGEGGATLINDRTLVERAEIIREKGTNRSQFFRGLVDKYTWRDIGSSYLMSDLQAAYLWAQLEAAERINQQRLALWQNYYDALLPLARAGRIELPTVPADCGQNAHMFYIKLRDIEDRSRLIAWLKEAEILAVFHYIPLHSCPAGEQFGEFRGEDRYTTQESERLVRLPLFYNLSVVNQRTVINSLLSYFS

SEQ ID NO: 8020 - protein, 246 aa, Klebsiella pneumoniae
RRCFALLTRQRGRMTTLSCKVTSVEAITDTVYRVRLVPEAAFSFRAGQYLMVVMDERDKRPFSMASTPAEQEFIELHIGASELNLYAMAVMDRILKEREIEVDIPHGEAWLRDDEDRPLILIAGGTGFSYVRSILLSALARNPDRDIAIYWGGREAKHLYDLAELEALSIKHPNLRIEPVVEQPEEGWRGRSGTVLTAVLQDYGTLAEHDIYIAGRFEMAKIARDLFCNERGAREDRLFGDAFAFI

SEQ ID NO: 8021 - protein, 297 aa, Klebsiella pneumoniae
TKIKTIFQETSMRISLACLVALCALPAGVMAQDASVHDKPAVRGSIIANLLQDHDNPFLLYPYESNYLLYTWTSDLNKEAIRSYDWAENARKDEVKFQLSLAFPLWRGILGDNSLLGASYTQKSWWQLSNSKESAPFRETNYEPQLFLGFATDYQFAGWTLRDIEMGYNHDSNGRSDPTSRSWNRLYARLMAQNGNWLVEVKPWYVVGNTDDNPDITKYMGYYRLKVGYQLGEAILSAQGQYNWNTGYGGAELGVSYPITKHVRAYTQIYSGYGESLIDYNFNQTRVGVGLMLNDLF

SEQ ID NO: 8022 - protein, 346 aa, Klebsiella pneumoniae
YTVKKRFSAVNRGVNPMFGQKKDWETRENAFAAFSMGPLTDFWRQREEAEFKGVDDVPVRFVRFCAQHNDRLVLICPGRIESYVKYAEVAYDLFHCGFDVMIIDHRGQGRSGRLLSDTHRGHVVNFSDYVDDLAALWQQQVVPGHWRKRFILAHSMGGAIATLFLQRYRAHCDAIALCAPMFGIIIRLPDWMVRHILDWAEGHQRIREEYAIGTGRWRALPFAVNVLTHSRQRYRRNLRFYADEPRLQVGGPTWHWVREGMLAGDEVLANVEKDTAPTLLLQAEEERVVDNLMHDRYCELRAAAGHPCEGGKPLVIEGAYHEILFEKDAMRSVALNAIVEFFNRHT

SEQ ID NO: 8023 - protein, 399 aa, Klebsiella pneumoniae
RMLKILLLFALLIAGIVLGPMIAGHQGYVLIQTDNYNIETSVTGLVIILILAMVVLFAIEWLLRRIFRTGAHTRGWFVGRKRRRARKQTEQALLKLAEGDYQQVEKLMAKNADHAEQPVVNYLLAAEAAQQRGDEARANQHLERATELAGDDLIPVEITRVRLQLVRNENHAARHGIDKLLEITPRHPEVLRLAEQAYTRTGAWQSLLDIIPSMAKANVGDEAHRAALEQLAWVGLMDKALADGGSEGLREWWRNQSRKTRALVPLQVAMAERLIESDDHDTAQQIIIDGLKKQYDDRLVMPIPRLKTNNPEQLEKVLRQQIKAVGDRPLLWSTLGQSLMRHGEWQEASIAFRAALKQRPDAFDYAWLADALDRLHQPEEAADMRRDGLLLTLQNNPQP

SEQ ID NO: 8024 - protein, 325 aa, Klebsiella pneumoniae
RLANKRPVVNLTLRYNACSLSNETTIVALLIITTILWAFSFSLIGEYLAGSVDSYFSVLMRVGLAALVFLPFLRTRGQSPRTIVLYMLVGAMQLGIMYLLAFRAYLYLTVSEFLLFTVFTPLYITLIYDLLSGRKLRWGYLLSAALAVLGAAIIRYDKVSDHFWTGLLLVQLSNLCFAIGMVGYKRLMEVRPMPQHNAFAWFYVGAFIVAVAAWFMLGNAQKLPTTTLQWSVLVWLGVVASGLGYFMWNYGATQVDAGTLGIMNNVHVPAGLLVNLAIWQEQPHWPSFISGALVILASLWVHRRWVAPHSGQTADDRRRGSAQSE

SEQ ID NO: 8025 - protein, 66 aa, Klebsiella pneumoniae
RKQNAYGLSIWRVSSGRSVSILCPAANRRWKALTITPKAMTKKKGRKPFFYAIIFCRWLSIRSIAR

SEQ ID NO: 8026 - protein, 179 aa, Klebsiella pneumoniae
LVFDIGFSELLLVFVIGLIVLGPQRLPVAVKTVVGWIRTLRSLATTVQNELAQELKLQEFQESLKKVEKASLNNLTPELKASMDELREAAESMKRSYSAHDPEKASDEANTILNPVVKGSEAQRQDVTPATAEHQASAPAHAPDPVADEQSASPADLQAEKTSATAAVPHSSPASSDKP

SEQ ID NO: 8027 - protein, 126 aa, Klebsiella pneumoniae
SVRLFMTQAYLRKIMSAALRRGGSQDGVYNASTQFIICHRGTCMGGISIWQLLIVVVIVVLLFGTKKLSSLGSDLGASIKGFKKAMSDDDKPEKSAPDADFTAKTIADKQDDAKKDETKRHDKEQV

SEQ ID NO: 8028 - protein, 126 aa, Klebsiella pneumoniae
DAGLVYGGCQPVRPARDAPRLSADGEVDRRYRRYAVCGLRHPPDYLALTGMLFPTRLFPGGKVSVAKPLQLVFRQTGHFHNRLVINTATAHRFGNLHQSLVFTFFYALLYAFLHTFCKPCFRQRHQ

SEQ ID NO: 8029 - protein, 91 aa, Klebsiella pneumoniae
NAGEIIMMQHQVALQARFNPETLERVLRVVRHRGFHICAMNMETAPDAQNINIELTVASPRPVELLFSQLSKLVDVACVEIQQPTSQQIRA

SEQ ID NO: 8030 - protein, 110 aa, Klebsiella pneumoniae
RVILWRPNLFQLTQGAIMAKTAAALHILVKEEKLALDLLEQLKNGADFGKLAKKHSICPSGKRGGDLGEFRQGQMVPAFDKVVFSCPELEPTGPLHTQFGYHIIKVLYRK

SEQ ID NO: 8031 - protein, 298 aa, Klebsiella pneumoniae
CVSLFTEKQLQSLLVLVTIITKCCQGLLYSTVLLLLIIRPTEEFFMSKSDVFHLGLTKNDLQGATLAIVPGDPERVEKIAALMDKPVKLASHREFTSWRAELDGKPVIVCSTGIGGPSTSIAVEELAQLGVRTFLRIGTTGAIQPHINVGDVLVTTGSVRLDGASLHFAPMEFPAVADFACTTALVEAAKSIGATTHIGVTASSDTFYPGQERYDTFSGRVVSRFKGSMEEWQAMGVMNYEMESATLLTMCASQGLRAGMVAGVIVNRTQQEIPNAETMKQTESHAVKIVVEAARRLL

SEQ ID NO: 8032 - protein, 338 aa, Klebsiella pneumoniae
NPICFCVPTELSDNFFALGVPVMLSAFQLENNRLTRLEADEIKHLASSVWVDLVEPDDDERSRVQTELGQNLATRPELEDIEASARFFEDEDGLHIHSFFFFEDADDHAGNSTVAFTIREGRLFTLRERELPAFRLYRMRVRNQTLVDGNAYELLLDLFETKIEQLADEIENIYSDLEKLSRVIMEGHQGDEYDEALSTLAELEDIGWKVRLCLMDTQRALNFLVRKARLPAGQLEQAREILRDIESLLPHNESLFQKVNFLMQAAMGFINIEQNRIIKIFSVVSVVFLPPTLVASSYGMNFEFMPELHWSFGYPGAIVFMMLAGLAPYLYFKRKNWL

SEQ ID NO: 8033 - protein, 204 aa, Klebsiella pneumoniae
YAVWSSASVHLAGALYPHFLARITGVLVKTLILFSTRDGQTREIASFLASELKELGIDAYTLNLTRTDVVEWHHYDRVVIGASIRYGHFHPAVDRFVKKHLAALQALPGAFFSVNLVARKPEKRTPQTNSYTRKFLLNSPWQPQSCAVFAGALRYPRYSWYDRFMIRLIMKMTGGETDTRKEVVYTDWQQVSRFAREIAQMARK

SEQ ID NO: 8034 - protein, 71 aa, Klebsiella pneumoniae
CPTCRPPICGRSWKRRSASTSSAWRCGRTTMMRCCRWRAPGVSNCRRFRPTAGKTRTCSTLSCAISRIAAD

SEQ ID NO: 8035 - protein, 502 aa, Klebsiella pneumoniae
LAACREVNNTSMKYHDLRDFLTLLEQQGELKRITLPVDPHLEITEIADRTLRAGGPALLFENPKGYTMPVLCNLFGTPRRVALGMGQEDVSSLREVGKLLAFLKEPEPPKGFRDLFDKLPQFKQVLNMPTKRLRGAPCQQKIIQGDDVDLNKIPIMTCWPEDAAPLITWGLTVTRGPHKERQNLGIYRQQLIGKNKLIMRWLSHRGGALDFQEWCAARPGERFPVSVALGADPATILGAVTPVPDTLSEYAFAGLLRGTKTEVVKCVSNDLEVPASAEIVLEGYIEAGEMAPEGPYGDHTGYYNEVDQFPVFTVTHITQREDAIYHSTYTGRPPDEPAVLGVALNEVFVPILQKQFPEIVDFYLPPEGCSYRLAVVTMKKQYAGHAKRVMMGVWSFLRQFMYTKFVIVCDDDVNARDWNDVIWAITTRMDPARDTVLVENTPIDYLDFASPVSGLGSKMGLDATNKWPGETQREWGRPIKKDPAVTARIDAIWDELAIFKQQ

SEQ ID NO: 8036 - protein, 416 aa, Klebsiella pneumoniae
TTSCAAYGISIPRLEADLREVTTRLESTQLHAEDKIRQMMNSEQRLSEQFENLANRIFEHSNRRVDEQNRQSLHGLLTPLREQLDGFRRQVQESFGQEARERHTLAHEIRNLQQLNAQMAQEALNLTKALKGDNKTQGNWGEVVLTRVLEASGLREGYEYQTQVSIETDNRSRMQPDVIVRLPQGKDVVIDAKMTLVAYERYFNAEDDYTREVALQEHLASVRNHIRLLGRKDYQQLPGLRSLDYVLMFIPVEPAFLLAIDRQPELISEALQNNIMLVSPTTLLVALRTIANLWRYEHQSRNAQKIAERAGRLYDKMRLFVDDMSAIGQSLDKAQESYRQAMKKLASGRGNLLAQAEAFRGLGVEVKRGINPDLVEQATAQDEQYRLEDEDNLPENDAFSPDSAETVRSREAAPPR

SEQ ID NO: 8037 - protein, 457 aa, Klebsiella pneumoniae
IRYRLLPAELSDGLAAGATVSGGGAGMTLMQFSGLLVVWLLSTLFIATATWFEFRRVRFNFNVFFSLLFLLTFFFGFPLTSILVFRFDVSVAPPEILLQTLLIAVCFYAVYYVTYKTRLRSASREVAHRPLFTMNRVETHLAWGILMGLALLCVGIFFAHNGFLLFKLNSYSQIFSAEVSGVALKRFFYFFIPAMLVVYFLRQDYKAWIFFLVSTVAFGLLTYAIVGGTRANIIIAFAIFLFIGIIRGWISLWMLAAAGVLGIVGMFWLALKRYGMNVSGDEAFYTFLYLTRDTFSPWENLALLLQNYDKIDFQGLAPMIRDFYVFIPSWMWHGRPTMVLNTANYFTWEVLNNHSGLAISPTLIGSLVVMGGVWFVPLGAVAVGLIIKWFDWLYELGNRESNRYKAAILHSFCFGAIFNMIVLAREGLDSFGSRVVFFTRDLWYLLAGGETAVLVPG

SEQ ID NO: 8038 - protein, 129 aa, Klebsiella pneumoniae
LILRAINSSAKESGACRMAESFTTTNRFFDNKNYPRGFSRHGDFTIKEAQLLERHGYAFNELELGKREPVTEDEKQFVSVCRGEREPVTEAERVWIKYMARIKRPKRFHTLSGGKPQMEGADDYTESDD

SEQ ID NO: 8039 - protein, 86 aa, Klebsiella pneumoniae
IRSRALYTPAVTPWEWVAKEVSSLTFREAAYHFVIHDWGEVLTKDPKGNPRVEYLLTLKNRLLNTYNKLFDEIKPLGILCGLELRG

SEQ ID NO: 8040 - protein, 97 aa, Klebsiella pneumoniae
VAERTGLEPATPCVTGRYSNRLNYRSTEFLRFITTGCHPGLLQFDAWQFPTLTWGDPTLPSALRRFTSEFGMGSGGTTALVPPGKFCFINTSYRRID

SEQ ID NO: 8041 - protein, 124 aa, Klebsiella pneumoniae
GAMRRYPGNTSLTEFHRLTGLLARRLLQQIPEGFAAAIADPLVAFEIEVIAALFGGQPHLVQRLLTVNNDFAAVFKADGQHAAVDFAVDVAIAVPVVQTFFDGHPQAIGQAMEFTVVHNLILLF

SEQ ID NO: 8042 - protein, 213 aa, Klebsiella pneumoniae
HHPRLDNTGAAQIRVFRRRRQMRTGVILHKASDIMHLQTQRMANPVRHKRPGQVILHHRLFAHVGNQLVFTQQLRDTLMELDMVINVTGTGLHGTNQRLLLIVNVFDQMGKVVIAVRRPGARQICGIAVIFRTGVEQETAHLRRGTMVQFGVVQDGGMLIQRDNIAVRHVGITMAGGGEIGLVDIEFAHSRLESFVGRTMTIHRRLLRFTHAG

SEQ ID NO: 8043 - protein, 60 aa, Klebsiella pneumoniae
ADWRRFRAACTIFASAARVSGQPRVFRPQSGLTHSRSTGIRCAAFFSSASIHSTLGTFGE

SEQ ID NO: 8044 - protein, 317 aa, Klebsiella pneumoniae
SNKLRLRTSNIVSKMRITCRKMTHFHPTLPRRCVAGRRLRHAETYGKCAESDTLSEHFLEKQAGIEMVEDSQETTHFGFQTVAKEQKADMVAHVFHSVAAKYDVMNDLMSFGIHRLWKRFTIDCSGVRRGQTVLDLAGGTGDLTAKFSRLVGETGRVMLADINDSMLKMGREKLRNIGIVGNVEYVQANAEALPFADNTFDCITISFGLRNVTDKEKALRSMYRVLKPGGRLLVLEFSKPIIEPLSKAYDAYSFHILPKVGELVAKDGDSYRYLAESIRMHPDQETLKGMMQDAGFENVDYYNLTAGIVALHRGYKF

SEQ ID NO: 8045 - protein, 70 aa, Klebsiella pneumoniae
LPGSAIGMTTRTPVMRPLRSSRTMSSPPQFFSAHGKIGTELSHDVLKPSSRTHFKWRTAIPLGTTSSPGM

SEQ ID NO: 8046 - protein, 78 aa, Klebsiella pneumoniae
KAERMNHGQLSMKNVFPTLAVLFAIFSLTGCGLKGPLYFPPADKTAPPPTKPVNPGIQSATPDRNDRGDTGGPSQVNY

SEQ ID NO: 8047 - protein, 572 aa, Klebsiella pneumoniae
TDASARLQPQLASAAFAHQQHRRCAIGKGGRGTRRYRTGHRVKRRFKRGQRLDGGFRADHLVIVKGLEYAIGIVAAGGDNLRFECAGLGCGPGTSVRARGELILHLAANTVQTRQHLRSQPHHPCRLCHVAAEARMEIDAMAHWHMAHVLDAANQADAGIAGHDHTGRIVQRLHGRTAQTVDRICWYRMRDLRQQRRVSGDVKTLLEGLLHATPVDIVYRACLKRRIARQQATHQVRGEVFRAHVAKCAALRTAHRGANCIDNDNLFHCDSLSRFQSANRTGWLYLGIIRFVMARFVTQTGWHFIQRAKVLVLLRHIEILRAADGVQPAECAAVERREAQAVYQRHIRFRRAGDNAFFQAADDFVNHGDHHAGDNLFIAEIALRLADVGQQAVDGSIFFFLRLTFAVVFIAPEAEAVLLAETVGVKQGVDGVAIIFLHPLREARRHDRLSMVRGIDADHVQQISRAHRPAKLFLHHFVDFAEVRPVAQQLAEAGEVGEQYPVDEEAGTIIHHDRRFAHFAGPGHHFGNGIIRGFFAADHFNQRHAMHRVKEVHTAEVFRALQNAGQLADGDR

SEQ ID NO: 8048 - protein, 307 aa, Klebsiella pneumoniae
TMKSMSSTSLYAAIDLGSNSFHMLVVREVAGSIQTLSRIKRKVRLAAGLNSDNTLSAEAMERGWQCLRLFAERLQDIPPTQIRVVATATLRLAVNAGEFLAKAQEILGTPVQVISGEEEARLIYQGVAHTTGGADQRLVVDIGGASTELVTGTGAQTTSLFSLSMGCVTWLERYFADRSLTKENFDLAEAAAREVLLPVADVLRYHGWKVCVGASGTVQALQEIMMAQGMDERITLAKLQQLKQRAIQCGRLEELEIEGLTLERALVFPSGLAILIAIFSELNIQCMTLAGRRVTRRPGVRHAASLR

SEQ ID NO: 8049 - protein, 562 aa, Klebsiella pneumoniae
ARAGRTGKTAGNAGGQMTPGELRRLYFIIHTFLSYGLDELIPKMRITLPLRIWRRMLFWMPNRHQDQPLGARLRLALQELGPVWIKFGQMLSTRRDLFPPHIADQLALLQDRVAPFEGKLAQQQIEKAMGGLPVETWFDDFSVEPLASASIAQVHTARLKENGKEVVIKVIRPDILPIIKADMKLIYRLARWVPRLLPDGRRLRPQEVVREYEKTLLDELNLLRESANAIQLRRNFEDSPMLYVPEVYPDYCSESMMVMERIYGIPVSDVEALEAQGTNMQLLAERGVQVFFTQVFRDSFFHADMHPGNIFVSYEHPEDPQYIGIDCGIVGSLNKEDKRYLAENFIAFFNRDYRKVAELHVDSGWVPPDTNVEEFEFAIRTVCEPIFEKPLAEISFGHVLLNLFNTARRFNMEVQPQLVLLQKTLLYVEGVGRQLYPQLDLWKTAKPFLESWIKDQVGIPALVRAFKDKAPFWIERMPEIPELVYQSLQQSKQLQTSVDTIVRDMHVRHVRQGQSRYLFGIGAVLLLSGTLLFIHRPEWGMMPGWLMAGGVVTWLIGWRKTH

SEQ ID NO: 8050 - protein, 521 aa, Klebsiella pneumoniae
IQAGWLIMADSQPLSGAPEGAEYLRAVLRAPVYEAVQKTPLQKMDKLSSRLDNVILVKREDRQPVHSFKLRGAYAMMSSLTAEQKSHGVITASAGNHAQGVAFSASRLGVKALIVMPVATADIKVDAVRGFGGEVLLHGANFDEAKARAIELAQQQGFTWVPPFDHPMVIAGQGTLALELLQQDAHIDRVFVPVGGGGLAAGVAVLIKQLMPQIKVIAVEAEDSACLKAALDAGHPVDLPRVGLFAEGVAVKRIGDETFRLCQEYLDDIITVDSDAICAAMKDLFEDVRAVAEPSGALALAGMKKYIAQHNIRGERLAHILSGANVNFHGLRYVSERCELGEQREALLAVTIPEEKGSFLKFCQLLGGRSVTEFNYRFADAKDACIFVGVRLSRGLEERKEILQLLNDGGYSVVDLSDDEMAKLHVRYMVGGRPSKALQERLFSFEFPESPGALLKFLHTLGTHWNISLFHYRSHGTDYGRVLAAFELGEHEPDFETRLNELGYECHDETHNPAFRFFLAG

SEQ ID NO: 8051 - protein, 60 aa, Klebsiella pneumoniae
SENGKSANLELRIHTFRGISLHLAENGRLIAKQSYVGKEGAEERGRREKTEFFSFLIFFI

SEQ ID NO: 8052 - protein, 104 aa, Klebsiella pneumoniae
ISLGISTSTGPGRPEFATWKASAITRGSSSRDCTRKLCLVQASDKPRTSTSWNASVPMKGAATWPVIATMGIESSRASARPVIRLVAPGPDVAIHTPVLPVARA

SEQ ID NO: 8053 - protein, 369 aa, Klebsiella pneumoniae
RHPGVYRRHQRSVAVRTILVTGGAGFIGSAVVREIIQHTADRVVVVDKLTYAGNLMSLAPVAQDARFAFEQVDICDRAELDRIFRQHQPDTVMHLAAESHVDRSIDGPAAFIETNIVGTYTLLEAARSWWNTLATAQKSAFRFHHISTDEVYGDLHGSDDFFTETTPYAPSSPYSASKASSDHLVRAWLRTYGLPTLITNCSNNYGPYHFPEKLIPLTILNALAGKPLPVYGNGQQIRDWLYVEDHARALYLVATRGEPGETYNIGGHNERKNIEVVETICQLLEELAPDKPQGVAHYRDLIAFVADRPGHDLRYAIDASKIARELGWTPAETFTSGMRKTVAWYLSNEAWWRQVQDGSYQGERLGLQS

SEQ ID NO: 8054 - protein, 184 aa, Klebsiella pneumoniae
PFAGFLRAGETCASARLWFQLITITGSTRNTANTRGYMTEKKAELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGFSEITAHRGLCAVLVPGDGAVDPGVNCRGTGGAGEPCGGPAIR

SEQ ID NO: 8055 - protein, 760 aa, Klebsiella pneumoniae
NKRGTKMTIINHTLGFPRVGLRRELKKAQESYWAGNATREELLAVGRELRARHWEQQKQAGVDLLPVGDFAWYDHVLTTSLLLGNVPARHQNKDGSIDIDTLFRIGRGRAPTGEPAAAAEMTKWFNTNYHYMVPEFVKGQQFKLSWTQLLDEVDEALALGHKIKPVLLGPVTYLWLGKVKGEPFDRLTLLNTILPVYQQVLAELAKRGIDWVQIDEPALVLELPPAWLEAFQPAYDALQGQVKLLLTTYFEGVSDNLATIAALPVQGLHVDLVHGKDDVAELHNRLPADWLLSAGLINGRNVWRADLTEKYAQIKDLVGKRELWVASSCSLLHSPIDLSVETRLDAEVKSWFAFALQKCGELALLRDALNSGDTAAITEWSAPIQARRHSTRVHNAEVEKRLAAITAQDSQRASPYEVRAQAQRQRFNLPKWPTTTIGSFPQTTEIRGLRLDFKKGNLDASHYRTGIAEHIKQAIVEQERLGLDVLVHGEAERNDMVEYFGEHLDGFIFTQNGWVQSYGSRCVKPPVVIGDVSRPQAITVDWAKYAQSLTDKPVKGMLTGPVTILCWSFPREDVSRETIAKQIALALRDEVADLEAAGIGIIQIDEPALREGLPLKRSDWDAYLQWGVEAFRLNAAVAKDDTQIHTHMCYCEFNDIMDSIAALDADVITIETSRSDMELLESFEAFEYPNEIGPGVYDIHSPNVPSVEWIEALLKKAAQRIPVERLWVNPDCGLKTRGWPETRAALANMVQAARNLRQSA

SEQ ID NO: 8056 - protein, 299 aa, Klebsiella pneumoniae
SSLGGMMKGIILAGGSGTRLHPITRGVSKQLLPIYDKPMIYYPLSVLMLAGIREILIITTPEDLRDFQRLLGDGSEFGIALHYAVQPTPDGLAQAFIIGEAFLNGEPACLVLGDNIFFGQSFSPKLRSVAARTEGATIFGYQVMDPERFGVVEFDDNFRALSLEEKPKQPKSNWAVTGLYFYDGKVTEYAKRVKPSERGELEITSINQMYLEDGALTVELLGRGFAWLDTGTHDSLIEASMFVQTVEKRQGFKIACLEEIGWRNGWLDDDGVKCAAKRLEKTGYGQYLLDLLRARPRQY

SEQ ID NO: 8057 - protein, 636 aa, Klebsiella pneumoniae
LKMGRHAPSHLINTDGSKKSMPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDKIIKLDLVDAMIQGADPKVSDEQSNQVERSACPTCGSCSGMFTANSMNCLTEALGLSQPGNGSLLATHADRKELFLNAGKRIVELTKRYYEQDDASALPRNIASKAAFENAMTLDIAMGGSTNTVLHLLAAAQEAEIDFTMSDIDKLSRKVPQLCKVAPSTQKYHMEDVHRAGGVLGILGELDRAGLLNREVKNVLGLTLPQTLEQYDVMVTQDDAVKKMFRAGPAGIRTTQAFSQDCRWDTLDDDRAEGCIRSLEHAYSKDGGLAVLYGNFAENGCIVKTAGVDDSILKFTGPAKVYESQDDAVEAILGGKVVEGDVVVIRYEGPKGGPGMQEMLYPTSFLKSMGLGKACALITDGRFSGGTSGLSIGHVSPEAASGGNIALIEDGDMIAIDIPNRSIQLQLSDAEIAARREAQEARGDQAWTPKNRQRQVSFALRAYASLATSADKGAVRDKSKLGG

SEQ ID NO: 8058 - protein, 129 aa, Klebsiella pneumoniae
YPPGPPPALELTPAPAARPDSLPTRSKHSKPPRRSGSRQSARRRYPPHRESLSSAPAGNSPRRSPSAPAPPGVPAPDSAYGRTAPGLSAPPPVKIPAPAGWKSQAPSPTRCPPPASGAGDRRDAAPPAS

SEQ ID NO: 8059 - protein, 216 aa, Klebsiella pneumoniae
PSRGGALREGLVYGMLHLSVEQDIRSRTLRNIQRRFMIDTEQAQRVGGLASHLLSQLDGSWELDPLSRDLLLSACALHEIGLSVDFKRAPQHAAYLVNNLDLPGFTPAQKKLIATLLLNQTNAIDLSSLHQQNAVPPRVAEHLCRLLRLAILFASRRRDDLLPAIQLTAQDEQLTLILPGNWLDEHPLGREMVDQECQWQSYVHWILRVASGDTLK

SEQ ID NO: 8060 - protein, 241 aa, Klebsiella pneumoniae
IMAIGIFVCSGSLLVGALAGASLNRFIPEHFKKTLPLIAGLISISMGIFFVNKLHNLPPIALAIIVGTIIGGLLNIEKWIERAGTTLRSPIERIFPAQSSASVGAEDFMNQFIAVLILFCASGTGIFGALTEGMTGDPTILLTKSILDFFTAAIFASTLGYIITVIFIPQLIVFVILFFAATFIMALINPSMIADFTACGGIIMLATGFRLCGIRAFPTANMLPSLILVMPFSAAWQQFIA

SEQ ID NO: 8061 - protein, 327 aa, Klebsiella pneumoniae
TYYMTGILLRKLIYSQRHVAFYEIQNRGVRAVDLRDLKTFLHLAESRHFGRSARAMHVSPSTLSRQIQRLEEDLGQPLFVRDNRTVTLTEAGEELRTFAQQTLLQYQQLRHVIDQQGPSLSGELHIFCSVTAAYSHLPPILDRFRAAHPSVEIKLSTGDAADAMEKVVTGEADLAIAGKPETLPGSVAFSMLENLAVVLIAPALPCPVRNQVTVERPDWSTVPFIMADQGPVRRRIELWFRRHKISNPSIYATVGGHEAMVSMVALGCGVALLPEVVLENSPEPVRNRVMILERSDEQTPFELGVCAQKKRLHEPLIDAFWKILPNH

SEQ ID NO: 8062 - protein, 320 aa, Klebsiella pneumoniae
RTFMIEIKHLKTLQALRNSGSLAGAAAALHQTQSALSHQFSDLEQRLGFRLFVRKSQPLRFTPQGEILLQLANQVLPQIARALQDCNEPQQTRLRLAIECHSCIQWLTPALENFRARWPHVEVDFHSGVTFDPQPALQQGELDLVMTSDILPRSGLHYSPMFDFEVRLVLAPEHPLAMKTLVTPEDLAAETLLIYPVQRGRLDIWRHFLQPAGISPQLKSVDNTLLLIQMVAARMGIAALPHWVVESFERQGLVVTKTLGEGLWSRLYAAVRDGEQRQPVTEAFIRSARNHACDHLPFVRSAERPSGDGPTARPGSPTLR

SEQ ID NO: 8063 - protein, 262 aa, Klebsiella pneumoniae
TVNMGVDDTQPLISHLIELRKRLLNSIIAILVIFLALVYFANDIYQLVSAPLISKMPVGATMIATDVASPFFTPIKLTFMVSVILSVPIILYQVWAFVAPALYKHERRLVVPLLVSSTLLFYIGMAFAYFVVFPLAFGFLTHAAPEGVLVSTDIRSYLDFVMALFMAFGVSFEVPVAIVLLCWMGVTTPEDLRKKRPYVLVGAFVVGMLLTPPDVFSQTLLAIPMYCLFEVGVFFARFYTGKRLTRDDDAAAEAEAAEHREE

SEQ ID NO: 8064 - protein, 321 aa, Klebsiella pneumoniae
WSIMTVTSMLDKVLKIATRQSPLALWQAQYVKARLEQAHPGLKVELVPMVTRGDVILDTPLAKVGGKGLFVKELELAMLEGRADIAVHSMKDVPVEFPEGLGLVTICERDDPRDAFVSNRYASIDELPAGSVVGTSSLRRQCQLAATRPDLAIRSLRGNVGTRLSKLDNGEYDAIILAAAGLKRLQLEARIRQPLSPEQSLPAVGQGAVGIECRLDDAWTRGLLAPLNHTETAVRVRAERAMNTRLEGGCQVPIGSYAELKDGELWLRALVGAPDGSQLVRGERRGPAEQAEALGISLAEELLDNGAREILAAVYDGEAPR

SEQ ID NO: 8065 - protein, 390 aa, Klebsiella pneumoniae
GVTMEQVVIVDAIRTPMGRSKGGAFRHVRAEDLSAHLMRSLLSRNPSLEASAIDDIYWGCVQQTLEQGFNIARNAALLAEIPHSVPANTVNRLCGSSMQALHDATRMIMTGDASVCLIGGVEHMGHVPMSHGVDFHPGLSRNVAKAAGMMGLTAEMLARLHGISREMQDQFAARSHARAWAATQSGAFKAEIIPTGGHDADGVLKSFNYDEVIRPETTVETLSTLKPAFDPVTGTVTAGTSSALSDGAAAMLLMSESRARELGLKPRARVRSMAVVGCDPSIMGYGPVPASKLALKKAGLSTSDIDVFEMNEAFAAQILPCIKDLGLMEQIDEKINLNGGAIALGHPLGCSGARISTTLINQMERKDAQFGLATMCIGLGQGIATVFERV

SEQ ID NO: 8066 - protein, 214 aa, Klebsiella pneumoniae
KQTIREFLMTIEWWFAYLLTSIILSLSPGSGAINTMTTSINHGYRGAAASIAGLQTGLAIHIVLVGVGLGTLFSRSVLAFEVLKWAGAAYLIWLGIQQWRAAGAIDLNTLAKAQTRGKLFQRAVFVNLTNPKSIVFLAALFPQFILPHQPQVMQYIVLGVTTIVVDIIVMIGYATLAQRISAWIKGPKQMKALNKVFGSLFMLVGALLASARHA

SEQ ID NO: 8067 - protein, 168 aa, Klebsiella pneumoniae
KHKINILLTNGTGVMSELTAEAALKLVGEIFVYHMPFNRALGLELERYEKAFAQLSFNNQPMMVGNWAQSILHGGVIASALDVAAGLVCVGSTLTRHDTINEEELRQRLSRMGTIDLRVDYLRPGRGERFTATSTLLRAGNKVAVARVELHNEAQVYIASATATYMVG

SEQ ID NO: 8068 - protein, 242 aa, Klebsiella pneumoniae
TGEIMRFYRPLGQISALTFDLDDTLYDNRPVIDRTMHESLAFVRSYHPSLSQFDAHELNQLRQTLLAAEPEIYHDVTVWRHRALELGMRNAGLSAEAAKAGADAAMEHFAHWRSRVDVPQETHDTLAKLAEKWPLVAITNGNARPELFGLSDYFRFVLRAGPDGRSKPFADMYHLAAERLNVPLGQILHVGDDLTTDVAGAIRCGMQACWIKPQGADLMHTADSRLLPHIEISRLASLTSLI

SEQ ID NO: 8069 - protein, 381 aa, Klebsiella pneumoniae
SKRIDVKVLTVFGTRPEAIKMAPLVHALAKDPHFEAKVCVTAQHREMLDQVLKLFSIVPDYDLNIMKPGQGLTEITCRILEGLKPVLESFKPDVVLVHGDTTTTMAASLAAFYQRIPVGHVEAGLRTGDLSSPWPEEGNRTLTGHLATYHFAPTETSRQNLLRENIADSRITVTGNTVIDALFWVRDRVLGDEALRETLLQRYPFISHGKKMILVTGHRRESFGLGFEQICQALAEIAHTHPEVQIVYPVHLNPNVSEPVNRILGHIDNVMLIEPQDYLPFVWLMDRAWLILTDSGGIQEEAPSLGKPVLVMRDMTERPEAVAAGTVCLVGTDSQRIVAEVTRLLEDDAAYQAMSRAHNPYGDGEACRRILSALKNNQVTL

SEQ ID NO: 8070 - protein, 70 aa, Klebsiella pneumoniae
RQSMRLLTSPPSSPLKVLYNPKAFFTHAAWLHQACAHCAIFPTAASRRSLDRVSVPVWLVILSDQLGIVA

SEQ ID NO: 8071 - protein, 530 aa, Klebsiella pneumoniae
IDHVLNHLSVRCSSQPHRRRMVTVFVEILKSSVLLYLGFLNIRRYVLYLYIETLKQRLDAINQLRVDRALAAMGPAFQQVYSLLPTLLHYHHPLMPGYLDGNVPRGICLYTPDETQRHYLEELELHRGMQTQEPPKGELPITGVYSMGSTSSVGQSCSSDLDIWVCHQAWLDSEERQLLQRKCSLLESWAASLGVEVSFFLIDENRFRHNESGSLGGEDCGSTQHILLLDEFYRTAVRLAGKRILWNMVPCDEEEHYDDYVMGLYAQGVLTPNEWLDLGGLSSLSAEEYFGASLWQLYKSIDSPYKAVLKTLLLEAYSWEYPNNRLLAKDIKQRLHDGEIVSFGLDPYCMMLERVTTYLQAIEDETRLDLVRRCFYLKVCEKLSRERACVGWRREVVSQLVNAWGWDEKRLMMLDNRANWKIDEVRKAHNELLDAMMQSYRNLIRFARRNNLSVSASPQDIGVLTRKLYAAFEALPGKVTLVNPQISPDLSEPNLTFIHVPPGRANRTGWYLYNRAPDMESIISHQPAGI

SEQ ID NO: 8072 - protein, 93 aa, Klebsiella pneumoniae
RDHVYLFGPERGRQRLNVMPVIYRQIEPQLRFIHTVHQQPAVRHLSHRHPGFELRIDLERVRMVIKEDVNQLAGVNQQSIHLKTGQDVAGTFL

SEQ ID NO: 8073 - protein, 130 aa, Klebsiella pneumoniae
FNSFPVRPDPPAFLFCVASRRKFLLNWTFVQHNSILCHQVIAGGVVDLSIIISAVIALAAGLMVGWLATKARADQIRADLIEERRELDIELSAARQQLAHDAHWREECELLNNELRSLRDINTSPRGRSP

SEQ ID NO: 8074 - protein, 400 aa, Klebsiella pneumoniae
LSTLEAIMTEQQNQSAVVEETREAVETTPQPENTEKKKAGNKTSLALSAIAIAIAIAAGIGLYGLNKQQATRQNATTSELASQVAALQKAQENQKSELEGVIKQQADQLNEAKHQQETLAKQLDELQQKVAVISGSDAKTWLLAQADFLVKLAGRKLWSDQDVTTAAALLKSADASLADMNDPSLIGARRAITDDIATLSAVSQVDYDGMILKVNQLANQIDNLRLADNNDDDSPMDADSDELSSSISEWRVNLQKSWQNFMDSFITVRRRDETAVPLLAPNQDIYLRENIRSRLMVAAQAVPRHQEETWKQSLDNVSTWVRAYYDTDDATTKAFLDEVDKLSQQSITMTVPETLQSQALLEKLMQTRVRNLMAQPAVTAGGAPSPAPAAPAVPAAPQGE

SEQ ID NO: 8075 - protein, 619 aa, Klebsiella pneumoniae
RLFSFQANGVNVAQAEVLNQESLAKQVLQETFGYQQFRPGQETIIETALEGRDCLVVMPTGGGKSLCYQVPALVMGGLTVVVSPLISLMKDQVDQLLANGVAAACLNSTQSREQQQEVMAGCRSGQVRLLYIAPERLMLDNFLEHLANWNLAMLAVDEAHCISQWGHDFRPEYAALGQLRQRMPQIPFMALTATADDTTRRDIVRLLGLNDPLIQVSSFDRPNIRYMLMEKFKPLDQLMRYVQDQRGKSGIIYCNSRSKVEDTAARLQSRGISAAAYHAGLENDVRAEVQEKFQRDDLQIVVATVAFGMGINKPNVRFVVHFDIPRNIESYYQETGRAGRDGLPAEAMLFYDPADMAWLRRCLEEKPAGPLQDIERHKLNAMGAFAEAQTCRRLVLLNYFGEGRQEPCGNCDICLDPPKQYDGLMDARKALSTIYRVNQRFGMGYVVEVLRGANNQRIREMGHDKLPVYGIGREQSHEHWVSVIRQLIHLGLVTQNIAQHSALQLTEAARPVLRGEVPLQLAVPRIVALKPKAMQKSFGGNYDRKLFAKLRKLRKAIADEENIPPYVVFNDATLIEMAEQSPLTAGEMLSVNGVGTRKLERFGKPFMALIRAHVDGDDE

SEQ ID NO: 8076 - protein, 217 aa, Klebsiella pneumoniae
FLSSLFSCELTMLMLFLTVALVHIIALMSPGPDFFFVSQTAISRSRREAMMGVLGITCGVMVWAGVALLGLNLILARMAWLHNIIMVGGGLYLCWMGYQMLRGALKKETVASAEPQVELARSGRSFVKGLLTNLANPKAIIYFGSVFSLFVGDSVGAGARWGIFLLIIVETLAWFMVVASLFALPGMRRGYQRMAKWIDGIAGTLFAGFGIHLIISR

SEQ ID NO: 8077 - protein, 240 aa, Klebsiella pneumoniae
WIYSFMKPIGEEQQEVASALNDRAVVDYLLQHPEFFIRNAAQVEHLRVPHPVRGTISLVEWHMMRARNHIHVLEENMSLLMEQAVANESLFQRLLQLQTRLAAAESLDDMLNRLHRWARELGLAGATVRLFPDCWRLGAPSKFTHLALNRQAFEPIRIQRLGQARHYLGPLNGPELLVVLPEAKAIGSVAISLLGGDNAPGVMLFSSRDAQHYQPGQGTQLLQEIAQMLPGLLERWIERA

SEQ ID NO: 8078 - protein, 223 aa, Klebsiella pneumoniae
RGDSRKQYRKYDARSEAGLMESWLIPAAPVTVVEEIKKSRFITLLAHTDGVAAAKAFVESVRTDHPDARHHCVAWVAGPPDDSQQLGFSDDGEPAGTAGKPMLAQLMGSGVGEITAVVVRYYGGILLGTGGLVKAYGGGVHQALAQLTTLRKTPLTAYTLQCEYGQLAGVEALLAQFSGNVVESEYLASVRLRVALPQAEVAAFSARLADFSRGSLQLLKINE

SEQ ID NO: 8079 - protein, 90 aa, Klebsiella pneumoniae
RPGSPARFGSRPESADKVRHLPPPYNSPPFPSAPLSPRRRQRRGSRWGDNGSLRPPPEPARRYRPSAPARFWRQYPAPVLSGCGCPRPGE

SEQ ID NO: 8080 - protein, 118 aa, Klebsiella pneumoniae
SPTSRSDSRRTPSSLRPKKVCTKLFFGRRSISSGAPCWTTSPPSISTRWSARRSASSISWVTSTIVRPSRRWMRSISCCSASRVTGSRAPKGSSINSTSGSAASARATPTRCCWPPES

SEQ ID NO: 8081 - protein, 96 aa, Klebsiella pneumoniae
RACSTAARIATARSSVRVPTLINSASAIAANCAASRGSITIAGEAPTASRTLAVKVCTTSLVMQCTRGEWARSRWRRCATGAGFNSSGIVCSRQTR

SEQ ID NO: 8082 - protein, 747 aa, Klebsiella pneumoniae
ISSSPATIAPRTTGVVPSWILLIVFTPWLSSTCWIILPSSAPSVSIFEPTFTGSAACSGKLIRAASASAPDHVVAIFIPLPSVLLRFAYRSLREKRSPFASDAKKKRPINRPLKRDVGLKSDALQQLKLALLHAGGVHADKDIEFARLSNVFHLLIPELQRVDVDWEANGLRFARFEGDLFKAAQHFHRPAHGGGDVLQVELDHRRPFAIAGVGHLHAGGHAAIARHGGRRHVDIGDAKGGVAQAVTKRIQRAIGFIEVTRGVLVRLLRIIRPAGIQVAVVGWDLPHRARERHRQLARRVVVAKQHVGDGVAAFGASKPGLQQRIGLLILFHQRQRTPVHQHQHQRFAGGFKSGNQIALALRQSDIGPAGGLMRHALRLAHHGDHHIGLLRRRDRFVDHFLRRAWVNLHRVLIQIEEIDNAFVIGNVRPFGVNHFAVIAQRFFDAGQDGHRLVGHPGRGPAAHHVALAVRQRAHHRDSAGFFQRQRIKTVLQQHQALASHFARLFTMQTTFRIGVLRVRIFRSQVAVGIVEQSHIIFHVEHVSGGIIQLGHGHLAGLHQPRQVLAVILVAHAHVDAGLQRYAHRVFRVGGHAVLNQLFDGAVVGNGDAFKAPLVAQDVFQQPGIRGRRGAVQRVQGHHHRAAAGIKPGFVRRHIVVEQALRAHVDRVVLFPALYRAVGGEMLDAGHHRIAVRRALALHRLHHRLAHHRGQIGVFPEPFGSASPARVAGDVDHRRPGHVQPVIGGFIS

SEQ ID NO: 8083 - protein, 323 aa, Klebsiella pneumoniae
INLSPDKLGLLCRTTVANPMMNEPWQRLPALSLKQLQYFVTLAQLRHFTDTASRLAISQPALSSALRQIETVLGGKLVNRTAATVTLTELGAAILPHAQRILSVAQAAFSDMQQIVEAGGDGTVRIGLVPSVSSLLFPLLPQTLAEAFPRLRIEFHDQTNDALIQALQRGEIDFGIGAIDSSLPAELLVYPLREDPFVAVLHRDDPLAAQAHLPWKQLVGRDIAVFSKGNIQRLVAALVESHRLTLTTRYQVDYIETLYGLVRSRLAVAILPALYTTHLQDPALRVAHLQQPALARTVALMRGPQALPPLIEDCFSLLQAALR

SEQ ID NO: 8084 - protein, 253 aa, Klebsiella pneumoniae
TTLSIQGMNMSQNIYDDPQFFAGYATLDRSVKGLEGAPEWPSLQAMLPPITGLRVVDLGCGYGWFCRWAQQQGASQITGFDISQRMLAQAREMTRGDEIVYRYADLQTLTLPANSCDLVYSSLALHYLPDIAPLFATLQQALVPGGTLVFSAEHPIYTAPLQQGWRVDEQGQKSWPVSHYQQEGERVSNWFAEGVIKQHRKLSSWINALIAAGFVLEQLDEWGPSAEQIVQQPALDEEKERPMIFLLRARKPG

SEQ ID NO: 8085 - protein, 381 aa, Klebsiella pneumoniae
RGLSTLSNVIPGGIMNLRQQQQQAFDRSGEPLIVGNVSHCPLPPETLAALGPDSPYVVQVYGSGLTGEVYRLRIAGKEYNLKKRRAVAGVANLNGQLSFLNEVQRRQALQQLKDDPVTAPRFTHIVPTLYADYRLGILLSPWIDGEPIHQLTPPLIAQLFTTLEACEEQGLMEWDLCSGNLLVDRQEQLWLFDFGYMYPFDPLREFNSNGLADPLFHFVERFETRFFFSWLMTRIPDAEQQLAHYREMKRLAVESYRRKLVWLRARRADPLVLAHFQQLTARWESALGDSAALSRLFAVEAFRSHVLDIEDDLHGQSCTLLTLQRIDWVINQLEQHYRFIADEGGLFYDNEGKSQQALLSSYAQKRQQAQQYLLNAAAAKD

SEQ ID NO: 8086 - protein, 256 aa, Klebsiella pneumoniae
IKISICRDLVMHPVINFSHVTKEYPLYHHIGSGIKDLIFHPKRAFQLLKGRKYLAIEDVSFTVGKGEAVALIGRNGAGKSTSLGLVAGVIKPTKGTVTTEGRVASMLELGGGFHPELTGRENIYLNATLLGLRRKEVQQRMERIIEFSELGEFIDEPIRVYSSGMLAKLGFSVISQVEPDILIIDEVLAVGDIAFQAKCIQTIRDFKKRGVTILFVSHNMSDVEKICDRVIWIENHRLREVGSADQIIELYKQAMA

SEQ ID NO: 8087 - protein, 344 aa, Klebsiella pneumoniae
NGISTPRRKNMKFLVTGAAGFIGFHIAQRLLNEGHDVVGIDNMNDYYDVSLKQARLDRLASLAFHFQQLDLADREGMAKLFATEQFDRVIHLAAQAGVRYSLENPYAYADANLMGYLNILEGCRHTKVKHLVYASSSSVYGLNRKMPFSTEDSVDHPVSLYAATKKANELMAHTYSHLYGIPTTGLRFFTVYGPWGRPDMALFKFTKAMLEGKSIDVYNYGKMKRDFTYIDDIVEAVVRVQDVIPQANADWTVESGSPATSSAPYRVYNIGNSSPVELMDYITALEEALGMEAKKNMMPIQPGDVLDTSADTQALYDLVGFKPQTSVKEGVKNFVEWYKDYYQI

SEQ ID NO: 8088 - protein, 626 aa, Klebsiella pneumoniae
IYSSGQTFAVPLEYPHYPCAGVVMSSNAQVRRRAVQAARGESPFDLLLIDAQIVDMATGEIRPADVGIVGEMIASVHPRGSREDAHEVRSLAGGYLSPGLMDTHVHLESSHLPPERYAEIVLTQGTTAVFWDPHELANVLGVAGVRYAVDASRHLPLQVMVAAPSSVPSTPGLEMSGADFAGAEMETMLGWPEVRGVAEVMDMHGVLHGSERMQEIVQAGLNSGKLIEGHARGLSGADLQAYLAAGVTSDHELTSADDALEKLRAGLTIEIRGSHPYLLPDIVAALKTLPHLSSQITVCTDDVPPDILLEKGGIIALLNLLIEHGLPAVDALRFATLNAAIRLQRHDLGLIAAGRRADLVVFDSLEKLVAREVYIGGKLMARAGNLLTPIAPAAGVTPPRDTLQIAPLRADDFILRVQGIRHGIARLRHIRGARFTQWGEVEVQVRDGKVQLPAGFSLIWVKHRHGRHQATPQIALLEGWGELRGAIATSYSHDSHNLVVLGRDANDMALAANQLIASGGGMALAQQGEILAHVAMPIAGMLSDLPAAELARQFRELRDLSSQVADWEPPYRVFKAIEGTCLACNAGPHLTDLGLTDGGSRQIVDPLIACREIPEPTDHNNNPQGA

SEQ ID NO: 8089 - protein, 453 aa, Klebsiella pneumoniae
PPPSRWWVPVCKSMKTIAITWLVRRLPARKIFHVCWGGKAPSNNSPHHKENIMTLPKIKHVRAWFIGGATAEQGAGGGDYHDQGANHWIDDHIATPMSKYKQYEQSRQSFGINVLGTLIVEVEADNGQTGFAVSTAGEMGCFIVEKHLNRFIEGKCVSDIKLIHDQMLNATLYYAGSGGLVMNTISCVDLALWDLFGKVVGLPVYKLLGGAVRDEIQFYATGARPDLAQEMGFIGGKMPTHWGPHDGDAGIRKDVAMVADMREKCGPDFWLMLDCWMSQDVNYATKLAHACAPYNLKWIEECLPPQQYEGYRELKRQAPAGMMVTSGEHHGTLQSFRTLSETGIDIMQPDVGWCGGLTTLVEIAAIAKARGQLVVPHGSSVYSHHAVITFTNTPFSEFLMTSPDCATLRPQFDPILLGEPVPERGRIHKSVLDKPGFGVELNRDCNLKRPYQH

SEQ ID NO: 8090 - protein, 353 aa, Klebsiella pneumoniae
CNKSRLHFLTIMTLHNKTGDSMNKKVFTLSAVMAGLLFGAAAHAADTRIGVTIYKYDDNFMSVVRKAIEKDGKSAPDVQLLMNDSQNDQSKQNDQIDVLLAKGVKALAINLVDPAAAGTVIEKARGQNIPVVFFNKEPSRKALDSYDKAYYVGTDSKESGIIQGDLIAKHWKANPNWDLNKDGQIQYVLLKGEPGHPDAEARTTYVIKELNDKGLKTQQLQLDTAMWDTAQAKDKMDAWLSGPNANKIEVVIANNDAMAMGAVEALKAHNKSSIPVFGVDALPEALALVKSGAMAGTVLNDANNQAKATFELAKNLADGKDAAAGTNWKIDNKIVRVPYVGVDKDNLSQFTGK

SEQ ID NO: 8091 - protein, 240 aa, Klebsiella pneumoniae
TRGLVKPASRNTGVKRPRRQPLRRIRNNRRQDYSAWRFCITLHAGECFSGRFRSAAMPAEAPLLDSDLEIREALPDDAHAIAALYVWHVLNGRASFEEIPPTVDEMRKRIQTVRDNGLPWLVALWRGAIVGYCYATFYRPRPAYRYTLEESIYVESGMGGRGIGSALLSRLIAECEKGPWRQMLAIIGDGHNNAGSLAIHKKFGFTVAGQLRSVGYKMGDWRDTLIMQRALGDGDWTLPE

SEQ ID NO: 8092 - protein, 529 aa, Klebsiella pneumoniae
IYRSAVLFTELRVSYQGLIARKYDTAEEVACRYPSDDRANRLPYRSHATTDNEQTMQDSVNQPGFLFHDYETFGTSPSLDRPAQFAAIRTDAELNVLGEPEVFYCKPADDYLPQPQAVMITGITPQEALAKGDDEATFARRIHDLFTVPQTCIVGYNNVRFDDEVTRNIFYRNFYDPYAWSWQHDNSRWDLLDVMRACYALRPEGIAWPENDEGLPSFRLEHLTVANGIEHQNAHDAMADVYATIAMAKLVKTRQPRLFDYLYSHRNKRKLATLIDVPQMKPLVHVSGMFGAARGNTSLVAPLAWHPENRNAVIMVDLAGDMAPLLELDADALRERLYTPRAELGDLPAAPIKLVHLNKCPVLAQANTLRPQDADRLGISIQRCLENAQLLRANPQVREKVVAVYAEAEPFVPSENVDAQLYNGFFSDADRAAMKIVLETEPRNLPALDITFADKRIERLLFNYRARNFPGTLDEHEQQRWLEHRRQVFTPEFLQAYADELQMLYQQYADDKEKLAQLKALWQYAQDIV

SEQ ID NO: 8093 - protein, 1025 aa, Klebsiella pneumoniae
VKFFALFIYRPVATILISLAITLCGILGFRLLPVAPLPQVDFPVIMVSASLPGASPETMASSVATPLERSLGRIAGVNEMTSSSSLGSTRIILEFNFDRDINGAARDVQAAINAAQSLLPSGMPNRPTYRKANPSDAPIMILTLTSDTYSQGELYDFASTQLAQTIAQIDGVGDVDVGGSSLPAVRVDLNPQALFNQGVSLDAVRTAISDANVRKPQGALEDSAHRWQVQTNDELKTAADYQPLIVHYQNGAAVRLGDVATVSDSVQDVRNAGMTNAKPAILLMIRKLPEANIIQTVDSIRARLPELQQTIPAAIDLQIAQDRSPTIRASLEEVEQTLVISVALVILVVFLFLRSGRATLIPAVAVPVSLIGTFAAMYLCGFSLNNLSLMALTIATGFVVDDAIVVLENISRHLEAGMKPLQAALQGSREVGFTVLSMSLSLVAVFLPLLLMGGLPGRLLREFAVTLSVAIGISLAVSLTLTPMMCGWLLKSGKPHQPTRNRGFGRLLVAVQGGYGKSLKWVLKHSRLTGLVVLGTIALSVWLYISIPKTFFPEQDTGVLMGGIQADQSISFQAMRGKLQDFMKIIREDPAVDNVTGFTGGSRVNSGMMFITLKPRDQRHETAQQVIDRLRKKLANEPGANLFLMAVQDIRVGGRQSNASYQYTLLSDDLSALREWEPKIRKALAALPELADVNSDQQDNGAEMDLVYDRDTMSRLGISVQDANNLLNNAFGQRQISTIYQPLNQYKVVMEVDPAYTQDVSALDKMFVINSDGKPIPLAYFAKWQPANAPLSVNHQGLSAASTISFNLPTGRSLSEASEAIDRAMTQLGVPSSVRGSFAGTAQVFQQTMNAQVILILAAIATVYIVLGVLYESYVHPLTILSTLPSAGVGALLALEIFDAPFSLIALIGIMLLIGIVKKNAIMMVDFALEAQRNGNLTPEEAIFQACLLRFRPIMMTTLAALFGALPLVLSGGDGSELRQPLGITIVGGLVMSQLLTLYTTPVVYLFFDRLRLRFSRHSSQPVSE

SEQ ID NO: 8094 - protein, 268 aa, Klebsiella pneumoniae
LATSAIACSSAGARSRANRRSTTAPGASGSCHGGISLNRSSITPPHVGPRAPAAALFAPFPSDNRTGRHLHAPPGGREQSPPANSPRRRRPRLLPPAAGQYALPPGGSCGSRPPGSAAAPARPAAETQCPADPAAAIPAAGCRRGGRKSRSSADKNQGRLHAARHWESAGAGRRAMPHRYHPAAPRRRRVHFAPPGNDPARSRPWSRLPRWRRRRGETGWRSSLTLRRPGDNSCCCRENQPPARRGSPVSPAPALPAGAAPATLVARL

SEQ ID NO: 8095 - protein, 482 aa, Klebsiella pneumoniae
PQTSGYGMDNTPPQRGRVDRPVRTNRPFCVGDQEYSSVICSARIRTDLLRGSAGRGLAENHLRPAGQPGGHRAKIIAAGQRNTRQLSGQRLFDQRRTGAAAGKIDHIRGGLAAVEREPHLFHNASQGLIQRGFQTLLGDGGGQIVLNKRQRGFDAGGAGESDFALFGAAHQTIAETLAPDLQQQSHLVGIPGAAQQIVQQAAVGGAVEIALRRHVVDRHRVPPREDRQRGAFLRFATHAEKGHQAFEGQGNVEIVTADAAAAVAEQALLSVGALPPLRAHQQQGAVGGSAADIDDQHPLFFTEGRFEIEPGGHRFKLKDHIAETGAVGGPLKDPLRLGVRLIAAEALEVNRPANHRLVDLLGQLAFGLQLNMQHHGADQVFKQGHLLRLQPAGAEEGFGRFNEVDLFWIFNILLQGGETELHAVAQHLDVFVAVGGDGPTQQRLVFVAVGGDIMMAIEPLADRFARRRAEHGGQQGAAVFQR

SEQ ID NO: 8096 - protein, 580 aa, Klebsiella pneumoniae
WRASTYNPLIDSRRGIMKTLLIIDAGLGQARAYMAKTLLGAAAPKAHLELIDNPNDAELAIVLGTALPADSALNGKNVYLGDINRAVAHPELFLGEAKDHAKPYVAPAAVAVPAAAQGQKRIVAVTACPTGVAHTFMAAEAIETEAKKRGWWVKVETRGSVGAGNAITPEEVAEADLVIVAADIEVDLAKFAGKPMYRTTTGLALKKTAQELDKAVAEAKPYQPSGKPQAAAEGKKESAGAYRHLLTGVSYMLPMVVAGGLCIALSFAFGIKAFEVKDTLAAALMQIGGGSAFALMVPVLAGFIAFSIADRPGLTPGLIGGMLAVSGGSGFIGGIIAGFLAGYVAKAISTKLKLPQSMEALKPILIIPLVSSLIVGLAMIYLIGKPVAGILAWLTHWLQTMGTANAVLLGAILGAMMCTDMGGPVNKAAYAFGVGLLSTQTYAPMAAIMAAGMVPPLAMGIATLVARNKFDKGQREGGKAALVLGLCFISEGAIPFAARDPMRVLPCCIVGGAVTGAISMAVGAKLMAPHGGLFVLLIPGAITPVLGYLLAIVAGTLVAGLAYAVLKRPEAQTAEVEKAA

SEQ ID NO: 8097 - protein, 548 aa, Klebsiella pneumoniae
GSNPMNKKMAVPRSQAVGPNSTRTNTRHEQETDVLLIGGGIMSATLGTWLQELEPDWSITMVEQMSSVAEESSNGWNNAGTGHAALMELNYTPQTANGINIDKAVDINEAFHISRQFWAHQVTRGVLNKPKSFINSVPHMSFVWGEDNVNFLRARYAALQQSELFRGIRYSEDHQQIKAWAPLVMEGRDPLQKVAATRSEVGTDVNYGEITRQLIAGLQKHDNFSLQLGTVVRRFKRNADKSWTVTLADADNRRQKRVIKAKFIFIGAGGAALTLLQETGIPQAKEYAGFPVGGQFLVCENPEVVNHHLAKVYGQAEVGAPPMSVPHIDTRIIDGKRVVLFGPFATFSTRFLKNGSLWDLLASTNTSNILPMLNVGLDNFDLVKYLISQVMQKDKDRLAALCEYYPEARKEDWRLWQAGQRVQIIKRDAKKGGVLRLGTEVVSDDEGTVAALLGASPGASTAAPIMLQLMEKVFKDKVNSPEWQAKLKAIIPTYGIRLDGNPAEIEKALAWTSEVLELKYQPAGAVDEVPQAELKPLSGGKPMADIAL

SEQ ID NO: 8098 - protein, 278 aa, Klebsiella pneumoniae
PGDPLCFYSVTVDITMHNKKINQLLIGAMLAAMAPAVSAADIPAWNGSALGFEAGQQGLLGDMLGIRPILEENGFHYNLGYLNEMAYNAGGGYDHDKHLAYIDQVALTFTQDLERWTGIPDARLEGNIVNRNHDDNLTTKRLQDPRVSFNDLSQESWGGGSITRLGWLTFARSFDDRRLTWRIGMMNKVQTFDQIIPCDFQLLTQCGGKSANSLTWNNWNIHTWGTTLEYKLTPTVTLKGGVMEQNPQATARSHAWSWSTKGSKGILLPMEIETPSVD

SEQ ID NO: 8099 - protein, 174 aa, Klebsiella pneumoniae
FHRPVSSGRVAKYQYINKEQQMMTWQDLHHSELTVPQLYALLKLRSEVFVVEQQCVYQDVDGDDLVGENRHLLGWRDGELVAYARILKSEEEFAPVVIGRVIVSPAARGAKLGYQLMEQALASCQQHWPQKAIYLGAQAHLQSFYAHFGFTPVTEVYDEDGIPHIGMAREKRAV

SEQ ID NO: 8100 - protein, 105 aa, Klebsiella pneumoniae
NTFPVPATVVSGCCQMEDVAFVSSRMSGIYVTDREGKEGFTELTLRTLESRTPLLRCHRQYLVNMAHLKEIRMEENGQAELLMRAGQTVPVSRRYLKSLKEAIGL

SEQ ID NO: 8101 - protein, 456 aa, Klebsiella pneumoniae
NPLPHHGYCYSAVEPLIMWGFTTVEVCVLSVSTALARLQDGLGESFPDSPGTRIIDVAFPLNDAFDPLLWCGQQAQWPQFYWQQRNGDEELATLGAVKTFTSLDAANRFLRQSGRQDLRICGLNAFEPQQGSLALPRLEWRRCGGRAVLRLVLHSDISLREDAATARAFLASLTTTQATPGAIPPLLSERHSSDYPQWQAMIARATKAISAGEMDKVVLARATDLQFAAPLDAVSIMAASRRSNLNCFHFLMAFNARQAFFGSTPERLWRRRGALLRTEALAGTVANHQEDAKAQQLADWLMKDDKNQRENMLVVEDICQRLQSEASTLDVLPPQVVRLRKVQHLRRCIWTELAAPDDSRCLLQLQPTAAVAGLPRRAALAFIQRHEAFSREWYAGSAGYLSLAQSEFCVALRSAKVNHDTLRLYAGAGIVSGSDAQQEWQEIDNKAAGLRSLLCP

SEQ ID NO: 8102 - protein, 275 aa, Klebsiella pneumoniae
TQSPVKNSASASRFTPWLRGAHAGDFRFRQRTIFTRRQRFIQQDVADAFPMQANHVVAHGGEHAFHLMVAAFADGEAHFGRSDNFQQRRFGEIFFVMQLDAFDEQLRGPFRQRAFQRHQIGFFTVVARRGNAMRPLAVIGHQHQPGGVDIQPSGGVQLMRHRLVEEIKDSRMIGIVGRTDVPLRLVEHKVTRAILLGQRISVILHLVLRLELKRGIFHNVAVHGNAAAANFTPGNSPADAQLLSDKLIKSHEIFLACHSAGAGKSPEKEEFHRLV

SEQ ID NO: 8103 - protein, 209 aa, Klebsiella pneumoniae
RSAPRPPAVRRDANSPPPRAATAGARPARYDQKRSVQSYFSVAGASPAAPPAGPPRPRPSAPGGPPDAALRQYHGSPAQSSVPADGGCAASPAAAPRGSPGRGRRRAHPSTAPPDLPPAPAPPPPAAAGRRRADAGNGRAASPPAPAAPSARRSGRRSLPAAIFAAAARWRYSAPPSSGETGRWTGWHSPSAAAGSGPAAGECPRRQSE

SEQ ID NO: 8104 - protein, 364 aa, Klebsiella pneumoniae
MLIPCIEGGDAVKNVLFVLPFLGYTGADRVIFTLLNNLDRTKIKPFLLVHSDKEEKSGLIKYLKDDVTVISLGINGRISRNLHRIIYGMRKNIKLYNIDTVLISDGTSNASISPFLFLFGDAKIIARESNLSSLFETKKVVRFLYKNFYSNYDRIIVQSNDMYDDLTKQMNISRDKIVKINNPLDYDFIISKSQEKSAYEMPSNKINLLAIGRLTYQKGFDLLLEGISKLKNDKYHLTLVGQGEDDMKLRDICKRLDIITKVTFIDKTDNPYALMKQADVFISSSRWEGYPNVVIEALACGLPVVANDYPGGINEIINDSNGYICDIRNDLEENLESALKLRNVSYDKKKIDVIFRAYEDTIIS

SEQ ID NO: 8105 - protein, 165 aa, Klebsiella pneumoniae
LPIPKAKSSKCMMARSSTIVDPRNLHVRPGEPADSPALRQIFLRARSLSWTWLPAAAWRLEDFDAATADEQLWLAECDGQPVGFAAVWTADNFLHHLFVDPDWQGKHIGSALLAQVERTFTASGTLKCLMENKNALRFYQRHGWTIEAQGASPEGRYWLMRSPRP

SEQ ID NO: 8106 - protein, 232 aa, Klebsiella pneumoniae
ERSPPRGEPVQSLWPYAAPGDPRPGRCPAVFQRGAVMNVVILDTGCANLNSVKSAIGRHGYEPVVSRDPEVVLRADKLFLPGVGTAQAAMDQLRDRELIDLIKACTQPVLGICLGMQLLGKRSEENNGVDLLGIIEEAVPKMTDHGLPLPHMGWNRVYAKAGDRLFRGIEEGAYFYFVHSYAMPVNPYTIAQCNYGEAFTAAVQKDNFFGVQFHPERSGSAGAQLLKNFLEM

SEQ ID NO: 8107 - protein, 389 aa, Klebsiella pneumoniae
SKPPVTIRCTHRVGLLLTGLLLVTLALPFVTYAPNRLLSGEGRGLWQVLPWLAGVQLAAALAGMLLCWLPGRIVPFLHLLLAELLFPLLIWGSGQAALELSRHGSPLARTSPGSGLWLSLALCLLLASEAIRHLTVRPLWRWLLNAQVWLLPIILLAIGALDQLSLLKEYANRQEVFDDALRQHLLLLFGTLLPGLLIGLPLGVWLWRRPRWQAPAFTALNVIQTIPSVALFGLLIAPLAGLARYFPTLGELGVSGTGVAPALIALTLYALLPLVRGVVTGLQQVPQDALESATAMGMSAGQRFRQVQLPLAMPVLLRSLRVVSVQTVGMAVVAALIGAGGFGTLVFQGLLSSALDLVLLGVVPTIALAVVVDALFALWGAWLKGEAND

SEQ ID NO: 8108 - protein, 364 aa, Klebsiella pneumoniae
GLTPTVRNRMETLSALLAAIPQPDVAGMARAQQHIDGLLKPPGSLGRLETLAVQLAGLPGLQGQLALAEKAIVVMCADHGVWHEGVTPSPQGVTAIHAGNMVRGNTGVCVLAAQAGARVQVVDVGIDADPLPGLINLKVARGSGNIARTAAMSRQQAETVLLASMHLTRQLAADGVKAFGVGELGMANTTPAAATISVLTGSDPDAVVGCGANLPLAQRGHKVAVVRQAIAHNQPNPADGLDVLAKVGGYDLVGMTGVILGAASCGLPVVLDGFLSYASALAACRMAPSAHPYLIPSHLSAEKGAQIALDALGLRPYLDMDMRLGEGSGAALAMHLLDAASVMYNQMGTLAQSNIVLPDSAPSS

SEQ ID NO: 8109 - protein, 209 aa, Klebsiella pneumoniae
RPAPASASAVRHPAAGPADWPAAGGMAVAASALAGASFHRAQCDPDYSVGSAFWPADCAACRSGALFPDAGRAGRLRDRRGASPDRSHSLCATAAGARGGDRPAAGTAGCPGKRDGNGHERRAALSSGAASAGDAGTAAQPAGGQRANRRHGGSGRADRRRRLWHAGFSGAAEQCAGSGAAGRGADHCPGGGGGCPVRPVGRLAKRRGQ

SEQ ID NO: 8110 - protein, 127 aa, Klebsiella pneumoniae
TPAPPGAAGRPPRRWAAAAADSGCRQAPPARSRCSVGDAAPYAASPPAAAGRPASRPHSAGAGRYPLPPACFPAGFCRLSSTSRPVAAPSRLPDGSRRSPPALRCAAARRAGATAVPAWSRKMPAGH

SEQ ID NO: 8111 - protein, 741 aa, Klebsiella pneumoniae
HCQPALGCQIEWIIFRKHCMTSVTTNKPATPDSDEIDLGRLIGELIDHRKLIIAITTGFTVLSVLYALLATPIYQADALIQVEQKQGNAILSSLSQMLPDGQPQSAPEIALLQSRMILGKTVDDLNLQAQVRPKYFPLVGRGLARIMGDKPGNIAISRIYLPSRGDDESAPKVILTVKDDKHYLVEGDDFSANGTVGTLLNEHGISLLVNSIDAKPGDKFTVSQLTRLKAITDLQEIFSVADQGKDTGMLELTLSGDNPELISRILDSISQNYLTQNIDRQAAQDAKSLEFLNEQLPKVRSDLDIAEDKLNAYRKQKDSVDLTMEAKSVLEQIVNVDNQLNGLTFREAEISQLYTKEHPTYKALMEKRQTLQEEKSKLNKRVSSMPSTQQEVLRLSRDVESGRAVYLQLLNRQQELNIAKSSAIGNVRIIDNAITEPDPVKPKKVLVVAIGIILGLFVSISLVLVKVFLRRGIESPEQLEEIGVNVYASVPVSEWLAKNNRKSKQLRKNESDALLAVENPADLAVEAIRSLRTSLHFAMMEAKNNVLMISGASPNAGKTFISSNLAATIALTGKKVLFIDADLRKGYVHKMFGRKQDKGLSEILAGQVAAETVIEKVTGGEFDYIGRGQIPPNPAELLMHPRFEKLLKWATQVYDLIIIDTPPILAVTDAAIIGRYAGTSLLVARFEENTAKEIEVSMKRFEQSGVIVKGCILNGVVKKASSYYGYGYNHYGYSYSDKKHD

SEQ ID NO: 8112 - protein, 202 aa, Klebsiella pneumoniae
NLWPGQRLRHGSQTPGQPASGRRSHRHAGRPVGSAGDRRQWRQPGLCRLRPAVAGGTRPGLAGDPPDPGRRHGQPRRRSRGAPAGRPAARRNCPRGALRQPDHRGPRSGAVRGYLQPVRPGALDHSDPSGPRAGGQHHQRRFRFPWRLVTGIRGRLRLGHQPRPADLWLHRHLLKPRSGRFPEADDGAGAVARRLCRPRLND

SEQ ID NO: 8113 - protein, 240 aa, Klebsiella pneumoniae
SDWPKRKRRMMHEIWWSLPLTLIVFFLARKLAARFKFPLLNPLLVAMVVIIPFLLLTGISYERYFAGSKVLNDLLQPAVVALAFPLYEQLHQIRARWKSIITICFIGSCVAMITGTTVALLMGATPQIAASILPKSVTTPIAMAVSGSIGGIPAISAVCVIFVGILGAVFGHTLLNLMRIRTKASRGLSMGTASHALGTARCAELDYQEGAFSSLALVLCGIITSLMAPFLFPLILAVVG

SEQ ID NO: 8114 - protein, 495 aa, Klebsiella pneumoniae
GFRPAGRLTILKRIARSMSVLHKKSARLRDEERARLIWLLSTDKAVTSALLGKLTLAERYDEGTLADDLAEVEMLVSHLPPPDLADALEALPYDARTALWCLVPDDKRGEVLLEASENVWGDLIDKMSDPELLQAMQPLDIDEQVYLLQHLPRNLTGRLLATLPAEKRARIRQIMRYADNSVGSIMEFEVITVRPEATLAAVQRYLRRLGKMPENTDKLFVTTRNKLLLGELELQTILLNDAQKRVGEVMEGDPVTFQPHEEAEKVARTFERDDLLSAAVIDADGKLIGRLTIDEIVDVVYEETDNDLRRMGGLSDEEDVFAPVSKAVKTRWAWLAVNLCTAFIASRVIDGFEHTISQLVALASLMPIVAGIGGNTGNQTITMIVRAMALQQIQPGSFTFLILREMGVALINGLVWGGIMGAITWWLYDDPQLGGVMTLAMMLNLLMAAMMGVIIPMVMVKLGRDPAVGSSVMITAITDTGGFFIFLGLATLFLM

SEQ ID NO: 8115 - protein, 133 aa, Klebsiella pneumoniae
AGRPSPRSPAGPAPRAPPARRHPAPPAGAAPAAPAPGRPACERPVAGRRLNQTAGQFAHSRSPLPAAVPGKGSPAGPAPLRPAPDESARGGLPRQSCGCSPHRENARRRQPRAPAENQPSTPSHRAGSRVTAP

SEQ ID NO: 8116 - protein, 319 aa, Klebsiella pneumoniae
KERPMIEFQGVSKVFAGHPAVKDLTLELREGAFSVLVGTSGSGKSTTLKMINRLLEPDRGTIRFAGEDIRQQPVLTLRRRMGYAIQSIGLFPHWTVAQNIATVPQLQRWPQARIADRIDELMALLGLEATLRDRYPHQLSGGQQQRVGVARALAADPEVLLMDEPFGALDPVTREALQQEMLRIHRLLGRTIVLVTHDIDEALRLADHLVLMDGGEVVQQGAPLEMLLRPKNSFVQTFFGRSELGVRLLSLREVGDYLRPDERLAGEGLTVTMTLREALSQFVARRCETLPVVDAEGRPCGTLHFADLLRQEMSHEGAS

SEQ ID NO: 8117 - protein, 405 aa, Klebsiella pneumoniae
NAKFRKKDGGSVNLEDMPLKGRLFIAVSLLASSVSCAFAVDLPATVAPPSIQAGSWVLMDYTTGQVLTAGNEHQQRNPASLTKLMTGYVVDRAIDSHRITFDDIVTVGKDAWAKGNPVFDGSSLMFLKPGDRVSVRDLSRGLIVDSGNDACVALADYVAGGQPQFVALMNQYVEKLHLRDTHFETVHGLDAPGQHSSAYDLAVLSRAIIHGEPDVYHMYSQKSLTWNGITQQNRNGLLWDKTMNVDGLKTGHTSGAGFNLIASAVDGQRRLIAVVMGADSPKGREQQAAKLLHWGQQNFDTVQVLQKGQKVGTERIWYGDKEQIKLGTDQDFWLALPKAEVSRIKAKYVLDKKDLEAPIAANQRVGEISLYDGDKVVGHYPLVTLESINKGGVFSRMSDYLHHEL

SEQ ID NO: 8118 - protein, 521 aa, Klebsiella pneumoniae
GKCTCLAGVAQRSQLVPRALSILVFPLFSLRYDSGAENGSCTMIKIARIAVTLGLLSSLGAQAYAAGLVVNDNDLRNDLAWLSDRGVIHLSLSTWPLSQEEIARALKKAKPSYSSEQVVLARINQRLSALKADFRVTGYTSTDKPGTPQGFGQTQPADNSLGLAFNNSGEWWDVHLQGNVEGGERISNGSRFNANGAYGAVKFWNQWLSFGQVPQWWGPGYEGSLIRGDAMRPMTGLLMQRAEQAAPETWWLRWVGPWQYQISASQMNQYTAVPHTKIIGGRFTFTPFQSLQLGASRIMQWGGEGRPESLSNFWDGLTGKDNTAANDPNEPGNQLAGFDFKFKLEPTLGWPVSFYGQMIGEDESGFLPSANMFLGGVEGHHGWGKDAVNWYVEAHDTRTNMSRTNYSYTHHIYKDGYYQQGYPLGDAMGGDGQLVAGKVELITEDNQRWSTRLVYAKVNPENQSINKAFPHADTLKGVQLGWSGDVYQSVRLNTSLWYTNANNSDSDDVGASAGIEIPFSL

SEQ ID NO: 8119 - protein, 165 aa, Klebsiella pneumoniae
RGSTGRCGKKCSIIRGVFVAPTSCVNYRKAEVLIARVSFGGYNAARFCIRKADNPPVAGSPVAGFIYRETSMFTINAEVRKEQGKGASRRLRAANKFPAIIYGGEAAPVAIELDHDKVWNMQDKAEFYSEVLTVVVDGKEEKVKVQAVQRHAFKPKLTHIDFVRA

SEQ ID NO: 8120 - protein, 476 aa, Klebsiella pneumoniae
CGDTPQLAAPGAANLTCHQNENTMFKPELLSPAGTLKNMRYAFAYGADAVYAGQPRYSLRVRNNEFNHENLQLGINEAHALGKKFYVVVNIAPHNAKLKTFIRDLKPVVEMGPDALIMSDPGLIMLVREHFPEMPIHLSVQANAVNWATVKFWQQMGLTRVILSRELSLDEIEEIRRQVPEMEIEIFVHGALCMAYSGRCLLSGYINKRDPNQGTCTNACRWEYNVAEGKEDDVGNIVHKYEPIPVQTVEPTLGIGAPTDKVFMIEEAKRPGEYMTAFEDEHGTYIMNSKDLRAIAHVERLTQMGVHSLKIEGRTKSFYYCARTAQVYRKAIDDAAAGKPFDTSLLETLEGLAHRGYTEGFLRRHTHDDYQNYEYGYSVSERQQFVGEFTGERNGPLAAVAVKNKFSVGDSLELMTPQGNVNFTLEHMENGKGETMPVAPGDGYTVWLPVPDDLPLQYALLMRNFTGQTTRNPHGN

SEQ ID NO: 8121 - protein, 472 aa, Klebsiella pneumoniae
TICTIDSTDFHHNRRFVARRGAATLYPENEVIMSINNKQWLGLPLNLLWGYIAIAVFMTGDGFELAFLSHYIKALGFSPAEASFAFTLYGLAAALSAWISGVVAEIITPLKTMMIGFVLWCVFHVLFLVFGLGHANYALILLFYGIRGFAYPLFLYSFIVAIVHNVKSDNASSAIGWFWAVYSIGIGVFGSYIPSFTIPHIGEMGTLWLALAFCLTGGVIALVSLRHIQTPQHMQNLTTREKFSELGRAATLLYTNRNILLSSMVRIINTLSLFGFAVIMPMMFVDELGFSTSEWLQVWAVFFFTTIFSNVLWGILGEKLGWMKVVRWFGCIGMALSSLAFYYIPQHFGHSFAMALIPAIALGIFVAAFVPLAAVFPALEPKHKGAAISVYNLSAGMSNFLAPAIAVVLLPFFSTIGVVIAYTGLYVVAFFLCAFIRVEQPGFSHKEATAREQVEFFVGAAAGMRFMPALMR

SEQ ID NO: 8122 - protein, 63 aa, Klebsiella pneumoniae
SGGTGKYALPANMYFMSAMQHFFTILIRHRALRRGMMAFASEVAHLTSRRTFHNVQKYFSECP

SEQ ID NO: 8123 - protein, 60 aa, Klebsiella pneumoniae
NNLTSDYNCMQINSSITENINNLFFSHLRICYIFLEHNHLFHYEIYQWKILQHAFYNLQD

SEQ ID NO: 8124 - protein, 769 aa, Klebsiella pneumoniae
SEITMKWLCTVGVAVSLALQPALADELFGNHPLTPQARDAFVTDLLKKMTVDEKIGQLRLISVGPDNPKEAIREMIKNGQVGAIFNTVTRPDIRVMQDQVMQLSRLKIPLFFAYDVLHGQRTVFPISLGLASSFNLDAVKTVGRVSAYEAADDGLNMTWAPMVDVSRDPRWGRASEGFGEDTYLTTMMGQAMVESMQGKSPADRYSVMTSVKHFAAYGAVEGGKEYNTVDMSPQRLFNDYMPPYKAGLDAGSGAVMVALNSLNGTPATSDSWLLKDVLRDQWGFKGITVSDHGAIKELIKHGVASDPEDAVRVALKSGINMSMSDEYYSKYLPGLVKSGKVTMAELDDATRHVLNVKYDMGLFNDPYSHLGPKDSDPQDTNAESRLHRKESREVARESLVLLKNRLDTLPLKKSGTIAVVGALADSKRDMMGSWSAAGVADQSVTVLTGIKEALGDNGKVIYAKGANVTDDKGIVDFLNLYENAVQVDPRSPQEMIDEAVAAAKQSDVVVAVVGEAQGMAHEASSRTDITLPQSQRNLIAALKATGKPLVLVLMNGRPLALVKEDQQADALLETWFAGTEGGHAIADVLFGDYNPSGKLPMSFPRSVGQIPTYYSHLNTGRPYNPEKPNKYTSRYFDEANGPLYPFGYGLSYTTFSVSDVNMSSATMPRDGSVTASVQVTNTGNREGATVIQLYLQDVTASMSRPVKMLRGFKKVTLKPGETQTVSFPIDVDALKFWNQQMKYVAEPGKFNVFIGVDSARVKQSEFELL

SEQ ID NO: 8125 - protein, 360 aa, Klebsiella pneumoniae
KGITMSHNATPNTSRVELRKTLTLVPVVMMGLAYMQPMTLFDTFGIVSGMTDGHVPTAYAFALIAILFTALSYGKLVRRYPSAGSAYTYAQKSISPTVGFMVGWSSLLDYLFAPMINILLAKIYFEALVPSIPSWVFVIALVAFMTAFNLRSIKSVANFNTVIVVLQVVLIAVILGMVIYGVFEGEGAGTLASSRPFWSGDAHVIPMITGATILCFSFTGFDGISNLSEETKDAERVIPRAIFLTALIGGLIFIFATYFLQLYFPDISRFKDPDASQPEIMLYVAGKAFQVGALIFSTITVLASGMAAHAGVARLMYVMGRDGVFPKSFFGYVHPTCRTPAMNIILVGADCAAGRLTSTW

SEQ ID NO: 8126 - protein, 94 aa, Klebsiella pneumoniae
RRGLMLTICCIPPPNRTEVSTSAYDDCAASSRVIISSDEEISTRSNFHFFFCFIDFFSRPYATWTCGLLPFRNLNLTSKSTLVLKRFLTKILTI

SEQ ID NO: 8127 - protein, 228 aa, Klebsiella pneumoniae
WSKTRRLPRAATRGAGRRRVAKASYCRWRSKPRPLINGLPGAYTLGVVWTNAPGRATFIAVNPAAPGRPDPQGYAEHDSTWFMYAGLNQQITRHADDPLRGMSVSLSGSLSDQRSNYIHSAVAASMRYRGLFDARPEDWIGFGLTWIDMSSHYARNQRYMNQISGATDYNDPAYQPVAGHSLNGELYYRFRPVSWLELQPGLQYWHRPGGVAQTQDAWVVEWKTVVTF

SEQ ID NO: 8128 - protein, 216 aa, Klebsiella pneumoniae
YWRTESVPGGTGRGDKGMLTEQLDWEKTDGMMPAIVQHAVSGEVLMLGYMNKEALEKTEATGKVTFYSRTKQRLWTKGETSGHVLNVVSITPDCDNDTLLVLVNPIGPTCHKGTTSCFGETGHQWLFLYQLEQLLAERKHADPESSYTAKLYASGTKRIAQKVGEEGVETALAATVNDRFELKNEASDLMYHLLVLLQDQGLDLGEVIDNLRARHR

SEQ ID NO: 8129 - protein, 485 aa, Klebsiella pneumoniae
SPLTISALLLNSGCRHGDDPLKSPPFFTGMGILQTMFIGFDYGTANCSVAVMRENTPQLLTLENGSALLPSMLCAPTREAVSEWLYRHHDVPTHSDENQALLRRAIAANRDEDIEVLRNSVQFGLASLQQYVEDPEEVYFVKSPKSFLGASGLKPQQVALFEDLVCAMMLHIKLQAESQLPEQIDQAVIGRPINFQGLGGDEANAQAQGILERAAHRAGFRDVVFQFEPVAAGLDFEATLSEEKRVLVVDIGGGTTDCSLLLMGPQWRERADRQQSLLGHSGCRIGGNDLDIALAFKCLMPLLGMGGETEKGTALPILPWWNAVAINDVPAQSDFYSTANGRLLNDLLRSARDADKVALLLKVWRQRLSYRLVRSAEESKIALSSAASVETALPFIQDDLATAIAQQGLEAALDQPLTRIMEQVRLALDSSQTTPDVIYLTGGSARSPLIKKALAAQLPGIPLAGGDDFGSVTAGLARWAQVVFR

SEQ ID NO: 8130 - protein, 487 aa, Klebsiella pneumoniae
FAMTITPQQLIALLPLLIVGLTVVVVMLSIAWRRNHFLNATLSVLGLNAALVSLWFVGQNGAMDVTPLIRVDGYAMLYTGLVLLASLATCTFAYPWLEGYKDNKEEFYLLVLIAALAGILLAGANHLAALFLGIELISLPLFGLVGYAFRQKRSLEASIKYTILSAAASSFLLFGMALVYANSGNLSFLALGKSLADNMLHEPLLLAGLGLMIVGLGFKLSLVPFHLWTPDVYQGAPAPVSTFLATASKIAIFGVVMRLFLYMPVGNSEAVRVVLGLIAFASIIFGNLMALSQTNIKRLLGYSSISHLGYLLVALIALQSGEMSMEAVGVYLAGYLFSSLGAFGVVSLMSSPYRGPDADSLFSYRGLFWHRPILSAVMTVMMLSLAGIPMTLGFIGKFYVLAVGVHAHLWWLVAAVVVGSAIGLYYYLRVAVSLYLSAPEQLNRDAPSNWQYSAGGIVVLISALLVLVLGIWPQPLISIVQLATPLM

SEQ ID NO: 8131 - protein, 113 aa, Klebsiella pneumoniae
QEMTSENKGYTLALENGRLHQKQEKIFLKPMVLYIPQQAVEAVNDLLSKLPDDREEGEFLLTVTNNNNGVSVDKTFSSLAALRDPLTAADAVKDLINIVRGYESDEETNVCGW

SEQ ID NO: 8132 - protein, 64 aa, Klebsiella pneumoniae
RHPTPNGIKSRPDKPKMPSGNLLRLINLTGRAQYCGSPAPSGWRRWHPTGSAPRRLSPPGLPAG

SEQ ID NO: 8133 - protein, 699 aa, Klebsiella pneumoniae
HRATSHIDEKTARACRRQSGKSPARVSSTLLFVWLYTSWRFGMFRLNPFIRAGLSASVVSLAFPALADVNEETLVVTASATEQNVKDAPASISVITQQDLQRKPVQNLKDVLRDVPGVQLTNEGDNRKGVSIRGLSSSYTLILVDGKRVNSRNAVFRHNDFDLNWIPVDAIERIEVVRGPMSSLYGSDALGGVVNIITKKIGQKWTGTLSADTTIQEHRDRGDTYNGQFFTSGPLIDGVLGMKAYGSLAKRAKDDPQSSSNATGETPRIEGFTSRDGNVEFAWTPNENHDFTAGYGFDRQDRDSDSLDRNRLERENYSLSHNGRWDIGNSELKFYGEKVDNKNPGQSGTITSESNAIDGKYVLPLGMINQLVTFGGEWRHDKLKDPVNLSSGGQSTSASQYALFIEDEWRIIEPLALTTGIRMDDHQTYGDHWSPRAYLVYNATDTVTVKGGWATAFKAPSLLQLNPDWTTNSCRGSCSIVGNPDLKPETSESFELGLYYRGEEGWLENVEGSITTFQNNVDDMIDVLRTSSASEAPGYPNFVGWKTVNGKRVPIFRYFNVNKARIKGVETEVKIPFGDEWKLTVNYTYNDGRDLSNGGDKPLQTLPFHTANGTLDWKPLDDWSFYVTANYTGQQRAVSATGKTPGGYTLFDVGAAWQVTKNVKLRSGVQNVGDKDLSRDDYSYTEEGRRYFMAVDYRF

SEQ ID NO: 8134 - protein, 310 aa, Klebsiella pneumoniae
GHWTMELTFLGTSAGVPTRTRNMTSIILNLQQPTRAEMWLFDCGEGTQHQFLHTPYHPGKLNKIFITHLHGDHLFGLPGLLCSRSMQGNSLPLTLYGPKGLKEFVETALRLSGSWTDYPLTIIEVGPGLVFDEEGYRVTAYPLSHPVECYGYRIAQHDKPGTLDAAQLIADGVPPGPLFHQLKRGQRVTLADGRVIDGSRYLGPATPGKTLAIFGDTAPCPQALEMARGADVMVHETTLEQAMAEKANSRGHSSSQQTAALAKEAGVGTLIATHFSSRYDAEGCLRMLAECREIFPNTLLAEDFMVYKMA

SEQ ID NO: 8135 - protein, 945 aa, Klebsiella pneumoniae
KYLASFHTTLKVSRYLFRALAVLLWLLIAFVSVFYIVNALHEREAEIHQELNLNADQAQRYIQRTADVMKELKYVAGNRLSAGDAVAQGQNGDMAVPNFEPLYPDSDCSAMSATWRNSLQSLAWFMRYWRDNFTAAYDLNRIFLIGSDNLCMANFGLRDVPIERDQALKVLHQRIEQYRNAPQNERGNNLFWISQGVRPGVGYFYALTPVYMANRLQAMLGVEQTIRMESFFTPGSLPMSVTIFDDNGQPLISLAGAEGKIQSEAKWMQERMWFGYSSGFRELVLKKSLSPSSLSIVYSVSVDQVLERIRMLIINAIVLNILSGAMLFALARMYERRIFIPAENDAQRLEEHEQFNRKIVASAPVGICILRTADGTNILSNELAHNYLNMLTHEDRQRLTQIICGQQVNFVDVLTSNHTNLQISFVHSRYRNENVAICVLVDVSARVKMEESLQEMAQAAEQASQSKSMFLATVSHELRTPLYGIIGNLDLLQTKALPKGVDRLVTAMNNSSSLLLKIISDILDFSKIESEQLKIEPREFSPREVMNHISANYLPLVVRKQLGLYCFIEPDVPEQMSGDPMRLQQVISNLLSNAIKFTDTGCIVLHVQCAGDYLQISVRDTGEGIPAKEVLRLFDPFFQVGTGVQRNFQGTGLGLAICEKLISMMDGDIAVETEPGMGSRFTIRIPLYGVQNTSPVSRDGFAGKTCWLAIHNTSLAMFVTSLLSYHGLTVRRHAGETPDAEDVLLTDDEALSGWQGRAMVIFCRRHIGIPQERSAGEWLHSVTTPHELLPLLGRIFHVALASAENSPALMAPEAQAGNNDDMMILVVDDHPINRRLLADQLGSLGYQCVTANDGIDALNVLSKQHIDIVLSDVNMPNMDGYRLTQRIRQLGLTLPVIGVTANALAEEKQRCLESGMDSCLSKPVTLDVLKQTLTVYAARVRKGRE

SEQ ID NO: 8136 - protein, 104 aa, Klebsiella pneumoniae
DAVALFITGRKRRRSGCFFAPSCAKRSRRPHKETLMNIAQFLEQRGHQQGLKQGLEQGLQQGIEQGEQQTAERIARAMLANGLDLSLVAKLTGLAPEYLARLQH

SEQ ID NO: 8137 - protein, 119 aa, Klebsiella pneumoniae
YEAAILSPGNIEETMRKTKMMLLGVLLTTAGASWTATAAGIDQYALKEFTADFTQFHIGDTVPAMYLTPEYNIKQWQQRNLPAPDAGSHWTYMGGNYVLITDTEGKILKVYDGEIFYHR

SEQ ID NO: 8138 - protein, 86 aa, Klebsiella pneumoniae
FDHATLHRRWTAFPHSTLLTPCLPGEKYYNAKRDADEEENLAQQEDAAPEEIRSWRWRRCMGRRRWCYRGCHLCPPGSGNGSRPGC

SEQ ID NO: 8139 - protein, 349 aa, Klebsiella pneumoniae
NINAANRVFIRSSSMKFLVTGAAGFIGFHVSKRLLNDGHQVVGIDNINDYYDVKLKESRLEQLESPSFTFYKLDLADRDGMSKLFETEQFERVIHLAAQAGVRYSLENPYAYADSNLTGYLNILEGCRHNKVQHLLYASSSSVYGLNRKMPFSTDDSVDHPVSLYAATKKANELMAHTYSHLYSIPTTGLRFFTVYGPWGRPDMALFKFTKAMLEGKSIDVYNYGKMKRDFTYIDDIVEAIVRIQDVIPQPDPEWTVEEGSPATSSAPYRVYNIGNSSPVELMDYINALEQALGLEAKKNMMPIQPGDVLNTSAETQALYETIGFKPETPVQQGVKNFVDWYKEYYQYN

SEQ ID NO: 8140 - protein, 97 aa, Klebsiella pneumoniae
DKGAPTGPCGRRPGQRHRRGSHPAPPAGHRRPPRGSPRSCPPDRNPPPSPGHPARRPGSADYGLSPGAPPPPYGPAAPAADWPHSPPPRQGRCPSGH

SEQ ID NO: 8141 - protein, 73 aa, Klebsiella pneumoniae
SGFAKQRRRPAGIQQPGSLIEPLNVKVKRHLRLQEKPGQDIDPNNALTLIDDTHNHKKPITSNSYLLKWAHLP

SEQ ID NO: 8142 - protein, 254 aa, Klebsiella pneumoniae
PMLASQRKQQILQILTEEKQVMSGELSQRFNVSEDSIRRDLRELAAEGKLQRVHGGALPVSAAIAPIETRKSVQIASKQAVARAAAALIQPGQVVIVDGGTTTAAMIGFLPADLSCTVVTHSPGIAVALVDHPRIEVILLGGRVFKHSVVAVGAETLAGMARINADLFFMGVTGVHPRAGFTTGDYEEAGIKRALTARAAETVVMASREKLNAASAFAIGELSLASTLIVDGEPDAALRQQLVQSGVEIVPVQR

SEQ ID NO: 8143 - protein, 433 aa, Klebsiella pneumoniae
RRIAIQLLRRAQIQADGHAQVVVETDRRADNHRGNQPPQMRMHTDGQHVELTDKAEGHRDAGQGEHHHRHHSRQDRTVPEQAAVGEQRVSIRAAVRAGHQADHAERAEAAEQVTGQVNAHGFHRHFTALQGNQRHQQIAEMGDGRVTEQALNVGLAQRHQVTEDDRGEGDQAQHHAYRFAVAHRHVQEQTHHYAEDSDLAGGRQEGGDRRRRPLVNVRRPQVERHQRQFKAKTDNHQAKTRQQQRLVQHVVRQAFAQREEGQVAGVRIHQRHTEQQEGRSCRGEDGVFDARFQRTLLAEGVTNQAEQRQRNQLNTEEQRRQMIRTGQQNAGQGGDQHQQVELFFVVLVTLKPRVGESTGREARQQHQTGVKHGVAVNADQRRDVHRPVLADEPERDQRGVKSKNRQRGIEKMIASPRNGEHHNHHRQADDQQR

SEQ ID NO: 8144 - protein, 124 aa, Klebsiella pneumoniae
PPAADMGCGCDAPRHRRHRIIMIANHPEREQIRLENVLSALGNPLRLEIIRTLADGSELSCNALRQEEVAKSTMTHHWRVLRDSGVIWQRPQGRENMISLRREDLDARFPGLLDTLLKVMVQAG

SEQ ID NO: 8145 - protein, 125 aa, Klebsiella pneumoniae
PYNAVALRIRISIIRGVKMETTKPSFQDVLEFVRLYRRKNKLQREIQDVEKKIRDNQKRVLLLDNLSDYIKPGMSVEAIQGIIASMKSDYEDRVDDYIIKNAELSKERRDISKKLKVMGEAKVES

SEQ ID NO: 8146 - protein, 207 aa, Klebsiella pneumoniae
GNNAMRNINVTINTRNAFVRESLVAMVNDLTRGDLRARFSWRNTDLSAEDIIICEVIPGEIYLCNTLIKNRKRGSSLIILHSYDQLPEDEFMINCLKGVIFVSLKTASIPQLLTIIKNELQHCMTPTATDAAGRELSCASCPHRVLSRSQTAVAHGILEGLDMSKIAALQRVSPRTAAYHKNKIMEKYSLNNNHEFFQFMNLLRERW

SEQ ID NO: 8147 - protein, 91 aa, Klebsiella pneumoniae
PLSAPCRQRAQLAAVIAFHHRYRALAVFRIIQRHDKHLLYLWMGEYHTLDLFRLNTFSTAKKEVIQSPNNRQPTVMQCSAIARRKPAFIVG

SEQ ID NO: 8148 - protein, 1046 aa, Klebsiella pneumoniae
TRSAFLMQVLPPGRTGGPSRLFIMRPVATTLLMVAILLAGIIGYRFLPVSALPEVDYPTIQVVTLYPGASPDVVTSAITAPLERQFGQMSGLKQMSSQSSGGASVVTLQFQLTLPLDVAEQEVQAAINAATNLLPSDLPNPPVYSKVNPADPPIMTLAVTSSAIPMTQVEDMVETRVAQKISQVSGVGLVTLAGGQRPAVRVKLNAQAIAALGLTSETVRTAITSANVNSAKGSLDGPARAVTLSANDQMQSAEDYRRLIIAYQNGAPIRLGDVASVEQGAENSWLGAWANQQRAIVMNVQRQPGANIIDTADSIRQMLPQLTESLPKSVKVQVLSDRTTNIRASVRDTQFELMLAIALVVMIIYLFLRNVPATIIPGVAVPLSLVGTFAVMVFLDFSINNLTLMALTIATGFVVDDAIVVIENISRYIEKGEKPLAAALKGAGEIGFTIISLTFSLIAVLIPLLFMGDIVGRLFREFAVTLAVAILISAVVSLTLTPMMCARMLSHESLRKQNRFSRASERFFERVIAVYGRWLSRVLNHPWLTLGVALSTLALSIILWVFIPKGFFPIQDNGIIQGTLQAPQSVSFASMAERQRQVASIILKDPAVESLTSFVGVDGTNPALNSARLQINLKPLDERDDRVQTVISRLQQAVDGVPGVALYLQPTQDLTIDTTVSRTQYQFTLQANSLEALSTWVPPLLSRLQAQPQLADVSSDWQDKGLAAYIKVDRDSASRLGISMADVDNALYNAFGQRLISTIYTQANQYRVVLEQDTEATPGLAALENIRLTSSDGGIVPLTAIATVEQRFTPLSVNHLDQFPVTTISFNVPDNYSLGEAVEAILAAEQSLDFPTDIRTQFQGSSLAFQSALGSTVWLVVAAVVAMYIVLGVLYESFIHPITILSTLPTAGVGALLALWLAGSELDVIAIIGIILLIGIVKKNAIMMIDFALAAEREQGMPPREAIYQACLLRFRPILMTTLAALLGALPLMLSTGVGAELRRPLGIGMVGGLMLSQVLTLFTTPVIYLLFDRLSLHLKRRFPRQEEEA

SEQ ID NO: 8149 - protein, 394 aa, Klebsiella pneumoniae
NSGAGRDERRRARGGYHRYGRCGAAGGPGAGSSAGYRGGGHWRGGLRHRRRAGAQRGGGQSADDPGGGHRLRAVGGGGGERGAAGRPAGKRGRRLRADEAGRGDRRPSGRPRQLYSGVSRRAVSGGAGMKRINALTIAGTDPSGGAGIQADLKTFSALGAYGCSAITALVAQNTRGVQSVYRIEPDFVAAQLDSVFSDVRIDTTKIGMLAETDIVEAVAERLARYRVANVVLDTVMLAKSGDPLLSASAVETLRQRLLPQVSLITPNLPEAAALLDAPHARNEREMLEQGRALLALGCGAVLMKGGHLDDAESPDWLFTREGEQRFTAPRVQTKNTHGTGCTLSAALAALRPRHADWAATVIEAKAWLSAALAQADSLEVGHGIGPVHHFHAWW

SEQ ID NO: 8150 - protein, 422 aa, Klebsiella pneumoniae
YPGAKISRSTPVASTEDGIAADVIRYPGKDERRQGDDRRHAQIGVEKDLMGAGGVEAHMLLAIQPQQQPGDGHADTHRQLHHHRQQAVAAAGQIVREIFQRQGIHRGEAAGVDHPLQKQDQRQHVIPPGQGAKHKQQADRRQAQGAGDQHPTVAKAVDHLDHDPLHAHAAEHHRDHHQPGVKGGEAEADLQKHRGHKRQHAAADASREAAAEAEGEGAVSKQVKAKQRPGVTAGVPQVEQQGAEADGHQPRQPGRGNAEPFLAVERQGQGRHPGGQQQKAGEIEAPGLHGVVGHQTEGGDRANDPHRDVDEEDPVPGGVLHQHPAQRRAEQRADLARQGDEGHRRHILIARDDLHHRQAADRHHHRAADSLQHPRHHQLVEGAGLGAKQRSGGKQHDGGEEDIAHPDPVGQPAAGRQHHRHR

SEQ ID NO: 8151 - protein, 104 aa, Klebsiella pneumoniae
AQGAVASSSSSSQVIASSRWVRHISGEGCRLAHTFGRRGEPKIRHKLRSESWIQRVLAGLPCGMPGIGDDIEGAMQHAPQSVRHSTTRLPNAHFAPQPKRFARR

SEQ ID NO: 8152 - protein, 565 aa, Klebsiella pneumoniae
HQYLIPDNFMSVSAFNRRWAAVILEALTRHGVQHICIAPGSRSTPLTLAAAENRAFIHHTHFDERGLGHLALGLAKASRQPVAVIVTSGTATANLYPALIEAGLTGEKLILLTADRPPELIDCGANQAIRQPGMFASHPAQTISLPRPSQDIPARWLVSTIDQALGALHAGGVHINCPFAEPLYGDMDETGVEWQQQLGNWWQSDKPWLRQALQLESEKQRDWFFWRQKRGVVVAGRMSAAEGKKVAEWAQTLGWPLIGDVLSQTGQPLPCADLWLGNGKAVSELAQAQIVVQLGSSLTGKRVLQWQATCEPDEYWLVDNLPGRLDPAQHRGRRLLSSVERWLELHPAEKRQPWATVIPQLVGQAWQAAVASNEPFGEAQLAQRIRRYLPEQGQLFVGNSLVVRLIDALAQLPAGYPVYSNRGASGIDGLIATAAGVQRASARPTLAIVGDLSALYDLNSLALLRQASAPLVLIVVNNNGGQIFSMLPTPQDERRQFYLMPQDVDFSHAAAMFGLAYHRPDDWPSLDEALAGAWRRAGATVIELAVNETDGAQTLQQLLAQVSRL

SEQ ID NO: 8153 - protein, 380 aa, Klebsiella pneumoniae
VGIAMRKLCYFINSDWYFDLHWIDRAIASRDAGYEIHIISHFIDDNIINKFKTFGFICHNVTLDAQSFNALVFFRTYHDVQKIIKNIKPDLLHCITIKPCLIGGVLAKKFNLPVIVSFVGLGRVFSSDSMPLKLLRQFTIAAYKYISSNKRCIFMFEHDRDRKKLAKLVGLEEQQTIVIDGAGINPEIYKYSLEQDHDVPVVLFASRMLWSKGLGDLIEAKKILRSKNIHFTLNVAGILVENDKDAISLQVIENWHQQGLINWLGRSNNVCDLIEQSNIVALPSVYSEGVPRILLEASSVGRACIAYDVGGCDSLIIDNDNGIIVKSNSPEELADKLAFLLSNPKARVEMGIKGRKRIQDKFSSVMIIDKTLQIYHDVVR

SEQ ID NO: 8154 - protein, 494 aa, Klebsiella pneumoniae
VMIAMENNMQNLINSLAEGNKKNVYIFYFFLIMLTFSPVIFFSYAFSDDWSTFFDAITRNGSSFQWDVQSGRPVYAVFRYYGQMLINDISSFSYLRLFNILSLVVLSGFIYNFIDSRKIFDNPVFKVIFPLLICLLPAFQVYASWATCFPFTISVLLAGISYNKCFPHSKQRSSLPEKLASIVVLWVAFAIYQPTAITFLFFFMLDSCIKKESSLTVKKVATCFIILVIGVAGSFIMSKVLPVWLYRESLSRAELTADIGGKMKWFINESLINAVNNYNIQPVKIYSWFSSLAILIGLYTILVGKSGRWKTFIVIAIGIGSYAPNLATKENWAAFRSLVALELIISTLFLIGINSLVSRIFKQAFVWPLIALTIMIIAQYNIINGFIIPQRSEIQALAAEITNKIPKNYTGKLMFDLTDPAYNAFTKTQRYDEFGNISLAAPWALKGMAEEIRIMKGFNFKLSNNVIISETNRCIDDCMVIKTSDAMRRSTINY

SEQ ID NO: 8155 - protein, 414 aa, Klebsiella pneumoniae
MNKANLQVGMVAGQHVDKIDLLAADDLRQPLAVLVGQHVQVVVRQFITENIGPVGSAQNTDPYRGRSHNFAVELLVLFQALGVILRGDKNAPLIHPRQREQHRAAEDIKNDSIDDQHTDPLQHLIYRDGIDDAQGGRREAFFQHQLAETRTVAKPHPLLHPLRFALDFTFRTGQRNQRLAVIVKDRHAHRQAARRKEAFHADGLLHAQHRLQAIGHIDRRQGVKIAHPGANALAYPEQVVAALILRRVPILLYALMQDFQRLIALNRHVPQAKVGHAEVIAADEKDAVKVVGGSKIIPPVAHKPCQRLQRITPGGAHRAAVGIGVQGFKVGHRHIAVLPLRYRVPCRQAITGDILQLFHYIRGTLDIALGLIGVEIKLLMDFGFPLVQRVDDIKHRDKRNKQPQQYRQRSEQIT

SEQ ID NO: 8156 - protein, 381 aa, Klebsiella pneumoniae
LLKASQNNKGVGMNSQSQAKSPERLRAMVAGTLANFQHPTLKHNLTALKALHHVAWLDDTVHIELQMPFVWSSAFEALKEQCSAELLRITGAKAIDWKLTHSIATLKRVKNQPGVNGVKNIIAISSGKGGVGKSSTAVNLALALAAEGAKVGILDADIYGPSIPTMLGAEDSRPTSPDGTHMAPIMKYGLATNSIGYLVTDDNAMVWRGPMATKALMQMLQETLWPDLDYLVLDMPPGTGDIQLTLAQNIPVTGAVVVTTPQDIALIDAKKGIVMFDKVEMPVLGILENMSMHICSNCGHHEPIFGAGGAQKLAEKYHTQLLGQMPLHITLREDLDNGTPTVVARPDSEFTDIYRQLAGRVAAQMYWQGEVIPGEIAFRAV

SEQ ID NO: 8157 - protein, 464 aa, Klebsiella pneumoniae
CAGAAAVTFNDWPWRHWRQRRGEALALRLNNQPLTWRELCARVDALASGFAAQGVMEGQGVALRAYNQPETLLAWLALLQCGARVLPLNPQLPAVLLQALLPALTMQHQLVLNGDVLPGNLPMLTLQLVEGEHAVCWHGDRLVSMTLTSGSIGLPKAAVHSASAHLASAAGVLALMPFAAGDDWLLSLPLFHVSGQGIVWRWLLAGARLTVRDKQPLAQMLHGCTHASLVPTQLWRLLNDDAAVSLKAVLLGGASIPVELTERARKQGIRSFCGYGLTEFASTVCAKEADGAADVGEALPGREVKIVAGEIWLRASSMAAGYWRDGQLLSLTNNEGWFATRDRGALHNGRLTVVGRLDNLFFSGGEGIQPEEVERVILAHPQVQQVFIVPLDDAEYGQRPVAVVECDDGCELSALAAWSAERLARFQQPVRWLRLPETLKNGGIKISRRALCEWVRQQTHATVS

SEQ ID NO: 8158 - protein, 342 aa, Klebsiella pneumoniae
KKMALIDLYFVRKKMGKKKILFDTRWIGEHGIGRFAKEVRDSKLTIQDLKLPWKPTNPLDTILLTIYLIFKKDIYFSPGYNAPFFFLKRSIITIHDLNHIDIPYNSSFLKRIYYKFVLKRACRKALCILTVSEFSKKRICEWSGRNADEVFVVGNGVSKEFLINHPTPKKEQILMVGNRKKHKNELNALIAFYKSNIPSSVKLVFTGSITNELDIIIDRNRLRDRVSFLGTVSNTKLAELYRESLFLLFPSLYEGFGLPIVESMACGTPVIISNSTSLPEVAGGAAIIVNPDDVEDIKDKIEKLYHDAELQNKLIEKGLLNIERYTWEMTRNKFETIMNRYI

SEQ ID NO: 8159 - protein, 82 aa, Klebsiella pneumoniae
PLSAGAAATITPASVYAASTMRIASWGLACRRRIFWLPAIRKDTLRTACRSGLAARRRCCRGYLLTRRYPWKGLCAGCRRWV

SEQ ID NO: 8160 - protein, 146 aa, Klebsiella pneumoniae
PLPALICWPMPTVSSPASAIRRSNTAPGKSPWTVARSCPSACSMASAYIWRATAVGRCWLSAWPAGCATSAARTTPVRRSTCAIRWSTRSGSGWPRAMSSSASTPCWGWRKYLAATCRTTPSLSPGSAPPGNSWRRTAPARPSPAR

SEQ ID NO: 8161 - protein, 97 aa, Klebsiella pneumoniae
CSPASPVTLIAWAAEETIITPASAIKMLFFIIYSIQKIKIKEVPKNLKILLRTHQESMTWRNEFSQECNQLRIFTASSVARTTNSLFNASNIHVYYD

SEQ ID NO: 8162 - protein, 257 aa, Klebsiella pneumoniae
PDTAKDYKMNHSVSSMNTSLSGKVAAITGAASGIGLECARTLLGAGAKVVLIDREGEKLNKLVAELGENAFALQVDLMQADQVDNLLQGILQLTGRLDIFHANAGAYIGGPVAEGDPDVWDRVLHLNINAAFRCVRSVLPHLIAQKSGDIIFTSSIAGVVPVIWEPVYTASKFAVQAFVHTTRRQVAQYGVRVGAVLPGPVVTALLDDWPKAKMDEALANGSLMQPIEVAESVLFMVTRSKNVTVRDIVILPNSVDL

SEQ ID NO: 8163 - protein, 94 aa, Klebsiella pneumoniae
STAARTRLSASRGCLPPILRRRFLCRVPRRIFLPVGWSQPSTRRWGRCTPAGCILTVRSLNRCMVIWMRPAWSGSSSSATGGRATNPGCARRCS

SEQ ID NO: 8164 - protein, 251 aa, Klebsiella pneumoniae
VKAAKVAADCHKIAMAMMKNRIPLILLLNIAGVALFCSWYLPANHGAWLPVDSAIFHFFNHGVSVSHAYAWLLAIINNRAFDACSLLAMGCLMLSYWLKAPTAGRRQIAIMGLVMLLAAVIINQLAQHLMPVQRASPSLFFSDITRVSDVVNFPTKDASKDSFPGDHGMMLLIFASFMWRYFGRRALGVALIIFVVFAFPRVMIGAHWFSDIAVGSLTAVLIGAPWVLMTPLSDKLIAFFDRYLPSRISAK

SEQ ID NO: 8165 - protein, 246 aa, Klebsiella pneumoniae
AMKALREPLWWLIALFIGLLAGLPYSAPLFSRLFPELPRPVYQQESFWALTLDHGWLVVASSLAATAIGLGAGVAVTRPAGGAFRPLVETIAAIGQTFPPVAVLAMAVPVLGFGWLPALIALALYGILPVLQGTLAGLGSIPPGVSGVAEGMGMTGWQRLYKVELPLAAPVILAGIRTSVIVNIGTATIVSTVGASTLGTPIIIGLSGFNTAYIVQGALLVALAAIIVDRAFERLTRWISRHRHAQ

SEQ ID NO: 8166 - protein, 443 aa, Klebsiella pneumoniae
LRRAARRPAPEDIMMSNTLLESVVKKNRARLIPFMLALYVLAFLDRSNIGFAKETYQLDTGLSNEAYALGAGIFFVVYAFLGVPANLLMRKFGARRWIGCTTLLWGVLSAAMAWADTEAKFLLVRTLLGAAEAGFFPGMIYLTSQWFPQQNRASIMGLFYMGAPLALTLGSPLSGALLEMHGFMGHPGWFWMFVIEGLLAVAAGAFTFFWLDDSPQHARFLSAAEKQALISELAREEEKKIASRLSDALRNGRVWQLALIYLTIQVAVYGLIFFLPTQVAALLGTKVGFVASVVTAIPWVAALFGTWLIPRYSDRTGERRNIAALTLLAAAVGIAVSGLVAPVLAIIALCVAAVGVIAVQPVFWTMPTQLLSGTALAAGIGFINLFGAIGGFLAPIVRVQAETLFASSAAGLLTLAGVAIVGVVIIFSLSLTRAVPQRGSVQH

SEQ ID NO: 8167 - protein, 297 aa, Klebsiella pneumoniae
WSRATIIETLYKGELMVLLPWTPPYDWAWMVGFLQARAVAGVERFHDGGYSRSFGVEGHRGLIHLAPDEEAQGLRVTLSPGLQPVAEICYARIGQLFDLACDPRQVARTLGDLAQARPGLRLPGALDAFEQAVRAVLGQLVSVAMAARLTAKVAAGWGEPLAEAPGYVLFPTPEALSRADPQALKALGMPLRRAEALIHLARAALSGELPLTAPADIDAGLRQLQTLPGIGRWTANYFALRGWQAKDIFLPDDYLIKQRFPGMTPAAIARYARRWQPMRSYALLHIWYTDDWAPAAE

SEQ ID NO: 8168 - protein, 363 aa, Klebsiella pneumoniae
GYTYSWRPVMKPIVADTDDRRWQAVCERDTRADGQFVFAVLTTGICCRPSCRSRRARRENVRFFADVAAAVAAGFRPCKRCQPDKDYPQQQRVDKVAQACRLLEQDSPLTLEALAGQLAMSPFHFHRLFKSVTGMTPKAWQQAWRAQRLREALEQGIPVTRAALAAGFPDSSSYYRQADAALGMTASQFRRGGAATVVTWTTGDCALGRCLVAQSERGVCAVLPGDNDAALLDDLRRRFPNAELREGDPDFCQQMTEIFAHLDDSRRLVSLPLDLQGTAFQLQVWQALRQIPVGETRSYRQVAEHIGQPRAVRAVAGACAANSLAVIVPCHRVVREDGALSGYRWGTARKAQLLAREAQHEEE

SEQ ID NO: 8169 - protein, 141 aa, Klebsiella pneumoniae
AHHYSLTIRSTCMPLLTFDLIEGRTEQEVKTLLDAAHRAVLRAFEVPERDRYQIVHENKAHHMVIEDTGLGLTRTRDLVVVRVYTSPRSEAQKQRFFAILQEELAEHCGLSGDDLMVSIISNQKGDWSFGRGVAQYLTGDL

SEQ ID NO: 8170 - protein, 388 aa, Klebsiella pneumoniae
DGGYMKTDINIGVVADWFITYAGSEKVVAEFLSLFPKCELYAVVDFLSQENKLHFQNKVITTTFIQNLPKARTKYQSYLPFMPLAIEQLDVSKHDVILLSSHAVAKGVLTGPDQLHISYVHSPIRYAWDLQHQYLREAGLSKGVKALLARWILHKIRMWDSRTANGVDHFIANSNFIARRIKKVYGRNADVIYPPVDVDNFTFQEEKEEYYFTASRLVPYKRIDLIVEAFSCMPGRKLVVVGDGPEMRKIKNKATKNIDILGYQSNEAMREYMQKAKAFVFAAEEDFGITPVEAQACGTPVIAFGKGGSLETVRPYGVSNPTGILFENQDIQSIINGVDLFERVCDEISPGDCRKHAVKFSIDRFRNEINDYVLEKYNKFLDAKKINY

SEQ ID NO: 8171 - protein, 607 aa, Klebsiella pneumoniae
HGILPPMYARLLLNLLALFSQDAKAATIQESVAFAIIGEPKYAAGFSHFDYVNPRAPKGGTLTLAAIGTFDNFNRYALRGNPAVRTEALYDPLFTTSDDEPGSYYPLIAERARYAEDYSWMEIALNPRARFHDGTPITARDVAFTFNKFMTEGVPQFRLFYKGTTVKAIAPLTVRIDLGQPGKENMLSLLSLPVMPEAFWRQHKLSDPLSKPPLASGPYRISAWRMGQYITYSRVADYWAADLPVNRGRWNFDTLRYDYYLDDNVAFEAFKAGAVDRREETVAKNWATRYVGRNFSRGYIIKDEHTNTSAQDTQWLAFNIQRPIFADRRVRQAITLAFDFEWMNKALFYSAYQRANSYFQNTEYAARSLPDAAELALLTPMKNELPPELFSQVYQPPVSRGDGFDRANLLKADALLNAAGWTVKNQRRVNAATGKPLRFELLLPAGGNDRWVLPFQHNLQRLGIVMDIRQVDNSQYSNRRRSRDYDMMPSLWRAMPWPGTDLQISWASDYIHSSYNAPGVQSPVVDKLIAQILQWQGNKQKLIPLGRALDRVLTWNNYMLPMWYMAQDRTAWWNKFSFPATRPIYSSGIDTWWYDVNKAATLPADRR

SEQ ID NO: 8172 - protein, 291 aa, Klebsiella pneumoniae
EMAYVTSSIPVVNNAPLLDVRDLCVDFVNGSAVTHAVRGVSFQLGHEKLAIVGESGSGKSTVGRALLQLHPKKARVSASRMQFADLDLQHLSEAQMRGVRGKRISMIMQDPKYSLNPVVCVGKQIAEAWLTHHPGRKDEAKARALEMLEVVRIRQPERVYQLYPHEISGGQGQRIMIAMMLITDPELIIADEPTSALDVSVRLQVLGLLDDLVQSRGLGLIFISHDINLVRSFCDRVLVMYAGRVVESIAAKDLDHARHPYTQGLINSLPDMQHRRPILPVLQRQASWLTD

SEQ ID NO: 8173 - protein, 368 aa, Klebsiella pneumoniae
SILYLIPRGVTFRQTKEKVMTALTLPTKHRSLWHFVPGLALTAAMTGAALWAGSFPAIAGAGFSALTLAILFGMVVGNTVYPKIWQPCDGGVIFAKQHLLRLGIILYGFRLTFAQIADVGVSGILIDVLTLSSTFFIACFLGQKVFGLDKHTSWLIGAGSSICGAAAVLATEPVVKAEASKVTVAVATVVIFGTIAIFLYPAMYPLLAHWFTPETYGIYMGSTMHEVAQVVAAGHAVSPDAENAAVIAKMLRVMMLAPFLLFLAARVKQLTPAGNGEKSKITIPWFAIMFILVAVFNSFHLLPKAVVDMLVTLDTVLLAMAMAALGVTTHVSALKKAGAKPLLMALMLFVWLIVGGGVINVAIHSLMA

SEQ ID NO: 8174 - protein, 129 aa, Klebsiella pneumoniae
VSAYGGHCFVAGGDFPFRYRGDYRRAAVDGDVYHRLADAGLYCLLRNLLYFLLALRIPAAKNRTLGHIFRGEIAPFLMHVNRNGLQGSAICFLYVKSISVKSRIVAIKKLFWITETGTYSANRLAGYKK

SEQ ID NO: 8175 - protein, 578 aa, Klebsiella pneumoniae
KNKYPMALRLSSLRPGRPDKPKMPPSGNMYPTVQANRDMKKTSLLGACILALAMSMGSGEAVAKTPPDQLIIGMNMNNLLTLDPAAMTGNEVVGIVVNLYDSLVELDPEQLTTVRPALAKSWDISPDGKTLTFHLRDDVKFHSGNPLTAADVVWSMRRILHLNLDQASVWKSYGFSKKNIDSQVSAPDRFTVQIVLPKDNDPQLVIYSLAALGNLGVLDSKTVQSHQQDNDWGNRWLTTHEAGSGPFILETWQAKDVLRMKRNPDYWRGEAKMSRVVLRHFQESQTLRLMIEKGDLDIANNMAVSDINALRSDPQLTVDAVQRGTMYYVAMSMKEAHFANPKVREAVRYLIDYQGINKALMPGYGVLHQRPIKAGMPSTLPDPGYRLDVARAKKLLAEAGYPNGFDTTLRVLSDQPFLNIAIAVQSTLMQAGINAKIITGTGNQIYGAMRERKFDLLVGRGGSGMEPHPHSSLRALVYNPDNSDKARLTNFQGWRTGFYDPQLNTMIDQALLERDPQKQVADYQAIQTRYDQLVPALIPLSQMVDSVVVRNEVREYQPHPSATTFLRDVYKVREGEKG

SEQ ID NO: 8176 - protein, 162 aa, Klebsiella pneumoniae
SGEYGRASRPAGSPAAVRSGCAADAAAGKPVHRYPAAAWPAAARGRSSCRSGRPRRSLRPPAALRRVYRRAPGTIARCGRHREALPAHRRDPAAADARPAFPLRPGHRPASLHHSAQPASVCPAARKSPLYRCSRAKSDGRALRHASGRFFYAKRTSIGQSF

SEQ ID NO: 8177 - protein, 506 aa, Klebsiella pneumoniae
FYTLDSMQCRVHLFSPEYFPPFLSTRVDEGIMTHFSKNVSCSVALALADFVSFVLSLYLALGVLSVTLPDFHQRVPKNQIEGWIGLHWLLGACCVVWYGVRLRHYFYRKTFWFELKEILRTLAIFAVIEMAVMAFANWYFSRYAWLLTWLFAAALVPFVRMSVKYVLNTFGLWMRDTWIIGSGKNAQEAYKAINSENNLGLNVVGFISNAEDNKLGMMIDGIQVIQSDTTWIKNIDKRAQFIVAVESHQSDIRNKWLREFMIRGYRYVSVIPTLRGMPLDSTDMSFIFSHEVMIFRVQQNLAKWSSRILKRTFDIVGALGIILLLSPLLIYISRKVRKDGGTAIYGHERVGKGGKPFKCLKFRSMVVNSKEVLEELLANDPEVKAEWDATFKLKNDPRITSIGHFLRRTSLDELPQLFNVLKGEMSLVGPRPIITAELERYNDEVDYYLLSKPGMTGLWQVSGRSDVDYDTRVYLDAWYVKNWSMWNDIAILFKTINVVLKKDGAY

SEQ ID NO: 8178 - protein, 590 aa, Klebsiella pneumoniae
QQQYMVTLRQPYREKVSQMVSWGHWFALFNMLLAMVLGSRYLFVADWPTTLAGRLFSYVSLVGHFSFLVFTSYVLILFPLTFIVVSQRLMRFLSVILATAGMTLLLIDSEVFTRFHLHLNPVVWELVINPDQNEMARDWQLMFISVPVIFLIEMLFATWSWQKLRSLTRRRHYARPVAWFFFLSFVSSHLVYIWADANFYRPITMQRANLPLSYPMTARRFLEKHGLLDAQDYQRRLVEQGAPEAVSVQYPLSNLRYRDLGAGYNVLLITVDNLNYSRFEKTMPALAAFAKENVNFTQHMSSGNTADSGLFGLFYGISPGYMDGVLSARIPAALITALNQQGYQLGLFSSDGFSSPLYRQALLSDFSLPSAKTQSDEQTANQWIGWLARYAQDENRWFSWISLNGTTFDDTQQQGFVRRYSKAAGDVDAQIDRVLTALREAGKLDNTVVIITGGHGKPLNAKHDAFDWSREQLQVPLVIHWPGTPAQEIATLTDNKDVMTTLMQRLLHVSTPANEYSQGEDLFSAARRRNWVTAANGDTLAITTPTITVVLNHNGTYTTWSRDGEKIKDQKPQLSLLLQVLTDEKRFIAN

SEQ ID NO: 8179 - protein, 131 aa, Klebsiella pneumoniae
TGRYSTTAGWPTQLAPHISTSLTSIDALLRRGEKMRKKSCCYGNMLPFHEQTDFEFMPQISRYSDQQVEQLLSELTNVLESHKAPVDLSLMVLGNMVTNLINSSVAPAQRQAIARSFAQALQSSINDDPAH

SEQ ID NO: 8180 - protein, 412 aa, Klebsiella pneumoniae
DLRYFCRVTLRLPGLRLCRPGQPIPAGQYSSTGLTSMAYTTFSQTKNDQLLEPMFFGQPVNVARYDQQKYDIFEKLIEKQLSFFWRPEEVDVSRDRIDYQALPEHEKHIFISNLKYQTLLDSIQGRSPNVALLPLISIPELETWVETWAFSETIHSRSYTHIIRNIVNDPATVFDDIVTNEQIQKRAEGISHYYDSLIEMTSYWHLLGEGTHTVNGKTVTVNLRELKKKLYLCLMSVNALEAIRFYVSFACSFAFAERKLMEGNAKIIRLIARDEALHLTGTQHMLNLLRSGSDDPEMAEIAEECKQECYDLFVLAAQQEKEWADYLFRDGSMIGLNKDILCQYVEYITNIRMQAVGLDLPFQTRSNPIPWINTWLVSDNVQVAPQEVEVSSYLVGQIDSEVDADDLSNFQL

SEQ ID NO: 8181 - protein, 486 aa, Klebsiella pneumoniae
LSYLTCPMKLILNKSVLAALPLAIALAGCAPSHEVANPPQQQIPASHVSMDLPAAVKNGWPQTDWWKDYHDPQLNNLIQRALANAPDMQIAEQRIRLAEAQARMSQANLGPEMDFSADIERQRMSAEGLMGPFATDTDGNTGPWYTNGTFGLTAGWDLDLWGKNRALVKARIGELKAQVAEQAQTRELLSGSVARLYWQWQTEAAIKAVLQQVKNEQNNIVTVDKALYQRGITNSAEGAENDINVSKTDQQLADVTGTMKEIEARMMALTNSQSQSINLKPASLPTVSAQLPDTLGYELLARRPDLQVAHWYIEASLSEVDAAKAAFYPDINLMAFLQQDALHLSDLFRHSAQQMGVTAGLTLPIFDSGRLNANLDIASAQNSLSIAQYNKAVVDAVNQVAKTASQVETLMAKSQQQQQVEKDAQRVVDLAQARMAAGILPGSRVSMAKLPALQERITALRLHGQWIDASIQLTSALGGGYHQTVK

SEQ ID NO: 8182 - protein, 186 aa, Klebsiella pneumoniae
  UNSURE (26),(27),(28),(29),(30),(31),(32),(33),(34),(35),(36),(37),(38),(39),(40),(41),(42),(43),(44),(45),(46),(47),(48),(50),(51),(52): Identity of amino acid at the above locations are unknown.
SPVQDRFSTNSTTFTFECGLLCRVGXXXXXXXXXXXXXXXXXXXXXXXPXXXPLPPPPLLSPSPFLLLSSLLPSLPLFFPFPLPPPFPPPSSPPLLSPPPLLPLPLPSSPLPLPPPSPLLPSPSFPPPLPLSSPSPLLPLFFFPLLFLPLLPSSFFFSLLPFFPLLPSPLPLFLPLLPPPSPLSPL

SEQ ID NO: 8183 - protein, 65 aa, Klebsiella pneumoniae
SAVHLTASILVQLYEYIRTIFAIITIGQVAAARVVSEPEFGYSSRQPPIWAAAAMRRATADTGLL

SEQ ID NO: 8184 - protein, 817 aa, Klebsiella pneumoniae
RQNQPLYSKDSLLKYSPYSVSFIDNPLHIVFIHRVSHNGLLWINGGYFLSRTGKIHMNQSLLVTKRDGTTERINLDKIHRVLDWAAEGLNNVSISQVELRSHIQFYDGIKTADIHETIIKAAADLISRDAPDYQYLAARLAIFHLRKKAFGQFEPPALYDHVVKMVEKGKYDHHLLEDYTEEEFQQMDGFLDHWRDMNFSYAAVKQLEGKYLVQNRVTGEIYESAQFLYILVAACLFSNYPRETRLDYIKRFYDAVSTFKISLPTPIMSGVRTPTRQFSSCVLIECGDSLDSINATSSAIVKYVSQRAGIGINAGRIRALGSPIRGGEAFHTGCIPFYKHFQTAVKSCSQGGVRGGAATLFYPMWHLEVESLLVLKNNRGTDANRVRHMDYGVQINKLMYTRLLKGGDITLFSPSDVPGLYDAFFADQDEFERLYTQYEQDDSIRKQRIKAVELFSLMMQERASTGRIYIQNVDHCNTHSPFDPVVAPVRQSNLCLEIALPTKPLEDVNDENGEIALCTLSAFNLGAIDSLDELEELAVLAVRALDALLDYQDYPIPAAKRGAMGRRTLGIGVINFAYYLAKHGKRYSDGSANNLTHKTFEAIQYYLLKASNELAIEQGACPWFNETTYAQGILPIDTYKKDLDGIVSEPLHYDWEALRESIKTHGLRNSTLSALMPSETSSQISNATNGIEPPRGHVSIKASKDGILRQVVPDYENLQNAYELLWEMPNNDGYLQLVGIMQKFIDQSISANTNYDPTRFPSGKVPMQQLLKDLLNAYKFGVKTLYYHNTRDGAEDAQDDLAPSIQDDGCESGACKI

SEQ ID NO: 8185 - protein, 78 aa, Klebsiella pneumoniae
STCLIVRSYQGQISLYAEAAHLIYNLSSMLQCQIQFEKIYYLKKQFSRLEILSETFSGHLYGGHGTNYSDVNLLFSTR

SEQ ID NO: 8186 - protein, 149 aa, Klebsiella pneumoniae
EMAQLMFDSILIVCTGNICRSPIGERLLRRALPNKKIDSAGVGALIDHAADASAIRTAEKHGLSLEGHKGRQFTPALGGQYDLVLVMERSHLEQVSRIAPEVRGKTMLFGHWLEGKEIPDPYRKSDEAFDSVYQLIDIASQRWAAKLSG

SEQ ID NO: 8187 - protein, 226 aa, Klebsiella pneumoniae
TFCQKIAKLAKSACLNARARVVLRDIFDSLSDRITAMPRANEIKKGMVLNYNGKLLIVKNIDIQSPSARGAATLYKMRFSDVRTGLKVEERFKGDDIVDTVTLTRRFVDFSYVDGNEYVFMDKEDYTPYTFTKEQIEEELQFIPEGGMPDMQVLTWDGQLLALELPQTVDLEIIETAPGIKGASASSRTKPATMSTGLVIQVPEYLTTGEKIRIHIEECRYMGRAD

SEQ ID NO: 8188 - protein, 434 aa, Klebsiella pneumoniae
SVRHRLIARRVRCHSARLWRRRLRRYRAARRQTDPRPCRRPAMNDTRFESCIKCTVCTTTCPVSRVNPRYPGPKQAGPDGERLRLKDGALYDEALKYCINCKRCEVACPSDVKIGDIIQRARAQYGQQKPTLRDAILSHTDLMGTLSTPFAPLVNAATGLKPVRRLLDATLNIDHRRTLPKYGFGTFRRAYRQLAARQKQYSEQVAFFHGCYVNYNHPQLGKDLIRVVNALGTGVQLLSKEKCCGVPLIANGFFDKARKQAQSNVAAMRENTLPIIATSSTCAFTLRDEYPHLLDVDNSDLRDRVELATRWIWKQLAAGRTLPLRPLPLKVVYHTPCHMEKMGWSLYTLELLRLIPGLQLEVLDSQCCGIAGTYGFKTENYAVSQAIGAPLFRQIEESGADLVVTDCETCKWQIEMSTSKRCEHPLTVLAQALV

SEQ ID NO: 8189 - protein, 388 aa, Klebsiella pneumoniae
KRQQMKSKKILIVGAGFSGAVIGRQLAEKGHQVHIIDQRDHIGGNSYDARDSETNVMVHVYGPHIFHTDNETVWNYVNKHAEMMPYVNRVKATVNGQVFSLPINLHTINQFFSKTCSPDEARALIAEKGDSTIADPQTFEEQALRFIGKELYEAFFKGYTIKQWGMQPSELPASILKRLPVRFNYDDNYFNHKFQGMPKCGYTQMIKSILNHENIKVDLQREFIVEERTHYDHVFYSGPLDAFYGYQYGRLGYRTLDFKKFTYQGDYQGCAVMNYCSVDVPYTRITEHKYFSPWEQHDGSVCYKEYSRACEENDIPYYPIRQMGEMALLEKYLSLAENETNITFVGRLGTYRYLDMDVTIAEALKTAEVYLNSLTENQPMPVFTVSVR

SEQ ID NO: 8190 - protein, 507 aa, Klebsiella pneumoniae
RRQQYRPPSTQQEWIVKFWRPGITGKLFLAIFATCIVLLISMHWAVRISFERGFIDYIKRGNEQRLTMLSDALSEQYAQHGSWAFLRNNDRFIFQLLRTFERDNDDRSPPGHAMKPDAAPDGPPPDGPPDGPRPRPEMPPHGWRTMFWVVDQSGRVLVGPRERVPEDGTQRSIVVNGAEVGKVIASPVERLTRNTDINFDRQQKRTSWLIVALATLLAALATFPLARGLLAPVKRLVEGTHKLAAGDFSTRVTVTGGDELGRLAQDFNQLASTLERNQQMRRDLMADISHELRTPLAVLRGELEAIQDGVRRFTPESIPSLQAEVATLTKLVDDLHQLSMSDEGALAYQKTSLDIITLLEVAAGAFRERFASRQLSIQVSLPEQAMIFGDRDRLMQLFNNLLENSLRYTDSGGSLHITARRSGRMLVIDFADSAPGVSDEQLARLCERFYRAEGSRNRASGGSGLGLAICLNIVAAHGGTLRADHSPFGGVSIKVELPLEHDLPRDV

SEQ ID NO: 8191 - protein, 339 aa, Klebsiella pneumoniae
NGKHWIFKKCKQNAAQVLCRLRCSDGDAYFGSNLKQGRIGMFRLEDLTLFVRAAALGSFSDAAREAGQQPAQVSAAIKRLETILNIRLFARSTRSLRLTPEGETWLPYATQMLDTLEAGLQKIQTPDDEVRGMLQIAVPSDLGRNLLLTLFRDFRQRHPALRLRLLFSDQLTDVFKDPVDVAFRYGNNDDASFISLPVAPENRRVLVASPEWIARHGEPQTLEELSQHNALIYILRGRPFDRWSLSLDGVVQQQKVSGTVMSDDAEVIRRLAIAGEGIAYKSMLDVSDDLRAGRLRRLLPRYQGDVVPLNLICPHRKQLSAAVRLLYEEVKSHCEGLNA

SEQ ID NO: 8192 - protein, 408 aa, Klebsiella pneumoniae
ALKHVNCVILRFVPKKLATTILVFNTNNVVLAEVRPRLDLQHFQRNAARVFQAVLGANRNKGGLVLGQQELLAVDGHLAGAGENDPVLGAVVMHLHREGAARFHRNAVDVEARGLDHHVAAAPGTVNLAVALVLAALVLLEELDRLLHVLGTLTVHHQHGVLGADNHQVLHADGRHQLLVAVDVAVFAVVHPRVAAEDVTLPVFRADLPQGGPGADVAPVGIETDHHRVGGFLHHRVVHGLVRALAENVMRNADEVAAVVGGIDRGLAGFEDIRAEFGQLGKVFFGAEHKHAAVPVVLSGGEVGLGAGAVRLLHETGHLVRGVGAVGEGHSALDIAVAGFRGIRHDTEGDQMASIGILLGDTDGVVEDRLVIDDMVGGEDQHQRVLTVTGGLKSRQGDGRGGVAPDRL

SEQ ID NO: 8193 - protein, 491 aa, Klebsiella pneumoniae
NYFLYIFKVFNDNGKLCLKTKRCLEGSAWFIISNLFPAISALLIFSLASRLISPSELGTVALATTIATVLTSLCAVGFGDALIQCKEITKRHLNTVFTVCICVSLFVYVISVTLIETINLDAFTHLFRVVYPLTASKIILDSCAIVPLSYLTRTMEFKSIALRTMYCSLASFILCIPILYYGGGVWAIVVSQLTTSAVSFLILIKAANLKLRVAFHRKEFNELKKFGLTSTITKLITSISVDNLMIGFYGNAITLGLYAFSRRIFGVISDVLNNAIANVSYPLYASKQDNLNELKIIFLKTTFLSALISLPAFCGLILISPYLIPMVFGNQWEPAISVVQVCSAIGFISCIGALQMSLIKGLGHTSWILKYQIAQQVSTAILVLIFAKDGAYIVMLAIAIKTFSIWPFSMRYVSKILGVGIVDYMRNFVKPILAVSAMITVCVIIECITKDYGSLVILLSVILGGVISYILSAFLLARKETFDFIKAIKKR

SEQ ID NO: 8194 - protein, 477 aa, Klebsiella pneumoniae
FIINQSVSDKAFFVSQDLQQQTELRFLIFNFLAVAAPGGIGAVMVEDHGDGRGGDGQRIAVGRGDPVTTPRGAEQIFSLRVLIGRRRNVKQALHQRSHHIFVIGQGGNLLRRRARPVNNQRHLQLLARPVERVVFRIQRLAVAAGNNYHRIIEFAGFAQRSQHPIDLGINVACRLAVAADKALLLRVVESGAIERDPREPPILILRVTGQPADPLIGRLLVALGLRARQREIGEQRLAIQRAAKPIGGEEAQLVALLVEGGNQRGGNTRREDTVHIARRNTVEQAKQAAVGGIARAHMLGKVNVFFGKCRQRRHGLFKPRVVQVVDGDQQHVVARAEVTVAQVAKRILDRYRLRRPLLHQTTLIILGVEQAMFLKETTGGHRIGERQIRPLHSDRAIEIGVRPDIDQVAADERQKEEPGDRAGVMAAARQAAQLLPAPGSEEHFNQKDDRDADKHQLPVARHLILVRVDDQLPDDRV

SEQ ID NO: 8195 - protein, 416 aa, Klebsiella pneumoniae
CLYNVIQFTTNGIFMAHEKSDIIVSVVIPVYNAEEYIADTLKNIVSQSLYEIEIIIINDHSSDNTLDILKEIASSDERIRIIDNAVNIGAGISRNIGLSEAKGEYIIFLDDDDYVDTNMLKHMSDCAELSGADIVVCRSRSFNLQSLQYAPMPDSIRKDLLPEKAVFSPGDIERDFFRAFIWWPWDKLFRREFIIQHSLSYQDLRTSNDLFFVCASMLSAEKVTILDEILIAHTINRKTSLSSTRSVSYHCALDALVALRDFLFKNGMMQKRQRDFYNYIVVFLEWHLNTLSGEAFNKLFQDVKLFISSFDINNEDFYDEFILSAYRRIADMSAEEYLFSLKDRVLNELEDAQRNILTLQNEVEEIKQQLQQKDEMIASMNRENLAIKADNKILENYNEELKTVQTKFLKLLSSKD

SEQ ID NO: 8196 - protein, 382 aa, Klebsiella pneumoniae
KAYNKQRVNNMKVKVLSLLVPALLVAGAANAAEIYNKDGNKLDLYGKIDGLHYFSDDKSVDGDQTYMRVGVKGETQINDQLTGYGQWEYNVQANNTESSSDQAWTRLAFAGLKFGDAGSFDYGRNYGVVYDVTSWTDVLPEFGGDTYGSDNFLQSRANGVATYRNSDFFGLVDGLNFALQYQGKNGSVSGEGTSPTNNGRGALKQNGDGFGTSLTYDIYDGISAGFAYSHSKRNGDQNRLDKGRGDNAETYTGGLKYDANNIYLATQYTQTYNATRFSGNGESDSISGFANKAQNFEVVAQYQFDFGLRPSVAYLQSKGKDIEGYGDQDLLKYVDVGATYYFNKNMSTYVDYKINLLDENDFTRRAGISTDDVVALGLVYQF

SEQ ID NO: 8197 - protein, 135 aa, Klebsiella pneumoniae
VGNNPKIVGDHQVSELSLPLQFCQQVKDLSLHRHIQRRRRLIQQQHLRLKNQRSGYRHALPLPAGELMRIALAKGAVETNFIQQHIDPPVAVVDTMDLQRLFEDIANGVTGMQRSVGVLKYHLHLTAALAANFMP

SEQ ID NO: 8198 - protein, 393 aa, Klebsiella pneumoniae
LKCNRMKITISGTGYVGLSNGVLIAQNHEVVALDIVQAKVDMLNQKISPIVDKEIQEYLAEKPLNFRATTDKHDAYRNADYVIIATPTDYDPKTNYFNTSTVEAVIRDVTEINPNAVMIIKSTIPVGFTRDIKERLGIDNVIFSPEFLREGRALYDNLHPSRIVIGERSARAERFADLLKEGAIKQDIPTLFTDSTEAEAIKLFANTYLALRVAYFNELDSYAESQGLNSKQIIEGVCLDPRIGNHYNNPSFGYGGYCLPKDTKQLLANYESVPNNIIAAIVDANRTRKDFIADSILARKPKVVGVYRLIMKSGSDNFRASSIQGIMKRIKAKGIPVIIYEPVMQEDEFFNSRVVRDLDAFKQEADVIISNRMAEELADVADKVYTRDLFGND

SEQ ID NO: 8199 - protein, 266 aa, Klebsiella pneumoniae
IQRNGGHSMLAKRIIPCLDVRDGQVVKGVQFRNHEIIGDIVPLAKRYADEGADELVFYDITASSDGRVVDKSWVSRVAEVIDIPFCVAGGIKSLEDAAQILSFGADKISINSPALADPTLITRLADRFGVQCIVVGIDTWFDAETGKYHVNQYTGDESRTRVTQWETLDWVEEVQKRGAGEIVLNMMNQDGVRNGYDLQQLAKVRAVCHVPLIASGGAGTMEHFLEAFRDADVDGALAASVFHKQIINIGELKAYLAAQGVEIRVC

SEQ ID NO: 8200 - protein, 255 aa, Klebsiella pneumoniae
NISNSYDLSDEAMLSVIPAGIFSRLRIFLGRLKPHALPVARRHIVLGSIGAGTGLAVTSMFSHWLLGEVNLWFIAPMGASAVLLFGVPSSPLAQPWSIVGGNVLSALIGVTVGMLVPDAALACGLAAALAIAGMYFLRCLHPPGGAVALTAILGGAGVHSEGYHFVLTPVLLNSLMLALLAIVFNNLVGRRYPHPLAAEEVKSRAVPLGISVTREDIHAALLEGQFLDIDEDDVQELLENIEQQARQRIATAARR

SEQ ID NO: 8201 - protein, 636 aa, Klebsiella pneumoniae
SLGNIMNNSVKIYTSHHKPSAFLNAAIIKPLHVGKANSCNEICCPGDDSGDNISFKNPFYCELTAHYWVWKNEELADYVGFMHYRRHLNFSEKQTFSEDTWGVVNHPYIDEEYEKIFGLNEETIQRCVEGIDILLPKKWSVTAAGSKNNYDHYERSEYLHIRDYQAAIAIVEKLYPEYSTAIKTFNDASDGYYTNMFVMRKDIFVDYSEWLFSILDNLEDAISMNNYNAQEKRVIGHIAERLFNIYIIKLQQDGELKVKELQRTFVSNETFNGALNPVFDSAVPVVISFDDNYAVSGGALINSIVRHADKNKNYDIVVLENKVSYLNKTRLVNLTSAHPNISLRFFDVNAFTEINGVHTRAHFSASTYARLFIPQLFRRYDKVVFIDSDTVVKADLGELLDVPLGNNLVAAVKDIVMEGFVKFSAMSASDDGVMPAGEYLQKTLNMNNPDEYFQAGIIVFNVKQMVEENTFAELMRVLKAKKYWFLDQDIMNKVFYSRVTFLPLEWNVYHGNGNTDDFFPNLKFATYMKFLAARKKPKMIHYAGENKPWNTEKVDFYDDFIENIANTPWEMEIYKRQMSLAASIGLTHSEPQQQILFQTKIKNVLMPYVNKYAPIGTSRRNMMTKYYYKVRRAILG

SEQ ID NO: 8202 - protein, 61 aa, Klebsiella pneumoniae
RRCLQVLAYLVMVNQVIPTASQCKIGTYVERDIHTPEEKYEVFGHWCRRFYRLPYRAAPAE

SEQ ID NO: 8203 - protein, 309 aa, Klebsiella pneumoniae
KSANACVYGFCTMKYTALIVTFNRLGKLKKTVEETLKLEFTNIVIVNNGSTDGTQAWLSSIVDTRVIVLTLTENTGGAGGFKTGSQYICEQLASDWVFFYDDDAYPYPDTLKSFSQLEKRGCRVFSGLVKDPQGKPCPMNMPFSRVPTSLGDTVRYLRYPAEFIPAANRSMFVQTVSFVGMVIHRDLLTTSLDHIHEQLFIYFDDLYFGYQLSLAGEQIMYSPELLFYHDVSIQGKLIAPEWKVYYLCRNLILSKKIFQKNAVYSNSAIAIRILKYILILPWQRQKYSYMKFILRGISHGIKGISGKYH

SEQ ID NO: 8204 - protein, 306 aa, Klebsiella pneumoniae
PEDKIMTVSLDSPLSGGAGEGRQRLQRAAARAVGFIGKMARNPLTAIGGGIIFMLLVVAIFAPLIAPYNPLVQDLNSALVAPNAQHWFGTDEFGRDIFSRLVYGSRITLYIVLLVSVTVGPLGLLLGVSAGYFGGKVDMVLMRVTDIFISFPSLVLALAFVAALGPGLEHVVIAITLTAWPPIARLARAETLSLRQADFISAVRLQGASSARVLWRHIVPLCLPSVIIRITMNMAGIILTAAGLGFLGLGAQPPEPEWGAMISSGRTYMMECWWVVTIPGLAILINSLAFNFLGDGLRDILDPRSE

SEQ ID NO: 8205 - protein, 315 aa, Klebsiella pneumoniae
AKRKRTEGSGMKMATTWSGALALAALISLPLQAAEPVKVGSKIDTEGALLGNMIQQVLESHGVKTINKIQLGTTPVVRGAIVAGELDIYPEYTGNGAFFFKDENDPAWKNAQQGYEKVKRLDQEKHQLVWLTPAPANNTWTIAVRQDLAEKNKLTSLADLSRYLKQGGEFKLAASAEFIERPDALPAFEKAYGFNLNQNQLLSLAGGDTAVTIKAAAQQTSGVNAAMAYGTDGPVAALGLQTLSDPQGVQPIYAPTPVVREAVLKAYPQIADWLQPVFASLDEKTLQQLNARIAVEGQDAKRVAADYLQQKGLLK

SEQ ID NO: 8206 - protein, 205 aa, Klebsiella pneumoniae
HELNSCIFICQESTMHVVSRYTAAEAAATIDPRGRAIALSVVIAAGALLLIMPPVIGVTGTLSLLTALIAAFSVGWGFTRGQSWLYRSPLAATRWAFLLSAAGWLLALVAWYGGQDWPALLPGVACGGAGAAVAWRIAAGRTALPGMRVSGATVLSVAIAIAATLLTWHTAGGGRHGVCFAFAVLLDWALLGALMVRIRQQESAA

SEQ ID NO: 8207 - protein, 175 aa, Klebsiella pneumoniae
RVSLSGMVSKMRLLLAVLFCSVMLPSAYAEKLPAPTGKPVLTISGKIGNMNVGDKAVFDLAMLEKLGMKTIETTTPWYTGKVRFDGIPLSKLMDLVGAKSTSARVLALNDYTTIIPIDDFYKFPVIMALKMNGQYMRIRDKGPLFIVYPYDSSAELQNQIYYSRSAWQVSKMIIE

SEQ ID NO: 8208 - protein, 515 aa, Klebsiella pneumoniae
QGIKIAMLLPWLILIPFIGGFLCWQTERFGVKVPRWIALITMGLTLVLGLQLWMQGGYSLTQSAGIPQWQSEFVLPWIPRFGISIHLAIDGLSLLMVVLTGLLGVLAVLCSWREIEKYQGFFHLNLMWILGGVIGVFLAIDMFLFFFFWEMMLVPMYFLIALWGHKASDGKTRITAATKFFIYTQASGLVMLIAILALAFVHFNATGVWTFNYEDLLKTPMSHGVEYLLMLGFFIAFAVKMPVVPLHGWLPDAHSQAPTAGSVDLAGILLKTAAYGLLRFALPLFPNASAEFAPIAMWLGVIGIFYGAWMAFAQTDIKRLIAYTSVSHMGFVLIAIYTGSQLAYQGAVIQMIAHGLSAAGLFILCGQLYERLHTRDMRQMGGLWSKIKWLPAMSMFFAVATLGMPGTGNFVGEFMILFGSYKVVPTITVISTFGLVFASVYSLSMLHRAYFGKAKSEVAAKELPGMSLRELSIILLLVVLLVLLGFFPQPILDTSHAAMSNIQQWFVNSVSTTRP

SEQ ID NO: 8209 - protein, 425 aa, Klebsiella pneumoniae
HRSLFFYKLRTFFMPPVSDPAASGNLRPILRSPSLLTREVLAGVLTALALIPEVISFSVIAGVDPQVSLIASVVLCLAMSVFGGRPAMVTAAAGSVALVIGPMVHQHGVGYILPAVILAGIIQILFGLCGMARLMRFIPPAVMTGFVNALGILIFFAQVPHFWSRQPLIVGLFVLTLLIVLWAPRVIKAIPAPLIAIVALTLYTATTGQQLPTVGDEGSMSGGLPGFTALTVPLNLTTLQIIWPCALSIAFVGLMESLLTAKLVDDLTHTPSNKSRESAGLGIANILAGCYGGIAGCAMIGQTIVNVEMGRARSRLSTVIAGLVLLLLVTALSQVMAKIPMAVLAGVMVIVAVKTFSWRSIRPGELARNPWPETLVMLVTVAATVGTSNLAIGVLAGIVAMAIIPRRLRAKAQATLETASPDPEK

SEQ ID NO: 8210 - protein, 589 aa, Klebsiella pneumoniae
IETKKGPNSRPFFIAVGLCRFFNFRCLRLRAFQHRVCKARHQRSGNNRQQVAQHRRNRPRDQQNKQPAVRRHQFRADRHGDSAGYRATDDTARQNAHRVTGGKRNRPFRDKAQAKNQRGFAPFPLPFVELIARYQRRDTHRQRWHHTGRHDRRHRRIGLGTQQANAKGIGRFVYRPAHIGTHHRAEDRAQQNRVGGAHGLQPMGQPGEDTGYRFTDQIDHCQTHDQTGDQRNDQDWLQGFHTLRQFQLRADGFRHITGKETSDDPADKAGAAANRQHTADKARGQTRTVGNGEGDKACQYRHHQREGRAAADLHQRRRQGVFHFKRFDPEGKGERDTQAPGHYHRQHIGDAGQQVAIGARRLFFPFSSRLRFAGWLVRFGFRHRFIQLLGGFLQRQTGGGAVHRLAGEFRQVHLDIGSDDHQIRLGHLFRGDGIARPNGAAGLHLHPPAAFFGFGFDGFCRHKGVGDAGRTGGDRDNAFLPLSGGRNGYRRWRNVGLSVVFRFSQEQLRMGDSTVNIAQVNVFTIQRAIGRQRGSQHDGQFGVIRVINQLKVRFRRRGTQQGFRHVGARLSESGINNQQRFHYASPAVN

SEQ ID NO: 8211 - protein, 370 aa, Klebsiella pneumoniae
RPQKRRNAARCRPEGASMSIEDLARANVRALTPYQSARRLGGKGDVWLNANEFPTAVAFQLTEQTLNRYPEPQPKAVIESYARYAEVKPEQVLVSRGADEGIELLIRAFCEPGEDAVLYCPPTYGMYSVSAETIGVECRTVPTLADWQLDLPGIEARLDGVKVVFVCSPNNPTGQIIDPQSMRDLLETTRGKAIVVADEAYIEFCPQATLAGWLSDYPHLVVLRTLSKAFALAGLRCGFTLANAEVINVLLKVIAPYPLSTPVADIAAQALSPEGIAAMRQRVAQILDERRYLVEQLRGIACVEQVFDSETNYVLARITASSAVFKSLWDQGIILRDQNKQPSLSGCLRITIGTRAESQRVIDALTAENV

SEQ ID NO: 8212 - protein, 656 aa, Klebsiella pneumoniae
CRQNLSATPTGVVLGFFYFLLLSRRLSAGSGSKEKSMEYKALAQDILNRVGGKENIVSLVHCATRLRFKLKDNGKADAEGLKANPGVIMVVESGGQFQVVIGNHVHDVWLAVRQEAGLSDDSEPVAEEKAAKGSVLSQLIDIISGIFTPFIGVMAATGLLKGLLALAVTCGWLTPEQGTYKIWFAASDALFFFFPLFLGYTAGKKFGGNPFISMVIGGALTHPLMIQAFEASQAPGAAVEHFLGIPVTFINYSSSVIPIILASWVSCWLERKSNALLPSSMKNFFSPAICLAVVVPLTFLVIGPVATWLSHLLANGYQFIYAFAPWLAGAVLGAMWQVCVIFGLHWGLVPLMINNMTVLGHDSMLPIILPAVIAQVGAVLGIFLATRDARQRVLAGSAFSAGLFGITEPAIYGLTLPLRRPFIFGCVAGAIGGAITAFSNSYAYSFGLPNIFFPAQMIPPGGIDASVWGGLIGTGVAFVLACVLTFFAGLPRGSAAPGAVTVAPASANDILAPMSGSVIALEQVPDSTFASGLLGKGVAIIPAVGQVIAPFPGEVASLFQTKHAIGLQSDSGIELLIHVGIDTVKLDGVPFTAHVKEGDRVQAGDLLIEFDRQAILDAGYDLVTPIIISNSDDYREIDTVASSAVEAGQPLLSVSH

SEQ ID NO: 8213 - protein, 77 aa, Klebsiella pneumoniae
AIKKPKVQYVDIKYIGLIEKDERMYIDGMEKRMKLLFLIERKRKYRIVNTYIIMPNTPENAKVEYTPDSTEKPPIPP

SEQ ID NO: 8214 - protein, 181 aa, Klebsiella pneumoniae
IMKKSIFMALAGVMMVSSAAHAISVTGEAGEHYTNLGVGFGTESTGLAVSGNWLHSDNDGDAAGLGLGLNIPLGPFLATVGGKGIYTNPKQGDEGYAAAVGGGLQWKIGDSFRLYGDYYYSPDSLSSGIDSYQEANVGASWTIMRPLSIQAGYRYLNLAGKDGNRDNTIADGPYIGASASF

SEQ ID NO: 8215 - protein, 110 aa, Klebsiella pneumoniae
SPRKTEVLISRIFSYLERRRFYMKTSRFSDAQIIAILKQAESGSPVPELCREHGISSATFYKWRSKFGGMDASLMARLKELEEENRRLKKMYAEERLKAEIISEAMAKKW

SEQ ID NO: 8216 - protein, 610 aa, Klebsiella pneumoniae
FLRNIHASNCHTKRYAYPRYFAHHHKEWNMSSAPTDTHKTFLADLARLVGPSHLLTDPAKTQRYRKGFRSGQGEALAVVFPGTLLELWRVLNACVDADKIILMQAANTGLTEGSTPNGNDYDREIVIISTLRLDKLHLLDKGEQVLAWPGTTLYSLEKALKPLGREPHSVIGSSCIGASVIGGICNNSGGSLVQRGPAYTEMSLFAQIDADGKLKLVNHLGIDLGSTPEQILSRLDDERISDSDVLHDGRHAHDHDYVTRVRDVDADTPARYNADPDRLFESSGCAGKLAVFAVRLDTFPAEKRQQVFYIGTNQPQVLTEIRRHILAEFQHLPVAGEYMHRDIYDIAEKYGKDTFLMIDKLGTDKMPFFFTMKGRTDAMLEKVSLFKPHFTDRFMQKLGHVFPAHLPERMKTWRDKYEHHLLLKMAGDGIEEAQRWLTEYFQQAEGDFFACTPEEGSKAFLHRFAAAGAAIRYQAVHADEVEDILALDIALRRNDTEWFEHLPPEIDSQLVHKLYYGHFMCHVFHQDYIVRKGVDAHALKEKMLELLKARGAQYPAEHNVGHLYEAPESLQQFYRQNDPTNSMNPGIGKTSKQKYWGEAAPTPASPADPQ

SEQ ID NO: 8217 - protein, 566 aa, Klebsiella pneumoniae
SAGNISTHGRAIPASLLHFRLILSMIVVTHTAVVQVLIHMEWIADPSIWAGLVTLVVIELVLGIDNLVFIAILAEKLPPAQRDRARITGLMLAMVMRLLLLASISWLVTLTKPLIVFHDFSFSARDLIMLFGGLFLLFKATVELNERLEGKDSDNPTQRKGAKFWAVVAQIVVLDAIFSLDSVITAVGMVDHLAVMMAAVVIAISLMLMASKALTRFVNSHPTIVILCLSFLLMIGFSLIAEGFSFIIPKGYLYAAIGFSVMIEALNQLAQFNRRRFLSANMTLRQRTTEAVMNLLSGQKEKAELDADTASLVADQDQHPLFNPQERLMIERVLNLNQRSVSSIMTSRHDIERINLSAPEEEIRSLVEKNQHTRLVVTGGKDNEDLLGVVHVIDLLQQSLRQEPLDLQALVRQPLVFPEGLPLLSALEQFRQARTHFAFVVDEFGSVEGIVTLSDVMETIAGNLPNEVEEIDARHDIQHHQDGSWTVNGHMPLEDLVQYVPLPLDDKREYHTVAGLLMEYLQHVPQVGETIEIDGYTLRTLQVDSHRVQKVQIVPPVKQDELDYEV

SEQ ID NO: 8218 - protein, 235 aa, Klebsiella pneumoniae
SYTLLTKTRRRRIFCAVHKIIYRVNYTWISAVRSRDKGDAMNHVWGLFAHPNREMSVIKSENETISHHYTHHVLLMAAVPVICAFIGTTQLGWNFGDGTVIKLSMLTGLALAVLFYAVMLAGVAIMGRVIWWMARQYPQQPSLKRCMVFAGYVATPLFLSGIVALYPLVWLCALVGTIALFYTGYLLYLGIPTFLSINREEGLSFASSTLAIGVLVLEVLLAITVVLWGYGYRLF

SEQ ID NO: 8219 - protein, 799 aa, Klebsiella pneumoniae
VLLNCIARQEWVGRAYTNVGRVSVALPGKNTLDLTSAAFAAVVLDGRGQVILGVFSAITGVVIVQRFDAEFIGVEQVFEQLLHRHFSGREARRIVVSVGRDRLVDKLLHDTHQLQITVVVRHLPQQLVGVLQVFVIRHHLAQDTVLGRFDTHVAARRLNAVGGVGDLRRGLGRHQRGERGVAQAVSFNGLAQCFPVVVQGFADDAVQIFLIGIDRQDALRIGGFVEPRAGALLDSQLVRGLQQIVLNRFERFVRQVVGAAVGVAFAMLRQIVSEVDHADTQRTTPHRTAFSRRDGVILIVEQRIQSTHRQHRQLFQLVEAVDSPEVEGRQGAQCDFAVFVVDIFQRFGRQSDLQAQVRLTHRGDYRIERAVGVAVVNVLDIDAAGRGALLHHQREQLNGFNTLLANAVVLLVLGVQALKLVLIGEEGVIQARDVGRAEQGNIAALQQTGVHQLVDLYPVVHVTNAVGVGTTVVFQHQQAFHFQMPHWVEEGCRAAAYAALRAGFHRGLEMLVERNAAGVEGFAAADRAAQRANAPGVDADAGALGNVFHNRAGGGVDGIQAVAALDQHAGAELTGWGTHAGHDRRRQRDFKGGHRVVETLDIVQTRFARIVREQASGDENIEELRALINFAGDAVLYQILAFQLLNGCVGEVHVAPVVEETVHLLELFFRVVFQQMMIVFTFLDHLHHVIVERRRLKLTEGFFTQMENRQTRGEVLVIRRVAGDQIRSGFNNGFVDVRGFDAVIELDMGAQLYLGNRNVIQSFCRPIQYAMDFVEIDALGGPVALCHQQTLIHVDFTCP

SEQ ID NO: 8220 - protein, 399 aa, Klebsiella pneumoniae
AMLNVEMLSTGDEVLHGQIIDTNAAWLADFFFNQGLPLTRRNTVGDDLDALVAILRERSEQADVLIVNGGLGPTSDDLSALAAATAKGEGLILHPEWLETMTRFFAERGRPMAESNRKQAEIPASAEMINNPVGTACGFAIQLNRCLMFFTPGVPSEFKVMVEQEILPRLRQRFTLPDPPVCLRLTTFGRSESELAQSLNPLTLPPGVVMGYRSSMPIIELKLTGPANQRDAMLALWPEVRKVAGDSLIFEGTEGLPAQIARCLQERQLSLTLSEQFTSGLLALQLSRAGAPLLASEVVPAQEETLAQAARWAAERRINHFAGLALAVSGQENDHLNVALATPDGTFALRVKFSATRHSLAVRQEVCAMMALNMLRRWLNGQPLASEHGWINVVDSLSL

SEQ ID NO: 8221 - protein, 325 aa, Klebsiella pneumoniae
ETMKLAGLHPDEQRRLQSLRSSGLLNSGKEERFDRLTRLARSLYNLPVASISLVGEDLLHIKSCAGLDVDTVPRDISFCAHTILQTDPLIVNDMQQDERFHDNPLVIEAPFIRFYAGYPVQLPDGATVGSFCLMDHQPRSFSAHEMQILSDLAAIVEDEFKVLDAATSDELTGLFNRRGFLTLAEYALLTAQRRHEPVSLAFVDLDRFKHINDTWGHEEGDRALIAIADLMKAAFRESDILARQGGDEFIILFANTSRHDAAAAMETLSHNVARFNQQAAHPWQLAFSWGCVEYDPAHHPSLNALVATADRLMYQAKQKQGRERR

SEQ ID NO: 8222 - protein, 165 aa, Klebsiella pneumoniae
STVKKITTLAVSLLTAACMSAGALAADQPLEKVAPFPKAEKGMKRQVIQLPQQQDESALKVELMIGQTLEVDCNHHRLGGELESKTLEGWGYDYYVFEKLSGPVSTMMACPDGKKEKKFVTAGLGDDAMLRYNSKLPIVVYTPSNVDVKYRIWRADETIGNAVVR

SEQ ID NO: 8223 - protein, 526 aa, Klebsiella pneumoniae
YGKNLAMLTRYFSPQRKTWLTSLSVGIIVALLAGSIQFMVIYHNRAERFDAIINNVNTYLKSYFHDLRQTIDGLQPLVDQPCENIDSGLTSHAAFSPNVRAFLLVKNGIAFCSSATGAMNTPLSQLIPAIDISKPVAMAILPGTPMMPKSAALALWVGKPGDQNSGIFVSINANLTPYILYSARQNDFSGIALAIDHTAISTFSNRLVDPQTLHNAPIRQAQIEGLPLKVYLYANSWLAENTQFALLLGVVCGLLAGLLCYYVLTIKSDPRKSILLGIKNNQFYIVYQPVVNAQTLRISGVEVLMRWRHPVVGEIPPDVFINLAETQQMIVPLTHHLLALIASDAAVLKRILPRGVKLGLNISPAHLQADSFRDDMLRFAAALPADHFHVVLEVTERAMIDKEKSMANFAWLHRQGFEIAIDDFGTGHSALIYLERYNFDYLKIDRGFVQAIGTETVTSPVLDAVLTLSRRLKLMTVAEGVETQEQAEWLRGQGVHFLQGYWISRPLSLAGLVAAHDEPANYFTTR

SEQ ID NO: 8224 - protein, 469 aa, Klebsiella pneumoniae
SQEKKMKTFPTDFLWGGATAANQVEGAYLEDGKGLSTSDVQPHGVFGEVVERVPGDSGIKDVAIDFYHRYPEDIALFAEMGFNCLRVSIAWTRIYPNGDDAEPNEAGLAFYDKLFDEMAKHNITPLVTLSHYEMPWALVKNYGGWGSREVIGFFERYARTVFSRYKNKVKLWLTFNEINMSLHAPMTGVGLPAGSSKGEVYQAIHHQLVASALAVKACHELVPEGKIGNMLLGGLMYPLSCKPEDVFETLQENRSWQFFGDVQARGAYPGYMQRYFRDNGITLTITDADREALKTTVDFISFSYYMTGCVTADEALNQQARGNILSMVPNPHLASSEWGWQIDPLGLRTLLNVLWDRYQKPLFIVENGLGAKDKVEADGSINDDYRISYLNDHLMQAREAIDDGVELMGFTSWGPIDLVSASKAELSKRYGFIYVDRHDDGTGTLARSKKKSFGWYKEVIASRGASLKA

SEQ ID NO: 8225 - protein, 120 aa, Klebsiella pneumoniae
GKYLTINCRFNPVHIGHHLCMLIDIVPHCFIVSMENMGSINMYHHIRFRVACIIGISPNMITLIDNVDLMSLLSKLATDNCTREASTYDQYFFTFHLLSLLLSKNSTAYFVIIFSHHVSS

SEQ ID NO: 8226 - protein, 909 aa, Klebsiella pneumoniae
MSDLAREITPVNIEEELKNSYLDYAMSVIVGRALPDVRDGLKPVHRRVLYAMNVLGNDWNKAYKKSARVVGDVIGKYHPHGDFAVYDTIVRMAQPFSLRYMLVDGQGNFGSIDGDSAAAMRYTEIRLAKIAHELMADLEKETVDFVDNYDGTERIPDVMPTKIPNLLVNGASGIAVGMATNIPPHNLTEVINGCLAYVDDEDISIEGLMAHIPGPDFPTAAIINGRRGIEEAYRTGRGKVYIRARAEVEVDAKSGRETIIVHEIPYQVNKARLIEKIAELVKEKRVEGISALRDESDKDGMRIVIEVKRDAVGEVVLNNLYSQTQLQVSFGINMVALHHGQPKIMNLKDIIAAFVRHRREVVTRRTIFELRKARDRAHILEALAVALANIDPIIELIRRAPTPAEAKAALVAQAWDLGNVAAMLERAGDDAARPEWLEPEFGVREGKYYLTEQQAQAILDLRLQKLTGLEHEKLLDEYKELLEQIAELLHILGSADRLMEVIREELELIRDQFGDERRTEITANSADINIEDLINQEDVVVTLSHQGYVKYQPLTDYEAQRRGGKGKSAARIKEEDFIDRLLVANTHDTILCFSSRGRLYWMKVYQLPEASRGARGRPIVNLLPLEADERITAILPVREYEEGVNVFMATASGTVKKTALTEFSRPRSAGIIAVNLNEGDELIGVDLTSGQDEVMLFSAAGKVVRFKEDAVRAMGRTATGVRGIKLAENDSVVSLIIPRGEGAILTVTQNGYGKRTAAAEYPTKSRATQGVISIKVTERNGSVVGAVQVDDCDQIMMITDAGTLVRTRVSEVSIVGRNTQGVILIRTAEDENVVGLQRVAEPVDDEELDAIDGSAAEGDDDIAPEADTDDDIAEDEEIIVQGKCSGKGGVFSPALFALTLRQSRVYPLP

SEQ ID NO: 8227 - protein, 344 aa, Klebsiella pneumoniae
QRHDFVTQVGKMKKITIYDLAELSGVSASAVSAILNGNWKKRRISAKLAEKVTRIAEEQGYAINRQASMLRSKKSHVIGMIIPKYDNRYFGSIAERFEEMARERGLLPIITCTRRRPELEIEAVKAMLSWQVDWVVATGATNPDKISALCQQAGVPTVNLDLPGSLSPSVISDNYGGAKALTHKILANSARRRGELAPLTFIGGRSSDHNTSERLRGFHDAHRELGLSVPQANILAPGYSKGHVEDCLQERFGSAKTLLQGIFVNSTISLEGVVRWLSQVGLTGSEQPPMGCFDWDPFVYLLGHDIDMVQQDVSAMLDAVFSIIDAGEASQQRIEIPPRLMSSS

SEQ ID NO: 8228 - protein, 351 aa, Klebsiella pneumoniae
ITNDQKRAKACQLCQPRRECGYSPGQLRALASNLGRETMSKEDDIRLDQKVRAAWMYYIAGQNQSEIASQLGTSRPVVQRLIAAAKEEGIVSINLHHPVANCLDYAQLLQEKYRLIECNVVPAFSEESTLDSVSFGCYQLMARYLQDDKEKIIGLGSGLTLKKALQRIDFDSLNTRCVALISAMNADGQCNYYDDVPLLLTRKIKAKYYQWPAPRYAQSAEEHEMWCTNRLFRSVSGVAREADVIFVGIGPLGTQSPIFKDGFINQAQMDELTARGGIGEILGRFIDAQGDVVDSEINRMITSYDIRQSHCPRIAAACGEHKRPAILAALKGGWINGLVTDEHTARWLLTR

SEQ ID NO: 8229 - protein, 144 aa, Klebsiella pneumoniae
LYDECTSSRVITMSKSLTIIWQYLRAFVLIYACLYAGIFIAGLLPITIPGSIIGMLILFVLLALQIMPPQWVNPGCNILIRYMALLFVPIGVGVMQYWDLLRAQLGPVVISCAISTLVVFVVVSWSSHLVHGERKVIGQKGKEE

SEQ ID NO: 8230 - protein, 126 aa, Klebsiella pneumoniae
IYCEAFCFRGNQVNTQQLSIVHRLPQSYRWLAGFAGSRVEPIPQNGAQNENSLVALKLLSPDGEKAWPVMHKLSQALSDIEVDCSVLECEGEPCLFVNLQDEFAATCRLKNFGVAIAEPFSGNNPF

SEQ ID NO: 8231 - protein, 235 aa, Klebsiella pneumoniae
LPRLAVRRHPPSLSRLIRSQKFMTDMSHQCVIVGIAGASASGKSLIASTLYRELREQVGDEHIGVIPEDSYYKDQSHLSMEERVKTNYDHPSSMDHSLLFQHLQMLKSGQPIELPVYSYVEHTRTPNTIHVEPKKVIILEGILLLTDARLRNELNFSIFVDTPLDICLMRRIKRDVNERGRSMDSVMAQYQKTVRPMFLQFIEPSKQYADIIVPRGGKNRIAIDILKAKISQFFE

SEQ ID NO: 8232 - protein, 62 aa, Klebsiella pneumoniae
KTSELSCACTGREISSSRLWPILIGKMPSVLDYWGVFKHPSFVKLAWENKAIARGGGLTERF

SEQ ID NO: 8233 - protein, 547 aa, Klebsiella pneumoniae
TKAEELKMTGRLDSEVIIIGGGATGAGIARDCARRGLRTLLIERHDIATGATGRNHGLLHSGARYAVTDNESARECISENRILRRIARHCIEPTNGLFITLPEDDLAWQQTFIDACQQAGIEATPLSPQEALRREPAVNPTLLGAVQVPDGTIDPFRLTAANMLDAREHGAQILTGCEVTGLLRRGDRVCGVQVYDRQLHQARTLYAGMVVNAAGIWGQRIAEYADLRITMFPAKGSLLILDHRINNLVINRCRKPADADILVPGDTISLIGTTSMHIPYDEIDDNRVTAAEVDTLLREGEKLAPVMGRTRILRAYSGVRPLVASDNDPSGRSVSRGIVLLDHAQRDGMEGFITITGGKLMTYRLMAEWATDAVCRKLGNTTPCTTAEAPLPGSQEPTESTLQKIISLPTPLRGSAVYRHGDRTPSWLGDSRQHRSLVCECEAVTAGEVKYAVENLAVNTLLDLRRRTRIGMGTCQGELCACRAAGLLQRFNVTTPAQSLTQLSEFLNERWKGVQPIAWGDALRESEFTRWVYLGLCGLPQEHRDEV

SEQ ID NO: 8234 - protein, 330 aa, Klebsiella pneumoniae
TRREPPEDSLPGAFFWTKFGQIQTGIQRKRTMLDNTRLRIAIQKSGRLSEDSRELLSRCGIKVNLHTQRLIALAENMPIDILRVRDDDIPGLVMDGVVDLGIIGENVLEEELLSRRAQGEDPRYFTLRRLDFGGCRLSLATPVDEAWNGPAALDGKRIATSYPHLLKRYLDQKGISFKSCLLNGSVEVAPRAGLADAICDLVSTGATLEANGLREVEVIYRSKACLIQRDGEMADAKQQLIDRLLTRIQGVIQARESKYIMMHAPTERLEEVVALLPGAERPTILPLAGDKQRVAMHMVSSETLFWETMEKLKALGASSILVLPIEKMME

SEQ ID NO: 8235 - protein, 171 aa, Klebsiella pneumoniae
EEREEKEEGGEEERGEEEREEEGRKEGERRRRRRGGEGERGGERRRGGEEGKEKREGGGGEKKGREEGEKGEGEGEGKRGEEGGGGEEERGGEGRKGGEREGEEEKEKREGGREGERRGGGRGRGRGEGGGGGGKKKEKKRKKKKKKKKKKKKKKKKKKKPPPDTTNRTQT

SEQ ID NO: 8236 - protein, 178 aa, Klebsiella pneumoniae
ERRERRRRREERKKEGKRRGKKREERKEREEEGGGEEREKEEGKEEEGEKRGRRREREGGGKRRGGKKGRRGRERERGRGERKGEEGRRREEGRGGRGGKGRGKRKRKKEREGGKERGEEEEGGGGEERGGGEGERKRKKKEKKKKKKKKKKRKKKKKKKNPHPTQQTALKRECSRIR

SEQ ID NO: 8237 - protein, 549 aa, Klebsiella pneumoniae
PVMELLSLVWRQYRWPFLGVIALSLLSAALGIGLIAFINLRLITAVDTSLRVLPEFLGLLGLLMAVTLGSQLALTTLGHHFVYRLRGEFVKRILDTQIEQVEKIGSASLLAGLTSDIRNITIAFVRLPELVQGIILTFGSAAYLAWLSGKMMLVTALWMALTIWGGFVLVSRVYKHMASLRETEDKLYHDYQTVLEGRKELTLNRERAEYVFNQLYLPDAREYRHHIVRADTFHLSAVNWSNIMMLGAIGLVFWMANSLGWADTAVAATYSLTLLFLRTPLLSAVGALPTLLSAQVAFNKLRQFSLAPYRADFPRPQAHPDWQTLELRDVTFHYPDQRFAVGPLNLTLKRGELVFLIGGNGSGKSTLAMLLTGLYQPISGQILVDGQPLAAERPEEYRKLFSAVFTDVWLFDRLLGPQGEEPDPALVATWLERLQMAHKLQLENGKIADLRLSKGQKKRVALLLALAESRDIILLDEWAADQDPHFRREFYQVLLPLMQQMGKTVFAISHDDHYFQHADRLLEMRAGQLAELTGEEREQASRDAVARTA

SEQ ID NO: 8238 - protein, 374 aa, Klebsiella pneumoniae
AGADNMRVNGLTKGFFILIVFIVTLAFFDVLSPYYSAILWAAILAVIFNPVKNKIRTRLGERNGLAALMTIVIICLIVFTPLAIILSSLAYELNLVYSKLQHNDTQFPTVVASLFAHLPGWARSFLADHNLDSAQQIQQQLSDAALKGGQYLAGSAFLIGKGTFGFTVSFGIMLYLLFFLLKDGPYLVLLILESLPLSSYVKQHLFAKFAAVARATVKGTVAVALAQGALGGFAFWIAGLDGSILWGALMAFLSLIPAVGSAIIWVPAAIYLFATGQLWQGAFIVGFFVIVIGLVDNILRPLLVGKDTRMPDYLILIATLGGMEIYGINGFVIGPLIAALFIACWNLLSGREHAGNTDEIDEEFIEEAKNSRNE

SEQ ID NO: 8239 - protein, 263 aa, Klebsiella pneumoniae
RIKERIMIEVQHLNLAFGEGEKRNQVLYDVSFHVKPGEIYGLVGESGSGKTTVLKCLAGLFTHWQGELTIDAQPLGHEISRERCRQVQMVFQDPYGSLHPRHTIGDILEEPLQIHRINDRDRRINVLLDKVGLNRAFRERYPHQLSGGQRQRVAIARALILEPQVLLLDEPTSALDVSVQAEILNLLAELQREAKLTYLMVTHDLGVIAHLCQKVAVMQYGKILETLTVDALVSGQAQTAYTQMLVNASRQYTREMAREVAEY

SEQ ID NO: 8240 - protein, 527 aa, Klebsiella pneumoniae
EAEDGVMGVGHQQAVNKVFFFNARCRFAFTATTLCFVVGQRLILHIALMRQGDHHVFLVDQIFDVDISAVGGDFGTTFVAELVADQLQLFANHFHQTVGAAEDVKQLRDLFQQLFIFVEQFFMLKAGQFLQTQIQNRLSLLLGQVVFTLAHAELWLQPFRTRGVITGTFQHRRDITEIPRLGNQRRFRFSRGRRATDQFDNRVDVGQRHGQRFEDMRPVARFAQFENRTTGHHFAAVAHEGGDDVFQVHDLRLAMVQRNHVDTEGDLQLGLGIEVVEHHFPYRVALHFNHDAHPVFIRLITQRADAFHAFFFHQLGDFLDQARFVHLIRNFVHDDGFAAGFRVHFHFRARADVHFTATGAVGLFDAATAIDNGGGREIRARNMRHQPFNADVFIVNIRQTAVNHFRQVMRRYVGGHPYGDPGGAVHQQVRNFGRHDVRNTLRTVIVVDEIDRLFFKIGHQLMSDFRQTNFGITHRRGGVAVDGTKVTLAVHQHVTQRERLRHTHDGVVYREVAVRVVFTDYVTNDTG

SEQ ID NO: 8241 - protein, 406 aa, Klebsiella pneumoniae
GYRDGDGRDQRGAPRAQEQEHHEDHQRHRNHQRLLHLLQRGADGRRAVLGDLQVDSRRNGLLQLRQAGADAVHRLDNIGFRQFADHQQDRRFGVGHPGVAYVLHRIRDGGDISQPHRGAILVVDDQRLIVGGGLQLIVGLHLPAVRAVLQRPLRFAHVGVADGGAHRVQRHALVEQRLRVEVDAHRRQGAAADVDIAHAVDLRDGLRQLGGGEIIQLTLGVGVRGQRQDHDRRIRRIGFAIGRPVGHSARQQALRGVDRRLNVARRAVDIAVEVKLKNDARTAQRAGGGHLIDPGYSSQGALQRGGHRRGHGLRRGSRQRGANHDHREVHLRQRGHRQQPEAENAAQGDGQRDEDRRHRAVNEEGEKLHLRLLFLTREAALQVQRQAVEQQIDHRGGEQGQHLAEH

SEQ ID NO: 8242 - protein, 113 aa, Klebsiella pneumoniae
SRLLRSADNRHPARWRRSSAPGRAGRGSPGRRNPRWPGDSHPAPSADGYRARSPARRSHAGRRARCRPPAADGHRRTIRDPPGPAAGCYHAAPPALSCREPPRFSGSAGSPRP

SEQ ID NO: 8243 - protein, 716 aa, Klebsiella pneumoniae
SQSLSQVTIIHIWAAIYGAPTALLVISKALFTTEDVMLTMTQVAKKILVTCALPYANGSIHLGHMLEHIQADVWVRYQRMRGHEVNFICADDAHGTPIMLKAQQLGITPEQMIGEMSQEHQTDFAGFDISYDNYHSTHSDENRELSELIYTRLKENGFIKNRTISQLYDPEKGMFLPDRFVKGTCPKCKSPDQYGDNCEVCGATYSPTELIDPKSVVSGATPVMRDSEHFFFDLPSFSEMLQAWTRSGALQEQVANKMQEWFESGLQQWDISRDAPYFGFEIPNAPGKYFYVWLDAPIGYMGSFKNLCDKRGDTTSFDEYWKKDSTAELYHFIGKDIVYFHSLFWPAMLEGSNFRKPTNLFVHGYVTVNGAKMSKSRGTFIKASTWLNHFDADSLRYYYTAKLSSRIDDIDLNLEDFVQRVNADIVNKVVNLASRNAGFISKRFDGVLAAELADPALYKTFTDAAESIGEAWDSREFGKAIREIMALADVANRYVDEQAPWVVAKQEGRDADLQAICTMGLNMFRVLMTWLKPVLPQLAARAEAFLNSELSWDAIQQPLLAHKVNPFKALYNRIEMKQVEALVEASKEEVKATAAPVTGPLADDPIQETITFDDFAKVDLRVALIENAEFVEGSDKLLRLTLDLGGEKRNVFSGIRSAYPDPQPLIGRLTVMVANLAPRKMRFGISEGMVMAAGPGGKDIFLLSPDDGAKPGQQVK

SEQ ID NO: 8244 - protein, 222 aa, Klebsiella pneumoniae
MSSLSKEAVLVHEALVARGLETPMRAPVQEIDNETRKRLITGHMTEIMQLLNLDLSDDSLMETPHRIAKMYVDEIFSGLDYSRFPKITVIENKMKVDEMVTVRDITLTSTCEHHFVTIDGKATVAYIPKDSVIGLSKINRIVQFFAQRPQVQERLTQQILIALQTLLGTNNVAVSIDAVHYCVKARGIRDATSATTTTSLGGLFKSSQNTRQEFLRAVRHHD

SEQ ID NO: 8245 - protein, 416 aa, Klebsiella pneumoniae
DRKLMKGSNIRRWGAALAVVIIAGAAYWFWHDRGTSGSGTPAAGQGPQGPGGARHGRFGAALAPVQAATATEEAVPRYLTGLGTVTAANTVTVRSRVDGQLLSLHFQEGQQVKAGDLLAQIDPSQFKVALAQAQGQLAKDQATLANARRDLARYQQLVKTNLVSRQELDTQQSLVVESAGTVKADEAAVASAQLQLDWTRITAPIDGRVGLKQVDIGNQISSGDTTGIVVLTQTHPIDVVFTLPESSIATVVQAQKAGKTLSVEAWDRTNKQKISVGELLSLDNQIDATTGTIKLKARFSNLDDALFPNQFVNARLLVDTQQNAVVIPAAALQMGNEGHFVWVLNDENKVSKHSVTPGIQDSQKVVISAGLSAGDRVVTDGIDRLTEGAKVEVVTASSGEQAQPAPRQSGKHGARS

SEQ ID NO: 8246 - protein, 75 aa, Klebsiella pneumoniae
LSHCLLVQFNDLIGRPHFSESMIFDPDDSIADFFNVTHIVANKQYRHASFLKISDGLNTFSLKSDITYCQNFINN

SEQ ID NO: 8247 - protein, 620 aa, Klebsiella pneumoniae
NINCGLARRAGLFAAFAAQRAAKKCDPGRHFSFLCRASKKVFARQGMVRAFRHVWFAGMYEFDLVLLLLQQMCVFLVIAWLMSKTRLFIPLMQVTVRLPHKLLCYVTFSIFCIMGTYFGLHIEDSIANTRAIGAVMGGLLGGPVVGGLVGLTGGLHRYSLGGMTALSCMVSTIVEGLLGGLVHSVLVKRGRPDKVFSPLTAGAITFVAELVQMMIILLIARPFQDALHLVQSIAAPMMVTNTVGAALFMRILLDKRAMFEKYTSAFSATALKVAASTEGILRQGFNEENSMKVAQVLIQELDIGAVAITDRDKLLAFTGIGDDHHLPGKPISSSYTQRAIETGEVVYADGNEVPYRCSIHPHCKLGSTLVIPLRGENQRVIGTIKLYEAKNRLFSSINRTLGEGIAQLLSAQILAGQYERQKALLTQSEIKLLHAQVNPHFLFNALNTLKAVIRRDSDQAGQLVQYLSTFFRKNLKRPTEIVTLADEIEHVNAYLQIEKARFQANLQIQMAVPEGLAHHQLPAFTLQPIVENAIKHGTSQHLGVGEITIRASQDDRWLQLDIEDNAGLYRANPQASGLGMNLVDRRLRARFGADCGISVTCEPERFTRVTLRLPLEENAC

SEQ ID NO: 8248 - protein, 641 aa, Klebsiella pneumoniae
NKGWILNRILTAIILSLFVVTGYITYLVHERQSELQKFTRYTDSWSMSQMVSEYMRLESRLAGMAIGAEGADHDEVRLRLEIMMSQIELLQEGDLGKFINKSEQRKTVVATLIRNLHLLDKQVDTMTPEQVRQILPVLSELDGPLTSMAAATLTQDINIVNITHDKIQHLYYIYSVISILLIAMCITLGLLMLRQNNNLRRAHVRMKTLANDLQASKEKLQVQNRRLQYDAYHDSLTGMPNRLSFWQRLQEIVNQVRPYKGCAVVMLFDLDSFKDVNDTLGHDAGDKLLQDLASRLSFFRKTSETLYRLGGDEFAMLSYDLTEEMALERANVIREKISQPYQIYDAQINIDACIGIVISDGESRTDYLYKCADLALYEAKKEGSGHVQIFRPGMLQRLQENKSFEDDLLQALAHDEFKVYYQPIADTVTREIYGYEALVRWFHPVRGAVPPTVFIPVAEKIGLINALGEWVLKTACAEAASWATPLKVSVNVSPIQLMNTSLTDTIIEVLHQTGLDPRRLDLEITESDVFNENTRSLEILSQLRELGIQISIDDFGTGYSSLSRLSYFPFDKIKIDRSFVINIPEQKDDLDIVRLIISMGKSLHMRIVAEGVETEEQLASLQALGCDLVQGYLIGKPSPLR

SEQ ID NO: 8249 - protein, 915 aa, Klebsiella pneumoniae
PLYCQQHLLCCQLLWRYILFTNNDESFSHKMTPKKFSLIPGNISRFFILMVIVLLATMGVMIQSAVNAWLKEKSYQVVDVSHALHQRIDAWRYATWQIYDNIAATSVNTASGGLQETRLKQDVYYLEKPRRKTEALIFGSHDSSTLEMTQKMSDYLDILWGAETIPWSMYYLNGLDNSLILVSTLPLKDLSSSFKESTISSVVESRRAEMLLQANTLDERETFSPLRHLAWQNAHYFTLRTTFNQPGHLATVVAFDLPINDLIPPGMTIDSFRIEPDPSQNLATTPDKESADHIGITFNGMQIDIATDISTTGMQLLWTVPMSTMLLESMQNILLPLLLNIGLLALALFGFTTFRHYKGRSHSSGAGLPSAANSELRLLRAINEEIVSLLPLGLLVHDQEANRTVISNPIADHLLPHLNLQNITNMADQHQGVIQATVNNEQYEIRQYRSQVAPRTQILIIRDQDREVLVNKKLKQAQRLYEKNQQGRAAFMQHIGSALKQPALTLAAEAAALSSTENRTLAQHADELVKLIDDIQLANLLESDAWKTNQTLFSVQELIDDVVPIVLPVMKRKGLQLLIGNALPAGEQRYGDREALRRTLVLLIQYSVTTTPIGKITLDVCQDESASDRLTFRILDTGNGVSANEIDNMHFPYLNETQSDLYGKANALTFWLCDRMTRKLGGQLTIKARESLGTRYTLHLKMPASEEAPEAGEHLLDDVIVLLDVTSSEVRRIVTRQLESWGASCITPDDRATSQAFDLYLTDNPSNLTASGLLLSDDEVGIRKIGPGQLRVNFNISTAMQEAILQLIEQQLAEEAVQPVTSGNESNAELHASGYYALFADTVPDDVQRLYTEIEAGDFAALAQTAHRLKGAFAMLNLIPGKQLCETLEHLIREKDAQGIEKYISDIDAYVKSLL

SEQ ID NO: 8250 - protein, 362 aa, Klebsiella pneumoniae
RLDCGECMTQKYLFIDRDGTLISEPPEDFQVDRFDKLAFEPQVIPGLLKLQQEGYKLVMITNQDGLGTDSLPQEAFDGPHNLMMQIFASQGVNFEEVLICPHFPGDNCACRKPKTQLVLPWLEEGVLDKAHSYVIGDRATDLELADNMGITGLRYDRETLDWPTICEQLTRRDRYAHVERITKETQVDVKVWLDREGGSKIHTGVGFFDHMLDQIATHGGFRMEVNVGGDLYIDDHHTVEDTGLALGEALKLALGDKRGINRFGFVLPMDECLARCALDISGRPHLEYKADFTYQRVGDLSTEMVEHFFRSLSYTMAVTLHLKTKGKNDHHRVESLFKAFGRTLRQAIRVQGDALPSSKGVL

SEQ ID NO: 8251 - protein, 97 aa, Klebsiella pneumoniae
AFCCGLPGWIYVSAILFCCAHCLSSSLMYSGPLSQRIAAGLPRHSMTCSSTRLTREAGKEKSTSMHSASRLKSSITLNNRTERPSLSWSCIKSIDQQ

SEQ ID NO: 8252 - protein, 149 aa, Klebsiella pneumoniae
QVCCWLRWRCRLSLMRRIAYSPGKGAGCGRCCPGSPAFSWRRPLPGCCFAGCRAGSCRFSTCCWLNCSSRCLSGAAARRRLSSPGTARRWRAPRPAAACGCRWRFVCCWPARPSVILPSGRSGAGCSMRKSGCCPSSCSLSGRSISSPC

SEQ ID NO: 8253 - protein, 64 aa, Klebsiella pneumoniae
PPGWPAGRRWFSASPRPALPRSRSVLILALQITLEYSWSPTQNGLFVRTGLSTLPRCGGVLSIP

SEQ ID NO: 8254 - protein, 84 aa, Klebsiella pneumoniae
SLKCATDHIMNSMHSADSLREPSLTRQGPTPCGSGGIAPHATLLDEARQIKANGTPQSPVKHKDYLAALPHRACGVRRASGPTH

SEQ ID NO: 8255 - protein, 493 aa, Klebsiella pneumoniae
LNEWPPATGCRSQQSSRRLQSVRMNTVGFSSFFSLKGENPPCADFSRRAPIYILRSESMANEEMTMIRKPLALALILAALPAAAMAQHCGSLTLDVCPTPYDQTLPAAKDMLSWDQTSRVIGFRNDYRNYAGDVFRHGASTPLERAEKQLTDARYTLNGHTWNLQDYLKRENVSGMLVLKDGKVAWKYLAEGNTDTTLWTSRSVGKSVVSTLVGIAIQQGKIHSLDDLITVYEPELKGTAWDGVTLKQLIQHTSGVEWNEDYTDPQSHFARLTQCEAQPGAYACVRKIVTGLARQHPAGEQWSYSSGGAWLLGDILERATGMSLAAWLEQALWQPAGMAHDGVWHAYQQGKHDVGAHGFNATLEDWGRFGEFVARDGRLSNGKQLVPTGWFDQAASWTKALNSVSAAHPEGIYGYQWWNNAIPANAQNVQPTPQEGLKGSLWALGIYGQVIMVNRAEHLVIVQWSTWPQAEPSFNAQPLEAALMYSAIARELR

SEQ ID NO: 8256 - protein, 221 aa, Klebsiella pneumoniae
ARQWTSSKDHRYMNWQLISFFGDSTVLLPSAAALFIVLMLRKTSRLLAWQWSLLFGITGAIVCASKLAFMGWGLGIRELDYTGFSGHSALSAAYWPIFLWLLSARFSAGLQKAAVATGYILAAVVGYSRLVIHAHSVSEVIAGLLLGAAGSALFLILQKSTSDSVYKTIPWGGVACLIMVPLVLLHSGSKAPTQSLLGQIATVIGPLDKPFTREDLHKQAW

SEQ ID NO: 8257 - protein, 169 aa, Klebsiella pneumoniae
TVFRLQFTEAARKLFHQHTAPSLCRRKPMRHRTIVCPLIENKGHYLLCKMAADRGVFPGQWALSGGGVEPGERIEEALRREIREELGEKLILTHIAPWCFRDDTRVKTYPDGHQETIYMIYLIFNCVSANRDVTINEEFDDYAWVKAEDLKNYDLNAATRVTLSLKGLL

SEQ ID NO: 8258 - protein, 355 aa, Klebsiella pneumoniae
RNLRLRDMTFFRPALLGACVLFSGWVSATTPATPTATATVLDGKTMGTFWRVSVIGVDEAKAQTLRAKVQAQLDADDRLLSTWKNDSALMRFNHAATTEPWPVSEAMADIVTLSLRIGAKTHGAMDITVGPLVNLWGFGPDKQPVTTPDAEAIAAAKARTGLQHLQVINQSGRQFLQKDIPDLFVDLSTVGEGYAADHLARLMEQEGISRYLVSVGGALVSRGMNGEGKPWRVAIQKPTDRENAVQAIVDINGHGISTSGSYRNYYELDGKRISHVIDPQTGQPITHKLVSVTVIAPTALEADGWDTGLMVLGPEKAQQVVREEGLAVYMIVKDGEGFKTWMSPQFRTFLVGEKN

SEQ ID NO: 8259 - protein, 463 aa, Klebsiella pneumoniae
PSSRNFSMNAGRACSPSPGAMRCAKANSPAGSTSACADCHRSTGMKFDCAIIGGGLAGLLCGLALNQHGLRSVIISRGQSALHFSSASLDLLSALPNGDNVTDVAQGLQQLAEQLPEHPYSRLGAEAVLEYATQTEALLAACGAVMQGDARRPHRRVTPLGTLRPAWLSPLEVPVAPLPSQGACLVGISGFADFQPHLAAAALGQHGVTAAAVEIELPLLDVLRDNPTEFRAANIARVLDDENMWPALHAALLPLAQQYDLLIMPACFGLADDRLYHWLQARLPCPLRLLPTLPPSVPGMRLHSQLQRQFIREGGAWLAGDEVVKISHRQDAVEAVWTRNHGDIALRPRFTVLASGSFFSNGLVATRDSVREPILGLDLHQTLPRESWYQRDFFASQPWQRFGVKTDALLRPLLGGQPFHNLFAIGSLLGGFDAIQLGCGGGVCAVTALHAARQIHALAGGRP

SEQ ID NO: 8260 - protein, 381 aa, Klebsiella pneumoniae
VIGRLTQPEQRRDAGGDAAGNLPCRAGRSARVSAGTRFSFSLPVRRARREVSRHRADARGGSPSYSPCRTQRAPGQPGGGDCLSGADSGKLTEGHSMISLDEAMLYAPVEWHDCSEGYTDIRYHKSTDGIAKITINRPQVRNAFRPLTVKEMIQALADARYDDNIGVIVLTGEGEKAFCAGGDQKVRGDYGGYQDDSGVHHLNVLDFQRQIRTCPKPVVAMVAGYSIGGGHVLHMMCDLTIAAENAIFGQTGPKVGSFDGGWGASYMARIVGQKKAREIWFLCRQYDAQQALDMGLVNTVVPLADLEKETVRWCREMLQNSPMALRCLKAALNADCDGQAGLQELAGNATMLFYMTEEGQEGRNAFNQKRQPDFSKFKRNP

SEQ ID NO: 8261 - protein, 154 aa, Klebsiella pneumoniae
PGGRLQRNDHRHHRHRRLLYFSGSGDAVSNVACAFARRRRGMIAIATIPASTPIARLLVPTVAATVTSITSVSGHGLRASSPGRMLRQLKVFTATITITPARTAIGIFAITWLSAVTSRSSTRPAITVERRLRARPISTFTIVWPIIAQPAMPP

SEQ ID NO: 8262 - protein, 284 aa, Klebsiella pneumoniae
DHLRGDGKKVVTPSARREMATKAVAHYAISIRLACQVFKVSEGCYRYQPVLADENQEIADWLLRLTANQRNWGFGLCFLYLRNVKGFGWNHKRVYRIYRALELNLRIKPKKRLVRAKPEPLAVPDQPNHCWSMDFMHDQLSDGRSVRLFNVIDDFNREALCIEVDFSLPASRVKRVLEQVIEWRGKPAAIRCDNGPEYISEELKQWAQQKRIALTYIQPGNPQQNAYIERFNRTVRYDWLGHYLFESLNELQEFATNWLWVYNHERPNMALGGYTPKQRLAQAA

SEQ ID NO: 8263 - protein, 438 aa, Klebsiella pneumoniae
RSIRSGLNVQTHHRLGIGRAQVKAPLRVFNTDTVRCVDVCGRRLILRPDARYRLRRISQLAVDLPRRRERRLAVRHQRFQRTVLQTQQLRHQQPRDHPAVAVGEVAEVMVRTHFPAVDGVFLAHPLLDERMPRLRHHRLAAAAGHDVHRVPRQTRVVNDFRPRLLLQERLRQQADNVVPLDKRRLVIEQEAAVEVAVKGDPHVRLMRTHRVGGVLAALRQQRVRDTVREMAVRLVMHLDKGHRRPGRREAFLHFINHVPRRPVAGVHHQLQRTGEVRQVHVAHQVVDVLLQHRYLAQGPATRRVHRRELVLLRQALDIPQAGVAADGLRVLAHQLHAVVVHRVMARRHLDTAVHPEVESGEVNLFRAAQANIQHVGAGVHQPAGQRQLQRLAGEAHIAPHHYLPGFQKFAVGAADTVGDVLVQLLAQFTTDVISLKAC

SEQ ID NO: 8264 - protein, 304 aa, Klebsiella pneumoniae
FAYRKGVAMKPLLDVLVILDALEKEGSFAAASAKLFKTPSALSYTIHRLESDLNIQLLDRSGHRARFTPSGQMLLEKGREVLHIARELENRAVKLQQGWENSLRLAVDSTFPVALLSPPIAAFYQQQPLTRLHFTLNPSLLDWRPLTDGQADLLLGALGEPPPLSGYDYLPLGELELLLVVAPQHPLARHRAPLSWRTLRRYRAVATGEGGALLSDQETLTVCDAAGQLALLRLGLGWGCLPRYQVQGLLDSGELVCMTVRGLSPRQRAWIAWNDATCGLAGKWWRETLLANSAIFTIYHTETV

SEQ ID NO: 8265 - protein, 76 aa, Klebsiella pneumoniae
FIHRINLIKAPADTTIFCFFKLKVDITPDIGRGSARRRGGYPDISQPSFHNSSIFTAPSLTKLVSFSETLQDETVN

SEQ ID NO: 8266 - protein, 96 aa, Klebsiella pneumoniae
SRCRRSEQLPAVMKRIFLKISDTRLECQDEHPSLLAALESHNIDVEYQCREGYCGSCRTRLVSGQVDWLTEPLAFIQPGEILPCCCRAKGDIEIEM

SEQ ID NO: 8267 - protein, 406 aa, Klebsiella pneumoniae
TPRRLLKLQKTKPMENRSAALPRRGFDVTSSAFLIVAFLTGIAGALQTPTLSLFLTNEVHVRPAMVGFFFTGSAVIGILVSQFLAGRSDRQGDRKQLIVVCCLLGVLACVLFAWNRNYFILLFIGVFLSSFGSTANPQMFALAREHADRTGREAVMFSSILRAQVSLAWVIGPPLAYALAMGFGFTAMYLSAAAAFIVCGIMVWLFLPSMRKAKPVATGRLEAPRTHRRDALLLFSICTLMWGTNSLYIINMPLFIINELHLPEKLAGLMMGTAAGLEIPTMLIAGYYARRFGKRFLMRLSAVAGVLFYVGMLTVHTPALLLAMQVLNAIYIGILAGIGMLYFQDLMPGQAGAATTLYTNTTRVGWIIAGSLAGVVAEIWSYHAVFWIALAMGVVTQACLWRIRDV

SEQ ID NO: 8268 - protein, 199 aa, Klebsiella pneumoniae
VARRPAASARRSPDRRHGTTAATAASHLLRQTASAPARQPRWPDGRWRYVPPLSAGRLNRRSTSSTPTDRHASKQHARPRPTAGLTSVNSPATHRHSAPADAAWLTRVTTPAATPLAAADSAAAPAPRTAAAPAMPAEFPAGYRPGAPRPALPLRPARQNQTPARQPARIAPARSAAGYSDVRRGPLRAADANAARASR

SEQ ID NO: 8269 - protein, 447 aa, Klebsiella pneumoniae
SASRSRDTQGNTIMSFNTIIDWNGCSADQQQQLLTRPAISASDSISKTVTEILNNVKANGDAALREYSAKFDKTTVAALQVSEAEIAAAGERLSDELKQAMAVAVKNIETFHNAQQLQAVDVETLPGVRCQQVTRPIASVGLYIPGGSAPLFSTVLMLATPARIAGCQQVVLCSPPPIADEILYAAQLCGVKTIFNVGGAQAIAALALGTESVPKVDKIFGPGNAYVTEAKRQVSQRLDGAAIDMPAGPSEVLVIADSGANPDFVASDLLSQAEHGPDSQVILLTPDADMGSRVAEAVERQLAALPRAETARVALSASRIIVARDLAQCVAISNQYGPEHLIIQTRQARELVDSITSAGSVFLGDWSPESAGDYASGTNHVLPTYGYTATCSSLGLADFQKRMTVQELSRDGFAALASTIEILAAAERLDAHKNAVTLRVAALKEQA

SEQ ID NO: 8270 - protein, 312 aa, Klebsiella pneumoniae
MSRRVATITLNPAYDLVGFTPEIERGEVNLVRTTGLHAAGKGINVAKVLKDLGIDVTVGGFLGKDNQDGFQQLFSELGIANRFQVVQGRTRINVKLTEKDGEVTDFNFSGFEVTPGDWERFVNDSLSWLGQFDMVCVSGSLPSGVSPEAFTDWMTRLRSQCPCIIFDSSREALVAGLKAAPWLVKPNRRELEIWAGRKLPEMKDVIDAAHALREQGIAHVVISLGEEGALWVNASGEWIAKPPSVEVVSTVGAGDSMVGGLIYGLLMRESSEHTLRLATAVAALAVSQSNVGITDRTQLAAMMARVDLQPFN

SEQ ID NO: 8271 - protein, 365 aa, Klebsiella pneumoniae
QYLRLCGQNSLLSASGLLFSPFFRQDRRNCYNITFILEKRVTRTNLITGFLGSGKTTSILHLLAQKPADEKWAVLVNEFGEVGIDGALLADSGALLKEIPGGCMCCVNGLPMQVGLNTLLRQGKPDRLLIEPTGLGHPKQILDILTAAVYEPWIDLRATLCILDPRQLLDERAVSNDNFRDQLAAADIIVANKSDRETPESARALADWWQRWGGERRKVSAIQGNIDLTLLDEPRRNTAPLPASAEHAHRHSPTSGLAALSLAEHQRWRRHLNNGQGYQGCGWIFDAETVFDTIGLLEWARLAPVGRVKGVMRIAEGAVRINRQGEDLHIETLSVAPPDSRIELISANEADWNALQTSLLRLRLS

SEQ ID NO: 8272 - protein, 399 aa, Klebsiella pneumoniae
NVTLKQNSSLGIVFILGLLAMLMPLSIDMYLPALPVIAAQYNVPDGSAQMTLSTYILGFALGQLLYGPMADSLGRKPVILGGTLVFAAAAVACALSQTVDMLIVMRFFHGLAAAAASVVINALMRDIYPKDEFSRMMSFVMLVTTIAPLVAPMVGGAVLVWFSWHAIFWILALVALLASLMIGLFIRETLPAERRQPFHLRTTLGNFATLFRHKRVLSYMLASGFSFAGMFSFLSAGPFVYININHVAPQHFGYYFALNIVFLFLMTMFNSRFVRRVGALRMFRAGLWIQFAMAVWMVVCALLDVGFWSLVIGVAAFVGCVSMVSSNAMAVILDEFPHMAGTASSLAGTFRFGIGAIIGALLSMATFTTAWPMLVSIAFCATCSIFFSLYASRRRKIAR

SEQ ID NO: 8273 - protein, 154 aa, Klebsiella pneumoniae
FSLRPATGRSHAGRPGAGAAGAAPAGGAGCLRAGGARGAGPAGERGDGRPAHRQSGGWLGRTAGGGAWICLVPDARGAVPCRSAGAEGAGDAAATRGGADPPRPGGAQRRAAPDGAGGYRRRAASTANPARDWPLDGKLLCPARLAGERYLFAG

SEQ ID NO: 8274 - protein, 316 aa, Klebsiella pneumoniae
DASRRTRERCLAFRAAGDDFIRHITRRFRVMVELHAVGSPSLRHRAQRGGITKHLRQRHVGADDLAAEALFHPLHHPATGREIAHNIPGVLFRRLHLDVHHRLKDHRVRFARALPEAEDRRHAERHLRGVHVVVRPEGQGRFHVNHRITRQHAGAHRFAQPFLHGRDVLARHHAAFGGVLEDETAARLQRLQGQHDVAILPFAAGLAHKFAFHVRHFLAQGFAVGDLRTANVGLDAKLALHPVDNDLQMQLTHAGDNRLAGLFIGMQTERRIFRRQPLQRDAHFLLVRFGLRLNRQRNHRLRKLHPFEGNHRIRIA

SEQ ID NO: 8275 - protein, 152 aa, Klebsiella pneumoniae
HHALFSLPRIYAMAVYHHALVLINSSQDGVPLLQHAARMAEENGMRITIAHISTDYRALNYVSDSLRDDRVSQEVIQAKALLNELACTVSLPVDTLSLVTTRRFEDVETCVRQRQIDLIIAGHHNRLLGVLSSHSLEYINHLNLDVLIKHLP

SEQ ID NO: 8276 - protein, 342 aa, Klebsiella pneumoniae
YQTRSGPGSANQARQGKLSRPALNIFYTVTGITFLCGRHSCRPPSAFSPGTGLQAGYPERGVCNMAFVTTQDGVNIYFKDWGPKEAQPIVFHHGWPLSADDWDNQMLFFLAEGFRVIAIDRRGHGRSDQVSEGHDMDHYAADVSAVVEHLDLHNAVHVGHSTGGGQVARYVARYGQPQGRVAKAVLISAVPPLMVKTEQNPGGTPIEVFDGFRKALAANRAQFYLDVASGPFYGFNRDGAEISQGTIQNWWRQGMIGSAKAHYEGIKAFSETDQTEDLKSITLPVLVMQGDDDQVVPYKNAAILQDKLLPNSQLKIYPGFPHGMHTSHADTINADLLAFIRA

SEQ ID NO: 8277 - protein, 284 aa, Klebsiella pneumoniae
SAQRKSQEPGMKKVAIVGLGWLGMPLALSLTARGWQVTGSKTTQDGVEAARMCGIDSYPLRLEPQLVCDTEDLDALMNVDALVITLPARRTGAGEGFYLQAVQEIVDTALAYHIPRIVFTSSTSVYGNVNGTVKENSPRLPQTASGQVLKELEDWLHNLPGTSVDILRLAGLVGPSRHPGRFFAGKSAPDGQHVVNLVHLQDVVAAIELLLQAPKGGHIYNLCAPRHPARGLFYPQMARELGLPPPVFSDSPDGGQGKIVDGNRICNELGFEYQYPDPLVMPME

SEQ ID NO: 8278 - protein, 431 aa, Klebsiella pneumoniae
HRQRVNGREYQTKGGDDGDRRHHFIAAEQDHKFADEVTGARHPQGGDSEEHRHRRQPFNFAPQAAHLAHIAGVQTFVQLAAQNEQTRRGQTVSNHLDHRSLIGQLAAGVDSNQHEAHVGHGSVGDQAFNIGLGEGHPRAVEDTDHAQPHGDGCKLGGGIREQRQRKAQQTVGGGFQQDPREVDRAGGRRLGVSVRQPAVQRHHRHFHREGDEEAEHQQVFHAVRHWGFQQIFIVEGPHAGGVEVDEGQRQNGNQHHQTARLGIDEELGGRCDTRFTVRGFVAPQRDQEVHRHQHHFPEEEEQEHVDGEEHADNAAQDPHQVEVEEALVFFDFTPRTEHRQHAEETGQHHHQQRQAVDRQMDANAEAWDPRQHEFRLPLRNTRGLRQRIAALHPQLQAKHQRQSHGNQRDPARHFHAKAFGLPAQEAADKGN

SEQ ID NO: 8279 - protein, 135 aa, Klebsiella pneumoniae
VSKRPRTVSCARWCRITKTCRTPTSCCGRCRTTTVICSWWVSCRSLSTSRSLPTLTTIRRASRPEKCRCSSCSKTCSTPINSASKRCTITTPVMALKTPRMTWPRPSRTTAAKAALVRSKVFLPGNATLTRPTFV

SEQ ID NO: 8280 - protein, 271 aa, Klebsiella pneumoniae
LLWRAVPPGALRERRGAAAEKLPGDVMIIPALDLIDGTVVRLHQGDYGQQRDYGSDPLPRLQAYAAQGAEVLHLVDLTGAKDPAKRQIPLLKSLVAGVDVPMQVGGGVRTEADVAALLEAGVARVVVGSTAVKSPEEVKGWFKRFGPERLVLALDVRIDADGNKQVAVSGWQENSGVTLEELVESYLPVGLQHVLCTDISRDGTLAGSNVSLYEEVCARYPQVAFQSSGGIGDLNDIAALRGTGVRGVIVGRALLEGKFNVTEAIQCWQNG

SEQ ID NO: 8281 - protein, 332 aa, Klebsiella pneumoniae
PVWRHRWFSGADRARAGRNVVRQQRRRTVNPGRRRHCRGGHYLFIEPYPRGTPARQRTALNKGIAMNALLSNPFKRGLLRGETQIGLWLSSTSSYMAEIAATSGYDWLLIDGEHAPNTIQDLYHQLQAIAPYASQPVIRPVEGNRSLIKQVLDIGARTLLVPMVDTAEQAREVVSATRYPPIGSRGVGAGVARAARWGRVENYMAEANDELCLLIQVESRTALENLDAILEVDGIDGVFIGPADLSASLGYPDDAGHPDVQRVIEQSIRRIRAAGKAAGFLAVDPAMAEKCLAWGANFVAVGVDTMLYTQALDRRLAMFKSASAQPQEKTSY

SEQ ID NO: 8282 - protein, 139 aa, Klebsiella pneumoniae
YSRRTLPASPPRRASPAQGSPGPLCARPPGSRRSPPCGTPSPRSPRRGTTRRSGSLSRQPPDNPPARRCPSLRAALSPRKGCTRAAPRRLWWRPRRRNRCPAPAAPGSARRGHTALCRRTGAQICLPRPSLSCAGFRGR

SEQ ID NO: 8283 - protein, 187 aa, Klebsiella pneumoniae
HPRRYRTQPGQRPLQHRQYAIQREGYQRRQPAKAQHRHRHRQHRHRRKGLPDSGDGLHQRTKRAAGGPGDRHPSPQPDCRCREAGRHHQPAVIESERPEALLLVDRPRQLREQPTEQRRAVGQPCQQADKQRDKPPQRLTKRLHGSSPDAADRQNAAYRRACLRHRPPAASRSAGRQTATALPAGSW

SEQ ID NO: 8284 - protein, 269 aa, Klebsiella pneumoniae
DRRRADPSAAAGAGKSPVILSAAVDNGQPGYPWLVFLHGFSGDRNEWRKVGDAFPAWPRLYLDLPGHGGSADIAVQDFAGVNTLLQSTLNSYSIHKYWLIGYSLGGRVAMNFASQPRAGMRGLIVEGGHPGLQDVEARQVRRSNDRAWAERFHREPLEQVFADWYQQPVFASLNAVQRESLVALRSRNNGATLAAMLQATSLAAQADLRASLQARDFPFHYLCGERDAKFRAIAQTLAADLHLIHHAGHNAHRDNPAAVIACLAQILAS

SEQ ID NO: 8285 - protein, 401 aa, Klebsiella pneumoniae
LTQLVGATKTPLIIEHFFPHLPVLPLHAGDDKVRMAQQRLLGHDIRRRYPAQRHPGGAGMRANKQLFEGGALGGGLQTEALTDIRPVFIVVGDFQPRALLVAAVLQGHAAAAQHQRVLQFQRRLQHIVRVNQYSVALPAAAGGDVVFRITLRAVFKAKAEVALFAVAVVIFEPPLAAAAKVFNQGAVGGGFAPEGIGEAAGRAEDLHRHVVAFALRRPHFRGIQVMRIAGVVEDQTVGFPRRQAQTAANDLLVKTHRLGGAEDGDQVDVRGVEAGGQHRDVHQIAIRLRFKGLDDAIPLRPRRFAGDQRRLAYRQQAGHFPGVFHGGGKDHHPFAVFGELHDLADDMRRDTLLFFQLMVKIGFAEQAVALRLQATEIVLHHRHIEALRRRQIAVFNHIAQR

SEQ ID NO: 8286 - protein, 194 aa, Klebsiella pneumoniae
GEKLFMDINHLISQYGYAALIVGSMAEGETITLLGGVAAHQGLLKFPLVVIAVALGGMIGDQLLYLVGRRFGGRILRRFASQKARIRKAQRMIQHRPWLFVIGTRFMYGFRVIGPLLIGASRLPPRIFLPLNIVGALVWALLFTTIGYLGGEVVGPWLHHLDAHLKHWIWLILAVVVVVAAHWWLRRRESKKKD

SEQ ID NO: 8287 - protein, 71 aa, Klebsiella pneumoniae
VQNRADRSSPPRIQANMSSYPAVYAEIYCLAKFIISIYSFQAYARRGGAGGQQTPIDGPLSHIARRKGTSR

SEQ ID NO: 8288 - protein, 181 aa, Klebsiella pneumoniae
QRISDSGKLRRFAGIDHHRRRGADGQQNIGGKGLHHVISHAVHKGGMGAQQMAQVRDRRGIQQLRHSLLPPDEVEAMTLRSLTSLRWHYPDQVVRVFLSLQRRRAPRVKIVKLLSVVEFTATHRFIQQAFSPGYDTFAAIMLFRRPGGIAFRCWRAENNDIMRYLAYRGYTPWPFITMRWY

SEQ ID NO: 8289 - protein, 118 aa, Klebsiella pneumoniae
LSTSSSSVTPEFSCQPLTATCLLPSASIRTSRASTSRSGPKRLNQPFTSSGDFTAVEPTTTRATPASSRAATSASVRTPPPTCIGTSTPATSDFSSGIWRFAGSFAPVRSTRCRTSAP

SEQ ID NO: 8290 - protein, 514 aa, Klebsiella pneumoniae
PRTSPPLFRLAPSTAWKTRAAFRWKCWRSSRGRTSARTTLFVLKTSMVVANFFGTKRRMTQLTCFKAYDIRGELGEELNEDIAYRIGRAYGEFLKPGKIVVGGDVRLTSESLKLALARGLMDAGTDVLDIGLSGTEEIYFSTFHLGVDGGIEVTASHNPMNYNGMKLVRENAKPISGDTGLRDIQRLAEENQFAPVDPARRGTLRQISVLKEYVDHLMGYVDLANFTRPLKLVVNSGNGAAGHVIDEVEKRFAAAGAPVTFIKVHHQPDGHFPNGIPNPLLPECRQDTADAVRAHQADMGIAFDGDFDRCFLFDDEASFIEGYYIVGLLAEAFLQKQPGAKIIHDPRLTWNTVDIVTRSGGQPVMSKTGHAFIKERMRQEDAIYGGEMSAHHYFRDFAYCDSGMIPWLLVAELLCLKNSSLKSLVADRQAAFPASGEINRKLGNAAEAIARIRAQYEPAAAHIDTTDGISIEYPEWRFNLRTSNTEPVVRLNVESRADTALMNAKTEEILALLK

SEQ ID NO: 8291 - protein, 407 aa, Klebsiella pneumoniae
GWRSRYQGSPHSLQHPFGRRQGIALDADRLAQRTAKGFEQALHAVVIVLTLGFQVQGHRHGVGERAEEVFHHLGAQIADALIGEVRLILQVRPAGDIQRAAGETLVHRQHEAEAVNAALVAKRQLQGFAEGQAGILHRVVIVDVQIAADVNLHAEAAVGGDLVEHMVKKADAGMDLAAAFAVQPHFHIHLGLFGDALDVGIAVAAGQLLADGRPVERLAVIAQTGNSHVIRQLKVGGPVANHIAVGFIQHALFQPRQHQLRFWLAAGAVVAREVRTNQHLFKVNALRGEDLHHQVVRAIKRFLRQTVGSQAILIGDHHQLIAFLLQLQQPRDHLRLKRQLVEPVHLEILRRFGNQGAVTVNKEILLGHTFSAVKASITRWLSARVPIVIRKQPLNEGCLFWSRKIMP

SEQ ID NO: 8292 - protein, 260 aa, Klebsiella pneumoniae
ARSRSCYSAGVGLQLLRQAKPDHLAFRRGSGFFVSGVYMQIAKVLNNNVVVVLDEHRREQVVMGRGLAFQKRPGDVLDDSKIEKVFALQSDELVGRLGELLSQIPLEVMTTCDRIIDLARGRLGKLQESLYITLTDHCHFAIERQKKGIALRNVLLWEIKRLYPKEFALGQEARAIIAKRLGVKLAEDEAGFIALHLVTAQLNSEMPEVMHVTRVMQEILQLVKYQLQPYYDEESLSYQRFVTHLKFFAQPMLTAHGDGR

SEQ ID NO: 8293 - protein, 457 aa, Klebsiella pneumoniae
KTARATEADMLSIFKPAAHKARLPAAEIDPLYRRLRWQIFIGIFFGYAAYYLVRKNFALAMPYLIEQGFSRGDLGFALSGISIAYGFSKFIMGSVSDRSNPRIFLPAGLILAALVMLVMGFVPWATSSIMIMFVLLFLCGWFQGMGWPPCGRTMVHWWSQKERGGIVSVWNCAHNVGGGIPPLLFLLGMAWFNDWHAALYMPAFGAILLAIFAFAMMRDTPQSCGLPPIEEYKNDYPDDYSEKHEEELTAKQIFMQYILPNKLLWYIAIANVFVYLLRYGILDWSPTYLKEVKHFALDKSSWAYFLYEYAGIPGTLLCGWMSDKVFKGNRGATGVFFMTLVTIATVVYWLNPPGNPGVDMACMIIIGFLIYGPVMLIGLHALELAPKKAAGTAAGFTGLFGYLGGSVAASAIVGYTVDFFGWDGGFMVMIGGSVLAVILLVIVMLGERRHHQQLKQA

SEQ ID NO: 8294 - protein, 341 aa, Klebsiella pneumoniae
DQGLHMSALNKKSFLTYLKEGGIYVVLLVLLAIIIFQDPTFLSLLNLSNILTQSSVRIIIALGVAGLIVTQGTDLSAGRQVGLAAVIAATMLQAVDNANKVFPDMATMPIPLVILLVCAIGAVIGLINGIVIAYLNVTPFITTLGTMIIVYGINSLYYDFVGASPISGFDSHFSHFAQGFVALGSFRLSYITFYALIAVFFVWILWNKTRFGKNIFAIGGNPEAAKVSGVNVALNLLMIYALSGVFYAFGGLLEAGRIGSATNNLGFMYELDAIAACVVGGVSFSGGVGTVFGVVTGVIIFTVINYGLTYIGVNPYWQYIIKGAIIIFAVALDSLKYARKK

SEQ ID NO: 8295 - protein, 299 aa, Klebsiella pneumoniae
GRKRMKTLQYSFAQIEAFATIAETGSLSQAAIRLAKDRTTLRDLLDYLEDALGYRLFSHEGRSLTLTAEGEQLFRQAHLLLRQAQAFESFAQTLPQTAGQALRLVYDPFVPREFLCALADNLARRQIRLSCWSASRREAEQALSDGVAEMAICQANNRTLGSEMEWRALGTVDLRFYAADSLFHDAPRPLTLLNLSLTPQLVMHRRSDDQIARRLQISGHTLYMNEITLLRHALEQGRGWGFLPDHLRPGEWQGVSEIATEVGSQGLNVTMVMLWLPGMNKHRMLNDIVHEAPELWQRR

SEQ ID NO: 8296 - protein, 352 aa, Klebsiella pneumoniae
SPRRRERMSTAILAPGSRGRRLSKRLLQVVITLFGLLLLTFTIGRVMPIDPVLAIVGPDADQSTYQQVYQQLGFDKSLTTQFGIYFVNLLHGDLGNALLTGKPVVDDIIRVFPATMELATMAIIVGAGLGIPLGVLAAARRNSVSDYVVRIISLAGYSTPIFWVGMMGLLVFYAWLGWVGGAGRVDLGLDGMVPRRTGLMTVDALLAGNGQVFWNAINHLILPASLLGFHSLAYISRMTRSFMLAQLSQEFIITARVKGLTERQVIWNHAFRNILVQLLTVVALAYGALLEGAVLIETVFSWPGFGSYLTGSLLLGDMNAVMGCVLLVGVIFVMLNLLSDMLYQFYDPRTKS

SEQ ID NO: 8297 - protein, 73 aa, Klebsiella pneumoniae
YPPSQESFHSLTQSSLSQVLMLQIPCITNRRMNITYVKLVRSCKHALSDCMATKKYYIMLRDIKLFNCQWHKW

SEQ ID NO: 8298 - protein, 275 aa, Klebsiella pneumoniae
GSQRPQGHCFYLVWREQTMPELLNPAPVAHLRHLLRAHSPLVHCMTNDVVQTFTANVLLAVGASPAMVIDPREAAQFAAIADALLINVGTLTEDRAVAMRAAVEHARQAGKPWTLDPVAVGALTVRTAFCHELLALQPAAIRGNASEILALAGMSAGGRGVDTTDTAAAALPAAQALARRLATVVAVTGEVDYVTDGERVLSVAGGNPLMTRVVGTGCALSAVVAASAALPGDRLENVAAACGLMKQAGEIAARQGGPGSFIPAFLDALYQEVQG

SEQ ID NO: 8299 - protein, 217 aa, Klebsiella pneumoniae
RAKSSPVALSAAKRAGSSLIRRKPMRLCDRDIEAWLDEGRLAINPRPPVERINGATVDVRLGNKFRTFRGHTAPFIDLSGPKAEVSAALDRVMSEEIVLPEGEAFFLHPGELALAVTYESVTLPADLVGWLDGRSSLARLGLMVHVTAHRIDPGWSGCIVLEFYNSGKLPLALRPGMPIGALSFEPLSGPAARPYNRREDAKYRDQQGAVASRIDKD

SEQ ID NO: 8300 - protein, 245 aa, Klebsiella pneumoniae
FTERRMTELPVDENTPRILIVEDEPKLGQLLIDYLQAAGYAPALINHGDKVLPYVRQTPPHLILLDLMLPGTDGLTLCREIRRFSDVPVVMVTAKIEEIDRLLGLEIGADDYICKPYSPREVVARVKTILRRCKPQRDLQALDAQSPLIVDEGRFQASWRDKLLDLTPAEFRLLKTLSQEPGKVFSREQLLNHLYDDYRVVTDRTIDSHIKNLRRKLEALDAEQSFIRAVYGVGYRWEADACRLA

SEQ ID NO: 8301 - protein, 182 aa, Klebsiella pneumoniae
RGERGEGGGRRGRKRGRGEGRRGKKGRREKKKEEGRRGRKRRGKKKRGRRGEGEERGRGGGKEGEGRRGEGGGRGRGEEGRGRGRRGGGERRGGEEGGGKGGGRGKGKKRGREGRREERRRKGEGERRGGGGRGKEKGKKKKKKKKKKKKKKEKKKKKKKTPTRHNKPHSNVNVVEFVENRS

SEQ ID NO: 8302 - protein, 90 aa, Klebsiella pneumoniae
AFGSRVVECRTDCGACCIAPSISSPIPGMPQGKPANTRCIQLSERNLCLIFGSPLRPKVCASLQPSPEMCLTHRDEAITWLLELELATAP

SEQ ID NO: 8303 - protein, 453 aa, Klebsiella pneumoniae
  UNSURE (133): Identity of amino acid at the above locations are unknown.
SSGSLSMADNTLHSSARANWLERRFALRSRGGTLRTECLAGITGFLAAAYLLVVIPGLLAIGGMDKGAATTGTILVFVVGSLLMAFYANLPFIVGPGIGGSVLVGVTLAGSEGIGWQTGLGIACWSGIIFFLXTRFGLREVVTRSVPQSIKLGLTASIGLFVAVLGFRNAGLVLANAKTNALMLGDFLAPGALVALCGLFLAIALQARKVPGAILWAILCATLVGIPFGVTHLPTSFIDVPHSLTPVLGQVDLLGALNIAFLPFLFVFFASEFFSTMGTTLAVGGEAGLLDEEGNMPQINRPFMVDSIAAALGPWVGIPAATALIESSAAAEAGGKTGLTALSAAVMFLLMLLFTPVALMIPKEATAPALILIGLNMFSGLRKVDLANFTDGLPVLMMVMITLIANSFGTGIAGGLLFYIVIKAIAGKWREIPIGLWVLAVPLVYYFATLVRH

SEQ ID NO: 8304 - protein, 135 aa, Klebsiella pneumoniae
HPIGTLAEYIMPSSGPLWQLMKYGLVGIVNTLITAVVIFLLMHLGLGIYLSNAMGYVVGIVFSFIANTIFTFTQPISINRLIKFLCVCFICYVANIIVIKIFFVFMPEKIYSAQILGMFTYTITGFILNKFWAMK

SEQ ID NO: 8305 - protein, 122 aa, Klebsiella pneumoniae
RHPGGDGQRHPPYCHRRHARPGEGLSPAPGGLAAGPVNPAHRPHRGTMRFTIRMTARYRATQYCSAPAFPSGCTSRWRHPTGASPARRRCPLPGACPYRDTAADPARRGRSAPLSPPTGVKE

SEQ ID NO: 8306 - protein, 345 aa, Klebsiella pneumoniae
IPPGLKGEFNMSLDIDQIALHQLIKRDEQNLELVLRESLLEPNATVVEMMAELHRVYSAKSKAYGLFNEESELAQALRLQRQGEEEFLAFSRAATGRLRDELAKYPFAEGGIVLFCQYRYLAVEYLLVAVLNNLSSMRVNEELDIRSTHYLDINHADIVARIDLTEWETNPESTRYLTFLKGRVGRKVADFFMDFLGASEGLNAKAQNRGLLQAVDDFAADAQLDKSERQNVRQQVYAYCNEQLQAGEEIELESLSKELAGVSEKSFQEFTAEQGYELEESFPADRSTLRQLTKFAGSGGGLTINFDAMLLGERVFWDPATDTLTIKGTPPNLRDQLQRRTSGGN

SEQ ID NO: 8307 - protein, 408 aa, Klebsiella pneumoniae
RIAGGHILQTDAGRDIPGVQFVNFVTVVGLHQHDTPDALFLTLHRVPHRIAFLQRPGVDADKGQLADVGVGHQFERQRRQRLIVARMAFRRLALLINALYRRNIQRRRHQLHHRIEHALHAFVFKGAPAEHRLDLPLHRALAQTGDDLRLVQLTGFQVFIHQLIAGFRRRRDHFLPPLLRRRQQLVRDWPIAEGHALGGVIPQDGAHFHQVDDAGEMLFSANGDHNRHRVSLQAVDHHLHHAEEVRPRAVHLVDEGQPRNVVFIRLAPDGLRLGLHPADGVVHHHRAVEHAHRTFHLNGEIHVPRGVDDIDPVRLEAAVHPRPEAAYRRRGNGDPALLLLGHPVGGCRAIVYFTQLMAHPGIKQDALGGGGFTGIDMRGDTDVAITFERDGSGHDASLVVLTVSLRSE

SEQ ID NO: 8308 - protein, 76 aa, Klebsiella pneumoniae
DFHGTEKHITKRISRSRQILTPCNTIRVKTMAMQTWLVLLLCIFFFSISVYSFISYLKDRRRQKFTFNDKRSMRRK

SEQ ID NO: 8309 - protein, 117 aa, Klebsiella pneumoniae
VTCGRPMLASTPNSRFIRSTMISRCSSPMPEIIVWPDSSSVCRRNDGSSAASRCSAMPIFSWSALVFGSIASEITGSGNSIRSRVITASGSHNVSPVVTSFRPTQAAISPACSSSTS

SEQ ID NO: 8310 - protein, 86 aa, Klebsiella pneumoniae
PKCGSPPGSPGPPAVAPPYTDAASRSFPSLQPHLTPPAVSNPARPASPAAPAVCHTTRGLSAPAASQSPAPAPPSPAPPPAERSAR

SEQ ID NO: 8311 - protein, 140 aa, Klebsiella pneumoniae
GSGGGESDLLRRRRRHQPGAEQRPSADQPQAAGRTRRPRPDGDKPPAAGGGRRPRRGALPAADPGPDHRHHGEPHPVSVHPAGKLPRGAEHLGAAAAQPPAGPAAAGRRQQRLAGQRPGRLYQGGSRQRQPPRHLNGRCR

SEQ ID NO: 8312 - protein, 70 aa, Klebsiella pneumoniae
WKSGRVTESTPNAKYNESTKLTKSAKANATLQLTFFEKCVIIPSSTRVDKKGGKYSGENRWTLHCIESRV

SEQ ID NO: 8313 - protein, 170 aa, Klebsiella pneumoniae
SLPGWRADLLHHHRAGFRYGGARWRGASDVRDGPRRRVPEKLLRLRPPDLSHSGDEHHPGRRRLRCWAINFDLVMATALINFGALVAFTFVNLSVISQFWIREKRNKTLKDHFQYLFLPMCGALTVGALWVNLEESSMILGLIWAGIGLVYLACVTKSFRNPVPQYEDVA

SEQ ID NO: 8314 - protein, 512 aa, Klebsiella pneumoniae
TQPGITMVSNNSERSGEYLLEMSNINKSFPGVKALDNVNLKVRPHSIHALMGENGAGKSTLLKCLFGIYQKDSGSILFQGKEIDFHSAKEALENGISMVHQELNLVLQRSVMDNMWLGRYPTKGMFVDQDKMYRDTKAIFDELDIDIDPRARVGTLSVSQMQMIEIAKAFSYDAKIVIMDEPTSSLTEKEVNHLFKIIRKLKDRGCGIVYISHKMEEIFQLCDEITILRDGQWIATQPLEGLDMDKIIAMMVGRSLNQRFPDRENTPGEVILQVRNLTSLRQPSIRDVSFDLHKGEILGIAGLVGAKRTDIVETLFGIREKASGTITLHGKKINNHSANEAINHGFALVTEERRSTGIYAYLDIGFNSLISNIKKYKNSIGLLDNSRMKSDTQWVIDSMRVKTPGQHTQIGSLSGGNQQKVIIGRWLLTQPEILMLDEPTRGIDVGAKFEIYQLIAELAKKDKGIIIISSEMPELLGITDRILVMSNGLVAGIVETKTTTQNEILRLASLHL

SEQ ID NO: 8315 - protein, 142 aa, Klebsiella pneumoniae
ARAGHAAAGGDLPGLSAAFSADPDDHPRRPARRPAADAEHRRWRRTAASAGDRHGRRSNAQPGADPVHHPGDLSAVRPPVAAPEAPLPASGRGGVSEVFRPLHLPPGGDDPHLAGHHPVRHSRLPAAAGGPAAAGGLPGDHG

SEQ ID NO: 8316 - protein, 390 aa, Klebsiella pneumoniae
NGAGCMERNVTLDFVRGVAILGILLLNISAFGLPKAAYLNPAWSGSASLSDAWTWALLDLLAQVKFLTLFALLFGAGLQLLLPRGKRWIQSRLTLLALLGFIHGLFFWDGDILLAYALVGLVSWRMVREAHHVKSLFNTGVVLYLTGIAVLVLLGLISGTAANRSWAPDAANLQYEQYWKLHGGMEAVSNRADMLSDNLLALGAQYGWQLAGMMLMGAALMRSGWLKGQFSLRHYRRTGALLVAAGMAVNLPAIFAQWYLAWDYRWCAFLLQAPRELSAPLQAIGYAALAWGYWPQLCRFRLVGAIACVGRMALTNYLLQTLICTTLFYHLGLFMRFDRLQLLAFVPPIWAVNLLVSSLWLRRFRQGPVEWLWRQLTLRASGTSLKDTSR

SEQ ID NO: 8317 - protein, 197 aa, Klebsiella pneumoniae
GQQGKINSMVKSQPILRYILRVAPAIAVAVLLSACSSTSTARNMHSETHAVGSGDLSSLQASQDEFETMVRNLDVKSRLMDQYASWKGVRYRLGGSTRKGIDCSAFVQRTFREQFGLELPRSTSEQQETGKSISRAQLRTGDLVLFRAGSTGRHVGIYLGNNQFVHASTSSGVTISSMDEPYWKKRYNEARRVLSRS

SEQ ID NO: 8318 - protein, 79 aa, Klebsiella pneumoniae
PGLGCAQYHPFASPLNVGADKRSAIRQCGSYAWPGLDYTVGVIPRLVRHPVGLISEAPSGSVAATPDPAWIIRWVSYPD

SEQ ID NO: 8319 - protein, 493 aa, Klebsiella pneumoniae
TGVGRMTTIATATLPKNVQYPQYDRSQLRSRIVHFGFGVFHRAHQALLTDRVLNNVGGDWGICEISLFSGDTLMSQLREQDHLFTVLEKGADGNQPIVIGAVHECLNARLDSLAAIIEKFCEPQVAIVSLTITEKGYCIDPATGKLDPTHPRIIHDLENPTLPQSAPGILVEALARRRERGLPPFTVLSCDNIPDNGHVVKNAVLGMAEKRSPALADWIADNVSFPGTMVDRIVPAATPESLAEIAAVLGVDDPCAISCEPFIQWVVEDHFVAGRPAWETAGVQMTDDVLPWEQMKLRMLNGSHSFLAWLGYLAGHAHISDCMRDEVFRRAARQLMLDEQAPTLTITGVDLLAYADSLIARFSNPALKHRTWQIAMDGSQKLPQRMLDGIRVHLARDSRWPLLALGVAGWMRYVSGTDDAGQTIDVRDPLVDKIRQRVAQSDEQQRVDALLGLEEIFGRDLPHNAQFVAGIRAAWQQLATHGAREAVARALNS

SEQ ID NO: 8320 - protein, 303 aa, Klebsiella pneumoniae
CKKGRGKYPALSRTFTLDDYFFVFGDVIIGIRFRGDIVIAFCRATVDGIQLFIIHRLSHALQTHHVFIFRGADEDHALGVTAHDAHFGNAGTHQRPGVGDHHDLIAVIHLHGADHGTVTLGDFDRNNALGGTRLGRILRRRGTFTVTVLRHRQDRAFAAWNNQRDDAVVFRKLNTAYAGGGTAHGANGVFFEAYNLTGRGEQHHFILTRGQIDADQLIAFVQVDRDDTGGTRTAELGQRGFLHGTASGGHKDVDALFVLADRQDGGDALIGFQRQQVDDRPTARAAAGFRQLIDLHPVQTAAA

SEQ ID NO: 8321 - protein, 624 aa, Klebsiella pneumoniae
RQRGVAEGAMRRILTTLMILLAVIVAGLTSLVLLVNPNDFRAYMVHEVAERSGYQLDLDGPLRWHVWPQLSILSGRMTLTARGAEEPVIRADNMRLDVALLPLLSHQLQVKQVMLKGAVIQLTPKTEAVRDSSAPVVPHDNTLPLAPEDRGWSYDVRQLQVADSVLFFQHENGEQVTVRDIRLQMEQDENHRATVDFSGRVNRDQRDLALNFSATVQGGDYPHSLKADFTQLSWQLRGAELPPDGINGQGSLQASWQEDDKTLRFDNLNLMANRSTVTGSGSVVLGDRPDWSLDLHATTLDLDSLLAQRSPATDSSASQQGQSQTRPLRPVIADSDEREDYQSLRGFNGRMVLSADQLQWRGLNFTQVQSEISNQQGLLTVSKMQGNLDGGQLSLPGTLDARGDTPLATFQPALQNVEIGSLIKAFNYSLNLTGKLSLSGEFSGTRIDADDFRRHWQGQAQLQMADTRTEGLNFQQLVQQAVERSTNVRAQENYDNATRLDSVSSRLTLDNGLVTLNRLQGQSDVMAMTGEGQLDLQKENCDMRFNVRVLGGWKGEGKLIDRLKQTAIPLRIYGEWQSLSYSLQVDQILRKQLQDEAKQRLNDWVERNKGSKDGNDAKKLLDKL

SEQ ID NO: 8322 - protein, 156 aa, Klebsiella pneumoniae
ISRGQQSVCRPPGGEGPDPGAARRRFLGAGGDFRLGQVDDAEDDQPSAGAGPGHYSLCRRGHSPAAGPDPAAADGLCHPVHRPVSPLDGGAEYRHRAAAAKMAAGKDRRPDRRADGAAGAGGDAARPLPASALRRPAAAGGGGAGAGGRSGGAVDG

SEQ ID NO: 8323 - protein, 382 aa, Klebsiella pneumoniae
CDIMKKKLVRFSALALAIGFLSGCTIIPGQGLNSLRKNVVELPDSDYDLDKLVNVYPMTPGLIDKLRPESVMARSNPQLDSLLRSYEYRIGVGDVLMVTVWDHPELTTPAGQYRSASDTGNWVNADGTIFYPYIGKVQVAGKTLSQVRQEITSRLTTYIESPQVDVSIAAFRSQKVYVTGEVTTSGKQAITNIPLTVMDAINAAGGLAADADWRNVVLTHDGKDTKISLYALMQKGDLTQNHLLYPGDILFVPRNDDLKVFVMGEVGKQSTMKMDRSGMTLAEALGNAEGISQSMSDATGIFVVRQLKGDKQGKIANIYQLNAQDASAMVLGTEFQLEPYDIVYVTTAPLVRWNRVISQLVPTITGVHDMTETVRYIKRWPN

SEQ ID NO: 8324 - protein, 386 aa, Klebsiella pneumoniae
MIIMDLMATQSSPEAAFHGGGEYAKCVFYAAIKNGYKDFTGIYNNTLNLDPDITFLCNQNNITLIPVSSSAELVKIVNSHPGSIFYSALPYALNGIDTSIINFIITIHGLRELECPYDEVVWDYTHGLKNKLKVFLKNYVFKSYFLDKVKSNFEKIAVKKNVKIFTVSNHSKYSILSFFPTIDKDDILVFRAPCPFGPHEPECKNHNLLSLGGRKFFLMVSGNRWQKNIVRALRALDNYFDKIADCDLKVIITGSKSPLIKLRNDKRFIFIDYVEGSTLDWLYKNAFCFIYPSLNEGYGYPPLQAMRYGTPVIASCTSSIPEVCADNVLYFDPRNISEIENRILQLSTDGELYNKLALKGSEHYKKILQSQDKDLSKLLRGIFEAR

SEQ ID NO: 8325 - protein, 490 aa, Klebsiella pneumoniae
EVTMYLGIDLGTSEVKALVIDENHEVIASHSAPLSIQRPHPHWSEQAPELWWEATEYLMATLREKCAQHWPAIKAIGLSGQMHGAVLLDAEGEAIRPAILWNDTRCAAECAELEAMAPELHQVAGNLAMPGFTAPKLLWVRRHEPEHFQRTATVLLPKDYLRYRMTGKKVSDMSDAAGTLWLDVAKRDWSDALLDKCGLSRSQMPTLVEGCEVSATLDPQVAARWGLNASVMVAGGGGDNAVSAIGVGAVSPGDAFISLGTSGVLFVVTDAYRPAPQSAVHAFCHVLPNLWHQMSVMLSAASCLQWFCRLTGTTEVALLAEIAELSEDDKANAPFFLPYLSGERTPHNDPDARGIFWGMTHASLRAQLGYAVLEGVSFGINDGLQALKESGTPIAQCSLVGGGARSPFWAQLLADILAMPVVTHKGGETGGALGAARLACLAAGKPVAAVCEKPEVWQTWRADPIRHHILMQRYAQFNALYLNDLHYRQH

SEQ ID NO: 8326 - protein, 297 aa, Klebsiella pneumoniae
GNAMHSRFQAALTTLAADLQAAIAPMLADPHFPALLEADQVATLQHATGLDEDALAFALLPLAAACARPDLSHFNVGAIARGVSGRWYFGGNMEFLGATMQQTVHAEQSAISHAWLRGETSLRAITVNYTPCGHCRQFMNELNSGLALRIHLPGREAHALEHYLPDAFGPKDLEIKTLLMDEQDHGFPVSGDALTQAAIQAANRCHAPYSHSPSGVALELKDGTIFSGSYAENAAFNPTLPPLQGALNLLSLNGYDYPAIQRAILAEKADAALIQWDATVATLKALGCHNIERVLLG

SEQ ID NO: 8327 - protein, 294 aa, Klebsiella pneumoniae
NICIMNVYAHIPSEEPCMELLEEHRCFDGQQQRWRHHSPVLNCAMTFSIFLPPERETPPPVLYWLSGLTCNDENFTTKAGAQRIAAELGIALVMPDTSPRGDEAANDDGYDLGQGAGFYLNATEAPWAAHYRMYDYLRDELPALIRSEFSVGERCAVSGHSMGGHGALIMALKNPGRYASVSAFAPIVNPSQVPWGKKAFTAYLGADESAWHSWDSCALMQASRPEDAVPTLIDQGDNDPFLAGQLQPAVLAEVARQKAWPLTLRIQPGYDHSYYFIASFIEDHLRFHAQHLFG

SEQ ID NO: 8328 - protein, 172 aa, Klebsiella pneumoniae
INCIFIQQFISKGGKMNYSITTLGKKTIAGFHLVGPWDHTVKQGFEQLMMWVENHQVPAREWVAVYYDNPEEVPAEKLRCATAVAVDEDYVIPANSEGVILAAIAGGDYACARARVVEYDFATPWMQFFDSLQQSTAYRIAPQPCFEVYLNDGNHDGYWDIDMYVPVERVAS

SEQ ID NO: 8329 - protein, 260 aa, Klebsiella pneumoniae
FMSIKMKYNLGYLFDLLVVITNKDLKVRYKSSMLGYLWSVANPLLFAMIYYFIFKLVMRVQIPNYTVFLITGLFPWQWFASSATNSLFSFIANAQIIKKTVFPRSVIPLSNVMMEGLHFLCTIPVIVVFLFVYGMTPSLSWVWGIPLIAIGQVIFTFGVSIIFSTLNLFFRDLERFVSLGIMLMFYCTPILYASDMIPEKFSWIITYNPLASMILSWRDLFMNGTLNYEYISILYFTGIILTVVGLSIFNKLKYRFAEIL

SEQ ID NO: 8330 - protein, 241 aa, Klebsiella pneumoniae
AKFMLKRAFYSLLVLLGLLLLTVLGLDRWMSWKTAPYIYDELQDLPYRQVGVVLGTAKYYRTGVINQYYRYRIQGALNAYNSGKVNYLLLSGDNALQSYNEPMTMRRDLIKGGVDPADIVLDYAGFRTLDSIVRTRKVFDTNDFIIITQRFHCERALFIALHMGIQAQCYAVPSPKDMWSVRLREFGARFGALADLYIFKREPRFLGPLIPIPAQQHDVPDDAQSYPAVTPEQLLELQKEK

SEQ ID NO: 8331 - protein, 242 aa, Klebsiella pneumoniae
KNLMRLDKFIAQQLGVSRAIAGREIRGSRVTVDGDIVKDASFKLQPEHEVEYDGNTLTQQNGPRYFMLNKPQGYVCSTDDPDHPTILYFLDEPVAHKLHAAGRLDIDTTGLVLMTDDGQWSHRITSPRHHCEKTYLVALESPLAEGTAELFVKGVQLHNEKDLTKPALLEVITPTEVRLTISEGRYHQVKRMFAAVGNHVVGLHRERIGDILLDESLAPGEYRPLTEAEIASVGAPQPRSKT

SEQ ID NO: 8332 - protein, 456 aa, Klebsiella pneumoniae
KRLIPITTNYVTDRTGYGFNNKRAAHRAGECTASCPAGRPWGSFAGAVVDWYDFLLYGITAALVFNREFFPQIGPAMGTLAAFATFGVGFLFRPLGGIVFGHFGDRLGRKRMLMMTVWMMGIATACIGLLPSFNQIGWWAPVLLVFLRAVQGFAVGGEWGGAALLSVENAPQGKKAFYSSGVQVGYGVGLLLSTGLVSLISSLTSDQQFLSWGWRVPFLFSVVLVLIALWIRNGMAESQEFEAQQSQDNAPQMKKRLPVVEALLRHPGAFLLIIALRLCELLTMYIVTAFALNYSTQNLGLPRELFLNIGLLVGGLSCLTIPCFAWLADRFGRRRIYITGALIGTLSGFPFFMALESQSVFWILFFALMLANIAHDMVVCVQQPMFTELFGASYRYSGAGVGYQVASVVGGGFTPFIAAALVTFSGGSWHSVALYLTAGCLLSALTALLMKKHPVD

SEQ ID NO: 8333 - protein, 159 aa, Klebsiella pneumoniae
KALMLSNDILRSMRYTLKVNNNDMMRILAISAMESTAASLDTWTTKEDEEGFVRCPDIILSGFLNGLIYDKRGKDDSAPELALERRVNNNTVLKKLRIAFSLKTDDIQAIISEQKYRVSVPEITAMMRSPDHKNYRECGDQFLRNFLRGLTQRVHNPKA

SEQ ID NO: 8334 - protein, 300 aa, Klebsiella pneumoniae
AAIITHPPAALTGVFFMKYVGAHVSASGGLANAAIRAAEIEATAFALFTKNQRQWRAAPLSDETIAEFKAACEKYHFGPGQILPHDSYLINLGHPVEEALEKSRDAFIDEMTRCQQLGLTLLNFHPGSHLQQIPEEECLARIAESINIALAKTEGVTAVIENTAGQGSNLGFKFEHLAAIIDGVEDKSRVGVCIDTCHAFAAGYDLRSAEACEKTFAAFERIVGFQYLRGMHLNDAKSAFGSRVDRHHSLGEGNIGHDCFSWIMQDSRFDGIPLILETINPDIWAEEIAWLRAQQIAEVA

SEQ ID NO: 8335 - protein, 703 aa, Klebsiella pneumoniae
GRIMPRPIPLERYRNIGISAHIDAGKTTTTERILFYTGMSHKLGEVHDGAATTDWMAQEQERGITITSAAVSCFWPGMDRSFEPHRINIIDTPGHVDFTIEVERSMRVLDGAVMVYDSVGGVQPQSETVWRQANKYHVPRLAFVNKMDRPGADFFRVVQMMIDRLKANPVPIVIPIGAEEHFTGVVDLVKMRAILWDDATQGMTFSYGPVPDELLATAQQWREKMVSAAAEASDELMDKYLETGELDEAEIVAGLRQRTVKGEIQAVLCGSAFKNKGVQRMLDAVVELMPSPLDIPAIQGVDEQGQPAERHPSDDEPLSALAFKLMTDPYVGQLTFIRVYSGTLKKGDAVWNPVKGKKERIGRIVLMQANDRHEVDELHAGDIAACVGLKDVTTGDTLCDPDAVITLERMEFPEPVISLAIEPKTKADQEKMGIALQRLAAEDPSFRLHTDEESGQTIISGMGELHLEIIVDRMKREFGVEANIGRPQVTYRETLRKKVTDVEGKFVRQSGGKGQYGHVVLTLEPLEPGSGFVFEDATKGGVVPREYIPSVEKGLREAMGTGVLAGYPVVDVKATLTFGSYHDVDSSEMAFRMAAIFGFREGARKADPVILEPVMHVEVETPEEYAGNIMGDLSSRRGMVQGMEERFGSQIIRADVPLAEMFGYSTTLRSMSQGRATYSMEFHHYAEAPRNVADEIIASRAKS

SEQ ID NO: 8336 - protein, 113 aa, Klebsiella pneumoniae
GTIMQRIIIPTHYVHTRSTPLWTKETAPASIWRRHLDAGTRQGVYPRLSVMQGAIRYLGYADETSPEPVETLTIEAGQFGVFPPEKWHCIEALSEDTVFNVDFYVDPKILIEG

SEQ ID NO: 8337 - protein, 69 aa, Klebsiella pneumoniae
AAVIAVTSLPACGKIKADCVLQRYHPLSPVFSIQPYKLNGISIPALAPTSSLSLLFAFVYHKEVFRRTD

SEQ ID NO: 8338 - protein, 429 aa, Klebsiella pneumoniae
SGVIAVANANKLTLFIVIFMLMGILSGAAIHAYATPTTVSAWADNITLLTDLFLRLIKMVIAPLVFSTLTVGIMRLGETATIGRVGGKAMVWFITSSVLSILVGLVIVTFQHPGAGLNLAVPKEAVDTGLAVSGMSLKGFLSHTIPTSITEAMANNEILQIVVFSMFFGIAGASLGEKFNAPLVAALNVVSHIMLKVTGYVMYVAPLAIFAAISSVIASQGLGILLNYASFIGGYYLAVLLTSAVLIAVGYMVLKKEVFRLLNMLKDPVLVAFTTSSSEAAYPKTLERLVKFGCSRNIVSFVLPIGYSFNLVGSMVYCSFAAMFIAQAYNVPLSFSEITVMMLTLMLASKGIAGVPRSALVVLAATIPSFNIPVAGILLLMGIDHFLDMGRSAINVLGNGIATAMLSKNEGLLTDEEAQPDWEVEKAEA

SEQ ID NO: 8339 - protein, 325 aa, Klebsiella pneumoniae
TESIMRVSQVYRWQIPMDAGVVLRERRLKTRDGLFIRLQEGEREGWGEISPLPGFSVETLEEAKMALLAWAQAWRDGAEPPLPMQPSVAFGISCAQAELSGGLPQAADYRAAPLCSGDPDELFARLAAMPGEKVAKVKVGLWEAVRDGMVVNLLLEAIPDLQLRLDANRAWTPLKAQQFAKYVNPAYRQRIAFLEEPCKTREDSRAFSRETGIAIAWDESLREADFRFVAEPGVRAVVIKPTLTGSLQKVQQQVAAAHALGLSVVISSSIESSLGLTQLARVAAWLTPQTIPGLDTLALMGAQLVRPWPESALPVLNIDALEPLL

SEQ ID NO: 8340 - protein, 367 aa, Klebsiella pneumoniae
GHPMGSYLIRRLLLVIPTLWAIITINFFIVQIAPGGPVDQAIAAIEFNQRGGMPGAGDGGMGASHARTGAGNISEGHYRGGRGLDPEVIAEITHRYGFDKPLHERYLKMLGDYLRFDFGDSLFRSASVLQLIKDSLPVSVSLGLWSTLIIYLVSIPLGIRKAVSNGSRFDIWSSTLIIIGYAIPAFLFAILLIVIFAGGSYFDLFPLRGLVSPNFDTLPWYQKILDYLWHITLPVLATVIGGFAALTMLTKNSFLDEIRKQYVVTARAKGVGEKQILWGHVFRNAMLLVIAGFPATFISMFFTGSLLIEVMFSLNGLGLLGYEATVSRDYPVMFGTLYIFTLIGLLLNIVSDISYTLVDPRIDFEGR

SEQ ID NO: 8341 - protein, 72 aa, Klebsiella pneumoniae
ARPIITTGTNVSVLRNSTREVFGVALCDIVIPFYGERQRVSKKLPHFFLFLSDNDCRFLVNIYPVRSPASWY

SEQ ID NO: 8342 - protein, 314 aa, Klebsiella pneumoniae
FSAIDEKNSAMRPPRLPPLGALRAFHAVARHRSFKQAAEALGVSATAVSHQIKLLESVLECRVCERSAQGVSLNADGEILYAATQRAFSALEQAVVQIAHARQPPSLTVTTTSNFLTHWLVPRLADFTARFPAIDLRLHTSVERVDLHLGTVDAAIRYRETPEPDLYCTLLYEDRFIVVASPTLGLSRPEDLQRVTLFHVANRCVPADSPSWENWRRRYGPPTLNIDAGLTFSDETHALQAAVAGQGVVIASELLARDLLQRGVLSAPFSNALPGARYYLVTTEAVAQRADIIALREWLLSQMVSGDGGHPTAG

SEQ ID NO: 8343 - protein, 492 aa, Klebsiella pneumoniae
HYHMVSETKTTEAPTLRRELKARHLTMIAIGGSIGTGLFVASGATISQAGPGGALLSYILIGLMVYFLMTSLGELAAFMPVSGSFATYGQNYVEEGFGFALGWNYWYNWAVTIAVDLVASQLVMSYWFPDTPGWIWSALFLGIMFLLNWISVRGFGEAEYWFSLIKVATVIIFIIVGVMMIVGIFKGAQPAGWSNWGIADAPFAGGFSAMIGVAMIVGFSFQGTELIGIAAGESENPEKNIPRAVRQVFWRILLFYVFAILIISLIIPYTDPSLLRNDVKDISVSPFTLVFQHAGLLSAAAIMNAVILTAVLSAGNSGMYASTRMLYTLACDGKAPRIFSKLSRGGVPRNALYATTVIAALCFLTSMFGNQTVYLWLLNTSGMTGFIAWLGIAISHYRFRRGYVLQGNDINNLPYRSGFFPLGPIFAFVLCLIITLGQNYEAFLKDTIDWGGVAATYIGIPLFLVIWFGYKLAKGTRFVRYSEMTFPDRFKR

SEQ ID NO: 8344 - protein, 474 aa, Klebsiella pneumoniae
ANNMTDLPASVRWQLWIVAFGFFMQSLDTTIVNTALPSMAKSLGESPLHMHMIIVSYVLTVAVMLPASGWLADRVGVRNIFFTAIVLFTAGSLFCAQASTLDQLVMARVLQGVGGAMMVPVGRLTVMKIVPRDQYMAAMTFVTLPGQVGPLLGPALGGVLVEYASWHWIFLINIPVGIVGAIATLCLMPNYTMQTRRFDLSGFLLLAAGMATLTLALDGQKGLGISPAWLAGLVAVGLCALLLYLWHARGNARALFSLNLFRNRTFSLGLGGSFAGRIGSGMLPFMTPVFLQIGLSFSPFHAGLMMIPMVLGSMGMKRIVVQVVNRFGYRRVLVASTLGLAAVSLLFMFSALAGWYYVLPLVLFLQGMINASRFSSMNTLTLKDLPDDLASSGNSLLSMVMQLSMSIGVTIAGLLLGLYGQQHMSLDAASTHQVFLYTYLSMAAIIALPALIFSRVPDDVGSNTVLRRRNRSGS

SEQ ID NO: 8345 - protein, 249 aa, Klebsiella pneumoniae
GECMSQLTLADCWPRRFSPSSLALQFCEDPSQAEQPLFAKASAGEAVAQLWQAPQGLVVPGSYRQFTDLPAVSAHFAARGWPVWLRRSGGGLVPQGPGIINLSLAWPVQQPLGEAAEPIYHSLCVVLQRTLARFGVASHPRAVSGSFCDGRYNLACGEGAEARKIVGTAQYWRPLTAGRGHVVLAHAVILIDADLSAAHQAANAFEAQLGSERVYCADKTVTLAQLLPGERHLLPRFSETLAQELDAAR

SEQ ID NO: 8346 - protein, 387 aa, Klebsiella pneumoniae
GPSMKIESVNVTVFQYPTRRVSDSAGHSHPGVESMAKMAMLTITADDGAQGFSFAPPEVVRPFVVNTFFRKVLVGQDPFNRERIWQDLNHWQRGSAHQLTERALSFVEQALWDLIGRSLKMPVYKLLGGYRDTVPAYGSTMCGDDLPGGLSTPEEYAAFAEKLVARGYKAIKLHTWMPPISFAPNPKMDIKACAAVREAVGPDIDLMIDGYHWYSRAEALWIGKELEKLNFAWFEEPMEEDSMSSYAWLAENLSIPIVGPESFGGKHHMRAEWVKAGACDILRAGANGVGGITPTMKVAALAESFGMDCEVHGNGAASLAVVGAIRNCRWYERGLLHPFLDYDEPAAYLNSIVDPMDDKGFVHLSQRPGLGEDINFAYIEANTVSHD

SEQ ID NO: 8347 - protein, 229 aa, Klebsiella pneumoniae
LASIGYPSSNDLVCARLCMLWCLLSPQRGNNMQTHAPHVRHVRETLLSDNWYTLKKYTFELLRRDGRWQEQSREAYDRGNGAVILLYNREKRTVVLTRQFRFPVFTHGHDGYLIEAAAGLLDNASPEARIVAEAEEETGFRVTRVEPIFTVFMSPGSVTEKLYFFIAEYQADDRRGDGGGLAAEGEDIEVLEWPLTRALQAIRDGEIMDAKTIILLQHLALNADTLLAG

SEQ ID NO: 8348 - protein, 203 aa, Klebsiella pneumoniae
  UNSURE (44),(45),(46),(47),(48),(49),(50),(51),(52),(53),(54),(55),(56),(57),(58),(59),(60),(61),(62),(63),(64),(65),(66),(67),(68),(69),(70): Identity of amino acid at the above locations are unknown.
RELILARVVTWRFLFLVKVPFRTDFQRIRLHSRLSAVCCVGWGXXXXXXXXXXXXXXXXXXXXXXXXXXXPSPPPLSSPPPPSSSSPLSFPPSLSFFLFLFPLPFPPLPPLPSSLLLPSSPFLSPLPLSLSLPLLPFFPPLLFPPPSLSLLLPLFSPSSSFPSSFSLSSPPPSSSLSFLSSLFFPLLFPSFFLSSLLLLLSLL

SEQ ID NO: 8349 - protein, 344 aa, Klebsiella pneumoniae
GPLMSFFSPVNQARWARFRHNRRGYWSLWLFLILFLCSLGAELLANDRPLLVQYRGQLYVPVLKNYTEQTFGGAFATAADYQDPWLQQQLATHGWALWPPVRFGATTINFASTVPFPSPPSASNWLGTDANGGDVLARILYGTRISVLFGLLLTLFSSVLGVLAGAIQGYYGGKIDLWGQRFIEVWSGMPTLFLIILLSSVVQPGFWWLLAITVLFGWMTLVGVVRAEFLRTRNYDYVRAAQALGVSDRQIILRHMLPNAMVATLTFLPFILCSSITTLTSLDFLGFGLPLGSPSLGELLLQGKNNLQAPWLGIAAFLSVAVLLTLLIFIGEAVRDAFDPSKAV

SEQ ID NO: 8350 - protein, 490 aa, Klebsiella pneumoniae
ANIMITFKLRTFRSDHTRQEYVMSKQQIGVVGMAVMGRNLALNIESRGYTVSVFNRSREKTEEVIAENPGKKLVPYYTVQEFVKSLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEDVKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGVFHTEWLE

SEQ ID NO: 8351 - protein, 454 aa, Klebsiella pneumoniae
HTSLFYNNNAPLLCSGDTHLHSEIEVNMSVNNKQWYGLPLNLIWGYVAIAVFMTGDGFELAFLSHYIKALGFTPAQASFAFTLYGLAAALSAWVSGVVAEIITPRKAMLIGFVLWCVFHVLFLVFGLGRANYALILLFYGIRGLAYPLFLYSFIVAIIHNVRSDSSSSALGWFWAVYSVGIGVFGSYIPSFTIPHIGEMGTLWLALLFCATGGIIALVSMRHTETPRHMQNLTTREKFAELGRAATLLYTNRSILFSSIVRIINTLSLFGFAVIMPMMFVDELGFTTSEWLQVWAAFFFTTIFSNVFWGIVAEKMGWMKVIRWFGCIGMALSSLAFYYLPQHFGHNFAMALVPAIALGIFVAAFVPMAAVFPALEPNHKGAAISVYNLSAGLSNFLAPAIAVVLLPYFSTIGVVIAYTALYILAFFLCPLIRVEQPGFTSVQHAKPFTANAAES

SEQ ID NO: 8352 - protein, 350 aa, Klebsiella pneumoniae
RAVILLRLLSMITIRDVARQAGVSVATVSRVLNNSALVSPDTRDVVMKAVTQLGYRPNANAQALATQVSDTIGVVVMDVSDAFFGALVKAVDTVAQQHQKYVLIGNSYHEAEKERHAIEVLIRQRCSALIVHSKALSDDELSDFMQHIPGMVLINRIVPGYAHRCVGLDNVSGALMATRMLLNHGHQRIGYLSSNHGIEDDDMRREGWSKALQEQGIIAPDSWIGSGSPDMQGGEAAMVELLGRNLGLTAVFAYNDSMAAGALTTLKDNGIVVPQHLSLIGFDDIPISRYTDPQLTTVRYPVMSMAKLATELALLGAAGKLDREATHCFMPTLVRRHSVAQRQTVGPITN

SEQ ID NO: 8353 - protein, 220 aa, Klebsiella pneumoniae
GGVMLDLFSDIPPWQEPLAPGAVVLRRFARERAPALLQAIADVASQSPFRQMVTPGGYTMSVAMTNCGALGWTTDRHGYLYAPVDPVTDQTWPPMPAVFHELALAAAAAGGYPEFSPDACLINRYCPGAKLSLHQDKDEQDLRAPIVSVSLGLPAIFQFGGLQRSDPLQRLLLEHGDVVVWGGESRLFYHGIQPLKAGHHPETGDCRYNLTFRQAGGRQY

SEQ ID NO: 8354 - protein, 386 aa, Klebsiella pneumoniae
NDSIQQERRTMFQLSVQDIHPGQQAGNKEEAIRQVAAALVSAGNVADGYVNGMLAREQQTSTFLGNGIAIPHGTTDTRDQVLKTGVQVFQFPQGVTWGEGQTAYVAIGIAASSDEHLGLLRQLTHVLSDDAVAAQLQSATTAEELRALLMGEKQSEALKLDNETLSLDVAASDLLTLQALNAARLKEVGAVDAAFVSHVINDTPLNLGQGVWLNDSAEGNLRSAVAVSRAANAFTRDEQPVSLLVTVAMADEQPTAVLNRLSKLLLDKKAEHLLKADAATVLALLTSDDAIAEDVLSAEFVVRNEHGLHARPGTMLVNTIKQFSSDITVTNLDGSGKPANGRSLMKVVALGVKKGHRLRFTAQGEDAQQALDAIGEAIAAGLGEGA

SEQ ID NO: 8355 - protein, 381 aa, Klebsiella pneumoniae
TNKIFMCLLHLLCGKYHCHKNILRFYARKNIFSTNPWDVHIHYHRFYFKQVLGDEMTTSTDIKSTPSLAIVVPCYNEQEAFPFCLEKLSNVLNSLIARNKINNNSYLLFVDDGSRDNTWAQIKDASTAYHYVRGIKLSRNKGHQIALMAGLRSVDTDVTISIDADLQDDVNCIEKMIDAYSQGYDIVYGVRCNRDSDTFFKRTTANAFYAIMSHMGVNQTPNHADYRLLSNRALEALKQYKEQNIYLRGLVPLVGYPSIEVQYSREERIAGESKYPIKKMLALALEGITSLSVTPLRIIAMTGFITCIISTIAAIYALIQKITGTTVEGWTSVMIAIFFLGGVQMLSLGIIGEYVGKIYIETKNRPKYFIDESVGNDSNGK

SEQ ID NO: 8356 - protein, 325 aa, Klebsiella pneumoniae
RAKILFRMPMMPKFRVSLLSLTLLLAVPFAPQALAKNPTAVTASQPEIASGSAMIVDLATKKIIYASQPDLVRPMASITKVMTAMVVLDAHLPLDEMLTVDISHTPEMKGIYSRVRLNSQISRRDMLLLALMSSENRAAASLAHHYPGGYDAFIRAMNAKAQALGMTHTRYVEPTGLSVHNVSTARDLTKLLIASEQYPLIGQLSTTKEETATFAHPAYSLPFRNTNHLVYRDNWNIQLTKTGFTNAAGHCLIMRTVINQRPVALVVMDAFGKYTHFADASRLRTWIETGKVMPVPASALSYKKQREAQMAEAMLKGGAQTAQND

SEQ ID NO: 8357 - protein, 338 aa, Klebsiella pneumoniae
MKKMLIILIAVFNPCYSFELGIGTHFSSYPGQPDKYLRLIKSYGFTSIRDDYTWNKIEDVKDDFNSRGKIAKVDKAINQAASFNINTLVVLDYGNKHYNSNYYPNTEESLNAYNRYVEWTVRHLKGKVKYYEIWNEWTIGTGIKKDGKIPPSVDDYYNLVKLTSATIRKEDPNAIILAGSINPLSDKPRFIGVSDEQWITALIKKGMLEYIDGISLHPYSYANSSESLRTVKGNIDAIDSFHDRIKLISGKEIPFYITEMGVPTHYGHGGVSLDEQSDFINEYSREVMNRKYIKGLWWYDLINDGGNILNKEDNFGFFYENLSPKPVMQDFKKNLISK

SEQ ID NO: 8358 - protein, 476 aa, Klebsiella pneumoniae
LKEINMLLPVIMAGGTGSRLWPMSRELYPKQFLRLYGQNSMLQETISRLSGLEMHEPMVICNEEHRFLVAEQLRQLNKLSNNIILEPVGRNTAPAIALAALEATRHGEDPLMLVLAADHIINNQPVFHNAIRVAEQYADGGHLVTFGIVPNAPETGYGYIQRGVALTDSAHTPYQVARFVEKPDRARAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 8359 - protein, 223 aa, Klebsiella pneumoniae
GERMSKQAVIFDMDGVIIDSEALWRQAQIDALAQWGATASVAECETLTKGKRLDDIAGTWCRYFQLDLAPQRLEDAILQRITRLIAAKGEPMRGVQEALRYFREAGYKIALATSSSRQVIAAVLNKLSLWHFFDAISSADDEPRGKPHPAVYLTTLRKLNLNASQCLVIEDSFTGFCAAQSAGIATIVIAEDSQHARFQAAAGRYQTLPELLEALSAEPAAAV

SEQ ID NO: 8360 - protein, 83 aa, Klebsiella pneumoniae
WVGIMIRCMIVPHFTVSNATFRNSLYDAYHIPLLNVKDIILLWNFTPTPFYTSQGLALRENKKGDFRILKSPGRIKINALKIC

SEQ ID NO: 8361 - protein, 412 aa, Klebsiella pneumoniae
RETFMSIDYFADHYRNIAFKYKHILCFLSLLCVAFAVFDGFRGTQYKPYFPFAFLRDLSVFVGGGLGFFIIAKIKIQKSFALLVFLQIFICAYSFFTSFLVSDKAVFVRQLTLGGGIGFWSKMLSMICICFLTYAYIYVSGKKAVEKIFKCFIYCSFLYSLLTIILYLFLPSLYASLPRQWYGRISIGYPTQDVYVLAISLVLLLENILNKTLSILISAVNVSCIIMQNTFTGYILIVFVFFIYFIRFGFFSKALILSLGFFLLMFVFYIYKNYEVFGNFGVLIKVKADSLILGGTDDPSFYLRLQQIAMMMKSLFSDWIFVLFGYGGIGGFSVESGVYSTLAFSGVLGIIIYVFTILYFLFLSIKNKSFILFSIPSMYILSSFSISPIYLMSTYWTLGFLIAYQSFVDEVK

SEQ ID NO: 8362 - protein, 252 aa, Klebsiella pneumoniae
AKMIVWSTAMERATNSPHDAVFKHLLSHRATARDFLDIHLPAPLRALCNLNTLRLESGSFIDDELRASHSDILYSLQTQAGEGYIYLLIEHQSSADRHMAFRLMRYAIAAMQRHLDKGHTQLPLVIPLLFYHGRVSPWPYPMCWLAGFADPDIARRIYGEDFPLIDITSTPDDEIMRHRRVAMLELLQKHIRQRDLMDLHEQLVRLLALGYTSRRQLKTLLHYLLQAGNAADPVAFLRHLAQNVPGGRIRRR

SEQ ID NO: 8363 - protein, 538 aa, Klebsiella pneumoniae
EDVMQNDTQNIIGVDVGSGSVRAGVFNLRGELLAHATREITLFRSAGNKVEQSSREIWQAVCYCIKTAVASAGVSPSSIAGIGFDATCSLVVIGDNDAPLAVGPSDDADRNIIVWMDHRATGQAEKINATGHPVLRYVGGKISPEMQTPKILWLKENRPHIYQQARHFFDLADYLTWRSTGDEARSVCTVTCKWTYLAHEQRWDAGYFRQIGLAELADEDFVRIGQRIVDPGTPCGEGLCATAAEEMGLPIGTPVAVGMIDAHAGGIGTVGVLNGAVNNMAYVFGTSSCTMTTTQEAVFVPGVWGPYYSAMVPGYWLSEGGQSAAGAAIDQLLSFHPAAAEAREQAKAAGVPLPVWLADRVLTQVASPSEAVTLAAGLHVVPEFLGNRAPLADPHAKALIAGLGMERDLDNLTALYVAGLCGIGYGLRQIIDAQRACGIESENIVISGGAGQHPLVRQLLADACGVSIVSTASREPVLLGSAILGAVAGRVAASLPEAMKQFTQVDATYHSETAFSPLHQRRYAAYKALQQAGRLIRE

SEQ ID NO: 8364 - protein, 127 aa, Klebsiella pneumoniae
KNVIKIATIRRSRRFSTPLPTRPGSARRRPDGASTAGPAAAPARRPGGSDNRAHRSANDRPPAGKPDRYSRWRRLSDSYSADYVRSGCSCRSTSGRSQSSPPGGRQTDRGSAWRRRRRSGYSCCAGR

SEQ ID NO: 8365 - protein, 359 aa, Klebsiella pneumoniae
GAAMKMKLTALMSGMILSSSALCFSATAADKMVIAHRGASGYLPEHTLPAKAMAYAQGADYLEQDLVMTKDDRLVVLHDHYLDRVTDVAQRFPQRARKDGRFYAIDFTLDEIKSLKFTEGFEPKNGKNVQTYPGRFPMGKSDFRIHTFEEEIEFVQGLNHSTGKNIGIYPEIKAPWFHHQEGKDIAASTLKVLKEYGYTSKQDKVYLQCFDANELKRIKNELEPKMGMDLNLVQLIAYTDWNETQQKQADGKWVNYSYDWMFKPGAMAQIAQYADGIGPDYHMLVAEGSKPGAVKLTAMVKEAHASHLQVHPYTVRADQLPEYATNVNQLYDVLYNQAGVDGLFTDFPDKAVQFLDAKR

SEQ ID NO: 8366 - protein, 221 aa, Klebsiella pneumoniae
KVALYMNTMNVIIADDHPIVLFGIRKSLEQIEWVNVVGEFEDSTALINNLPKLDAHVLITDLSMPGDKYGDGITLIKYIKRHFPDLSIIVLTMNNNPAILSAVLDLDIEGIVLKQGAPTDLPKALAALQKGKKFTPESVSRLLEKISASGYGDKRLSPKESEVLRLFAEGFLVTEIAKKLNRSIKTISSQKKSAMMKLGVENDIALLNYLSSVSLSATDKE

SEQ ID NO: 8367 - protein, 355 aa, Klebsiella pneumoniae
SIKIISPLCRIERAGYGVRLVRRIERFQPAPGGATIAPLFFSGNDMRVLLAPMEGVLDSLVRELLTEVNDYDLCITEFLRVVDQLLPVKSFYRLCPELHHQSRTPSGTRVRVQLLGQYPEWLAENAARAVALGSWGVDLNCGCPSKLVNGSGGGATLLKDPELIYRGAKAMREAVPEHLPVTVKVRLGWDSGERRFEIADAVQQAGASELVVHGRTKEDGYKAERINWQAIGEIRQRLTIPVVANGEIWDWQSAQDCMAVTGCDSVMIGRGALNVPNLSRVIKYNEPRMPWPQVVQLLQKYTRLEKQGDTGLYHVARIKQWLGYLRKEYTEALTLFNEIRALQTSAEIAAAIGRY

SEQ ID NO: 8368 - protein, 63 aa, Klebsiella pneumoniae
AGEMAQKRIDGKDGRNHTLDLTFWQFAIQLILLIKSTDNKDGHLLRIDVNGLHLTCLPLWNGE

SEQ ID NO: 8369 - protein, 318 aa, Klebsiella pneumoniae
YKRIFLPSAASICVTIVRKVIQVGLLNGWVMHITLRQLEVFAEVHKSGSTTQASQMLALSQSAVSAALTDLEGQLGVQLFDRVGKRLVVNEHGRLLYPRALALLERALEIEQLFRGDNGAIRVYASSTIGNYIMPEIIARYRHDFPDLPVELSVGNSLDVINAVADLRVDFGLIEGPCHAADIIAEPWLEDELVVFAAPNSPLLAGEVTLQQLAEAPWILREHGSGTREIVDYVLLSHLPAFHLGMELGNSEAIKHAVRHGLGISCLSRRVIAEQLASGTLAELKVPLPRLTRTLWRIHHRQKHISKALQRFLHYCQV

SEQ ID NO: 8370 - protein, 263 aa, Klebsiella pneumoniae
PGGIEISGLRQAEGADIEKQDTEDGDAADKVQRDISLHAPCSVLVVVTYCAQEFLAGILAGFKQAAERGSGGGAGRVANAARLHAIMHRVNGYRHVVGAEQRLQRDQDLLRQTLLDLRTLGEELHDAVDFRQADHRIFRDIGYRRFTIDGNEMVFAGAGQGDIAHGDHFIDLHFVFNDGDFREARVIQPGEDLIDIHFGDAMRGLHQTVITQIQIQQLHNLGHMTGNQTLACFVINFLYWRTHRRLQPTSDQRFMNEDGFFTQ

SEQ ID NO: 8371 - protein, 169 aa, Klebsiella pneumoniae
  UNSURE (10),(11),(12),(13),(14),(15),(16),(17),(18),(19),(20),(21),(22),(23),(24),(25),(26),(27),(28),(29),(30),(31),(32),(33),(34),(35): Identity of amino acid at the above locations are unknown.
VRFVVSGGGXXXXXXXXXXXXXXXXXXXXXXXXXXPPPPPPSPLPLPLPPPLLSPSLPPSLFSFSSSPSLSPPFLPSPPLSSSPPPPSSPLFPSPSPSPFSPSSLPFFSPPPPSLFSFPSSPPLLLSPPLSPSPPLLLLLLSPSFLPSSSLSSSPLSSSPPSSFSSLSS

SEQ ID NO: 8372 - protein, 85 aa, Klebsiella pneumoniae
ARPVRLISLSRLPDGIFGLSGRLFIPLGVGWRYAYPTYGSRHGDLKIPMPGVGSRLTRPAFGDLSILLKIPAIKRGFLALTRRVK

SEQ ID NO: 8373 - protein, 427 aa, Klebsiella pneumoniae
ASTVCSQVRNMYGSRHECRHYWYNNFCEDIAMEQTWRWYGPNDPVSLDDVRQAGATGVVTALHHIANGQVWPVDEIKARQALLAAKGLTWSVVESIPVHEDIKTHSGQYATWIANYQQSIRNLAACGIDTVCYNFMPILDWTRTDLEYELPDGSRALRFDQIAFAAFELHILKRPGAEADYSEEEQRQAEVYFKAMSEADIDKLTRNIIAGLPGAEEGYTLDQFRARLAEYDHIDKAQLRENMAYFLRAIVPVCEEVGIRLAVHPDDPPRPILGLPRIVSTIEDMQWLKETVDSINNGFTMCTGSYGVRADNDLVKMVETFGDRIHFTHLRSTCREANPKTFHEAAHLSGDVNMVAVVDAILREEQRRKQAGDLRPIPFRPDHGHQMLDDLRKKTNPGYSAIGRLKGMAEVRGVELALKMTKYPELL

SEQ ID NO: 8374 - protein, 262 aa, Klebsiella pneumoniae
WQTVAGRAWPGRLHLYSHPPHGCLRGERRMALRLAIIEDNADLLDELLAWLGYRGFEVWGTRSAEAFWRQLHSHPVDIVLVDIGLPGEDGFSVLNYLHELGHYGLVVVSARGQQQDKLQALSLGADAYLIKPVNFAHLAETLTALGARLRQDRPAAPPAEAIGTPPAVSPGSWRLQEDKLISPDARTLELTQQEYRLVELLMRNRNEVCSKLDLHACLFSHESEPDLHRIDVVVSRLRHKARQQGIHLPVRAIFGKGLAFIS

SEQ ID NO: 8375 - protein, 236 aa, Klebsiella pneumoniae
RRAVPGQPPGQRAGDESGGQAAAGAFWRRLRHQRHLRAGALYPCHPTSAPGGECMLRVLIIDDEPLARENLRILLETQRDIEIVGECGNAVEAIGAVHKLRPDVLFLDIQMPRISGLEMVGMLDPEHRPYIVFLTAFDEYAVKAFEEHAFDYLLKPIEAARLEKTLARLRQERNLQDVSLLDDAQQTLKYIPCTGHSRIWLLPDGGCGLRQQPDERHLRDRPRGKRGLYRTDPAHP

SEQ ID NO: 8376 - protein, 107 aa, Klebsiella pneumoniae
NIYVFCCFIFYLSHFGSVTDNNKFSSWHTTKCLNNQINTFIRNQTRCRKIIFFLLFLKCEVVDINRRIYNIRIPAIDFFYTTRNKIRISNEMVYTICSPGIPHPYFM

SEQ ID NO: 8377 - protein, 390 aa, Klebsiella pneumoniae
ARRVVAVYPCSGQGFLHSRHAPGEKAVTIGLFVLPERVVRADKSLKPFEIRLYRHYRVVHGVRIALAFVLTFLLVRLLNVPEGTWPLITLVVVMGPISFWGNVVPRAFQRIGGTILGSALGLVALKLELISLPLMVLWCAAAMFLCGWLALGKKPYQALLIGITLSVVVGAPPGDMHTALWRSGDVIFGSLLAMLFTGIWPQRAFIHWRIQMASYVTNFNRLYQAGFSPNLVDRPRLEKHLQQALNDVVKMRGLITPASKETHIQKAIFEAIQTVSRNLVCMLELQINAWWATRPGHFVMLNAHTLRETQQMTQQTLLSIAHALYEGNPQPVRANNEKLTEIILELRQLLKEQGDDGLAETPVHGYVWLSIELARQLELLSHLICRALRK

SEQ ID NO: 8378 - protein, 61 aa, Klebsiella pneumoniae
GFGVAPEAWLRSLIKGSANFNNYRYGYWILCATSRTMNTNFAPRKSKERHTCRRNINVITE

SEQ ID NO: 8379 - protein, 290 aa, Klebsiella pneumoniae
RSGVRAISQHLSPLRRSIRQKTNSGADRARQNSSAAFADRSQPHVIKSFFAALSFISRLPVPARLSQGLEIEQYQRSIVTFPLVGLLLGAIAGAVALLLQPWCGVPLAALFGVLALALLTGGFHLDGLADTCDGIFSARTRDRMLEIMRDSRLGTHGGLALIFVLVAKVLVVGELLLRDIHPIAALAAACAVGRGMAVLLMYRHRYAREKGLGNLFIGKISLQQTLVTMAMAIALATALLGLQGLRAALITLVLIWGLGWALKRTLGGQTGDTLGAAIELGELLFLLALL

SEQ ID NO: 8380 - protein, 468 aa, Klebsiella pneumoniae
SITVAPSTQGEQNMNNQFTWLHIGLGSFHRAHQAWYLHRLIASGDNRWRIAAGNIRNDAEQVVQALAAQGGRYVLETVSPEGEREYEEITSIQKLLPWQAGLQPLINEGANPQTKVIAFTVTEGGYYLNTRHRLETSNPDLQADLQGECKTIYGTLARILEKRMADNAGPLTLLNCDNVRHNGERFHDGMVEFLQLTGKQAVIDWMAANTTCPNTMVDRITPRPAADLPARIKAQTGIDDKAPVMGETFIQWVVENNFRDARPNLEAVGVEMVESVIPYEEAKIRILNSSHSCIAWAGTLIGQQYIHESTLTDVIYAIADRYVTEDVIPCLGDNGIDLPTYRDVVLKRFTNPYIQDTNQRVAADGFSKIPAMIAPTLQECYQRGVRPEATAMLPALFFVFMEQWHKGTLPYQYQDGILDAQAVHEMFEAQDPVAVYARDKALFGDLANNADFLALMREKVAAVYTLIN

SEQ ID NO: 8381 - protein, 547 aa, Klebsiella pneumoniae
FLLVKRFATPLTRVRRCNMTHPLLAIDNLSIAFRQQGETQTVVHNLSLEVAVGETLALVGESGSGKSISALSVLRLLPTPPASYPSGDIRFHGQSLLHADEATLRGVRGNRIAMIFQEPMVSLNPLHTLEKQLYEVLSLHRGMRKQAARGEILDCLERVGIRQAPRRLADYPHQLSGGERQRVMIAMALLTRPELLIADEPTTALDVSVQAQILQLLRELKQELNMGLLFITHNLSIVRQLADRVAVMQDGRCVEHNDCRALFSAPAHPYTQRLLDSEPDGEPVPLAADAPVLLQADDLKVAFPVRKGILRRVVDHHRVVNSLSFQLRAGETLGLVGESGSGKSTTGLALLRLIPSGGKITFAGQPIQGRNRRQLLPLRRQMQVVFQDPNSSLNPRLTAQQIIEEGLRVHQPTLTAAEREQAVILAMQEVGLDPASRQRYPAAFSGGQRQRIAIARALIVKPQLIVLDEPTSSLDKTVQAQILKLLKALQRKHQLAYIFISHDLGVVRALCHQVMVLRQGEVVEQGECKSVFSAPRHEYTRQLLALS

SEQ ID NO: 8382 - protein, 142 aa, Klebsiella pneumoniae
AAVVAYRAVYRPAGRAALQRAAVQSAVPGAAAAGLPAGELLGAHSRSRLAGGGVQPRGNGNRAGGWGGGHPARRRRVSSAGGDHRRYRADLSAGGGAGDGGAGAGLWLAAGADSPRVVWHTAGAAGDAGRAGFDTAGGVRCG

SEQ ID NO: 8383 - protein, 379 aa, Klebsiella pneumoniae
AKSVPGLTCPKKLGWDNACRLRPALREIAMTDITQLLGKDAESLLQHRCITIPSDQLYLPGADYVDRVMVDNNRPPAVLRNMQTLYNTGRLGGTGYLSILPVDQGVEHSAGASFAANPLYFDPKNIVELAIEAGCNCVASTYGVLASVSRRYAHRIPFLVKLNHNETLSYPTEYDQTLYASVEQAFNMGAVAVGATIYFGSEQSRRQIEEISAAFERAHELGLVTVLWAYLRNSAFKKDGVDYHVSADLTGQANHLAATIGADIVKQKMAENNGGYKAVNFGYTDDRVYSKLTSDNPIDLVRYQLANCYMGRAGLINSGGAAGGETDLADAVRTAVINKRAGGMGLILGRKAFKKSMADGVKLINAVQDVYLDGKVTIA

SEQ ID NO: 8384 - protein, 266 aa, Klebsiella pneumoniae
SNTVYSWRAADILAGLNRKGVKAPMNAEKTSVAPNVDHAEIAKFEAVASRWWDLEGEFKPLHRINPLRLGYIAERSGGLFGKKVLDVGCGGGILAESMAREGATVTGLDMGAEPLQVARLHALESGIQVDYVQETVEEHAAKHPQQYDVVTCMEMLEHVPDPQSVVHACARLVKPGGQVFFSTINRNGKAWLMAVVGAEYVMKMVPKGTHDVKKFIKPAELLGWVDQTTLKEQHIIGLHYNPLTNTFKLAPGVDVNYMLHTTAKQD

SEQ ID NO: 8385 - protein, 62 aa, Klebsiella pneumoniae
RRTVMEDDDVSLHSAVKDNYAKAWKCAETVATHLQKQYQRSLTTEEIMFLAIHIERVRKEGR

SEQ ID NO: 8386 - protein, 425 aa, Klebsiella pneumoniae
VGAVEAIAAGDRRLVNLAEELRGQFVFHRRQQGQLGCVRQAAGGIFGVLEIAVGALIGAVKQRLVHPFEIERQGNGLPHPAIGKNRALNIERQPLGILRRGIGMLIFNDVAAAEVATDVAGSPVFGDGLFPAIDGSRFKGFESDIVVEIIVIAQRIEIPATAVDRQVGRPVVCDPGIGNILPHSPGADAVWPAGQRRLRQRVAEFVLAPERLGHHRQAQQTQHVLFAGLAEVNTHGQRRDGLHGGAFIKQAKLRHPFGHKLVEGKRHIAGGDRRAVMEAGARVERDLHPGIVLGIARPLGNQRVVAAGLIIRGGEQGIVERLRAYRGVAAQRITVEVIKGADRRQGEGAAFRRPGIDVIKMTETGGVFRFADNREGYAFLNGCRLSVLAKQSQQIQKEARIHRRQNTVSWPAPMADISSRIISET

SEQ ID NO: 8387 - protein, 325 aa, Klebsiella pneumoniae
AIKVPLMMSTFPASLLILNGKGANEPQLREAVNLLRDEGIDIHVRVTWEKGDAARFIDEALQLNVETVIAGGGDGTINEVATALVERGGKMALGILPLGTANDFATSVGIPQDLASALKLAIVGRDVPIDIARVNDKTGFINMATGGFGTRITTETPEKLKAALGGVSYLIHGLMRMDTLKPDRCEIRGENFHWQGDALVIGIGNGRQAGGGQQLCPEALINDGLLHLRIFTGEELIPALFSTLANPENSPNIVDGVSSWFEITAPHEMTFNLDGEPLSGKTFRMELLPAALRCRLAARLPAATLIRLRKAKTAPGWYTAAGFVD

SEQ ID NO: 8388 - protein, 647 aa, Klebsiella pneumoniae
LKRVSAIFAAVRRCRPRLLAGWLLSCGLLLLLVAPQAQAATRQVGIDIPVQWYADDSGQMTLDRFAALPTDQLATTRQIPSFGYSRKTWWLRSELPGTWFAGEPRWLQLGPTFVDHLTIYYRPLGSDGPWTQRIFGDRDGARGSDLHYRERVLILPPPPTAAGYELVFRLQSTSTLILLASLSSAQAFVQRATADTAFWSFYFGLAAVASGVALWLALALRRRLLWGICLFSLNYPLVAALHGFPEWFFGHAALPFQDFMISSLSLFSYATALWLHSEIFDLKKNMPRLHQLLIAAVILNLALQVSIPLGFYGFAMQIEGVVFIIITPVLLFTSWWLWRKKAIDRTTLLLGLLPPFYVVAAVLVQLSIHGIIPFHMAIYSLWQYALIVHIITVLIIAILRVRAENRQLEQKQRLARELQIEREASFHQRQFMGMVAHEFRTPLAVIQAALENLRLSAPSTSQEARFDRIGRAATRLVQLTDNCLADARLASHDLHVERQQTALLTVINMAASVVAISHDHYLNIRQHGAVESPQLQADAGLLCIAIANLLDNAVKYSPPGEIAIDIHSDAGQTELRIRDHGTGLPAGQAELIFERYRRGEHTSPVPGGTGLGLYVARQIVQAHDGKLWLAEHGPDGCTFILTLPTVA

SEQ ID NO: 8389 - protein, 373 aa, Klebsiella pneumoniae
TKSFWIHMKKLIIVNEVCSDNIGDHAINLGVLKILDEYNFKGISYGFDAEKKNVGPTIKKSKKESSFIRFLKFIKNKTLKNNRFYKYSLWILRNYSRVSSITKQNKGQAIIIGGGQLIQSGGTFAIAMYTWTLFSKLRNVDIYIIGVGCAEHFDRIDRFLFKRSLSRAKDILVREKSSISKIKDFFDCDVRYIPDLAYALFKQDDYNHKKDNLAIIGCTAYYVYMKNINELGLKDIMTFEQYINAWISIILDECNEHRVLLLSTTVEDAEFSRIVYNQISKNYIHLLDRIIIKDEVLPVREYIELLKTAKIVRSGRMHSLILGHISGCKCIPYNINKKIEHFSHEYLDHDASNISKSVYNSFGNAFSGDKGSK

SEQ ID NO: 8390 - protein, 329 aa, Klebsiella pneumoniae
LNTLFLLVNNHMSESRPESYWLHLYWLTVLEEQKSYTRAAEKLGISKSAISQKISELERVTGKTLVHRTTRSVSLSDDGLRLVAELNEPFGQLRDIFTGACDEGGPLRGTLRLTAPVAFSRQQLVPAIAPFLHQHPLLHLQLEVTDRLVSLASEGFDLAIRHCRREALPDTHVAWPLCHTATLTVASADYIRRHGRPETPEDLRHHQCLTYPRGPQRPQWTFASRQSPDARVTINVQGPFATNNSESLRDAVLAGLGVALLPDFSAREAIGRGLVQELLPAWQPVEVFADRLYVIRPYTPRVSRAVETFSRYLKATFSEPRPAPAPASR

SEQ ID NO: 8391 - protein, 67 aa, Klebsiella pneumoniae
IWALAQQDVTVFTKDERNVRQIDQEKKGRERREEINRPATSRECLRPQMADLNRRRWLRAKRFQQFR

SEQ ID NO: 8392 - protein, 314 aa, Klebsiella pneumoniae
HVQFCKTACFATKQVKMNMANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMIARFNETGRSQVLAKRMPGDLSEYSVIQTKEPMVAEGQVARIVEFIEKPDEPQTLDSDLMAVGRYVLSADIWAELERTEPGAWGRIQLTDAIAELAKKQSVDAMLMTGESYDCGKKMGYMQAFVTYGMRNLKEGAKFRESIKKLLA

SEQ ID NO: 8393 - protein, 387 aa, Klebsiella pneumoniae
NPFSVRGIPLLRIEGHNPVNNKISLAKEVAWASQNMPRTLRQVAALPDLSGVRLACCMHLDMKMIPLVQGILDKGAQVFLTTCNPTTVQDDVVAWLVERGAEACAWRNMSDADWQQSWEKAIAWQPTHLCEMGADITTLLHQRGEFGNIVAGLEATGSGVNRLGDIQPGYPIFNWDDLPVKEGLHNRHMVGLTAWHTFFQTTHLTLHEKKVLVIGYGLVGQGVAAAAKAFGGQVMVAEIDPARRLQAAYDGWHVVDLQEAIASADVVATATGGKNVVNRQALDRAKAGVFILNVGHVAEEIDGDYLRQYPQEEVMPYINAYRMADKTVYLLANGSMLNLTAGFGDSLNAFDVTLAVMASGIRHIVTDGMRAPAKVYLLPQAVWQQAL

SEQ ID NO: 8394 - protein, 89 aa, Klebsiella pneumoniae
LLKLALPFIRERSHASGATPNPYRRIRNVPTAVRIHKRRRYTGMLAISCINDAVSSQKEKVKVAHRLMKYLYYERLRAHPFRGALHGTA

SEQ ID NO: 8395 - protein, 589 aa, Klebsiella pneumoniae
PREFMTFTLRPYQQEAVDATLAWFRRHTEPAAIVLPTGAGKSLVIAELARLARGRVLVLAHVKELVAQNHAKYCALGLEADIFAAGLQRKESHGKVVFGSVQSVARNLDQFRSEFSLLIVDECHRISDDDDSQYQQIIGHLRQVNPQIRLLGLTATPFRLGKGWIYQFHYHGMVRGDEKALFRDCIYELPLRYMIKHGYLTPPERLDMPVVQYDFSRLQAQSNGLFSEADLNHELKKQQRITPHIVSQIVEFAENRKGVMIFAATVEHAREVTGLLPVGQAALITGETPGPERDRIIEAFKAQAYRYLVNVAVLTTGFDAPHVDLIAILRPTESVSLYQQIVGRGLRLAPGKTDCLILDYAGNPHDLYAPEVGTPKGKSDNVPVQVFCPACGFANTFWGKTTADGTLIEHFGRRCQGWFEDDDGHREQCDFRFRFKNCPQCNAENDIAARRCRECDTILVDPDDMLKAALKLKDALVLRCSGMALQHGGDEKGPWLKITYYDEDGADVSERFRLQTPAQRTAFEQLFIRPHTRTPGVPLRWITPADIVTQQALLRHPDFVVARMKGQYWQVREKVFDYQGRFRRANELR

SEQ ID NO: 8396 - protein, 270 aa, Klebsiella pneumoniae
FQYSGLESSMLESTKVPALTRAIEILNLIGRIGPCSAATIIAELGIPKSTVYLLLGELKKQRFISMDNQDNYCLWTKLVELAGQALSKMDLRELARPRLTRLMDECGLLCHLGIIDQGNAYYILKIESPATISVRSHEGKSLSLYRSGIGKCLLAWQPASVQASIIEDLQWERATPTTITDAQQLREELGRIRARGWSFDNGEDYPDVRCVAAPVFNANNDLTAAISVVGTRLQINEDNRDYLAGKAIACAKDISRLLGWKSPFEQLASS

SEQ ID NO: 8397 - protein, 241 aa, Klebsiella pneumoniae
QGLSLRSRQVKKMSDAVLSILCLVATLVLYYANKKLYRRFHKLPLMPLVFTPILLVLILVVGHISYQSYMGETHWLLWLLGPATIAFAVPVYENVAVIKRHWMSLSAGVVTAVVVAVTSSVWLARGFMLSDEIQRSLAVRSVTTPFALAAAKPLGGQPDLVALFVVITGVFGMAVGDMLFLRLAIREGMAKGAGFGAASHGAGTARSYELGQQEGVVASLVMMLSGVVVVLAAPVVRWLLF

SEQ ID NO: 8398 - protein, 376 aa, Klebsiella pneumoniae
LYSSKIACIIEVLPHQGDQEPDRLSKNKLSKGQQRRVKANHQRRLKTTAEKADYDDNLFGETSEGIVISRFGMHADVESADGSVHRCNIRRTIRSLVTGDRVVWRPGKDAADGVSVKGIVEAVHDRASVLTRPDFYDGVKPIAANIDQIVVVSAILPELSLNIIDRYLVACEAQDIEPLIVLNKIDLLDDDGLRFVNEQMDIYRNIGYRVLLVSSRTQDGLKPLEAALTDRISIFAGQSGVGKSSLLNALLGLNEDQILTNDVSDVSGLGQHTTTAARLYHFPHGGDVIDSPGVREFGLWHLEAEQITNGFVEFHDYLGRCKYRDCKHDTDPGCALREAVENGKIAESRFENYHRILESMAQVQVKTRKNFSSSDD

SEQ ID NO: 8399 - protein, 634 aa, Klebsiella pneumoniae
PCPSAGAAGLPEVTPPVSNPRTAGSTRHAWRQRLPLMAYRIITLILLLCSTSATAGLFDAPGRSNFVPADQAFAFDFQQQQHDVNLSWQIKDGYYLYRQQFTFSAAGATIDEPALPAGEWHEDEFYGKSEIFRQRLTVPVTVKEADKEATLTVTWQGCADAGFCYPPETKVIPLSAVRAASNDAQPTAAAPVSSLNHRPAFNPPLPVEPRPMEENAVPQAPAMAPPAGVPARLPFTALWALLIGIGIAFTPCVLPMYPLISGIVLGGKQRLSTPRALLLAFIYVQGMALTYTALGLVVAAAGLQFQAALQHPYVLVGLSAVFILLALSMFGLFTLQLPSSLQTRLTLLSNKRQGGSPGGVFAMGAIAGLICSPCTTAPLSAILLYIAQSGNLWLGGGTLYLYALGMGLPLILVTVFGNRLLPKSGPWMSHVKTAFGFVILALPVFLLERIFGDQWGLRLWSMLGVAFFSWAFITSLGATRPWMRLVQIILLAAALVSARPLQDWAFGAPAVEQQAHLAFTRVSSVAELDQALAQAKGQPVMLDLYADWCVACKDFEKYTFSSPDVQQALKGTVLLQVDVTKNSPQDVALLKHLQVLGLPTILFFNAEGQEQPERRVTGFMDAAAFSAHLRDWQA

SEQ ID NO: 8400 - protein, 711 aa, Klebsiella pneumoniae
VGRSMTNEIFTTIISRLNFSLRHKTPVILQSEATECGIACLAMVCGHYGLDIDLFNFRQRFGSASQGVTMMSLSKTADHAGLKSRALSLDLNEIRQLKLPCILHWGMNHYVVLTKVRKSSFIVHDPALGKRVIGNQEMSNYFTGIALELWPDQNFQQEKAKSRLRLLDLMRNIIGLKSTLLKIFAFSVVVEAIGLLLPIGTQLVTDHVIMAHDQSLLSVICIGLVFFTLFRTFISMLRAWTSLTLNTLTNIQWKTTLFDHLASLPLSFFEKRHLGDIQSRFSSLDTIRSTFTNSIVSGIIDSIMTIGLLIMLTLYGGWLTWVVVGFTLCYAIMRFATYRFYRRVAEEQVIKGARSSSHFMESLYGISTIKALNLKERRSQHWLNINIEACNAGIKQTRFDMMFGGINTFITTIDQVAVLWLGAIMVIDNNMTLGMFMAFNAYRGQFSQRASSLIDLCMQLRMLSLHNERLSEIVFSEPEQELPAREVFSADSGAKLEVKNLCYQYDPFSQPIFSNLNITVEPGESVALIGPSGVGKTTLLKVMCGLLSPTSGDVLADNLDITKIGLNNYRHGTACVLQEDRLFSGSLIDNISGFEDNADIDFVMECARRCNIHDEIMKMPMGYETIVGELGLGISGGQKQRILIARALYRKPSILFMDEATSHLDLKNESVINQSISALSITRIIVAHRPSTIASADRVIDLSQTKTLAPA

SEQ ID NO: 8401 - protein, 131 aa, Klebsiella pneumoniae
SCLSPCSGKEAEMINPNPKRSDEPVFWGLFGSGGMWGAIVAPVMVLLVGILLPLGLAPADAFSYERVLAFAQSFIGRAFIFLMIVLPLWCGLHRIHHAMHDLKIHVPNGKWVFYGLAAILSVITLVGVLFI

SEQ ID NO: 8402 - protein, 515 aa, Klebsiella pneumoniae
GQASLVGRCPRLDRFMHQQLKKMSLIGLILMIFTSVFGFANSPSAFYLMGYSAMPFYLFSALFFFIPFALMMAEMGSAYRREEGGIYSWMNHSVGPRFAFIGTFMWFASYVVWMVSTAAKIWVPLSTFLFGADKTQTWALGSLTPTQTVGILAACWMVVVTFIAVKGINKIAKITAVGGIAVMGLNLVLLLVSGAILLLNGGHFAQPLNFTLSPNPGYQSGMAMLSFVVFAIFAYGGIEAVGGLVDKTDKPEKNFAKGIIIAAIVISIGYSLAIVLWGVSANWQQVLGARSTNLGNITYVLMTSLGATLGQALHLTPAASALTGVWFARITGLSMFLAYTGAFFTLSYSPLKAIIQGTPKALWPSVMTRLNVNGMPAAAMWLQCLLVGVFIVLVSFGGDSASAFYNKLTLMANVSMTLPYLFLTIAFPFFKAKTHLDRPFVIFKNRPSTLLATGVVLLVVTFANIFTIIQPVIDSGDWNSTLWMVGGPIFFSLLALGIYESYRRRMASGALVMES

SEQ ID NO: 8403 - protein, 188 aa, Klebsiella pneumoniae
SSIPNTDDRLNAINGSDGAAVFLCKIRGGRFYLFTYCCTLRRIHSQKESMMWYQQTLTLGPKSRGFHLVTDEILGQIRGLSGVKVGLLHLLLQHTSASLTLNENCDPTVRYDMEQYFLNAVPDNAPYEHDYEGPDDMPSHIKSSMLGVSLMLPVEDGRVRLGTWQGIWLGEHRIHGGSRRIVATLMGE

SEQ ID NO: 8404 - protein, 237 aa, Klebsiella pneumoniae
APVPIVNLNKLRERLMLTVHHLNQSRSQRVLWALEELQLPYQIVRYQREKTMLAPAALKKIHPLGKSPVLEDNGYVLAESGAILEYLQETWDSGGLLKPQGIDDKLQYRFWLHYAEGSLMPLLLMKLVFASLGKPPVPFGVRSLGSLLGKGIQKTWLDPQLATHARFIDDHLAARPWFAGERLSMADIQMSFPVMALLARGGMHDLVHIEAWRQRVEQRPAWQRAIERGGPFTLPGA

SEQ ID NO: 8405 - protein, 214 aa, Klebsiella pneumoniae
VHPPGCTFFCTRGSLLHGCCVNDRILTFARHQPPILRYNAFTLCTGESGMSHPALTRLRALRYFAVMPSLPPPLSDWLLLEDSMTQRFEQQGKQVTVTLVNEGYIGRDALTDEAALLPDEPRYWLREIILNADGEPWLAGRTVAPESTLCGPELALQQLGQTPLGRYLFTSSTLTRDFIEIGRDAALWGRRSRLRLSGKPLLLTELFLPASPLY

SEQ ID NO: 8406 - protein, 101 aa, Klebsiella pneumoniae
AGNPLCCPGQPAAARRPAPGAWSGCARAWRPLPPATWLSARHRSAPSPPPARQSSAGWSSYGARWPSAAPARGPRFRCLHRPRTDRRRAPRTARKFWRTSC

SEQ ID NO: 8407 - protein, 518 aa, Klebsiella pneumoniae
RMIPMDAVKKRHWWQSPQLTWSVIGLLCLLVGYLVVLMYAQGEYLFAIMTLILSSVGLYIFANRKAYAWRYVYPGLAGMGLFVLFPLICTIAIAFTNYSSTNQLTFERAQQVLMDRSFQAGKAYNFTLIPAGDEWKLALTDGESGKNYLSDAFKFGGEQKLALKETDALPEGERANLRVITQNRTALNQLTAVLPDDSKVIMSSLRQFSGTQPLYTLGEDGVLTNNQTHVKYRPNNDVGFYQSINADGSWGNEKLSPGYTVTIGWDNFTRVFHDEGIQKPFFAIFVWTVVFSVLTVVLTVAVGMILACLVQWEALKGKAIYRVLLILPYAVPSFISILIFKGLFNQSFGEINMMLSTLFGIKPAWFSDPTTARTMIIIVNTWLGYPYMMILCMGLLKAIPDDLYEASAMDGAGPFQNFFKITFPLLIKPLTPLMIASFAFNFNNFVLIQLLTNGGPDRLGTTTPAGYTDLLVSYTYRIAFEGGGGQDFGLAAAIATLIFLLVGALAIVNLKATRMKFD

SEQ ID NO: 8408 - protein, 131 aa, Klebsiella pneumoniae
GRHPQPLQVKHHKRRDGMAKVKQTGVFEQIVAAGVIRRAIDRNRRADSPAQRKQPLHMIQMVVGQQHLLKAAGGMMFHQIRSSGIEQRHGAVERDHSATGAAAVIFLAASAAAGRAVAAEDRHQLSAAGAG

SEQ ID NO: 8409 - protein, 254 aa, Klebsiella pneumoniae
RGHPDAKQGISMRKVLTVLLLSTLAIGTASAETLHFGTTTANPPFVTANGKNQPVGFDIDLAHALCQQMQAQCQFTAQRFDTLIPALRFKKFDAVIAGMEVIPMREKQVAFSRPYRQALSGVVIVNKDVAHTFADLKAKKVGVVKGTLHQRYLRDKQKAVQAVPYDDVASALAALKAGQITGVMGDFATLDAWQQENPDYAIMDERATDPAYYGKQYAIAVRKDDPELLNAINDALAAVMATPDFQQMQQKWFK

SEQ ID NO: 8410 - protein, 168 aa, Klebsiella pneumoniae
TQRPLMKETPVRWIPFIAFFLYVYIEISIFIQVAHVLGVFMTLILVIFSSVVGMSLVRNQGFKNFLLMQQKMAAGESPAAEMIKSVSLIIAGLLLLLPGFFTDFLGLLLLLPPVQKHLTMKLMPHLRFSRMPGGGFSAGTGGGETFEGEFQRKDEQRDRLDHKDDRRD

SEQ ID NO: 8411 - protein, 342 aa, Klebsiella pneumoniae
RDVPPMNPRKPSVTAQDVARRAGVSRAVVSRALSNNGSISPDARARVLRAAEELGYQVNFLAQGLNRQRSHLIGVIVSRISDPFRSTLLDALLNEIQRQGFQALVSEIHSEQDLAQTLRRFAQFRVSGVIVTSGQPPEALVNECVQQHIPVVGINRQPTIPGVDYVCSDNAAGAELAADQLLRSGCQRFGWLNHHPSTWAGRMRGEAFGRALQTRGVDVERHLAILACQQEGYAGGLQAAALADEALEGIFCANAQLACGFLDGMRQRGREAPADFQLIGFDNTPTTAQYSYQLTTLHQDVAAIARQALARLLERAADPSQPSRTTWVEVTLIHRRTSPFVI

SEQ ID NO: 8412 - protein, 265 aa, Klebsiella pneumoniae
NLPPLILHKKTAAPSLPFIAFRRSSVFGIDDYFLAQRASHRQRLIGGVGGPQHADATGARFAGGGDIVIRIAVENLYLLRLQPLGLGVLARLIASENHRIHIGGRDEKIILQGFRNGFGFGLAAAGDEPDAVPALHMHRNQLARHLFRHAEFIPAIVHFFPELRVFQVILAAGREGFLPAPETRTGEEDGVIDIKADGHRRPPQQAVLNLRHRNPVDWRLLGQLGHVGADPQRLRRGGACHNGAVQREQERSRRKGESKFAHIYP

SEQ ID NO: 8413 - protein, 68 aa, Klebsiella pneumoniae
YWPPAPAPAAPAGPPPAGPASASAPAASPAAVPLRFCTPAPPPPATGAPPPWRHSPCPAPDPYCRACR

SEQ ID NO: 8414 - protein, 565 aa, Klebsiella pneumoniae
IRPFDQKRSQRGKSMIKRVLTALAATLLPLGAHAADAITGSVQRQPTNWQAIVMFLIFVALTLYITYWASKRVRSRSDYYTAGGNITGFQNGLAIAGDFMSAASFLGISALVYTSGYDGLIYSLGFLVGWPIILFLIAERLRNLGRYTFADVASYRLKQGPIRTLSACGSLVVVALYLIAQMVGAGKLIQLLFGLNYHVAVVLVGVLMVLYVLFGGMLATTWVQIIKAVLLLCGASFMAFMVMKHVGFSFNNLFTEAMAVHPKGAAIMSPGGLVKDPISALSLGLGLMFGTAGLPHILMRFFTVSDAKEARKSVFYATGFMGYFYILTFIIGFGAIMLVGANPAFKDAAGQLIGGNNMAAVHLADAVGGNLFLGFISAVAFATILAVVAGLTLAGASAVSHDLYANVFRKGATERQELKVSKITVLILGVVAILLGILFENQNIAFMVGLAFSIAASCNFPIILLSMYWSKLTTRGAMVGGWLGLLTAVILMILGPTIWVQILGHEKALFPYEYPALFSIAIAFIGIWVFSATDNSPEGMREREQFRAQFIRSQTGIGIERGQAH

SEQ ID NO: 8415 - protein, 481 aa, Klebsiella pneumoniae
KCRPKGRHSVLAAQALCAPGFITVNQAVSRAVVAANFAAVFQLRQDAVSQLFAQLNAPLVKGEDVEDRALGEDFVLVQGNQRPEAERGDLTQQDGVSRAVTFEHFERHHVLQGRRVFTLIAIFLLNHFAGFTKGQGLGLGEEVRQQFLMVVRQRVVGDSRSDEIARYHFGALVDQLVERVLTVGARLTPDDWASLVVYRVAVTVNILTVGLHVALLEVSGKAVHVLVVRQNRFGFRTEEVVVPDADQRQQHRQVFLRRSGGEVLIHCMRAGQQLNEVVEAHGENDGQTNRRPQGVTAANPVPEFEHVGGVDTELANRFRVGGKRGEVFRHVLVVARGCQEPVARAVGVGHGFLGSESLGRHQEQSRFRIHVLQHFGDMGAIDVRDKVHVEVVFIRTQRLGHHERTEVGAADADVNHVGDRFAGVAFPATGDNRFGEGFHLLQHSVHFRHHIFAINHNRRIAAVTQRDVQYRAVFGAVDLLT

SEQ ID NO: 8416 - protein, 94 aa, Klebsiella pneumoniae
WRLPPGMSASSTHTPFLLKIAKIPSSLDGLSMLIGHENKTDTKDDIMVKKTIAAFFTVLVLSSALTACNTTRGVGEDISDGGNAISGAATKAQQ

SEQ ID NO: 8417 - protein, 403 aa, Klebsiella pneumoniae
KTVPILKPTLSVMKGWFISLACKIVVSYLFYGANGRINVAMQRINYFPRKEVSQHPKLFAASDKRISHMKKIFLFSALLIIACGQAEATCNIKDIAKRVNFNMPSNVKISTDPTIPVGSILYTKLMGIGGSAPAFTCDNSSKNRYTTVITASEVPGVTGIMGKPVYETGIPGIGYQISDLLTGSVYGMIPAVAGSIPVPGTTENTLYRYWLIKTGTIDLSQSPTNSSVSFYVADSDYKATMPSSLLLSINMKFVSPVPRENSCEITSTKTVNLSRIDKVTLLSTSPGSKTSKEKSFTLNINCEQKSTGNTIYYWFNPRSSTDGTPGVLLNSDSTSSGGAQNVNTIIKENGIPVNFYDYEAKSFIVDANKLNKEINLTADYYRTTDDITIGTVRGLLEVVIQEE

SEQ ID NO: 8418 - protein, 472 aa, Klebsiella pneumoniae
YCALNNPTKQRNTIHTPCSGYHDEKEWCLSLRKSVVKKTKKVSLAWQILLALVLGILLGSYLHYHAESRDWLISNLLTPAGDIFIHLIKMIVVPIVISTLVVGIAGVGDAKQLGRIGAKTIIYFEVITTVAIVLGITLANVFQPGTGIDMSQLAAVDISKYQNTTAEVQSHAHGLMGTILSLVPTNIVASMAKGDMLPIIFFSVLFGLGLSSLPATHREPLVTVFRSISETMFKVTHMVMRYAPVGVFALISVTVATFGFASLWPLAKLVLLVYFAILFFALVVLGIVARLCGLSIWILIRILKDELILAYSTASSESVLPRIIEKMEAYGAPASITSFVVPTGYSFNLDGSTLYQSIAAIFIAQLYGIDLSIWQEITLVLTLMVTSKGIAGVPGVSFVVLLATLGSVGIPLEGLAFIAGVDRILDMARTALNVVGNALAVLVIAKWEHKFDRKKALAYEREVLGKFDKTAQ

SEQ ID NO: 8419 - protein, 456 aa, Klebsiella pneumoniae
PVRPASFAATRTSATPPPATTPSSTAARVACRASSTRAFFSFISTSVAAPTLITATPPASLATRSCSFFTIVVGGRFLDLLTDLSYAALDCGFFANAIDDGGGVFVDNHAFRLAQVFQSRFFQLHTDLFRDNGTASQSSDVLQHSFTTVAEARCFHRSHFNDAAHGVNHQGRQRFAFNVFSDDDQRFASFRYGFQNRQHFADVGDFFVSQQDERAFQLNGTGVRLVDEVRRQVAAVELHTFNYVQFVFQTGTVFNGDHAFFTNFIHRFRDQFTDGFVGVSGDGTYLSDSFGVRARNGQRFQLFYGSQYRFVDTAFQIHRVHACSNSFQTFVHDSLSQYGCGGGTVACCVVRFRGNFFHHLRAHVFELVFQFDFTCNGNTIFGDGRRAEGFVQNHVTAFRAQGHFNCICQYVYAAQHFYTSVVTEFYVFCCHFFYSSNSFRVVRIKLQQLPGCRFRT

SEQ ID NO: 8420 - protein, 297 aa, Klebsiella pneumoniae
KIKLRIKAPLGKASAKKGDILSPRLTCRSLIARIPTMSGHKKYLSVAMLSAVLLPAMASAADAPATFTPEQEAKIGKIAADYLVAHPEVLLQASQKLQQIQAEQQASAATQAVLKNAAVLTQDKNTPTYGPANGKVTVIEFFDYQCVYCSRLAPVMEQVIKAHPQTRFAFKEWPIFGGRWESSLEAAKTGLQIYQQKGADAYLAYHNGIYATGHNEGKLTTADIQQQAKKAGFDAKKAADVEPVLQSINDLAQEIGLSGTPGVIVMPTTGATEASITVFPGLADKASLEAAIKKAGG

SEQ ID NO: 8421 - protein, 122 aa, Klebsiella pneumoniae
INTTMVFRLTRRNTMRYRESIRGARWMRIRDSIAERLEACGLYRRAASRWIEVMQRCLDDEDREWIRHHRNQCLKKAQRPPAPKEEFADLHQAAKETQYRMGIAKPYGEAFRLPGKGKTAAE

SEQ ID NO: 8422 - protein, 680 aa, Klebsiella pneumoniae
CKYTVLRMTMLNTTLRNGLMLLIWLCLIFSVRAEEVPFLVPQQRPQLEANQPWPADRFLVLAYHDVEDDAADQRYLSVRTSALNEQIAWLLHNGYHAISVQDILDAHYGLKSLPPKAFLLSFDDGYSSFYTRVWPLLKAWNVPALWAPVGSWVDTPAGQPVNFGGLMTPRERFATWEMVRELSRSPLVEIGAHTWASHYGLPANPQGSREPAAANRGWDKTTGRYESDAQFTRRMTDDVQKVTAKIHEVAGKTPRAWVWPYGAASGSTLAIAKQQGYQLAFTLNDGLGNVKDLDNIPRLLIAGNPSLKAFASAVTQIQEADPVRVMHVDLDYVYDPNPVQQAKNIDKLVQRVYDMKISHVFLQAFSDPQGDGTVKSLYFPNRWLPMRADLFNFVSWQLQTRGNVKVYAWMPVLAFDLASDLPRVQRWDPQTGKALLARQPYVRLSPWDPRVRQQITDIYEDLARHASFSGILFHDDAVLTDFEDVSPEAVAAWRQTGMAHDAAPVPQRPQERQAWMRFKSQTLTRFTLDLRQAVQAIRGPQVKTARNLFALPILEPQSEAWFAQNLDDFLAAYDWTVPMAMPMMESVPIDASQAWLTRLVQAVARHPGALKKTIFELQARDWNRRQQNAIPDQQLADWMRLLRLNGVKNYGYYPDDFINNQPDISRIRPQFSSWWYPDHD

SEQ ID NO: 8423 - protein, 396 aa, Klebsiella pneumoniae
RRGTPSGRRPTALYGNDSMIINNVKLVLDDEVVHGSLEVHDGRILAFAESQSRLPQALDGEGGWLLPGLIELHTDNLDKFFTPRPKVDWPAHSAMSSHDAMMVASGITTVLDAVAIGDVRDGGDRLENLEKMVNAVEETQKRGLNRAEHRLHLRCELPHHTTLPLFEKLIDRESVSMVSLMDHSPGQRQYADRSKYRDYYQGKYHLTHDEMDRFEAEQMALAATWSQPNRQTIAAMCRARRIALASHDDATEAHVAESHQLGSVIAEFPTTLAAAQASRQHGMHVLMGAPNIVRGGSHSGNVAAHQLASHGLLDILSSDYYPASLLDAAFRIADAEDNAFTLPQAIRLVSQHPAQALGLDDRGVIAEGKRADLVLAHRRGEHIQIDHVWRQGKRVF

SEQ ID NO: 8424 - protein, 68 aa, Klebsiella pneumoniae
HTSTWVVRGIASRRSPQVRIRSMPSGNGCGRSVNSSMMQSGSCGAIIRSSAMPAPVRRSMRPPLRLAS

SEQ ID NO: 8425 - protein, 74 aa, Klebsiella pneumoniae
KLATVGVEGHKHTESHIIINNHNGTQPKNRDLIDSSYKSIDSTKHHVEARLFDSGIAGFNINIEPMLGATLFQV

SEQ ID NO: 8426 - protein, 77 aa, Klebsiella pneumoniae
PFSTDVYRISLNFAYDEQKMTSRCANVIVHAQSANNFLVSCFHLSTSSDPLISQAPGKVKGPPRSMARCQAGRCSTR

SEQ ID NO: 8427 - protein, 101 aa, Klebsiella pneumoniae
SFGFRYWYSPFWWPISSRPMFARTSLVFMFTEVPAPPWKTSTGNWSMHLPLFRTSSQAAIIAFAALLGMVCSSLFASAAAFLTMTMPRTNSGMSLILLLLM

SEQ ID NO: 8428 - protein, 214 aa, Klebsiella pneumoniae
GGGFIKEQDRIVDRKTAGDVDPLLLAAGKGGRRKVPQAFRNVEAGQELGGFRGARFARRPKIEQRLHHHLQRRNARDHPQKLADPADGGFAHFQHLAWGGGDQVHPFVAVADMDMAAVRQIIGVQRTQQGRFAAAGVTVEHHALPGVNGQRGVGQHRQTHAVLLVQNKGFMDVFNADHVSSHGVELPGGASLTRPTNNAPVARVRSNRHPAKQH

SEQ ID NO: 8429 - protein, 253 aa, Klebsiella pneumoniae
SMATKLNWLLQNSAPGDVILQSWLSQHAISPSLAFKYAQSGWLKKRGNGVYARAGREPEWNDAFACLQNQLAAPVYVAGLSSLVWQGRSHYLQLKQNQCWLSVENKALLPKWFREFPGVEWIVISGKKLPVLDDRYRVTLDIKGKKLIGSAPELAAYELLSAVPGTLSFNHGAELFQGLVNLNPRKVEYLLSVSQSVQAKRLYLFFASFYEHGWLKRIDSQKIDLGAGKRQIVENGKFNAQYQITVPERFQKE

SEQ ID NO: 8430 - protein, 336 aa, Klebsiella pneumoniae
GRATMSIPKENSAPVAKSASAKKMLMGDLMQTVGILPILILIVAVFGFIAPNFFTESNLLNITRQASINIVLAAGMTFIILTGGIDLSVGSILGTTAVAAMVVSLIPAFALLSIPAALMLGLLLGLFNGALVAFAGLPPFIVTLGTYTALRGAAYLLADGTTVINSDISFEWIGNDYLGPVPWLVVIALAVIAVCWFILRRTTLGVHIYAVGGNMQAARLTGIKVWLVLLFVYGMSGLLSGLGGVMSASRLYSANGNLGVGYELDAIAAVILGGTSFVGGIGTITGTLVGALIIATLNNGMTLMGVSYFWQLVIKGAVIIIAVLIDKYRTRHHQSA

SEQ ID NO: 8431 - protein, 204 aa, Klebsiella pneumoniae
WGKTSMIHAILDEYSHARRVENSMSANENNLIWIDLEMTGLDPERDRIIEIATLVTDANLNILAEGPTIAVHQSDAQLALMDEWNVRTHTGSGLVDRVKASTVSEHDAELATIEFLKQWVPAGKSPICGNSIGQDRRFLFKYMPQLEAYFHYRYLDVSTLKELARRWKPEILDGFKKQGTHQAMDDIRESVAELAYYREHFIKL

SEQ ID NO: 8432 - protein, 245 aa, Klebsiella pneumoniae
GLMTMHLSRHPTSYPTRYQEIAARLEQELRHHYRCGDYLPAEQQLATRFDVNRHTLRRAIDQLVERGWVQRRQGVGVLVLMRPIDYPLNAQARFSQNLLEQGSDPTSEKLLSVLRPASAHVAEAFGINEGENVIHLRTLRRVNGVALCLIDHYFADLRFWPVLQTFSHGSLHDLLRDRLDVELTRVRTKISARRAQAKESKLLEIPNMAPLLCVRTLNSREGESLTAEYSVSLTRADMIEFTMEH

SEQ ID NO: 8433 - protein, 95 aa, Klebsiella pneumoniae
SWVTINDVNPSLFCRDLISWRTFRRTLASRLDNGSSNTSTWGSMARALASATRCRWPPDSSVTFTSPSPSRLTIRSSSATRRAISAPRHLRSFRP

SEQ ID NO: 8434 - protein, 187 aa, Klebsiella pneumoniae
MKKTIVAVMVAASAVLSAQAMATNTAQVTVLGEVSDASNSCVVTPTGTLNNGIVQLITVTTTEANAEAAGKLFKTQDFGFEVKDCAQGSTNPVTGVTVNVSGTSSSDATILDNTAANGAAGIGIGIQRVSDAHRVAFDGSDTMSESYSATNGTQLKYTTGYVRTNAATPVTEGPVKGVATFTIDYTN

SEQ ID NO: 8435 - protein, 199 aa, Klebsiella pneumoniae
KNLAAFSLLDSTLSLKASKEHAMRILPIITAIAVSFLSVACSTPAPPPGVTVVSPFDVQRYLGTWYEIARFDHPFESGLEKVTIAWHPRDDSGLDVVNKGYNPDRGMWQKTDGVAYFTGEPSRAALKISFFGPFYGSYNVIALDKEYRYALVCGPDRDYLWLLARAPTIAPEVRQQMLDIATRQGFDVGKLVWVNQRYD

SEQ ID NO: 8436 - protein, 131 aa, Klebsiella pneumoniae
RRIAPYPGCLNGTSKRKTPVSTAPPGNGSVVIPFVVFIRLLHHAVSHRAEQAVQTLHIPQQRQVQRTGFDALHVLLMQTVNVRMRVAAVKNAEPVFAAPQAAGAGHIAGEEDRHRQLQVAEQQIVQGVQLL

SEQ ID NO: 8437 - protein, 354 aa, Klebsiella pneumoniae
MYVAVKGGEKAIRAAHALQEQKRRGDGRLPELSVEQIGDQLSLAVDRVMTEGGIADRELAALALKQASGDNVEAIFLLRAYRTTLPRLAVSEPINTAEMRLERRISAVYKDIPGGQLLGPTYDYTHRLLDFTLLANGEAPSVQQADGEAEPTPHVFSLLTQQGLAKTEEDRGTPPDDITRTPPVYPCSRSSRLQQLMRGDEGYLLALAYSTQRGYGRNHPFAGEIRSGYVQVEIVPEELGFSVNIGELLLTECEMVNGFVAPQEEPPHFTRGYGLTFGMSERKAMAMALVDRALQAPDYDEEIAGPAQDEEFVLAHADNVEAAGFVSHLKLPHYVDFQAELALLKRLQRENERG

SEQ ID NO: 8438 - protein, 92 aa, Klebsiella pneumoniae
ALVAAPEIALPPSEISSPTPRVVLQAVSAEERTKTVKNAAIVFFTIMSSLVSVLFSCPISIDKPSKDEGIFAIFKRKGVCVEEADIPGGKRH

SEQ ID NO: 8439 - protein, 425 aa, Klebsiella pneumoniae
PPAAGGCRAVLADKKPRSAPCANAGPAYFSFTTITVISACSFWGQSMLTKTKAAIVTTLFLSLGAQADTILNVATAGDQNMVDYVKTWLGPKFEAAHPGVKVRVIGTGPGDAGSNKISEKLTAQQESGAQQWDIDVAVVHQKAGGEQVTKGLLQKYRQDIQTGGMVSSPSATQALGVNVDGYVMPMFLSQTAIAWNSDLVTTPPASYDELVAWTQKHPQAFGYNGIKNGMSGVSFVVGWIYAYGTDAQRLSAGPYDKSVEKGWQQAYEKLKAFNKNVTFTPGNAGTLDMLSRGEIAMGPVWVDMFYSWKDQGKLPPSIKLALLAPGMPGQPMYYVIPTKAANPQLARDFIALATSPEVQAQGIVKQFNWYPGIDAGQVKPKLDAATWQKLFAEISPEALAKYGKSFPIAPYFDDIKEGYESQVAN

SEQ ID NO: 8440 - protein, 502 aa, Klebsiella pneumoniae
SSYAAGGNEPGGACHALSNAEGGAGDSDLDPMSISMTTKLSYGFGAFGKDFAIGIVYMYLMYYYTDIVGLSVGVVGTLFLVARILDAIADPIMGWIVNCTRSRWGKFKPWILIGTITNSVVLYMLFSAHHFSGGALLAWVWLTYLLWGFTYTIMDVPFWSLVPTITLDKREREQLVPYPRFFASLAGFVTAGVTLPFVNAVGGADRGFGFQMFTLVLIAFFVVSTLVTLRNVHEVYSSDSGVSEDSSHLSLRQMVALIYKNDQLACLLGMALAYNTAANIIAGFAIYYFTYVIGSAEMFPYYMSYAGAANLLTLILFPRLVKGLSRRILWAGASIMPVLGCGVLLLMALGGVYNIALISLAGMLLNIGTALFWVLQVIMVADTVDYGEYTMNIRCESIAYSVQTLVVKAGSAFAAWFIAIVLGIIGYVPNVVQSSHTLLGMQVIMIALPTLFFALTLFLYFRYYKLNGDMLRRIQIHLLDKYRRVPENDVEPERPIVVPNQV

SEQ ID NO: 8441 - protein, 62 aa, Klebsiella pneumoniae
SPHASNRSAILSLILIHLAPLMLSRYLMVFRRVSRNTMVVLIYDKTIPVRRKEYIHYNNRCA

SEQ ID NO: 8442 - protein, 322 aa, Klebsiella pneumoniae
WSNAMRIFIDDGSTNIKMLWEQDGETFTHISPNSFKRGWSATFGSGKPFNYTVDDEKYSFDLITPDALPTNNIDWQYSPLNSIAVHHALLTSGLEPQDVEIVVTLPLTEFYDEDAQYRLDNIERKKKSLLRDVKLNKGVVFNITKVTVRPESIPAGISLCDELKPSHSVLIIDLGGTTLDISMVAGQMTSVSRIYGDPKLGVSLVTDAVKLALARANTDTSSYNVDQIIINRHDEEYLTDNINDPDAVSEVKKVINNSIERLTTRVLTAIDSFKCYSHAIVIGGGAPLVADAIRERMGLREDRFVVAEEPQFALVRGLKIIG

SEQ ID NO: 8443 - protein, 68 aa, Klebsiella pneumoniae
PLGATSYRFSATNTIILITIITTISAINHMGILKVTCNRSDAFSPSSGLFAIKSLPCFDEFSISGRFK

SEQ ID NO: 8444 - protein, 85 aa, Klebsiella pneumoniae
PPTAAATTPAISRLFTPPPADFHGRIHLGDERPVAVFHIALQHKPDPENSALMKNRVQDIRVIKPEVVLYPVVYFRPVAVARHLQ

SEQ ID NO: 8445 - protein, 394 aa, Klebsiella pneumoniae
PRHAHASAGNQVDAKLIAQTIHLRRAKSGIAEHPALLEQVIHFAARGNLLQRVDQRLAHGQDVRAHGVHFRLPRGFQPGIVQHRRHHLRAKARRAGVVTAHGGLQLPQHAARGFAVFTDHGQTADALPVQRENFGERVADQHRHPGAGDGANSVGILFQPPAKALVGDVEEGDQLTRFQYLNHAVPLGWRQVGAGRVVAARVQQHNIAGRQRLQRRQQVLKAHAVGGFIKPGVSTYFEASPFKNGDVVFPGRIADPDMRLRKVTFEEVGPDLQRARTADRLNRGNAILLKRGMLCAKQQWRNRLTVAAQPFHWQIQRGAMRLGVQACFRFRHRLQLRDNAVIVVVQPDTQVDFVASRVFFEAFHQRKNRVAGVGVNFLKHAMYLQVYMGQVLTQ

SEQ ID NO: 8446 - protein, 74 aa, Klebsiella pneumoniae
RLNASYVNAAVMRIFHASAANRKKPYDSYTNGAFYSVLTRFLTGVRVKSQKSSQFSVTGATIDRSHNLKSEEYC

SEQ ID NO: 8447 - protein, 196 aa, Klebsiella pneumoniae
KVNASRLIEQMRNTDRTSILIHDRSERNEQPDTLKGFTMSQQYTNELTTDVLERLRQPPFTDEFLSELEPQSRQSLVAEMESMLQRPVLHIFRGATIGSLTRHGGVIRETSGKSTLDGHYSARVGDKVVYPDGREATIICGAGKGRVMQGESMALVGSMLDNGDEIISTPQGCQMFVFREGDALPDGFLTVPGDKH

SEQ ID NO: 8448 - protein, 117 aa, Klebsiella pneumoniae
DQSAMPSSVAPGRPWLPTFFEDRLMASITTSVVLLRWPLVSAVLMFLASSLNIQLRKSDYAGLAVICSCLGLAAACWFATGLLGITLLDIAKIWGNIKDVMIEVMSQTPPEWPMMMT

SEQ ID NO: 8449 - protein, 267 aa, Klebsiella pneumoniae
FTGARRPLLSESRTMTEAQRESLCALIRQAGAHAQALRDAGLQVDKKARQDFVSQADLAVEQEIKGWLQAHFPEEGFLGEESGFEGDDHTVWVLDPVDGTTNFILGMDYWCISLARVCQGELSLGIIYAPDRDEFFFAARGEGAYLNGRRLTLREPEPDAVVIGMGRSSRAPASDYARAIDTLLDAGLEYRRFGAGALMLAHVAAGQLHAYYEAHMNSWDALAGMLLIEEAGGTCNAFLANAGLRRGNLVLAGCASVQPRLAALLAK

SEQ ID NO: 8450 - protein, 124 aa, Klebsiella pneumoniae
PGSAWRKPGTSSSRYPAVRWLKIPNNESTPAFSSIVNTMSGTKRAVNPPNDEDVIMNKDEIGGNWKQFKGKAKEQWGKLTDDDMTVIEGKRDQLVGKIQERYGYEKDQAEKEVSDWEHKNDYRW

SEQ ID NO: 8451 - protein, 169 aa, Klebsiella pneumoniae
RCPAGVRWRRRSAHRRARSGSPRSPAGGRFYTGSDADKTPRLPPGALLSDACRYPASSTRSPARGDRLAPAPPAVRGYAPPYAGAGRRSPPGLPQQKSLPAGGSAGRCPPLAGAAPLPGGRRQRRRRRSAFARSREDRVRRRSLSLPQPVCWRAPVHADVAGCVAERGG

SEQ ID NO: 8452 - protein, 275 aa, Klebsiella pneumoniae
QRPADVCLLRYRLLPPAERGAEKMNQPLLAVNNLTHLYAPDKGFRNVSFELWPGEVLGIVGESGSGKTTLLKAISARLTPQQGEVLYQQRSLYAMSEAERRRLLRTEWGVVHQHPMDGLRRQVSAGGNIGERLMATGARHYGNIRATAEKWLQEVEIPPSRIDDLPTTFSGGMQQRLQIARNLVTQPKLVFMDEPTGGLDVSVQARLLDLLRGLAVELNLAVVIVTHDLGVARLLANRLLVMKQGQVVESGLTDRVLDDPHHPYTQLLVSSVLQN

SEQ ID NO: 8453 - protein, 286 aa, Klebsiella pneumoniae
IMKALALVSTPAWWVKGRRKVRASPVLQTLLLLFMLLAMFGPLLNLLIWTVAESWYFPHSLPSRWGLKYWYQVFNPYSDVSSSLLTSVLIALLSVGVCLLISVPAGYALSRRKMPLRMLFMLLFLIPQAFPNLTVYMNVARLFYQWGLNGSIAGVVLVHSVHGLMYSVWICVAAFSAIDPLLARASRNLGAGPVYTFWHIVLPQAAPGIVAASIFVFLESLDEFTGTFFVGAPDITTLPLLLYNASMSGNYQVSSITALILLVPSLLFMVVIHKFMRPEMMAKLGK

SEQ ID NO: 8454 - protein, 145 aa, Klebsiella pneumoniae
ITGARPMKKVVTVCPYCASGCKINLVVDNGKIVRAEAAQGKTNQGTLCLKGYYGWDFINDTQILTPRLKTPMIRRQRGGKLEAVSWDEALDYVATRLSAIKAKYGPDAIQTTGSSRGTGNETNYVMQKFARAVIGTNNVDCCARV

SEQ ID NO: 8455 - protein, 778 aa, Klebsiella pneumoniae
GKYFIPLFFQLGKALCPTATENRAYSMKYTSHFPLGIVIPLLACSVPLQAAENMTEQSTPDESAATAENHEETMVITAARQNLQAPGVSTITAEEIRKHPPARDVSELIRTQPGVNLTGNSTSGQRGNNRQIDIRGMGPENTLVLVDGKPVTSRNSVRYGWRGDRDSRGDTSWVPAEMIDHIDVIRGPAAARYGNGAMGGVVNIVTKPTTPEWHGSWNTYMNAPQHRKEGATKRTNFSLNGPLSDSVSFNLWGNLSKTQADAQDINAGHEAERTGSYAGSYPAGREGVVNKDIHSKLRWEFAPMQALEFEAGYSRQGNLYAGDTQNTNTSTLVKSMYGKETNRLYRQTYGVTWTGGWDNGVTSNSYAQYEHTRNSRMDEGLAGGTEGIFSSSEFSDIDLADVLLHSEVNIPFTLGVDQNLTLGTEWNQQRMKDGVSTTQALSYGTIDGVSATGRSPYSSAEIFSLFTEDNMALTDSTMLTPALRFDHHSIVGNNWSPSLNLSQELTDDWTLKLGIARAYKAPNLYQLNPNYILYSNGQGCYASSSACYLMGNSDLKAETSVNKEIGLEYKHDGYQAGITWFRNDYHNKIESGYAAVGTASNGTTNIYQWENVPKALVEGLEGTLNLPVGEAVNWSNNLTWMLQSKNKTTGDRLSVIPQFTLNSTLSWQVREDLSLQSTFTWYGRQKPKRFNYKGEAVSGSELNEVSPYSIVGLSATWDVNKNLSFTSGIDNLFDIRHYRAGNAQTTGNATTGAYLYGAGAETYNESGRTFFMSVNTHF

SEQ ID NO: 8456 - protein, 434 aa, Klebsiella pneumoniae
APLASWNAASPARCMSSNSVSPRLSAASRSARRSASAGQMLYGILSGFFVIVWSIMSQPLDLVQLAQQIKQWGTELGFQQVGIADTDLSASEPKLQAWLDKQYHGEMEWMARHGMMRARPHELLPGTLRVISVRMNYLPANAAFARTLKDPTLGYVSRYALGRDYHKVLRNRLKKLGEKIQEQCASLNFRPFVDSAPILERPIAEKAGLGWTGKHSLILSRDAGSFFFLGELLIDLPLPVDSPIAEECGRCVACMTICPTGAIVEPYTVDARRCISYLTIELEGAIPEEFRPLIGNRIYGCDDCQLICPWNRFSQLTDEEDFSPRKALHAPPLVELFAWSEAWFLKVTEGSAIRRIGHLRWLRNIAVALGNAPWDEAHLRALESRRGEHPLLDEHIEWAIAQQLKKRNADAVEVQLPKKLRLVRVVEKGLPRDA

SEQ ID NO: 8457 - protein, 413 aa, Klebsiella pneumoniae
ALMALEGYFLFQGDRTVCGGKIITGAEDTEFFGRSQARESDKVTCGKHPGIYRICGGMGDMYEVGGVNRQLAGSIESYSSCPCRAKFIPQDLDNTYEYNCNAGLAAEREREASRKKLNEAKAKGPEPMPLPALIYATHRAMDDYGAKDMHHGDLSEEALKERFGLTDVSAKVNPYTLTLVPPAPASSYGVFYPGSLTGSTPVVVSREESVRLMFDEFRGLAKVFSFHGPYKNIITDMINHMQGNSGTPYSSPLLDRALKEQILNDHSSDSSLLGIKTALDDAVSYEYGFLPLGKKDDLFDGKGNFKEVNKAVLPKFDRQIDKTNGLVITVHDTWSTHITLESLEVTGDSYRAKVHYRVQDHFGLDDADILNPVFHQGRIFRIWFVLQRYVKYGYRPFITEMNATVEISGRRGE

SEQ ID NO: 8458 - protein, 70 aa, Klebsiella pneumoniae
TRPAWWVCSRANRVGDDIEIYRDETRTHVLTVSHHLAPADEEVGLRQLLPRRFCRAEAERPRRTTSARSP

SEQ ID NO: 8459 - protein, 451 aa, Klebsiella pneumoniae
SFTYEPGEPGNYMEHLHMKTRTQQIEELNKEWTNPRWEGITRPYSAEEVVKLRGSVNPECTLAQLGAAKLWRLLHGEAKKGYVNSLGALTGGQALQQAKAGIEAIYLSGWQVAADANLASSMYPDQSLYPANSVPAVVDRINNTFRRADQIQWSAGIEPNDPRFIDYFLPIVADAEAGFGGVLNAFELMKSMIEAGAAAVHFEDQLASVKKCGHMGGKVLVPTQEAIQKLVAARLAADVMGVPTLVIARTDADAADLITSDCDPYDREFITGDRTSEGFFRTHAGIEQAISRGLAYAPYADLVWCETSKPDLEQARRFAEAIHARFPGKLLAYNCSPSFNWKKNLDDKTIASFQQQLSDMGYKYQFITLAGIHSMWFNMFDLAHAYAQGEGMRHYVEKVQQPEFAAGPEGYTFVSHQQEVGTGYFDKVTTIIQGGTSSVTALTGSTEEEQF

SEQ ID NO: 8460 - protein, 461 aa, Klebsiella pneumoniae
RLPLRSVICCVTLRRFSSIRSSNMLLNAADKALWRLALPMIFSNITVPLLGLVDTAVIGHLDSPVYLGGVAVGATATSFLFMLLLFLRMSTTGLTAQAWGAKDPQRLARALVQPLALALGAGVLIILLRLPLIDLALHIVGGSEAVLEQARRFLEIRWLSAPASLANLVLLGWLLGVQYARAPVILLVVGNLLNIVLDLWLVMGLRMNVQGAALATVTAEYATLIIGLLMAKRVLTLRGVSLAMLKNAWRGDLRRLLALNRDIMLRSLLLQLCFGALTVFGARLGSDIVAVNAVLMTMLTFTAYALDGFAYAVEAHSGQAYGARDGSQLLEVWRAACRQSGMVALAFALIYSLAGQYIIALLTSLPSLQQLADRYLIWQTILPVVGVWCYLLDGMFIGATRGAEMRNSMAVAAAGFAVTLLTLPVLGNHGLWLALAVFLALRGLSLALIWRRHWRRGTWFS

SEQ ID NO: 8461 - protein, 244 aa, Klebsiella pneumoniae
LIDLGINMRKLTLALAAASLLFTLNSAVVARASTPQPLWVGTNVAQLAEQAPIHWVSVAQIENSLLGRPPMAVRFDIDDTVLFSSPGFWRGQKTFSPGSEDYLKNPQFWEKMNNGWDEFSMPKEVARQLIAMHVKRGDSIWFVTGRSQTKTETVSKTLQDDFLIPAANMNPVIFAGDKPGQNTKTQWLQAKQIKVFYGDSDNDITAAREAGARGIRVLRAANSSYKPLPMAGALGEEVIVNSEY

SEQ ID NO: 8462 - protein, 323 aa, Klebsiella pneumoniae
QQHLTCEEKRMRLKPIVTALCAGALLAASPFASAKELKAIGVTVGDLANPFFVQITKGAELEARKLAGDNVKVTLVSSGYDLGQQVAQIDNFIAAKVDMIILNAADSKGIGPAVKRAKEAGIVVVAVDVAAEGADATITSDNTQAGELACKYISDRLNNKGNVVIINGPPVSAVQNRVEGCETEFKKHPDIKILSANQNAKGSREGGLEVMTSLLAANPKIDGVFAINDPTAIGADLAAKQAQRSEFFIVGVDGSPDGEEALKRKNSLFVATPAQDPQVMAAKAVEIGYDILQGKPAPTAPVLIPVTMIDKNNVSSYKGWTVK

SEQ ID NO: 8463 - protein, 89 aa, Klebsiella pneumoniae
VNPQSADAARAAAPFPYPAVAGEGAPAAAPPGRAGLRPADWRSPATATARAGCLTPGAPAAFDSSPAAAGTPPDPCAAPAGSAPGRVHG

SEQ ID NO: 8464 - protein, 438 aa, Klebsiella pneumoniae
QRDQHQQGAHKPQRLGTDGIEVDLADLRLHRPFRAADVNGLIFAAGALSENFRATMAGPVEGQPAALDQHPAADDVIDHQQQEPDGDRGFQTRKQRLGGGEVADGGRQHGHQRGAKHQVPQQAVHHIVAIPLFIQIERNTGVLKAQGDHRQRAADQQEAQAAQRSGEFAVVKIIEHDQRHNQRHNQPDAHQVVAHRLRHAATRPAEVGDKQPVWPGEGGADHHHPQQRHRRGDSIANRHRQRERPGGLQTIAERHPQHRQRRGHQYRPEDRAQRQPEVILGDFPHPGAGALEKAGEMAPRADAKANQQQGGKQRQQGLFAGKHHRAGFAQFADGIQGDQAPQILDDLQRPGEADGADVRSPEQIAVGGFVDLFQRVFQLAVGDLQLGELQHQGVAAAQQRVQQLVLRAQLRLQDLVLLAGQRFAVGLADLPQLRLLTE

SEQ ID NO: 8465 - protein, 225 aa, Klebsiella pneumoniae
AASHRLYGCRGIQRPFARLASVSDTLGGKMEENTVLREDVLAEAIKILEIEGIANTSLEMVAERVSCPTSDLKRFWPDREALLYDALRYLSQQVDAWRRQLLLDETLSAEQKLLARYAALTTCVSNQRYPGCLFIAACTFYPDPQHPIHQLAEQQKQASLAYTHELLTQLEVDDPEMVAKQMELIVEGCLSRLLVKRSQTDVDTARRLAEDILRFAQCRMGGALT

SEQ ID NO: 8466 - protein, 297 aa, Klebsiella pneumoniae
TFFQPGPPSRALACADARFIMSSSIKYLLLVAPAALMIAILFLYPLGFSLVSAFTAPGQPFTLDHFRKVYALYASDVLFSLLIVLISVALLALLAITLSAVIALSPCRPVVRLLGFLYRLPLFIPFIVVAQMMRTFLAKNGLMNNALVAADLVTPLETLSWLGWKGIVITFVWKQLAFATLLICGAMAALESSQILAARNLGASRPRILFDIMLPQVLPTIGVALVLSTVTMMSVLSVPLMIGVGTPTMLTVDMAFRVNSYGDYAVANALGVVSLAICGALSWFYLRHSLQQKGGES

SEQ ID NO: 8467 - protein, 67 aa, Klebsiella pneumoniae
RLPQLKKQWDKILASARRQILAQVSAFPALMGIKKSVRHNKIKCPVSSLEKKRCALFFDSVIQTACH

SEQ ID NO: 8468 - protein, 243 aa, Klebsiella pneumoniae
GHPHPVTGDDAAVGVVAVDAPGAAGSQHHGVSADLHQGAFHHIHRHQAAGLPVIDQQVKDEMFVKALNLGKLKGGLEEGMQHVEAGFVGGKPGAFDFHATEAPDVDAAVGAAAPWASPLLQLGHFRRAVMNKIVDDILLAQPVASRDGVVKMVLKAIVILGNGCGSPFCSDRMAAHRIDFRNQGDFSVGVGLSGGDSGTKACPAGANYGEIGLKSLHDIPPVLVYFAAGLAKKYHCSFIGTGV

SEQ ID NO: 8469 - protein, 825 aa, Klebsiella pneumoniae
AQRQQNTAIAHYLVDDTFMLKKTHIISGLLIAPLTLYAATSYQVDDIRFEGLQRVTIGAALLSMPLHAGDAVTPEDVSEAVRALYASGNFENVQILRDGKTLVVQVKERPTIASVSFSGNKAVKDDALKENLTASGISAGSALDRNSLSEIEKGLQDFYYSAGKYSAQVHAVVTPLPRNRVDLTFVFQEGISAKIAQINIIGNQAFREETLLDQLQLRDNVPWWNVVADKKYQKQKLEADLETLRSFYLDRGYARFAIESTQVSMTPDKKSLYITIALNEGERYRVDRTQVTGDLAQHGPEIEALAQPLAGAWYSGAQVTTVENEIKKHFGKYGYAWPQVTSTPEIDDAHHRVVLHIQVNAGRRYSVRQIRFSGNDTSRDAVLRREMRQMEGAWLNNEKVDQGKVRLDRTGFFENVEQQIVPVSGTADQVDVVYKVKERNTGSFNVGLGFGTDSGVSYQLGVTQDNWLGTGNSVSFNGTRNSYQSYLELGATNPWFTVDGISLGGKIFYNSYDASDADAGSYNQQSYGLGSTLGFPISENNSLNLGLDYVHNRLTNMDPELTTWRYLSSRGIEPSVVTKDGDSGAKYSANDYFASLGWGYNDLDRGFFPRAGNKSSLSGKVTLPGSDNSYYKLSFDTAQYLPLSENKRWVWMERLRAGYAGGLDGKSVPFYDNFYAGGSSSVRGFSSNTIGPKAAYYRCNGSESSYSACPLDASSDAVGGNAMAVLNSEFIIPTPFVNDKYADSLRTSLFVDAGTVWSTSWHNTAQTLAAGIPDYGDPSHIRLSAGIAVQWMSPLGPLVFSWAEPFKKYDGDKAEQFQFNIGKTW

SEQ ID NO: 8470 - protein, 561 aa, Klebsiella pneumoniae
LSSLNCAERKLHNDLSLASSGSTKRSSTMTQQATITDELAFSQPYGEQEKQILTPEAVEFLTELVSRFTPARNKLLAARLQQQQAIDDGQLPDFISETASIRNGDWTIRGIPADLQDRRVEITGPVERKMVINALNANVKVFMADFEDSLAPDWRKVIDGQINLRDAVNGTISYTNEAGKIYQLQPNPAVLVCRVRGLHLPEKHVAWRNEAIPGSLFDFALYFFHNYQALLAKGSGPYFYLPKTQAWQEAAWWNDVFSFTEDRFDLPRGTIKATLLIETLPAVFQMDEILHALRDHIVGLNCGRWDYIFSYIKTLKNHPDRVLPDRQVVTMDKPFLSAYSRLLIKTCHKRGAFAMGGMAAFIPSKDTERNRQVLSKVTADKELEANNGHDGTWIAHPGLADTAMAVFDRVLGDKPNQLSVTRSEDAPITAEQLLAPCEGERTEAGMRANIRVAVQYIEAWISGNGCVPIYGLMEDAATAEISRTSIWQWIHHQKTLNDGTPVTKALFRQWLAEELMVIQEELGEHRFSHGRFDDAARLMEQITTSDELIDFLTLPGYRLLA

SEQ ID NO: 8471 - protein, 210 aa, Klebsiella pneumoniae
LYIHPGGGMKALTTRQQEVFDLIRDHISQTGMPPTRAEIAQRLGFRSPNAAEEHLKALARKGAIEIVSGASRGIRLLTEEEQGLPLIGRVAAGEPLLAQQHIEGHYQVDPSMFKPNADFLLRVSGMSMKDIGILDGDLLAVHKTQDVRNGQVVVARIDEEVTVKRLKKQGNVVELLPENSEFSPIVVDLRQQSFTIEGLAVGVIRNGEWL

SEQ ID NO: 8472 - protein, 445 aa, Klebsiella pneumoniae
SGTHQACGAQKSGLYRCALTFPSTSSRPAVISGLLCKNLPHVNLEIHRVFQKVDAYAGDPILSLMERFKEDPRSDKVNLSIGLYYNDDGIIPQLQAVAEAEARLNAEPHGASLYLPMEGLSGYRQAIAPLLFGAEHTALKQNRIASIQTVGGSGALKVGADFLKRYFPESHVWVSDPTWENHIAIFEGAGFEVSTYPWFDKATNGVRFEDLLATLQTLPARDIVLLHPCCHNPTGADLTPAQWDRVVEVLKARQLIPFLDIAYQGFGGGLEKDAYAIRAIASAGMPMLVSNSFSKIFSLYGERVGGLSVVCEDSETAGRVLGQLKATVRRNYSSPPSFGAQVVATVLNDAGLKATWQAEVDAMRAHILTMRQALVDALQQVAPGSKVDYLLKQRGMFSYTGFSAAQVDRLRDEFGVYLIASGRMCVAGLNSRNVQQVAKAFAAVM

SEQ ID NO: 8473 - protein, 214 aa, Klebsiella pneumoniae
LLQHGPWRRYSVLSGRMSVMDAGFQHGRGADMNMRDGSTRGLLVASLLLLSLPALAYEGSSTVNFNVTGTIEAPSCEVAVEPSNSIDLGTVSSQTFSGHAGASGASVPVKLVFSSCSADASAVTIAFSGTSFDSTHASIYKNFQTGSSGASGVGLQLQSMTDQQPLGPGDQYLYTFGDDADIHTFNMVARMYSPYGQANPGIVGFTATFDVVYK

SEQ ID NO: 8474 - protein, 488 aa, Klebsiella pneumoniae
IHWQLEKKVHMLNNIRIEEDLLGTREVPADAYYGVHTLRAIENFYISNSKISDIPEFVRGMVMVKKAAALANKELQTIPKSAANAIIAACDEVLNNGKCMDQFPVDVFQGGAGTSVNMNTNEVLANIGLELMGHQKGEYQYLNPNDHVNKCQSTNDAYPTGFRIAVYASILKLIDAIKQLGEGFQAKAEEFQDILKMGRTQLQDAVPMTLGQEFHAFNVLLNEETKSILRTAELLLEVNLGATAIGTRLNTPDGYQQLAVQKLAEVSNLPVVPAEDLIEATSDCGAYVMVHSSLKRLAVKLSKICNDLRLLSSGPRAGLNEINLPELQAGSSIMPAKVNPVVPEVVNQVCFKVIGNDTTVTMASEAGQLQLNVMEPVIGQAMFESIHILTNACYNLLEKCVNGITANKAVCEGYVYNSIGIVTYLNPFIGHHNGDIVGKICAETGKSVREVVLERGLLTAAELDDIFSAQNLMHPAYKAKRYTDESEQ

SEQ ID NO: 8475 - protein, 115 aa, Klebsiella pneumoniae
SAGQYPARPPAAAAPLHRWRFPASASPADAAVHIASGGHPLHLPAPAPAARPPGTARPPLAPPPSQPRSTLAAAAAAPSSPAPARSPAPPGRPTGAQSHTPSTAPGRCRCRWLWW

SEQ ID NO: 8476 - protein, 154 aa, Klebsiella pneumoniae
TMINRVIPLPDEQATLALGDRIAQACTGATVIYLYGDLGAGKTTFSRGFLQALGHRGNVKSPTYTLVEPYTLENLMVYHFDLYRLADPEELEFMGIRDYFADDAICLVEWPQQGAGVLPDPDVEIHLDYQAQGREARITAISSRGESLLARLAF

SEQ ID NO: 8477 - protein, 138 aa, Klebsiella pneumoniae
NHAKECIMTTKRKPYVRPMTSTWWKKLPFYRFYMVREGTAVPTVWFSIVLIYGLFALKHGAESWAGYIGFLQNPVVVILNLITLAAALLHTKTWFELAPKAANVIIKGEKMGPEPVIKGLWVVTAVVTVVILFVALFW

SEQ ID NO: 8478 - protein, 247 aa, Klebsiella pneumoniae
QMNKKVIFRGASAIMPLCIGDFPFSFIVGALSVSAGMSVWQSTAWSAIVIAGSAQMLALNMLKTGATLGVIIFTTLIINLRHVLYSASISGTVREASFFKKCFMSYALTDEVYATTVKEMEGNKKEKYLFYGSAMITFWAIWVLADFLGALVGASFPHIEKYGLDFAMVAAFIAIVVPQIKSQACTVAAVVAAVSGVLLVVLPYSLGIVVASVLGVLAGLCVDLAEERKQMAKTESDMPLVEAMENE

SEQ ID NO: 8479 - protein, 90 aa, Klebsiella pneumoniae
IYVKQTLRVGVLTALFVNWGADHAMIKLGEISSNETLKRNNYANEFIETEAVKIFLLQILMQYNWGKFAALCIKAEESPVLKGLRSMPCK

SEQ ID NO: 8480 - protein, 346 aa, Klebsiella pneumoniae
LSHKMAHIVTLNTPSREDWITQLANVVTSPDELLRLLNVDADEKLLAGREARRLFPLRVPRAFIARMEKGNPNDPLLRQVLTAEEEFIVAPGYSTDPLEEQHSVVPGLLHKYRNRALLLVKGGCAVNCRYCFRRHFPYAENQGTRRNWQTAMDYIAAHPQLDEIIFSGGDPLMAKDHELDWLMTQLEAIPHVKRLRIHSRLPIVIPVRITETLASRFQRSSLQIILVNHVNHANEIDGEFRAAMAMLRQAGVTLLNQSVLLRGVNDNAQTLADLSNALFDAGVMPYYLHVLDRVQGAAHFMVSDDEAREIMRELLTLISGYMVPKLAREIGGEPSKTPLDLGLKQR

SEQ ID NO: 8481 - protein, 335 aa, Klebsiella pneumoniae
SRNNTGANMATRIEFSKHGGPEVLQAVEFTPRDPAEHEIQVENKAIGINYIDTYVRSGLYPPPSLPSGLGTEAAGIVSKVGHGVTHIKVGDRVVYAQSALGAYSTVHNVLADKAAVLPDAISFEQAAASFLKGLTVWYLLRKTYEIKPDEMFLFHAAAGGVGLIACQWAKALGAKLIGTVGSAQKAQRAKEAGAWQVINYREESIVERLKALTDGKKVAVVYDSVGKDTWEASLDCLQRRGLMVSFGNSSGPVTGVNLGILNQKGSLYVTRPSLQGYITNREELEEACSELFSLIASGVIKVDVAESQIYPLSEARRAHEVLESRVTQGSSLLLP

SEQ ID NO: 8482 - protein, 290 aa, Klebsiella pneumoniae
NACNGRTNVANPLTGYNFAYLDEQTKRMIRRAILKAVAIPGYQVPFGGREMPMPYGWGTGGIQLTASVIGENDVLKVIDQGADDTTNAVSIRQFFKRVTGVATTERTEDATLIQTRHRIPETPLVEDQILIYQVPIPEPLRFIEPRETETRTMHALEEYGVMQVKLYEDIARFGHIATTYAYPVKVNGRYVMDPSPIPKFDNPKMHMMPALQLFGAGREKRIYAVPPYTPVESLDFDDHPFTVQEWDEPCAICGSRHSYLDEVVLDDSGQRMFVCSDTDYCRQQSEGQKK

SEQ ID NO: 8483 - protein, 60 aa, Klebsiella pneumoniae
RQCFLLVLRKLVYYFFSIGYLFFINFYLYRTNISSSRVTRDIYFIERLSFFNQITNFHIL

SEQ ID NO: 8484 - protein, 386 aa, Klebsiella pneumoniae
IVINTRQSRLTSCRVNVAFFLQPNEHVFTLLKKMPQQRFQVANMSYLQISGLKISYGDKVVLHNIDLAVEQGEMIALLGPSGCGKTTLLNALCGFIPVQSGEVAIASRTITHLAPEQRNITMVFQSYALWPHLTVARNIGYGLKLRKWRGADIARRVAELLRIVNLEGLGEVKVTELSGGQRQRVALARALAIEPQVLVLDEPLSNLDAKVRLNVRHEIKSLQKRLGFTSLIVTHDQQEALVMADRIAVLNQGRIEQTGTPEEIYQRPATPFVADFMGADNKIISGELSAAAISGLSAAQQGDNVIYFRSADAALAELTQPAPQEGLALEGVVEQSAFLGNLYRHSVRCHDRLLLADAAQCWPTKSRVRLHVPTPALHIFPLPLSQ

SEQ ID NO: 8485 - protein, 158 aa, Klebsiella pneumoniae
LEVKRFMEKKSPRIKMLLTPGEVAKRTGVAVSALHFYESKGLIHSQRNAGNQRRYRRDVLRAVAIIKIAQRIGIPLATIGDAFGVLPEGHNLSAKEWKMLSSQWREELDRRIHTLTALRDQLDGCIGCGCLSRRDCPLRNPGDKLGEEGTGARLLEDE

SEQ ID NO: 8486 - protein, 313 aa, Klebsiella pneumoniae
TLSKGIKNMDIQAPYYRQVALLMQVLPYVAVEREFALRGGTAINLFIRDFPRLSVDIDLAWVPLESRAIALPHIRDALARIVANLQQQAGMSAVLQANRSDEMRVIVTTDSAQIKIEVSPVARGTLYPPQEREVVGAVEDVFGYASLPVVSLPDLYGGKLCAALDRQHPRDFYDVKLLLDAQELDRPIFNGFIVYLLSHNRPLAEVLNPRWKDIAEPFYREFSGMTFETIALEELTAVPNRMIAALKSCFTQQDVDFLLSFKRGEPDWRLAPEMRIQDLPAVQWKLRNIHQMPAIKRAESLDKLEKVLAEWRS

SEQ ID NO: 8487 - protein, 476 aa, Klebsiella pneumoniae
TASKTTATTLTILLTTSLISLVSGRNFLPGGTLTMTDRIIALCILCLVFGLPLGVAAVFTGELILDFVFFWPLFMSVLWITGGLYFWFQLERHWPWGEDTPPPTLPGNPLISILIPCFNEEKNARETISAALAQRYANLEVIAINDGSSDNTAQVLQQLAQEEPRLRVIHLAANQGKAVALKAGAAAARGDLLVCIDGDALLDRDTAAWLVAPLIHYPHVGAVTGNPRIRTRSTLIGRIQVGEFSSIIGLIKRTQRIYGRVFTVSGVIAAFRRQALADVGYWSPDMITEDIDISWKLQLRHWDIFFEPRALCWILMPETLKGLWKQRLRWAQGGAEVFLVNLRRLFHWQHHRMWPLFLEYACSTLWAFAYAITILLFILSRLMPLPDNLAVYSLFPPEFTGMLLGLMCLLQFVASLYIERRYEKKVAKSLFWVIWFPMVYWMIGLLTTLVAFPKVMVKRQRSRARWVSPDRGKGSL

SEQ ID NO: 8488 - protein, 344 aa, Klebsiella pneumoniae
NRPLFSGPRPQAGSGTTYHGLEATLLNDLKLSLQYILPKLWLTRLAGWGASKRAGWLTKLVIDLFVKYYKVDMKEAQKPDTAAYRTFNDFFVRPLRDDVRPLNTDPNVLVMPADGVISQLGAIENDKILQAKGHDYSLEALLAGNYQMADLFRNGSFATTYLSPRDYHRVHMPCNGILREMIYVPGDLFSVNHLTAQNVPNLFARNERVICLFDTEFGPMAQILVGATIVGSIETVWSGTVTPPREGIIKRWTWPAGDNEGSIALLKGQEMGRFKLGSTVINLFAPGQVKLVDTLQSLSVTKIGQPLATAVEATAAAEPAPLPEEEIRAEHRASPLVDDKQDQG

SEQ ID NO: 8489 - protein, 504 aa, Klebsiella pneumoniae
QRKNMLKRKKIKPITLKDVTIIDDGKLKKAITAASLGNAMEWFDFGVYGFVAYALGKVFFPDANPSVQMIAALGTFSVPFLIRPLGGLFFGMLGDKYGRQKILAITIVIMSISTFCIGLIPSYATIGIWAPILLLLCKMAQGFSVGGEYTGASIFVAEYSPDRKRGFMGSWLDFGSIAGFVMGAGVVVLISSVVGEQNFLDWGWRIPFFLALPLGIIGLYLRHALEETPAFQQHVDTMEQGDREGLQDGPKVSFKEIATKHWRSLLTCIGLVISTNVTYYMLLTYMPSYLSHNLHYSEDHGVLIIIAIMVGMLFVQPVIGMLSDRFGRRPFILIGSVALFALSIPAFIMINSNVTSLIFAGLLLLAVVLNCFIGVMASSLPAMFPTHIRFSALASAFNISVLIAGLTPTLAAWLVETTQNLMMPAYYLMVIAVVGMATGLSMKETANRPLKGATPAASDIQEAKEILGEHYDNIEQKIEDIDQEIADLQAKRSRLVQQHPRIND

SEQ ID NO: 8490 - protein, 292 aa, Klebsiella pneumoniae
EEEKMEWSLSQNKLLAFHRLMRTDKPIGALLLLWPTLWALWVASPGVPPLWILAVFVAGVWLMRAAGCVVNDYADRKFDGHVKRTARRPLPSGDVTEKEARTLFIVLVLLSFLLVLTLNTMTILLSVAALALAWVYPFMKRYTHLPQVVLGAAFGWSIPMAFSAVSESLPLSCWLMFLANILWAVAYDTQYAMVDRDDDLKIGIKSTAILFGENDRLIIGILQVAVLALMGAVGWLNGLGWEYYWSLFVAAGLFGWQQKLIFNRDRDNCFKAFMNNNYVGLVLFLGLAMSYL

SEQ ID NO: 8491 - protein, 160 aa, Klebsiella pneumoniae
ECRKGESMVINIRRSRPDEGDKLTAIWCRSVDATHDFLTKAYRKELEEMVRAFLPEAPLWVAVNTEDQPIAFMLLTGDHMDALFVDPDVRGCGVGKLLIEHALSLTPKLTTNVNEQNEQAVGFYQKMGFRVTGRSETDDLGQPYPLLNLMYEQQAEADYD

SEQ ID NO: 8492 - protein, 274 aa, Klebsiella pneumoniae
RRLKKCHRERNLSAQACRIDQTDTNSRRAEAKMKPVILVVDDDRAMGELLSDVLGAHAFEVLVSQTGNDALATVAQRADIALVLLDMILPDTHGLQVLQQLQRTRPELPVVMLSGLGSESDVVVGLEMGADDYIAKPFSSRVVVARVKAVLRRSGALAGEASGAGAGLTFNGWRLDTTRCELYNPQQQAIPLTQGEYGLLLALAQNARRVLNREQLLALTHNESTEVFDRTIDVLIMRLRRKIELNPHQPTLIKTLRGLGYVFSADVTHSEKAA

SEQ ID NO: 8493 - protein, 427 aa, Klebsiella pneumoniae
IIMNTDNASLYVKWLKQEVAPALGCTEPVAISFAAAYAAQYLDQPCTKISGFISANLYKNAMGVTIPGTTVCGVPLAAAIGAFGGDSQKGLKTLEDITPRHVEMAQKLIANNAVDIAVEETPDFIHLDLTLSAGENYCRVVVKGTHTNVVELYINGQPQPLSEKQNTRTQRETLPTFSLQQAYEFINRVDFNDIRFILDAARLNSALAAEGKTKKYGLNINGTFSDAVKNGLMSNDLLSKVIINTVAASDARMGGAPVVAMSNFGSGNQGITATMPVVVVAEHLGVDEETLARALSLSHLTAISIHSRYTRLSALCAASTAAMGAAAGMAWLFTRDINTINTAIINMVSDITGMICDGASNSCAMKVSSVVSSAFKAVLMAMQNSCAGANDGIVCADVEQTINNLCRLVIKPMTLTDKEIISIMVAK

SEQ ID NO: 8494 - protein, 230 aa, Klebsiella pneumoniae
IQMKYLFLFLLVFTSGAAVATEPGSQYQQQAEAGDRRAQYYLADTWVSSGDYQKAEYWAQKAAAQGDGDALALLAQLKIRNPQQADYPQARQLAEKAVEAGSKSGEIVLARVLVNRQAGATDVAHAITLLQDAARDSESDAAVDAQMLLGLIYASGVHGPEDDVKASEYFKGSSSLSRTGYAEYWAGMMFQQGEKGFIEPNKQKALHWLNVSCLEGFDTGCEEFDRISKG

SEQ ID NO: 8495 - protein, 81 aa, Klebsiella pneumoniae
RVMKRHFCFINLCELYHTWRFIHQSKNELLLRLITMKFVWILVSNPGKHIFIHCLMIIILRVLLPVLVYYTEKPSQMRVYS

SEQ ID NO: 8496 - protein, 374 aa, Klebsiella pneumoniae
RREKGMASVQLRNVTKAWGDVVVSKDINLDIHEGEFVVFVGPSGCGKSTLLRMIAGLETITSGDLFIGDTRMNEIPPAERGVGMVFQSYALYPHLSVAENMSFGLKLAGAKKDLINQRVTQVAEVLQLAHLLERKPKALSGGQRQRVAIGRTLVAEPSVFLLDEPLSNLDAALRVQMRIEISRLHKRLGRTMIYVTHDQVEAMTLADKIVVLDAGRVAQVGKPLELYHYPADRFVAGFIGSPKMNFLPVKVTATAIDQVQVELPNRQQIWLPVDSANVQAGANMSLGIRPEHLLPSDIADVTLEGEVQVVEQLGHETQIHIQIPAIRQNLVYRQNDVVLVEEGATFAIGLPPERCHLFREDGTACRRLHKEPGV

SEQ ID NO: 8497 - protein, 319 aa, Klebsiella pneumoniae
QFRNTLTMEHRFTSLPPDPFMCSSDEKQSRSPLALYSEYQRMDIELRPPHAMPTSHWHGQVEVNVPFDGDVEYLINNEVVRIEKGYITLFWACTPHQLTRPGDCQQMAIFNLPMHLFLSWPLDRELINHVTHGMVIKSLAAQQLSAFEVRRWQQELSHENEQIRQLAIDEIALMLKRLSLAGWQPILVNKTSRTHKNSVSRHAQFYVSQMLEFIAAHYDQALTVNAVAEHVKLNPNYAMGVFQRVMQQTMKQYITAMRINHVRALLSDTDKTILDIALTAGFRSSSRFYSTFTRYVGMPPQQYRKLSQQRRHGLALPKA

SEQ ID NO: 8498 - protein, 439 aa, Klebsiella pneumoniae
KTRKAYMFGAELVIVLLAIYLGARLGGIGIGFAGGLGVLVLTLIFQIKPGAIPFDVIEIIMAVIAAIAAMQVAGGMDYLVSLAERMLRRHPKYITFLAPLVTWFMTVLAGTGHTAFSTLPVITEVAKEQGIRPSRPLSIAVVASQIAITASPISAAVVFFAGILEPLGVSYLTLLAICIPVTLLAVMLTAIVCNFLGCELKDDPVYQERLAKGEVRLRGSQVFELQPHAKRSVLLFLIGIVAVMFYATAISDTVGLIKNPVLPRNEAIVVFMLTIATLISITCKIDTGEVLNASTFKSGMSACVCVLGVAWLGDTFVKAHISDIQAVAGDLLHNYPWLLAVVLFFAATLLYSQAATTKALMPAALLLGVSPLTAIASFAAVSALFVLPTYPTLLAAVEMDDTGSTRIGKYVFNHAFLIPGVIAITLCVILGFIFGGIML

SEQ ID NO: 8499 - protein, 601 aa, Klebsiella pneumoniae
NWRNVVQTFQADLAVIGAGGAGLRAAIAAAQANPNAKIALISKVYPMRSHTVAAEGGSAAVAQDHDSFEYHFHDTVAGGDWLCEQDVVDYFVHHCPTEMTQLEQWGCPWSRRPDGSVNVRRFGGMKIERTWFAADKTGFHMLHTLFQTSLQFPQIQRFDEHFVLDLLVDDGQARGLVAMNMMEGTLVQIRANAVVLATGGAGRVYRYNTNGGIVTGDGMGMALGHGVPLRDMEFVQYHPTGLPGSGILMTEGCRGEGGILVNKNGYRYLQDYGMGPETPLGEPKNKYMELGPRDKVSQAFWHEWRKGNTIPTPRGDVVYLDLRHLGEKKLLERLPFICELAKAYVGVDPVKEPIPVRPTAHYTMGGIETDQQCETRIKGLFAVGECSSVGLHGANRLGSNSLAELVVFGRLAGEQAMQRAAQAGEANGAALDAQAADVEQRLKDLVNQEGNENWAKIRDEMGLSMEEGCGIYRTPELMQKTIDKLAELQERFKRVRITDNSSVFNTDLLYTIELGHGLNVAECMAHSAIARKESRGAHQRLDEGCTERDDVNFLKHTLAFREADGTTRLEYGDVKITTLPPAKRVYGAEADAAEKKETTHG

SEQ ID NO: 8500 - protein, 853 aa, Klebsiella pneumoniae
VIHLQCQSAKWDHPHPLTHRQRTVVLCNGFLMNIWQIEMERSPYSNTLLFNRNTKLSLSIGLLLLFPALVQGADSLYDQQILQARQGQYAPFLSYLQQYQLRHALTPSQVADWLQVALWAGQDDEVVKVWRRYQVYMPLPARGTAAAAQALRNQKQWQTSLTLWQQALSQAPGSDDYRIGYIKTLADARKDGEALSEARRLVAEQASVAHLQTLSYVYLRLGKSWDQLLVDTQILDRDPQNKTALASLMATLTRNRIDSPALGLANSVELTPAEKRNLQLNAAAELVRLADTPSREEKARYALARTALTQYDAMIAAWHPDPQAAPDIIRARIDRLGALYASAEYAQVIREYQSLIAQQQTVPDWAIGWVISSFIALKQIEPALTLIHQHPSWLTSQQNEEHELFYALLDTGQYPAAQRYVARLTRNAPYIRRLYGSPTPQPNDDWLTAQSLNVHYLAATNDLPQAEARMQRLAATAPGNQGLQIDYAALLQERGLPRAAERQLKAAESLEPASLQLERQQAWVALDLQEWRQMDLLADDVVARSPRDLNTQRLARAREIHHLSELRLSVGKGLHSDNPVSGTHDLSFETAIYSPPLADSWRLFGGHRFAEGNFEEGKGSRRQLFAGIEWRPRDYWGELELSSVNFHGENKPGVRLSAAHDVSDRWQLGGELERISQQTPLRALRNGVSANRGEGWLRWSPNERREYRVSAAASRFTDRNRRQEYTLSGKERLWQTPWLTLDLQPGLSASANSRTDTAYYSPARDLAATAALAVDHTLYQRYDTVWSQQLLAGGGSYWQKNHAAGAITVLGYGQRLRWNNVVDTGLMLNWDKRPYDGKRENNLAITLDANIRF

SEQ ID NO: 8501 - protein, 89 aa, Klebsiella pneumoniae
LDPDAGQESGQNGVKSPISIAIIRLFSVSRRGMKNPHNRSVDIAGVKPLYIRSAYVLVGIYCSRISRYSERVFAGDIMSLFPRPGERRQ

SEQ ID NO: 8502 - protein, 548 aa, Klebsiella pneumoniae
GEADSVLTLLHLLSAVALLVWGTHIVRTGVMRVYGARLRTVLSSSVEKKPLAFCAGLGVTALVQSSNATTMLVTSFVAQDLVGLMPALVMVLGADVGTALMARVLTFDLSWLSPLLIFIGVIFFLGRKQTRAGQLGRVGIGLGLILLALELIVQAVHPITQANGVQVIFASLTGDIMLDALIGAVFAIISYSSLAAVLLTATLTAAGAISFPVALCLVIGANLGSGLLAMLNNSAANAAARRVALGSLLFKLVGSLIILPFVHPLAAAMHKLPLAESELVIYFHVFYNLLRCIAMVPFAGPMAKLCQRLIRDEPELDNHLKPKHLDPSALDTPALALANAARETLRIGDAMEQMLESLHKVMHGEPRQEKELRRMADDINVLYTAIKLYLARMPKDELAEEESRRWAEIIEMSLNLEQASDIVERMGSEIADKSLAARRAFSVEGLKELDALYDLLLSNLQLAMSVFFSSDVPSARRLRRSKHRFRILNRRYSHAHVDRLHQQNVQSIETSTLHLALLGDMKRLNSLFCSVAYSVMEQPDEDDERDDY

SEQ ID NO: 8503 - protein, 317 aa, Klebsiella pneumoniae
KMNDVTEASLPKAIFLMGPTASGKTALAIALRKVLPVELISVDSALIYRGMDIGTAKPDAAELSAAPHRLLDILDPAEAYSAADFRRDALAAMADIVAAGRIPLLVGGTMLYFKALLEGLSPLPSADPEVRARIEQQAAEQGWNALHQQLQEIDPVAAARIHPNDPQRLSRALEVFFISGKTLTELTQTSGDALPYQVHQFAIAPASRELLHQRIEQRFHQMLASGFEAEVRALFARGDLHTDMPSIRCVGYRQMWSYLNGEIPYDEMVYRGVCATRQLAKRQVTWLRGWEGVHWLDSEQPEQALNKVLQVVGASQN

SEQ ID NO: 8504 - protein, 239 aa, Klebsiella pneumoniae
ISLFAPTSTPRVGSSRIRMRGPIATQREINSFCWLPPDSPPARTWACGTRMLSNWMASSEMVCAFRRLSIPQVASRSSVAMVMFSWAASSRNNPCSLRFSVRKPIPRSMASRGEWITTGSPSISITPAVALRTPKISCASSERPAPTSPARPTISPACTTRLLGLTLPPSVRSSTRRRGWPRGMSRSLLNRSLSGRPTIMRTSSGALSLSRTRLPTYCPSRRTLTRSESSYTSAMRWLI

SEQ ID NO: 8505 - protein, 257 aa, Klebsiella pneumoniae
TKGDTMSLTLRLTGTGGAQLVPVFGCDCAACRRARREENHRRRPCSGVVTFNSAVTLLDAGRPDLMEHHPAGSFQQVLLTHYHLDHVQGLFPLRWGVGASIPVYGPPDDAGCDDLLKHPGLLDFSHTVTPFVMFNLQGLRVTPLPLNHSKLTFGYLLESAHSRLAWLSDTAGLPDKSLKFLLNNRPQAMIIDCSHEPRAQTPRNHNDLNTVRSLNQVIGCPRVILTHISHQFDVWMMDNPLPTGFEAGYDGMEIALD

SEQ ID NO: 8506 - protein, 150 aa, Klebsiella pneumoniae
MHFDTATRQRWMSVLAHSEPQDLLARMQSLQLAPEYELIRTPETGLVQLQARMGGIGDRFFAGDATLTRAAVRLADGTLGYSWILGRDRPHAERCAAIDALLQSPRHFHTLMETLITPLEALRSARIEARRAEVNASRVDFFTLVRGDNV

SEQ ID NO: 8507 - protein, 92 aa, Klebsiella pneumoniae
RGSDGQRAQQQDGEDFSHANSLFGVGVASLYVAPPLYDASDFASFSRAEKAILPVMTLIYTIQRRRWRENVHLNKKRKKVIVRGLQGHRILV

SEQ ID NO: 8508 - protein, 459 aa, Klebsiella pneumoniae
PFSLKDDGMKYRITTWLAAALMLSSLHATAASLSDIQVSNGDQQARITLSFVGEPEYSFTPQGKRLVALDIKQTGVLQGLPLQFSGSNLVKSIRAGTPQDTQTLRLLVDLTEDGKTRAVKQQNGANYTVVFTINADAPPPPPPPPVVVKRADPPPVMPSRTTTSGRNPFSSSGHERQTVMTSSQPAMTNNQTVTRPAARTVSADDKVIIAIDAGHGGQDPGAIGPNGTKEKNVTIAIARKLRALLNADPQFKPVLTRDGDYFISVMGRSDVARKQNANFLVSIHADAAPNRDATGASVWVLSNRRANSEMAGWLEQHEKQSELLGGAGDVLANSQADPYLSQAVLDLQFGHSQRVGYDVATNVLSQLQRIGNLHKRRPEHASLGVLRSPDIPSILVETGFISNNGEERLLGSDDYQEQIAEAIYNGLRNYFMQHPLQSAPRGEAAQTASAAAPGGMLIN

SEQ ID NO: 8509 - protein, 256 aa, Klebsiella pneumoniae
MKIDVLGCGSAFSYTQNTSALRVIDADNKQWLIDCGPTVPRALWQRGGEVNDIDAIYFTHVHPDHCTGLTALLNHWKSYSRQKPVIIYCQPAQQPVLMQLAALANWPQADLGFTIDWQECREAWTWQDWQIRTAPTQHELSNRAIRITIAGQTLFYSGDGRPTADSIALMAGAGLAFQECASVAALDDDASHGDFPSCLMLFRTLQLPAMGLYHCEDASLSALKQACQPWPGLFVSRDGLTLTLPRPTPTDETYLL

SEQ ID NO: 8510 - protein, 194 aa, Klebsiella pneumoniae
TISEGLMATYYSNDFRAGLKIMLDGEPYAVEASEFVKPGKGQAFARVKLRRLLTGTRVEKTFKSTDSAEGADVVDMNLTYLYNDGEFWHFMNNETFEQLSADAKAIGDNAKWLLDQAECIVTLWNGQPIAVTPPNFVELEIIETDPGLKGDTAGTGGKPATLSTGAVVKVPLFVQIGEVIKVDTRSGEYVSRVK

SEQ ID NO: 8511 - protein, 177 aa, Klebsiella pneumoniae
HRPEAQVSEVVVNQAQGDAIDPAQGTQVDHVLALIDAKGLGDMGAGGAQHRQQLFAGGIAALFQQVLAEARLGVKRVVDGAHQHQHTHALTALNPAALNQLVDSPAQGVAVNVEARRQLLLGGQIVAAAIVVAQLLLKSGGDFLIARGVTGRMSGQVHGHQASHSIGEELPRVVGRS

SEQ ID NO: 8512 - protein, 374 aa, Klebsiella pneumoniae
GIKEMAAKDVKFGNDARVKMLRGVNVLADAVKVTLGPKGRNVVLDKSFGAPTITKDGVSVAREIELEDKFENMGAQMVKEVASKANDAAGDGTTTATVLAQAIVNEGLKAVAAGMNPMDLKRGIDKAVLAAVEELKALSVPCSDSKAIAQVGTISANSDETVGKLIAEAMDKVGKEGVITVEDGTGLEDELDVVEGMQFDRGYLSPYFINKPDTGAVELESPFILLADKKISNIREMLPVLEAVAKAGKPLVIIAEDVEGEALATLVVNTMRGIVKVAAVKAPGFGDRRKAMLQDIATLTGGTVISEEIGMELEKATLEDLGQAKRVVINKDTTTIIDGVGEESAIQGRVAQIRKQIQETTSDYDREKTAGTCR

SEQ ID NO: 8513 - protein, 456 aa, Klebsiella pneumoniae
PDGECVMSAPKITFIGAGSTVFVKNILGDVFQRPALKSAHIALMDIDETRLEESHIVVRKLMDSVGANGEISCHRDRKTALQGADFVVVAFQIGGYEPCTVTDFAVCKRHGLEQTIADTLGPGGIMRALRTIPHLWAICDDMSEVCPDATMLNYVNPMAMNTWAMYARYPHIKQVGLCHSVQGTAEELARDLDLDPADLRYRCAGINHMAFYLSLEKKLADGSYVSIYPDLLQAYADGRAPKPNLHGNPRCENIVRYEMFKKLGYFVTESSEHFAEYTPWFIKPGRDDLIARYKVPLDEYPKRCVEQLANWHQELESYKRGERIEVKPSREYASTIMNAIWTGEPSVVYGNVRNDNLIDNLPQGCCVEVACLVDANGIQPTKVGALPAHLAALMQTNINVQTLLTQAILTENRDYVYYATMMDPHTAAVLGIEEIYALVDDLIASHGDWLPAWLHR

SEQ ID NO: 8514 - protein, 470 aa, Klebsiella pneumoniae
LAVDGPPRISTNDKNFQGKFSMSTPSARTGGSLDAWFKISARGSTVRQEIVAGLTTFLAMVYSVIVVPGMLGKAGFPPAAVFVSTCLVAGVGSLAMGLWANLPMAIGCAISLTAFTAFSLVLGQQISIPVALGAVFLMGILFTVISATGIRSWILRNLPQGVAHGTGIGIGLFLLLIAANGVGLVIKNPLDGLPVALGNFDSFPVVMSLIGLAVIIGLEKMKVPGGILLTIIGVSIVGLIFDPNVHFSGIFAMPSLSDGQGNSLIGSLDIVGALNPVVLPSVLALVMTAVFDATGTIRAVAGQANLLDKDGQIINGGKALTTDSLSSVFSGLVGAAPAAVYIESAAGTAAGGKTGLTAVTVGVLFLLILFLSPLSYLVPAYATAPALMYVGLLMLSNVAKIDFNDFVDAMAGLITAVFIVLTCNIVTGIMIGFATLVIGRLVSGEWRKLNLGTVIIAVALVVFYAGGWAI

SEQ ID NO: 8515 - protein, 158 aa, Klebsiella pneumoniae
LTKEQGMPIQVLPPQLANQIAAGEVVERPASVVKELVENSLDAGATRIDIDIERGGAKLIRIRDNGSGIKKDELALALARHATSKIASLDDLEAIISLGFRGEALASISSLARLTLTSRTAEQQEAWQAYAEGRDQAVTVKPAAHPVGTTSGSPRSVI

SEQ ID NO: 8516 - protein, 107 aa, Klebsiella pneumoniae
DMGESLMATVTVTFTITELCLRTGVSEEELTEIVGLGMIEPHQPQADTWLFDDSAVTIVHRAVRLRNELELDWPGIAVALTLLDENARLTRENRLLQQRLARFLAHG

SEQ ID NO: 8517 - protein, 164 aa, Klebsiella pneumoniae
  UNSURE (6): Identity of amino acid at the above locations are unknown.
VRTDSXHLFPFRGEDKNKSFPQDFTRRNAVSNTCPGSVAGGVAVASVRRVDDERETSGDAKMNEQLCQRIENSAHFRELVASRQRFAAILSVIMLVIYVGFILLIAFAPGWLGTPLHAGTSVTRGIPLGIGVIVISFILTGIYVWRANGEFDRLTKSVLNEVKA

SEQ ID NO: 8518 - protein, 128 aa, Klebsiella pneumoniae
GIILACRQNDESRIERGRFMSHQDIIQTLIEWIDEHIDQPLNIDIVARKSGYSKWYLQRMFRTVMHQTLGDYIRQRRLRLAAEALRTTQRPIFDIAMDLGYVSQQTFSRVFRREFDRTPSDYRHQISA

SEQ ID NO: 8519 - protein, 604 aa, Klebsiella pneumoniae
GIGFAILPPPIISHRELRMTRLLKTILPIILCALFGLSFASPTQAVASLPIVLPALTCDALSATDFSAAVGAKVTINHTEMQTSAQGSWCKVSATIAPEIGVQIALPTQRWSQRFLQVGCGGLCGSINLSLSNASGCLPAMNGEFVVAATDMGHHGSMMDASWAEDPQKRIDFAWRANHLTAVLAKAVMQTLYRQPPKYAYFMGCSDGGREALMEAQRFPQDFDGISAGAPAAFFQFQNSFFHGWNVAANQRPDGTAILLKNRLPLIHQAVLAHCPTLSGVQDGILQNPYACQFSESWLPRCPADARDRSTCLTQEEIEVVKKLYRGAYDSHGAQFVAGGLPLGSELRWPVPETPTGHSMSEMMVLPALQSVLLPGEKQKIQSMRDFPLNQQNFDAVAQLAPLYNAANTNLHAYQQRGGKLILWHGLADDSVSPAFSIAYYRGVEAEMGHAATDTFLRLFLLPGVSHCGYGEGYDQIDLLTPLMRWTEEGIAPQEIMAGKRATAAADLPPMTEKPDAQTQFHGVQKVSQPYADAAPAVIATRPVYPFPAIAHYNGRGDVNDGENYHAEQTTAFGHLQLAKPASDYIGPDNQKNYQVRHGILTVQ

SEQ ID NO: 8520 - protein, 185 aa, Klebsiella pneumoniae
KRKLIIVKPPKCIHEYNTKKDGYMKIKTGARILALSALTTMMFSASALAKIEEVKLVIWINGDKGYNGLAEVGKKFEKDTGIKVSVEHPDKLEEKFPQVAATGDGPDIIFWAHDRFGGYAQSGLLAEITPDKAFQDKLYPFTWDAVRYNGKLIAYPIAVGSPVPDLQQRPGAEPAEDLGRDPGAG

SEQ ID NO: 8521 - protein, 62 aa, Klebsiella pneumoniae
AIIWRQQTKRLGFANYCLADFVAQKLSGQGGLHRRVRRDRRPWKRTRWRTPMKRSMMTITRS

SEQ ID NO: 8522 - protein, 327 aa, Klebsiella pneumoniae
AECCSQARRSFWRMNHTIQVFSRPQGRVYFAFTGESMLPDSSTRLNKYISESGICSRREADRFIEQGNVFINGKRATIGDQVKPGDLVKVNGRLIEPREADDLVLIALNKPVGIVSTTEDGERDNIVDFVNHSKRIFPIGRLDKDSQGLIFLTNHGDLVNKILRAGNDHEKEYLVTVDKPVTDEFIRGMGAGVPILGTVTKKCKVKKEAPFVFRITLVQGLNRQIRRMCEHFGYEVTKLERTRIMNVSLTGIPLGEWRDLTDDELIDLFKLIENSSSEAKPKARPKPKAATPGIKRPVVKMENSNDKGRPAGNGKRFTQPGRKKKGR

SEQ ID NO: 8523 - protein, 86 aa, Klebsiella pneumoniae
GQCCFSTPGSQVFCVPRWYFIRGLRLFDRYDAGEQAVLVHIYFSQDKDMEDLQEFETLASSAGVEAMQVITGSRKAPDPKYFVGES

SEQ ID NO: 8524 - protein, 111 aa, Klebsiella pneumoniae
WRRWKMSNSYFIALTLGMAAVTFLIRFSFIGLAGKIQMSERVTKTLRFVPVTVLPAIITIQILSVNSSMEFDLKNPKVIAAIICTLASFRLGLVWVVVSGVGSLVLLNYFM

SEQ ID NO: 8525 - protein, 145 aa, Klebsiella pneumoniae
MRPWKSAGGGVNKRLIAGVVAAAVGGYLLWQYLSPVEIVAVHDGNTILVRHFPYLKSRQIAWWEANKAVIQAKYGIPHEGKDGFYHVWIVDFGNGYRTEPDENLLFSTDEVFCFNDIPTEDRCIDRKPLFDVRWSRNYGLKYESY

SEQ ID NO: 8526 - protein, 82 aa, Klebsiella pneumoniae
IEAWVLSKLVPLNAMVTADASAEQLEKTSLTGTLAPLAPACPENVCEETVPKSILFDGSTATSQEGASMVPVTLKLTVLLPS

SEQ ID NO: 8527 - protein, 438 aa, Klebsiella pneumoniae
QLLLVAAGQSAGAHLGVRHADVKQLDGVIGDGLRLPAVEHPPGRVALQRRHGDVFLGCQFEKQPLFFAVFGQKADPEVDGFPRRVDHHRLAVDLNHPGGGFAHPEDQLRQFGTPGADQPGEADDFAGMHHQAAGLNLAAIGQILDPQARLAAGNVPFFIEQIAERPTDHHAHQLRRVELVAHQAADILPIAQDADPVGELIHFRHAVADIDDRHPLIAQAQDELEQALGFPRGEGGGGFIHHQNAALTVQGAGDLHLLLFGDGQGHHPVAGFELGAETVDHRLRLAEHGFALHQTTARQLAAEENVFRDGQVRRQLHLLVDQCDPGGQRVLGAADRLRFSVDQDLAAGGGIGAGEDLHQRAFSGAVLPHQSMDLAGPDRQVDALQRVEFAKSFGDMAHFQYRGGGHRGAPVCKNNSCSPPSENKCRMSESIHICHSDK

SEQ ID NO: 8528 - protein, 203 aa, Klebsiella pneumoniae
EKGRQIAVLGDLVPDGLLDDRPADHAGRFSESDGETSTFPRALGEPGPGKRKPVMNENTLILTEHRVLPRLVDAGLTLLAWLGFLFFLYANLLMQFIAPPSPRWESLMDSLNTALVYLLIAALNGWLLILWYHYNRRRARTRRHTAVLALRDDELASSFNVAPQIISEMSRYNLLIVYHDQIGQIIDLKSHALPPPQEESDDA

SEQ ID NO: 8529 - protein, 263 aa, Klebsiella pneumoniae
TAFRLPTSCAISARRYGGDARISASIIFLKQEEKMELLLLSNSTLPGKAWLEHALPLIAAQVKGRRKAVFIPFAGVTQSWDDYTAKVAAVMAPMAVSVTGIHSVDDPIAAIESTEMVIVGGGNTFQLLKECRSRGLLAPIVDVVKRGALYIGWSAGSNLACPTIRTTNDMPIVDPQGFDALGLFPLQINPHFTNALPTGHQGETREQRIRELLVVAPELTVIGLPEGNWIQVTDGHATLGGPNPTLLFKAGEEAITLPAGHRF

SEQ ID NO: 8530 - protein, 74 aa, Klebsiella pneumoniae
VFIRFRAISIPKINNPYMVKAVFTLVWNPVLRLYYGLIGFPPGYLTTFQVWKMPDQNRISIVNCHNLNRGQILP

SEQ ID NO: 8531 - protein, 62 aa, Klebsiella pneumoniae
ARVRSITPELAQGVPGLSFWARSRGMIKKHAQSAVRLTGFSNFGLLNFHQQNTSGRVLYGYR

SEQ ID NO: 8532 - protein, 267 aa, Klebsiella pneumoniae
SLTRSQSEALSLIYNKDLVPNPPKTWEEIPALDKELKAKGKSALMFNLQEPYFTWPLIAADGGYAFKFENGKYDVKDVGVDSAGAKAGLTFLVDLIKNKHMNADTDYSIAEAAFNKGETAMTINGPWAWSNIDKSKVNYGVTLLPTFKGKPSKPFVGVLSAGINAASPNKELAKEFLENYLMTDQGLEAVNNDKPLGAVALKSFQEKLEKDPRIAATMANAQKGEIMPNIPQMSAFWYAVRTAVINAASGRQTVDAALKDAQSRITK

SEQ ID NO: 8533 - protein, 201 aa, Klebsiella pneumoniae
SMTRITCRLSVFSEERDKVTDSNSRNPRMLMDKTPSQEMLAHAEKLCAQRGVRLTPQRLEVLRLMSLQQGAISAYDLLDLLREKEPQAKPPTVYRALEFLLEQGFVHKVESTNSYVLCHLFDQPTHSSAMFICDRCGVVKEEAAEGVEDIMHTLAARMGFALRHNVIEAHGLCAGCVEVEACSTPGHCQHDHTIQLKKKAR

SEQ ID NO: 8534 - protein, 789 aa, Klebsiella pneumoniae
IVNRDHSYAASFSAPSRLSADRSFTGVVMTARRYPFFTSARGRLLSFNLLMVVVTLLVSGVAVFGFHHASQLQEQVQRQTLNDMRGSMDLARDTANVATAAVRLSQVVGALEYKSEAERLLATQQALKHSLAQLAAAPLAQQEQARVANIIRRSNALQQSVAEMLERGQRRHLQRNALLSSLYQNQSNLRHLADLNDRGGDKAIDPRRLAEMDRLIVAAIHTVTPRSIVLQLDQLRGALPTRSADPALAFVLPDVTRELATLAPLSAQLEESDLTISWYMYHIKALVALLNEDINQYVTRVAEASEQRAAQSHRELRSISMFILLSALLALAITGCAGWYIYRNLGSNLTAISRAMSRLAQGEPNVSVPALQRRDELGELARAFNVFARNMASLEHTTRLLKEKTNQMEIDRIKRQELEEALLHSQKMKAVGQLTGGLAHDFNNLLAVIIGSLELVEPDARDAPRLSRALKAAERGALLTQRLLAFSRKQALHPQAVAMAPLLENLSELMRHSLPATLSLEIEAQSPAWPAWIDVGQLENALINLVMNARDAMAGRDGVIKIRTWNQRVTRSSGQRQDMVALEVIDHGSGMSQAVKARVFEPFFTTKATGSGSGLGLSMVYGFVRQSGGRVALESAPGQGTTVRLQLPRALTEVEKEVAPAVDEPSPAGERLALVLEDEEDVRQTLCEQLHQLGWLTLETASGEEALQLLEASPDIALLISDLMLPGALSGADVIHTARRRFPALPVLLISGQDLRPAQNPALPEVEWLRKPFTRAQLAQALSAAYARI

SEQ ID NO: 8535 - protein, 130 aa, Klebsiella pneumoniae
RINRMIITTADAPAAIGPYVQGVNLGAMTITSGQLPINPLDGTMPEDIAEQARQSLENVKAIVEAAGLTVGQIVKTTVFVKDLADFAAINAAYEAFFIEHQAAFPARSCVEVARLPKDAGVEIEAIAFAR

SEQ ID NO: 8536 - protein, 269 aa, Klebsiella pneumoniae
RSPRCRRQNVSMAQKRTRLRRRRPPMAEMKNLKVEVVRYNPEVDTAPHSAFYDVPYDEQTSLLDALGYIKDNLAPDLSYRWSCRMAICGSCGMMVNKVPKLACKTFLRDYTKGIKVEALANFPIERDLVVDMTHFIESLEAIKPYIIGNNRTPDQGPNKQTPAQMAKYHQFSGCINCGLCYAACPQFGLNPEFIGPAAITLAHRYNEDSRDHGKKERMAQLNGQNGVWTCTFVGYCSEVCPKHVDPAAAIQQGKVESSKDFLIATLKPR

SEQ ID NO: 8537 - protein, 312 aa, Klebsiella pneumoniae
LQMRDEAGRFDVIGVSQHKLFILRRAGNLFVIVRRLQRTVDQRHGHRFALAHAEGQAVAAGEVRRLLLRGDEAINHLALGQQQLANIDAKAQLFRDDFHLHVAAADLAGKRMVAAIAALGRIGQRQQVAFIAAHQLLQARGTRAGVDRRGAGDIVGRRAAIFLGLRQPLLREQAKDVRRRLCFAIGLLHRRRFAIGQQGKIEQAVGVVVSGAQQLAAGDIFIHCGDAAFEAHLRGINRFADRQPRQGGAVGAQQKYCFDVIAAGLLQRQRRQFAVGDAALGHHPVHRQAELVAYLFDAQFGKPSIAPSFLFL

SEQ ID NO: 8538 - protein, 166 aa, Klebsiella pneumoniae
RYQRRAAQRPFRWHRHRAGNWRHTDRSACQPQRRTHAAPDRGRHCRRANDRAAAAGLHHRRINRTPAPVPAGHRPDPHLRRAPAGDPAHHPRGGVLNVRCRQGRREGDPRRSRLTGTETTGRWTASRTERRTDRRPAQPGGGPGDDRGRHRRPRTGGAGAEAGQRR

SEQ ID NO: 8539 - protein, 201 aa, Klebsiella pneumoniae
SQQRVGSKPALRRLLAVGHVGGKDIAQTAQGFNQRRLMRVELNFAPQAHDQHIDGPVEYLGAFVMGQRQQLFAIQYPARVLRQRQQQAIFSLGQRDRLLLRVIQFTARGIQPPAVKRQASTGARRLAGQRPAASQYRFHPGDHHPRAERFGDVIIGAHLQAHHHIRLTAQTGEHHHRQLRPRALQLLEHLQAMGIRQDHVQ

SEQ ID NO: 8540 - protein, 389 aa, Klebsiella pneumoniae
NEQRRDRGKRGDSRQRADAQQQRGRHQRLGGGCLRVEQRGGEKQYHRQQPWVIMQQIAGHGLDVADMRFNEGISQPGDAEDADAGAHPGLKGAGVEHFAGVDFAGDANQGGDGQHKYHDRLVTRQHRVLNQADGIADGRGVEHHRHDADQKQQDRAFGVRLQLKYLAAAQSDFPLGQPLLVNRIVFQFAAEEVADDSGEHHCQQRDWNTDGQQRQIANAQRFKDTCEKDHCGGNGRGGDRYLGGHHRNRQWTRRTNALLFGNFGDHRQRGEGGMAGASEHGHKPGHQRGKEGNVLRVAAQHPFGEADQVIHPAGNLHGGDSGNHRHNDFNNVEGDRTRFNLKNKRQDKDAKATGKADTDAAKPGAEINRQQDNNQFCTKHICLPCFLTS

SEQ ID NO: 8541 - protein, 361 aa, Klebsiella pneumoniae
GAKRGALCACGVSLCYSSAPFYPDAYLFAMMPESTSPVFPAHRFSIAPMLDWTDRHCRYFLRLLSRHTLLYTEMVTTGAIIHGKGDYLAYSEEEHPVALQLGGSDPQALAQCAKLAEARGYDEINLNVGCPSDRVQNGMFGACLMGNAPLVADCIKAMRDVVSIPVTVKTRIGIDDQDSYEFLCDFIETVSGKGECEMFIIHARKAWLSGLSPKENREIPPLDYPRVWQLKRDFPHLTMAINGGIKSLDEARVQLEHMDGVMVGREAYQNPGILASVDREIFGVAGADADPVAVVRAMYPYIERELSKGTYLGHITRHMLGLFQGIPGARQWRRYLSENAHKAGADIAVLEHALKLVADKR

SEQ ID NO: 8542 - protein, 344 aa, Klebsiella pneumoniae
  UNSURE (90): Identity of amino acid at the above locations are unknown.
THRRAGCVRAGAAARPAARPGGGAESGGGDCYPRSRRRSPAGEPSAGDEAGPGGGEWLNRPGARRSAPSLHPAAGVVGVAELMLFCRVAXAPYPGHRCVIRRPGKRSATRQLNPVRANMIRVENVHKTFVLHQQHGVRLPVLADASLTVNAGECVVLHGHSGSGKSTLLRSLYANYLPDSGHIHIRHGDEWVDLVTATPRKVLEVRKTTIGWVSQFLRVIPRISALEVVMQPLLDLGTPREASAAKAAQLLTRLNVPERLWHLAPSTFSGGEQQRVNIARGFAVDYPILLLDEPTASLDDKNSAAVVNLIHDAKARGAAIVGIFHDEGVRRQVADRLHSMGMTA

SEQ ID NO: 8543 - protein, 224 aa, Klebsiella pneumoniae
RSRRHRRGKTRRPGAGAPSRRTYPDRPCLAPGKEGLLMPGKLIWLVGPSGSGKDSLLAALRQREHPQLLVAHRYITRPFNAGSENHIALSEHEFFTRAEQHLFALSWHANNTYYGIGVEIDLWLHAGFDVVANGSRAHLALARERYGEVLVPICLAVSPPVLRQRLEQRGRENALEIAQRLERAARYKPDNCLTLNNDGSLRQSVDEFFRLLRSHAAREADQLV

SEQ ID NO: 8544 - protein, 485 aa, Klebsiella pneumoniae
SRRRTRSVPLLEVLDLLYNTPARRKFMRTEKTEFGHIDEVVRRIALARFDVTINLSHNGKVMRQYRAVAQDGQRERRLGTICGAAFLEHALAIEWQHGDLTLRGWVADPLHTTPALAEIQYCYVNGRMMRDRLINHAIRQACEDKLGADQQPAFVLYLEIDPHQVDVDVHPAKHELRFHQSRLVHDFIYQGVLSLLQQQLDAPLAEKDDPPAPRPMPENRIAAGGNQFARPAEARETAARFSITPSREPAATSGKPGGASWPHAQPGYQKQQGALYRQLLDTPTAPKPALQPPAAAELAGHSQSFGRVLTIVGGDCALLEREGGLALLSLTVAERWLRQAQLTPGAEAVCAQPLLIPLRLKVTEGEKQALAAAQPALAQLGIDVHTDALHVTVRAVPLPLRQQNLQILIPELIGYLAQQNAFDVGNIAQWMARNLTSEQTSWNMAQAIALLADVERLCPQLVRTPPGGLLQPVDLHSAMNALKDE

SEQ ID NO: 8545 - protein, 465 aa, Klebsiella pneumoniae
RAGRVRLPIKKARTRLAIYRRSVQRKAMISGDRMMITLRKLPLAVAVAAGVMSAQALAVDFHGYARSGIGWTGSGGEQQCFQATGAQSKYRLGNECETYAELKLGQEVWKEGDKSFYFDTNVAYSVSQQNDWESTNPAFREVNVQGKNLIDWLPGSTLWAGKRFYQRHDVHMIDFYYWDISGPGAGIENIDLGFGKLSLAATRSSESGGSATYADRDPLTGDRVYDHLVPNDVFDVRLAQMETNPGGTLELGVDYGHTNIPDDYYLQPGASKDGWMFTAEHTQSILKGYNKFVLQYATDAMTSNGKGVPQGGSINNDGSMWRVLDHGAVSLADDWDMMYVAMYQDVDLDNNNGTKWWTVGVRPMYKWTPIMSTLLEVGYDNVKSQKTGDSNNQYKITLAQQWQAGDSIWSRPAIRLFATYAKWDEKWGYTDSGVAMRDTSGTGINTSSRGDSDEWTFGAQMEIWW

SEQ ID NO: 8546 - protein, 309 aa, Klebsiella pneumoniae
DMFSFTPPMSPVVIALLPNKTKIISTIQKKEFAMATTPIPAKRGRKPAAATAQQAGGQVQSLTRGLKLLEWIAESHSSVALTELAQQAGLPNSTTHRLLTTMQQLGFVRQVGELGHWAVGAHAFVVGSSFLQSRNLLAIVHPILRQLMEDSGETVNLAVLDQSDHQAIIIDQVQCTQLMRMSAPIGGKLPMHASGAGKAFLAQLSEEQVTSLLHRKGLHAYTHATLVSPLHLKEDLAQTRKRGYSFDDEEHALGLRCVAACIYDEHREPFAAISISGPISRMTDDRVTELGALVIKAAKEVTLAYGGVK

SEQ ID NO: 8547 - protein, 127 aa, Klebsiella pneumoniae
RFARPGKPGDDNEFVARDNEVDVFEIMGAGAPNFDLIHSPFPVGRYTDCLVCLKDKRQKRLIMTQFNLNEYTVSECKFGSSVQQCRSRVLSLESASQLLKCYVEMVHSRVYTIKKRIQETRTWPAEA

SEQ ID NO: 8548 - protein, 114 aa, Klebsiella pneumoniae
LPYRVSVKYSLPYTGCSGLTEGTTMALPRITQKEMTEREQRELKTLLDRARIAHGRPLSNAETNSVKKEYIDKLMAQREAEAKKARQVRKQQAYKTDKEATFSWSANTPTRGRR

SEQ ID NO: 8549 - protein, 124 aa, Klebsiella pneumoniae
RMNSGSSAFISTGRCSALAFAIRSLHHRSRPSCQSILPPVRFRTTTCSMLFTFGFFSASSTFFFSGMARPARSPSSAVITRRELESIMRPATASGEKPPKMTEWIAPMRAQASIATAASGTIGI

SEQ ID NO: 8550 - protein, 534 aa, Klebsiella pneumoniae
MGDSAPHKALRLIGTGLVILLPVVLALWFAQLRAKAETIDQLHSFSQLALQKTEMVIREADQARAKASQYRGELCSADHQRYLLHIVRGLLYVEDLIYANGQRFICSTSVHQQTGWRMPAANYTKKPDVAIYYYRDTPFYPGFAMNYMQKGPYVVVVNPFSYSSVIASDRDLAYGVFDTKTNLFFSVSNNVEPAELHALIREGDTFFNQNGRVYTIARSAIRPIAVIMSTSRASYYHNFCDQASLTLPLGIICSILLVLVWSRTRRQYHSPRNMLQRALSCRQLRLHYQPIIDIKNNRCVGAEALLRWPGFDGPVMNPAEFIPLAENEGMIAQVTDYVVDELFYEMGEFLASHPQLYIAINLSASDFHSARLISQISEKAHSYAVCIGQIKIEVTERGFIDVPKTTPVIQAFREAGYEIAIDDFGTGYSNLHNLHALNVDILKIDKTFVDTLTTNNTSHLIAEHIIEMARGLRLKTIAEGVETPEQVSWLYKRGVQYCQGWLFAKAMPAREFMQWLANAPAPANVPQPPRHAEI

SEQ ID NO: 8551 - protein, 426 aa, Klebsiella pneumoniae
PTSSPLAPATSISIPLGTMRISIPLIWWHVCIRPMARRTPASSGLPPRLMWSTNNISTGMSMKKLIFLCMLVLCPLYSWATCSGTNSGDVSMTNLPEKILVNAGSYTAGTVLYDSGKITRAQTAFTNCQGNVYAVFAWSSNNAGALIGDNIYATSVQGIGLRVKVWLNISGEYEGDTDDFSPDSQVHYIGDVNYYLGKPTGLFDYYASTHYTPAYQLQLVATGGAIASNSQLSFSDPVATVSAKDNGGTISISRLHISGTTSIQMIPMGCIVSSNNLSFSMGSINASEFNTATKVGSARQSLTLSCEPGTNVSMRVAAAQASGDNPGNTVMALTAGENVATGVGVQLNMDGEALPLNTDISLYTSSRTTVTNSGADASYSYFTNPDSPGGAAAMQTLALSTNYYRTGSAVTAGTANATGVITFTYN

SEQ ID NO: 8552 - protein, 128 aa, Klebsiella pneumoniae
GSGRTLMRLAPMKRYATALLFCTLSLTSLAARADIIDDAIGNIQQAINDAYNPGSSRSDDDDRYDDDGRYDDGRYQGSRQQSRDSQRQYDERQRQLDERRRQLDERQRQLDRDRRQLESDQRRLDDSY

SEQ ID NO: 8553 - protein, 133 aa, Klebsiella pneumoniae
TPGLLTEEPCVMGLAAIMRSKTLQQSVLSDLLLWIDNNLDKKLTVDDLSDISGYSPWHLFRLFRHYFDRSPMEYIRQQRMSLCCRLLLTTPGYRIVDICMMVGYDDLSAFNRTFKKYHALTPTQYRYQITRQK

SEQ ID NO: 8554 - protein, 1122 aa, Klebsiella pneumoniae
TRPRLILQQKGYAVRLIYTFLLALSLSFGAYAATAPDAKQITQELEQAKAAKPAQPETVEVLQSALNALEERKSSLERARQYQDVIDNFPKLFQSLRAQLNNLSEEPRQVPTGLTADALNQEILQVSSQLLESSRQAQQEQDRAREIADSLNQLPQQQTDARRQLNEVERRIGTQTGNNALAQAQNLALQAESARLKALVDELDLAQLSANNRQELSRARSELAQKQSEQLDAYLQALRNLQNSQRQREAEKALESTELLAENSENLPPDITAQFKVNRELSQALNQQAQRMDLVASQQRQATNQTLQVRQALNTLREQSQWLGSSNLLGEALRAQVARLPERPRPQQLDTEMAQLRVQRLRFEDLLSKQPQLRQIRQADGEPLTSEQNKILQAQLRTQNELLNSLLRGGDTLMLELTKLKVANGQLEDALKEINEATHRYLFWTSDVSPIGFSWPLEIVQDLRRLISLDTISELGKASAMMLTSKETLLPLFAALLLVGFSISSRRHFTRFLERSSARVGKVTQDHFWLTLRTVFWSILVASPLPVLWMTLGYGLQSAWPFPLAVAIGDGVTATVPLLWVVMICATFARPNGLFIAHFGWPRSRVAKAMRYYLMSIGLIVPLIMALIMFDNLNDREFSASLGRLCFLLICGALAVVTLSLKHAGIPLYLDKEGNGDNMVNRLLWNLMLGAPLVAMLAAAVGYLATAQALLARLETSVAIWFLLLVVYHIIRRWMLIQRRRLAFDRARHRRAEILAQRARGEDEPVHVSSPEGSVETEVSEVDLDAISTQSLRLVRSLLMLIALLSVIVLWSEIHSAFGFLENISLWDVTSTVQGVESLEPITLGAVLIAILVLIITTQLVRNLPALLELAILQHLDLTPGTGYAITTITKYLLMLVGGLVGFSMIGIEWSKLQWLVAALGVGLGFGLQEIFANFISGLIILFEKPIRIGDTVTIRDLTGSVTRINTRATTISDWDRKEIIVPNKAFITEQFINWSLSDSVTRVVLTVPAPVDADTEEVTKILIAAAHRCSLVIDTPAPEAFLVDLQQGIQIFELRIFAAEMGHRMPLRHEMHQLILAGFREHGIDMPFPPFQMRLESIDGRQSSKTMTSAGKTSRRTAGSL

SEQ ID NO: 8555 - protein, 82 aa, Klebsiella pneumoniae
ARASGAPPGMATAREPPVCRVAATPYPAYKRHWAHHYTGSVGPRKRSAAGHGPSQGAACMPGGGYALPGLQTALEPTIELDP

SEQ ID NO: 8556 - protein, 90 aa, Klebsiella pneumoniae
ARASVAPPGMAPAWEPPVCRVAATPYPAYKWHWTHHYTGSVGPRKRSAAGHGPSQGVACMPGGGYAIPGLQTKRSASRGVSRVAQTGNSA

SEQ ID NO: 8557 - protein, 660 aa, Klebsiella pneumoniae
QVQRRKKAMSQIHKHPIPANIAERCLINPDQYKAQYQQSITDPDTFWGEQGKILDWMRPYTRVKNTSFAPGNISIKWYEDGTLNLAANCLDRHLAERGDQTAIIWEGDDASQSKHITYRELHADVCRFANVLLDLGIKKGDVVAIYMPMVPEAAVAMLACARIGAIHSVIFGGFSPEAVAGRIIDSSSRLVITADEGLRAGRAIPLKKNVDDALKNPNVKSIEHVVVLKRTGGNIDWQEGRDLWWSDLIANASAEHRPVEMNAEDPLFILYTSGSTGKPKGVLHTTGGYLVYAATTFKYVFDYHPGDIYWCTADVGWVTGHSYLLYGPLACGATTLMFEGVPNWPTPARMCQVVDKHKVSILYTAPTAIRALMAEGDKAIEGTDRSSLRILGSVGEPINPEAWEWYWKKIGNEKCPVMDTWWQTETGGFMITPLPGAIELKAGSATRPFFGVQPVLVDNEGLPLDGATEGNLAIADSWPGQARTLFGDHERFEQTYFSTFKNMYFSGDGARRDEDGYYWITGRVDDVLNVSGHRLGTAEIESALVSHPKIAEAAVVGIPHNIKGQAIYAYVTLNHGEEPTPELYAEVRNWVRKEIGPLATPDVLHWTDSLPKTRSGKIMRRILRKIAAGDTSNLGDTSTLADPGVVEKLLEEKQAITMPS

SEQ ID NO: 8558 - protein, 427 aa, Klebsiella pneumoniae
TRSRGCDMMDHTMTKNPDSIPYNIWPAEALRLAEREAADSLGLTLFELMQRAGEAAFQLASGAYPASAHWLILCGHGNNGGDGYVVARLAQAAGRRVTLLAVESDSPLPEKAQAAREAWLNAGGVIHAATIPWPDDISLIIDGLLGTGLHSAPRDPVAALIHQANHHPAPVVALDIPSGLNAQTGATPGAVVQADHTLTFIALKPGLLTGKARDVVGQLHHHALGLERWLAGQSTPLTRFCAAHLADWLPPRRATSHKGDHGKLVIVGGDRGTAGAIRMCGEAALRSGAGLVRVLTHPENVAPIVTVRPELMVDELTPQTLKAALEWADVVAIGPGLGQREWGRSALRTVESFNKPMVWDADALNLLAFNPDKRHNRVLTPHPGEAARLLNVSVAEIESDRLLSAQRLVKRYGGVVVLKGRGHSSAQ

SEQ ID NO: 8559 - protein, 87 aa, Klebsiella pneumoniae
ARASVAPPGMAPARKPPVCRVAATPYPAYKRHWTHHYTGSVGPRKRSAAGHGPSQGATCMPGGGYALPGLQMALVPPLHWICRPAQA

SEQ ID NO: 8560 - protein, 106 aa, Klebsiella pneumoniae
GKERMAKGQSLQDPFLNALRRERVPVSIYLVNGIKLQGQIESFDQFVILLKNTVSQMVYKHAISTVVPSRPVSHHSNNAGGGSSNYHHGGSAQGSSAPQQDSDDAE

SEQ ID NO: 8561 - protein, 869 aa, Klebsiella pneumoniae
LWRSRVALFLIAVIRNLFYHYRDVSMPNKNNGLFKLSTVFLAMLPALLSGLNNKAQARDFFDPSFISSLNGSDPSTTPDLSIFQTQNAQAPGDYRVDIMFNGRYLDTRTIKFVANNRASSDNREPTLVPCLSLKTLAEYGVRIKAFPELAEDKNGCANFSVIPDTKADFDFTAQRLNISIPQAALSTTAQGYIPPDQFDDGINALLVNYQFSGSNDMQANDEYYSLNLQSGLNVGPWRIRNLSTWNKNNSGAGDWDSAYLYMQRSIRSINSNLVMGESSSLNGIFDSVPFTGIQLATDTTMLPESMRGYAPIIRGIARTNARVIIKQNGYQVYQTYVAPGAFEITDMYPSGGSGDLYVSVEESDGSKQEFVVPFATLPVMVRENQLEYEITSGKYRPYDGGVDETPFTQATATYGVSSSLTLYGGMQAASRYQALSTGLGYNLGELGAASADVTQAWSKMKDDEKTSGQSWRVRYGKNIVETGTNVTIAGYRYSTRGFHTLSEVLDSYSNDGYYTSRSLRNRTNLTVNQSLGKGLGSLSISGLIEDYWDDKRTNKSISVGYNGGFRNVNYYLGYSYNRYTWGGDNSGKDAQDDQRITLTVTLPLSNWLPGTYTSYQLTNSNPGSTDQSVSIGGNALENDSLEWSLQQGYSNREYYSGDMRATYNGARGSVNAGYSYDRSSERIDYGANGSIVAHADGITLGQDITDAAVLVKAPGLDNVKLTNDNTISTDYRGYAIVPYVTPYRRTDITLDSSTLGEDMELPETTQSVVPTRGAIVRANYAGNIGRRALIQLEMPGDKPVPYGSTVTIKNSANTQANIVSDEGMVYLSGLQDSGELLVLWGQRQDQRCNATYQLLPTQGSLTTSKAICR

SEQ ID NO: 8562 - protein, 124 aa, Klebsiella pneumoniae
PKPGEIDHASRTVAGRFVLKSKAYGWHAFCNTCRVKYSFFGERTMLELLFVIGFFVMLLVTGVSLLGIIAAIVVATALMFVGGLFALMIKLLPWLLLAVAVVWIIRALKSPNGNAFRDNNRWRY

SEQ ID NO: 8563 - protein, 139 aa, Klebsiella pneumoniae
SADGRGHPVGQRRGGVRLSSRQPAAGAGAAPDSQRHARQYGSGAGHGECRHGGGAPVAGGGGAGVQKRSGTAAGDAAGAEALAGPAGGGPAGAAGAGAGGQYYSPQQRAAAERGGDAGARPAPPSAAQCAAEFALPESE

SEQ ID NO: 8564 - protein, 160 aa, Klebsiella pneumoniae
LKDGSIHRNAEPGGVSIVGGLAFVDVIVWVQVLVFAFLVAHQLKANVRQDFVGVHVYGGTGPALEDIDRELVHAFAVIQDFVTGGDNRICRAFGNGLQLLVRQRGGFLNHDHAAHEFWYVADFAVANVEVFNRSQSMNAVVSVRGNFPGAQQIFFDTNVV

SEQ ID NO: 8565 - protein, 417 aa, Klebsiella pneumoniae
IMSGLKQELGLGQGVGLLSTSLLGTGVFAVPALAALVAGDNSLWAWPLLILLVFPIAIVFALLGRHFPSAGGVAHFVDMAFGPRLASVTGWLFLSVIPVGLPAALHIATGFGQALFGWHDAQLLLAELGTLAIVWWVGSRGASSSANLQTLVAVLIVALIVVVWWRGGISPAQIPFPAPAEIDRGQLFLALSVMFWCFVGLEAFAHLASEFKHPERDFPRALMIGLLLAGSVYWACTVLVLHFHAFGEEMAAAASLPNIVVRLFGVEALWVACVIGYLACFASLNIYIQSFARLVWSQAQHKPHSYLARLSPRQIPRNALNAVLGSCVVSTLGIYLLDINLDALIVYANGIFIMIYLLCMLAGCRLLRGRYRLLAVVGSILCLLLLAMVGWKSLYALVMLAGLWLFLPRRKLATGSV

SEQ ID NO: 8566 - protein, 117 aa, Klebsiella pneumoniae
TAFGPASPITDNDFLEGELSMSIRPLHDRVIVKRKEVETKSAGGIVLTGSAAAKSTRGEIIAVGKGRILENGTVQPLDVKVGDIVIFNDGYGVKTEKIDNEEVLIMSESDILAIVEA

SEQ ID NO: 8567 - protein, 332 aa, Klebsiella pneumoniae
FAIGESTMSETATWQPSAPIPNLLKRAAVMAEIRRFFTDRGVLEVETPCMSQATVTDIHLFPFETRFVGPGHSQGLNLYLMTSPEYHMKRLLAAGCGPVFQLCRSFRNEEMGRHHNPEFTMLEWYRPCYDMYRLINEVDDLLQQVLECQPAESLSYQQAFQRHLEIDPLSADKAQLREVAAKLDLSNIADTEEDRDTLLQLLFTMGVEPHIGKDRPTFIYHFPATQASLAQISPEDHRVAERFEVYYKGIELANGFHELTDAHEQRLRFEQDNRKRAARGLPQQPIDNNLLAALEAGLPDCSGVALGVDRVVMLALGAESIGEVIAFTVDRA

SEQ ID NO: 8568 - protein, 324 aa, Klebsiella pneumoniae
ALPGLSLPIGHPLLPLQIALSICRRQRLSRQHKKERTMQGTFIGFNTAGITFENRFMALLLKIKQENGFCQQYYLQAPIVLDLLLILQNRLLVTFKSLQDQGETYKEKLIAYNESLIANIPAVEMTEIQQPNPERRIMSITHKPDETWSTLILVLQNEQVCTLCIEDRQVEALLAGIEYTLKTVGDQAFIHYLSSNLEFLMCYAVDLTTQPNIDYQQYPQEEWKLNLFSHYLGVLYCCETDEGKKIVSGAVVKTSAPHLSELENNVVTRLIEKSPKLKAMHAELAPCQIFSTIIPSQPGRMLSLEECLRPLHAFYLEKKAELSV

SEQ ID NO: 8569 - protein, 602 aa, Klebsiella pneumoniae
RGAGWGKAMTRGLELLIAQTILQGFDAQYGRFLEVTSGAQQRFEQADWHAVQQAMKQRIHLYDHHVGLVVEQLRCITEGKSTDVDFLLRVKQQYTQLLPDYPRFEIAESFFNSVYCRLFDHRSLTPERLFIFSSQPERPFRTLPRPLAKDFFPERGWSHLLGKVLSDLPLRLPWQNKARDIGYIIASLQEALGEELLATCHLQVANELFYRNKAAWLVGKLVMPMATLPFLLPIHRSEEGELFVDTCLTTHAEASIVFGFARSYFMVYAPLPGALVEWLREILPGKTTAELYMAIGCQKHAKTESYREYLHYITRCDEQFIEAPGIRGMVMLVFTLPGFDRVFKVIKDRFAPQKEMTAAHVRACYQLVKEHDRVGRMADTQEFENFVLDKRQIAPALLALLQAEAGNKLTDLGDRIVISHLYIERRMVPLNLWLEQVNGQALRDAVEEYGNAIRQLAAANIFPGDMLFKNFGVTRHGRVVFYDYDEICYMTEVNFREIPPPRYPEDELASEPWYSVSPGDVFPEEFRHWLCADPRIGPLFEEMHADLLRADYWRALQMRIKNGHVEDVYAYRRKQRFSVRYGADSRPDKAFTPPSGKVRRSA

SEQ ID NO: 8570 - protein, 525 aa, Klebsiella pneumoniae
PDYGRSADAAACRRRRWWAGRRCARAGSPPPAATFRRWRECCRSGGRRWPLAVRRCCPRRRPGDADRPSGADALRPIRCATGGGVRLRSWRTASAAGTAPRPAAASGGRRLPSAGWFYRSRTRRRCRALLPATARRRHCENLYPGRRDGSGYSQQVMAGSFFLPLALLAAIVGIGADKHPLAAVIQYHFVEVAVARAADGAGLIPLLHGKGMVVEIETLHRGIGRHGVDPLFAPGAEQLQRRHHVHFRVIEFRDRRRVHHVAAIDLHRIGVGGGDMAEAGDIFIQFHLHDAVLFQGVHGAGFGFTRLDKAQWLRDRHLVDQDLIFHQRRLRDPVAGLDQGGVFGTLGGGDAGDALKELTNRHRVGGVIRALVNHLQHVILTDDAGGQLDAAGAPAVGHWHFAPAERHLVAGNRYRFENSPADHALGLLVEVSKVIASQWVSHVRSPVAGVSAAPVRPGNRHSAVASDARRSRPLRRYRREPAQTLHPAPGRQSLRHSPAPAAHGRPAPWPSLCARSCRRSGRSRG

SEQ ID NO: 8571 - protein, 122 aa, Klebsiella pneumoniae
GWCGSSSTRSVKPLSTTWPCFITSRRFASRRATPRSWVTITTARFSSTARPRSRSSSRACTDTSSPPVGSSINTSFGWVTRLRAICRRCCMPPEKVVGRSSMREGGISTSCSHFSAVARMLP

SEQ ID NO: 8572 - protein, 218 aa, Klebsiella pneumoniae
FRVGGTIIFSHNRRRSRYPGGRLSPAHPVISLAGNRYLHCRLPSYFSAPFRPAVWLNRLPGDYALRVTVTEVFTMSLSPYLAFAGNCAEAIAFYQQTLGAELMFKMTFGEMPPPAQEASDGCPSGQKMADDAIAHASLRINNGELMLSDSAFGPDVHYAGFTLVLDPSDVAEGQRWFDALAVGGRIEMAWQETFWAHGFGKVVDRFGVPWMINVVKQG

SEQ ID NO: 8573 - protein, 83 aa, Klebsiella pneumoniae
TLPGAEPAGAAHGSGGVPAAAGDESNAAGAPGVKHPARAVAVAGLLQSAGRSPARPGGAAAGAPSPATAGYGNGAAARAASAL

SEQ ID NO: 8574 - protein, 562 aa, Klebsiella pneumoniae
RLTGIKENAANREHMEIFFTILIMTLVVSLSGVVTRVLPFQVPLPLMQIAIGALLAWPTFGLHVEFDPELFLVLFIPPLLFADGWKTPTREFIEHGREILGLALALVVVTVVGIGFLIYWIVPGIPLIPAFALAAVLSPTDAVALSGIVGEGRIPKKIMGILQGEALMNDASGLVSLKFAVAVAMGTMVFTVGGATVEFLKVAIGGVLAGFVVSWSYGRSMRFLSRWGGDEPATQIVLLFLLPFASYLIAEHIGVSGILAAVAAGMTITRSGVMRTAPLAMRLRANSTWAMLEFVFNGMVFLLLGLQLPDILSSSLVAAEADPNVETWMLFTDIILIYAALMLVRFGWLWSMRKLSQRFLKKKPMEFGSWTTRELLISSVAGVRGAITLAGVLSIPLLLPDGNVFPARYELIFLAAGVILFSLFVGVIALPILLRHIESSDNVQQRKEERLARAATADVAIVAIQKMEERLAADTKENIDTQLLTEVSSRVIGNLRRRADGRNDVETSMLEESLERRFRLAALRSERGELYHLRATRQISNETLQKLLHDLDLLEALLIEDQ

SEQ ID NO: 8575 - protein, 701 aa, Klebsiella pneumoniae
LLTGIDMRAFFWAAWLGLCSTPLLAAPLQGISFAQKDWELACDNTGACRAAGYGVRMGEVSVLLTRNAGSEQHLTATVTFAQIEHDIPADSTASLLIDDRDFGALDALDDSHFRFDSDQTTALLQALTNQRKIEFTLNGQHLPLSSAGSREVLGKMDAFQRRTGTADALLDKGDAGDDAILPATPAPEIIAAPVLHNAQPVPLSMLQRQKLLPILTPLLNQRCDDWQNQAIPAADRQITLTALDKTHSLAQALCWRAPYNDGYALWLVDNAQLSKPRLLTTEASSYADGAIVFLHKERGMADCVTGETRVWDGKTFTPSLKYSTGMCREITPGGTWMLPTFVSQVIPRQQKEADNLALRTLYNAVLKAQKSDPELSLNKVAEQFPLTGHITDFTLTYADDTLITTSKPSPDISDDEWQAFLRSSISADSENGKVSFTLIDLDGDGKRDLIIDSYVGGTGLFSYTGVLKRGNDDFAAVNGSDSDNGDDFDAGVPGALFSINGRGANQWNHWVKINGQVYALWYNGQFGEDNLYLLRPFSTTSQTPAVTVRYRYTLNSIRSPEKDQPLTPSLSDGDKADLLRSLEVMQGSLLKDRPASDNDAPICPIPPGTSADEADNYYSGVAVNYIYETVAYIPVWLNGKCYIGTIFSHHGAYRHGVDAEITLSSPREDEEVIGDYLISGLRHVIAITSGWKTREGDNWMQ

SEQ ID NO: 8576 - protein, 472 aa, Klebsiella pneumoniae
AMAGNKPFNKPQTETRERDPQLAGLKVPPHSIEAEQSVLGGLMLDNERWDDVAERVVADDFYTRPHRHIFTEMARLQESGSPIDLITLAESLERQGQLDSVGGFAYLAELSKNTPSAANISAYADIVRERAVVREMISVANEIAEAGFDPQGRTSEDLLDLAESRVFKIAESRANKDEGPKNIADVLDATVARIEQLFQQPHDGVTGVNTGYDDLNKKTAGLQPSDLIIVAARPSMGKTTFAMNLVENAAMLQDKPVLIFSLEMPSEQIMMRSLASLSRVDQTRIRTGQLDDEDWARISGTMGILLEKRNIYIDDSSGLTPTEVRSRARRIAREHGGIGLIMIDYLQLMRVPSLSDNRTLEIAEISRSLKALAKELQVPVVALSQLNRSLEQRADKRPVNSDLRESGSIEQDADLIMFIYRDEVYHENSDLKGIAEIIIGKQRNGPIGTVRLTFNGQWSRFDNYAGPQYDDE

SEQ ID NO: 8577 - protein, 815 aa, Klebsiella pneumoniae
LTRGFTSFMSGWQRIYYKLLNLPLQVLVKSKSIPAEPAQELGLDTSRPVMYVLPYNSKADLLTLRAQCLAHDLPDPLEPLEIDGALLPRYVFIHGGPRVFTYYTPKEESIKLFHDYLDLHRNHPDLDVQMVPVSVMFGRSPGREKGEVNPPLRMLNGIQKFFAVSWLGRDSFVRFSPSVSLRRMADEHGTDKIIAQKLARVARMHFARQRLAAVGPRLPARQDLFNKLLASKAIARAVEDEARSKKISHEKAQQNAIALMEEIAANFSYEMIRLTDRILGFTWNRLYQGINVHNAERVRQLAHDGHEIVYVPCHRSHMDYLLLSYVLYHQGLVPPHIAAGINLNFWPAGPIFRRLGAFFIRRTFKGNKLYSTVFREYLGELFSRGYSVEYFVEGGRSRTGRLLDPKTGTLSMTIQAMLRGGTRPITLVPIYIGYEHVMEVGTYAKELRGATKEKESLPQMVRGLSKLRNLGQGYVNFGEPLPLMTYLNQHVPDWREAIDPIEAVRPSWLTPTVNSIAADLMVRINNAGAANAMNLCCTALLASRQRSLTREQLTQQLECYLALLRNVPYSPDATAPSASASELIDHALQMNKFEVEKDTIGDIIILPREQAVLMTYYRNNIAHMLVMPSLLAALVTQHRHLSRAEVLRHVETLYPFLKAELFLRWEKAELAGVVDALIAEMLRQELIVVDGDVMSLNPSHSRSLQLLAAGARETLQRYAITFWLLSANPAINRSSLEKESRTVAQRLSVLHGINAPEFFDKAVFSTLVLTLRDEGYISDTGDAEPEETLKVYRMLADLITSDVRLTIESVTQDDA

SEQ ID NO: 8578 - protein, 97 aa, Klebsiella pneumoniae
KGAGTVVPSESGAMGIIDAGNAGMATGGMGDVLTGIIAALLGQHLTPYDAACAGCVAHGDTADGLAAREGTRGMLATDLFSTLRRVVNPDVIDVDHD

SEQ ID NO: 8579 - protein, 198 aa, Klebsiella pneumoniae
MLKGRFVATLMILVTQDYYLFQGVKNFFPDIIQLDSSGKAILDNEVDEVSLLVDSRSPLCHYDYLVLAAAKSRKRICCIVLDMRHREEHLLSLKSFLNMSLSPADMATLFGLFLEMNSKRLTKEWFDDLRLSLSEQLMLRLLMAGMTMEEVAVNLNTSLKSLYRKRTALYERLGLDNFNEACLFIFRNKLLEQTERSL

SEQ ID NO: 8580 - protein, 75 aa, Klebsiella pneumoniae
TSKGLTTVTPGGGAGVLQATDRNETAIAVIIGRIRMACSLLAFKLSVESSREKAARFFYEASPVAEMRPGSCRIR

SEQ ID NO: 8581 - protein, 189 aa, Klebsiella pneumoniae
LSFIMDMGINMKMSKKFLAGALIFSACSALSIVAQADNTITFNGIVSDTTCTATIDGGVTAIDMGTTSVADLKAYTFGAAKNFSFSLADCPTAEEGGNSIARVTFGGVSDTVNSDYFKNQATDEPATGVAVALFDEAGNVMKNNEEGSDVDISSGAATIPFTVKMVKSGDADPTKGTVQTTVTYNVTYH

SEQ ID NO: 8582 - protein, 860 aa, Klebsiella pneumoniae
LMIMVCQGRNIPLSFSSVELLFSTKSICVAIILCLSTLPSRAEAGEYFNPNLLEVAESPAASVDLSYFSQDGIPPGTYHLDVYINDKYVSSDSLTFQEISHDAGATASPCLSAEYLNSWLINTTAYPQLFEAGETCARLSAIPGMTFSVSLAQQRIDFTVPQAAMLNRPRDYIPESQWQQGINAGLLNYSVTGQRNAPRHNGATIDSQFVSLQPGLNLGPWRLRNYSTYSHSDNNSRWESVYSYLSRDIHTLRSQLVVGNTYTSSGIFDSLSFTGLQLSSDKEMLPDSLHGFAPTIRGIARTTAEVSVYQNGYSIYKTTVAPGAFEINDLYATGSAGDLYVNIKESDGSEQNFVVPFASLAILQREGQLDYALSSGRTRSGSSDDKEYNFIQSSLAYGATSNITLYTGFQQAEDKYTNLLLGAGFNLGTIGALSFDGSQSWADVKTSDTASSTSKEQGQSYPVRFSKSFLQTGTSFSVAGYRYSTSGYYSFQDFVDNSSTQRDCCTQSGRTKGRFDASLSQTLFGYGSLSLSLVNETYWDSSRMESVGVGYSGSIGKASYFINYSYNRNVQSTDDSDNNRPASDTVVSLTLSIPLGETLSANYTLNHGRHNDTTHSVGLNGSAFEDRSLNWSLMEGYNTQDKSTSGNLSVNYQGSKGDVAGGYGYDRYSNHYNYSLRGGMVAHAGGLTLSRFLGESSALVETPGVSDVTVRGQTNVTTDAAGYAVVPYVRPYHRNSLALDEQEIPGAEVDNVARTVVPTRNAIVKVKYDTRIGYKAMLTLRTRNGVVPFGALVTLDNDHGSASRSNIVGDEGQVYLTGLQKKGQLLARWGEKSSEQCTVHYDFSSMALGDDILFYQAECR

SEQ ID NO: 8583 - protein, 126 aa, Klebsiella pneumoniae
GASMTLDRRKVLIYLRPDISASERFADAKIEAHHRGDRGDMSRTALLAGLALGEVDSRLPSMLAALLAEDTKPETLRKMLASFLEIQPASPAPAAAAAAAPAKAPEPPAPVSESVSARNLAGSLPD

SEQ ID NO: 8584 - protein, 349 aa, Klebsiella pneumoniae
TIPIAGLEPGFFITTSTQPADLLAAHRDGAARFAYRKEHNMLATLTRLFPLWALLLSVLAYYTPTTFTPIGPWVTTLLMLIMFGMGVHLKLEDFKRVLSRPAPVAAGIFLHYLVMPLAAWLLALLFHMPPELSAGMVLVGSVASGTASNVMIFLAKGDVALSVTISSVSTLVGVVATPLLTRLYVDAHIQVDVMGMLLSILQIVVIPIALGLIVHHLLPKVVKAVEPFLPAFSMVCILAIISAVVAGSAAHIASVGLVVIIAVILHNTIGLLGGYWGGRLFGFDESTCRTLAIEVGMQNSGLAAALGKIYFGPLAALPGALFSVWHNLSGSLLAGYWSGKPIAKKADKR

SEQ ID NO: 8585 - protein, 139 aa, Klebsiella pneumoniae
GVTMPSVYRPLVNFVAKAMQAVLNLALLCLGIILVVFLGKETLHLAHVLFTPEPVSKYKLVEGLVVYFLYFEFIALIVKYFESGFHFPLRYFVYIGITAIVRLIIVDHESPLAVLIYSAAILILVITLWLCNSNRLKRE

SEQ ID NO: 8586 - protein, 232 aa, Klebsiella pneumoniae
IKHMRYPFFAIGLLLSSSFAQASVVVGGTRLVFDGTKNNAVITVENKDQNSNIVQSWLSVVDAASPAKDAFIITPPLFRLKAGEKGFVRVVRSGKKLPDDRESMFWLNIKGIPATEYVPDKNVVQFAINSKIKLIYRPAALKGNTPESYAEKLQWGKEGTSVTVKNNSPLYMNFSQVSLNGKNISGAWFAAPFSTLKIPVQSSLSATGKKEITWSVINDYGMSGKKYTAIIQ

SEQ ID NO: 8587 - protein, 120 aa, Klebsiella pneumoniae
GRNMKWTILNTLICPQSGIAFSAISSLRFLKFIMWYEADVILLPGESIRLYSSRVLINDQYHSLKIYNITVYDEAQWEKLRERPSCPYHAGGERSDSCFYQSFCTIKRCPNNIPRSEPWR

SEQ ID NO: 8588 - protein, 118 aa, Klebsiella pneumoniae
AFLIRGRPQQRSLMSWIVLFIAGLLEVVWAVGLKYTHGFSRLVPSVITIVAMVASMALLSWAMKTLPVGTAYAVWTGIGAVGAAVTGIVLLGESASAMRIASLVCIVIGIIGLKISAH

SEQ ID NO: 8589 - protein, 1045 aa, Klebsiella pneumoniae
TCLILPVVVFSAPVVYASMVCWLFGLSRALSGASVSSKVEQLHQQLKERILVLDGGMGTMIQGYRLSEQDFRGERFADWPCDLKGNNDLLVLSKPEVIREIHDAYFEAGADIIETNTFNSTTIAMADYQMESLSAEINFAAAKLARASADAWTARTPEKPRYVAGVLGPTNRTASISPDVNDPAFRNITFDQLVAAYRESTRALVEGGVDLILIETVFDTLNAKAAIYAVKEELEALGVDLPLMISGTITDASGRTLSGQTTEAFYNSLRHAEALSFGLNCALGPDELRQYVQELSRIAECYVTAHPNAGLPNAFGEYDLDADTMATQIREWAEAGFLNIVGGCCGTTPEHIAAMSRAVAGLPPRQLPEIAVACRLAGLEPLNIGDDSLFVNVGERTNVTGSAKFKRLIKEEKYSEALDVARQQVESGAQIIDINMDEGMLDAEAAMVRFLNLIAGEPDIARVPIMIDSSKWEVIEKGLKCIQGKSIVNSISMKEGVESFIHHAKLVRRYGAAVVVMAFDEVGQADTRERKIEICRRAYKILTEEVGFPPEDIIFDPNIFAVATGIEEHNNYAQDFIGACEDIKRELPHALISGGVSNVSFSFRGNDPVREAIHAVFLYYAIRNGMDMGIVNAGQLAIYDDLPGELRDAVEDVILNRRDDSTERLLELAEKYRGSKADDGANAQQAEWRTWEVKKRLEYSLVKGITEFIEQDTEEARQQAARPIEVIEGPLMDGMNVVGDLFGEGKMFLPQVVKSARVMKQAVAYLEPFIEASKEQGSSNGKMVIATVKGDVHDIGKNIVGVVLQCNNYEIIDLGVMVPADKILKTAKEVNADLIGLSGLITPSLDEMVNVAKEMERQGFTIPLLIGGATTSKAHTAVKIEQNYSGPTVYVQNASRTVGVVSALLSDTQRDEFVARTRKEYETVRIQHGRKKPRTPPVTLAAARENDLAFDWESYTPPVAHRLGVQTVEASIETLRNYIDWTPFFMTWSLAGKYPRILEDEMVREEAHRLFKDANELLDKLSAEKTLNPPGVVGLFPGQPRGRRY

SEQ ID NO: 8590 - protein, 308 aa, Klebsiella pneumoniae
EKIMELKDYYAILGVQPTDDLKTIKTAYRRLARKYHPDVSKENDAEAKFKDLAEAWEVLKDEQRRAEYDQLWQHRNDPGFGRQRQTHEQSYSQQDFDDIFSSMFGQQAHQRRRQHAARGHDLEIEVAVFLEETLAEQTRTISYNLPVYNVFGMIESETPKTLNVKIPAGVVDGQRIRLKGQGTPGENGGPNGDLWLVIHIAPHPLFDIVGHNLEIVLPLAPWEAALGAKVTVPTLKESILLTVPPGSQAGQRLRIKGKGLVSKTHTGDLFAVIKIVMPPKPDEKARELWQQLAAAEASFDPRKTWGKA

SEQ ID NO: 8591 - protein, 443 aa, Klebsiella pneumoniae
QRPIPGLFTSVNKQKMTRRLYRKEAIEYKRVYWKGKALLLAGMPTWLIIVLSLLFLGLLISAMIFCSFTQRIDVNGEVITLPHSVNVYAPQQGFIVSQYVKVGDLVKKGQPLYEIDISRDTTTGNVSSVQIEVNKEKIANAEEIINKLSQNKQETLSSIEKQLKANKESLKEINRLLANALAGLKKMHDNLSSYDSYLRDGLITKDQYNYQHSLYFQQQSTYQSLVSQKMQLESQITQYNSDKITKIADFDNQITAQQNQINDFKNQLVESNAKGNAIIKATTEGRIESLSVTKGQMVDNGSSLAQIKPTGNIEYYLILWLPNNSIPYVKPGDVINIRYDAFPSDKFGQFPGEVISISSVPAARQEMSEYTNVSNGTNQQELALYKTIVKIKNKTFSYNGKTLKLSNGLKARAVVFLEKRPLYMWMFTPFYKMSQSVSGPIHD

SEQ ID NO: 8592 - protein, 231 aa, Klebsiella pneumoniae
RKAMFRTLLNLTASCALLLSSIAHAGIVVESTRYLYKEGAREITAQIENKDDIPYLIKSWVETPAGKAPSFMATPPLFRLEGKQQNTVRLFATGNVNAPTDRESMYYFNVMAIPPADDAKANNNTIQLAVRHRMRLVYRPKTLFDLSPNTEAKKLEWRKAGKKLTIKNPTPFFFYFNSIQIGGKEVKPEVNSVAPMTTKEVTLKENINASSITWKVVNDYGGAGSLYSSSL

SEQ ID NO: 8593 - protein, 324 aa, Klebsiella pneumoniae
RSAIGIEVITMNMKKSLVALCLSAGLLASVPAVSFADVNFVPQNTAAAPSIPASALQQLTWTPVDQSKTQTSKVATAGQTLNVPGITGPVVAYSVPANIGELTLTLTSEVDKQTSVYAPNVLILDQSMTPSAFFPSSYFTYLEPGVMSADRLEGVMRLTPALGQQKIYVLVFTTPQDLQQTTKLIDPAKAYAKGTGNAVPDIPDPIAKHTTDGTLSLKVKTSSSSSVLVGPLFGSSGPGPVTVGNTAAPVYNAPATAPAAAAAAAPAAKSEPMLSDTETYFNNGIKQAVKQGDIDKALKLMNEAERLGSKSARSTFISSVKGKG

SEQ ID NO: 8594 - protein, 134 aa, Klebsiella pneumoniae
QIYIRASASSSSIMGNNMQVKYLAGIVGAALLLAGCSSSNELTSAGQNVRFVQEKPGAECQLLGTATGKQSNWLSGQNGDEGGSMRGAANALRNQAAAMGGNVIYGVSSPTQNLLSSFVPTDSEMNGQVYKCPN

SEQ ID NO: 8595 - protein, 125 aa, Klebsiella pneumoniae
YPRILRVIVPLFADTRFMMTTPDAVVVLCTAPDEATAQDLAAKALAEKVAACATLLPGATSLYYWEGKLEQEYEVQMLLKTDLAHQQALLDCLKSHHPYQTPELLVLPVTHGDNDYLSWLTASLR

SEQ ID NO: 8596 - protein, 119 aa, Klebsiella pneumoniae
KMTISELLQYCMAKPGAEQSVHSDWKATQIKVSDVLFAMVKEVEDQRPAVALKASPKLAELLRQQHRDVRPSQHLNKAHWSTVYLDGSLPDSQIYYLVDASYQQAVKMLPEPVRQQLTR

SEQ ID NO: 8597 - protein, 362 aa, Klebsiella pneumoniae
GIQMQAATVVINRRALRHNLQRLRELAPASKLVAVVKANAYGHGLLETARTLTDADAFGVARLEEALRLRAGGIAQPILLLEGFFAAEDLAVIAAQRLHTAVHSPEQLAALEQADLPEPVTVWMKLDTGMHRLGVRPEEAEAFYQRLSQCKNVRQPVNVVSHFARADEPTCGATERQLDIFTTFTEGKPGLRSIAASGGILLWPQSHYDWVRPGIILYGVSPLDDRSTGRDFGCQPVMTLTSSLIAVREHKAGEPVGYGGTWISERDTRLGVVAMGYGDVYPRAAPSGTPVLVNGREVPIVGRVAMDMICVDLGPQAQDKAGDAVVLWGEGLPVERIAEITKVSAYELITRLTSRVGMKYFD

SEQ ID NO: 8598 - protein, 72 aa, Klebsiella pneumoniae
LPEMRTIFYPLTKLFIHLSVSRGLPFVIHSADAGDSNPSGDGAGTGVADGVPASEILGEGLIFILSPEREKV

SEQ ID NO: 8599 - protein, 70 aa, Klebsiella pneumoniae
VKEINLNTSVRMKSILQNYLKTQTIIYPYLSVAVSGINYPFIYQQEICLLVCNRSFTCSASQLNGTILIL

SEQ ID NO: 8600 - protein, 298 aa, Klebsiella pneumoniae
SQGIIMDIRTLRYFVEVVRQQSFTRAAEKLFVTQPTISKMLKNLEDELNCTLLIRDGRKLLLTDTGRVVFERGQAILGEFSQLESELSDINHLHKGVLRLGIPPMVGMLMAEPISRFRQRYPGVELKIAEFGGLTVQQAVSNGELDMAMTALPVEEDSSLTILPLFNHPLCVLTPRTAEWEGKTSLSPAELASHPLVIYNEEFALSQQLMRLFAEHDVKPRIAVRSGQWDFLAAMVQAGIGVAILPEPICQRLDRQNFCWIPLQSELRWELGMIWREGVYMSRSAEAWLTCSKAFWLE

SEQ ID NO: 8601 - protein, 195 aa, Klebsiella pneumoniae
RMTLQPAFTLAVQDAQHSFRRLLKAMSEPGVIVSLQQLQHGWQPLNVASTSLLLTLADHETPVWLASALRNDLVGQNLRFHTGAPLVDQPQQAVFAVANDGISAEQLNVLSAGTVTAPETGVTLIVQLASLSGGRMLRLTGAGIAEERMIAPQLPDCIIDELTERPHPFPLGIDLILTCGERLLAIPRTTHVEVC

SEQ ID NO: 8602 - protein, 60 aa, Klebsiella pneumoniae
CYLMLRGFSWKQGICYFSTVVPRHHTSALIIRICLDNQPTCLNRDNRRPANIAFSVPPSQ

SEQ ID NO: 8603 - protein, 67 aa, Klebsiella pneumoniae
PAALMIRVNPVVLLAITKPFYVNDVDECARLPRGNGNFAHFLLFLPRICMINQRLHIVYVRLATNLL

SEQ ID NO: 8604 - protein, 124 aa, Klebsiella pneumoniae
LTTIAVELTLAFIQLAAALVQLALPLVILALTVTALLTAPLIAPVIIPAIVIVSVVVIGATAARVIGVVNGLLNIADRVIDNIGASGQAGQRQSAKEQCGCVTFHRGQSHQSPAATLIIRMKPG

SEQ ID NO: 8605 - protein, 347 aa, Klebsiella pneumoniae
SAAILPIFASCSGVKVAGASAAEAIAGSKTALSMATERYFLWPDIVGILAISERHVSLGDKISPFFAEALPNGALIRNFIFQALSFPRDSAGLRQWSTRPQAEYPAQRFFLLFFQVVSLDMYAFLQQWDMAVIMLQIVAIDLLLGGDNAVVIAMACRKLPPQKRTKAIIIGTVGAILARVLLLAIALYLLSLPWLKIVGALLLLWIGIKLVRNEEEESEVSSSGSLWRTAITITVADVIMSLDNVLAVAAAGKGHIALVALGVAISIPVIVAGSKLVLVLLTRFPAVVLLGGMLIGWIAGSMLVSDPTVRQLFPSAGEGTARLAGAVGALLVLFTGWRRRPRPQAKD

SEQ ID NO: 8606 - protein, 164 aa, Klebsiella pneumoniae
PAALEEDALADAYEAQHDDYNKIMIKAIADRLAEAFAEYLHEKVRKVYWGYAANENLSNEELIRENYQGIRPAPGYPACPEHTEKGTIWQLLDVEAHTGMKLTESFAMWPGASVSGWYFSHPDSKYFAVAQIQRDQVEDYALRKGMTPAEIERWLAPNLGYDAD

SEQ ID NO: 8607 - protein, 941 aa, Klebsiella pneumoniae
MDKIEVRGARTHNLKNINLVIPRDKLIVVTGLSGSGKSSLAFDTLYAEGQRRYVESLSAYARQFLSLMEKPDVDHIEGLSPAISIEQKSTSHNPRSTVGTITEIHDYLRLLYARVGEPRCPDHDVPLAAQTVSQMVDNVLAQPEGLRLMLLAPIIKERKGEHTKTLENLASQGYIRARIDGEVCDLSDPPKLELQKKHTIEVVIDRFKVRDDLAQRLAESFETALELSGGTAIVANMDDEKAEELLFSANFACPICGYSMRELEPRLFSFNNPAGACPTCDGLGVQQYFDPDRVVQNPELSLAGGAIRGWDRRNFYYFQMLKSLAEHYKFDVEAPWGTLSANVQKVVLYGSGKESIEFKYMNDRGDTSVRRHPFEGVLHNMERRYKETESSAVREELAKFISNRPCASCDGTRLRREARHVFVENTPLPTISDMSIGHAMDFFNNLKLSGQRAKIAEKVLKEIGDRLKFLVNVGLNYLTLSRSAETLSGGEAQRIRLASQIGAGLVGVMYVLDEPSIGLHQRDNERLLGTLIHLRNLGNTVIVVEHDEDAIRAADHVIDIGPGAGVHGGQVVAEGPLEAIMAVPESLTGQFMSGKRKIEVPKQRVPVNPEKVLKLTGARGNNLKDVTLTLPVGLFTCITGVSGSGKSTLINDTLFPIAQRQLNGATIAEPAPYRDIQGLEHFDKVIDIDQSPIGRTPRSNPATYTGVFTPVRELFAGVPESRSRGYTPGRFSFNVRGGRCEACQGDGVIKVEMHFLPDIYVPCDQCKGKRYNRETLEIKYKGKTIHEVLDMTIEEAREFFDAVPALARKLQTLMDVGLTYIRLGQSATTLSGGEAQRVKLARELSKRGTGQTLYILDEPTTGLHFADIQQLLEVLHQLRDQGNTIVVIEHNLDVIKTADWIVDLGPEGGSGGGEILVSGTPETVAECEASHTARFLKPMLK

SEQ ID NO: 8608 - protein, 302 aa, Klebsiella pneumoniae
LREITIMAMVQPKSQKLRLFTTHLLLLIFIAAIMFPLLMVIAISLREGNFATGSLIPDTISWEHWRLALGFSVEHADGRVTPPPFPVLLWLWNSIKVAGITAIGIVALSTTCAYAFARMRFPGKATLLKGMLIFQMFPAVLSLVALYALFDRLGQYIPFVGLNTHGGVIFAYMGGIALHVWTIKGYFETIDGSLEEAAALDGATPWQAFRLVLLPLSVPILAVVFILSFIAAITEVPVASLLLRDVNSYTLAVGMQQYLNPQNYLWGDFAAAAVLSAIPITVVFLLAQRWLVNGLTAGGVKG

SEQ ID NO: 8609 - protein, 593 aa, Klebsiella pneumoniae
WGFLLRFDPIPDRRQGQVTKIITIFRHRRYNRPKSQSQIRRVLLMKNINPTQTSAWQALQKHFDEMKDVTISELFAKDSDRFSKFSATFDDLMLVDFSKNRITEETLAKLQDLAKETDLAGAIKSMFSGEKINRTEDRAVLHVALRNRSNTPIVVDGKDVMPEVNAVLEKMKTFSEAIISGSWKGYTGKPITDVVNIGIGGSDLGPFMVTEALRPYKNHLNMHFVSNVDGTHIAEVLKNVNPETTLFLVASKTFTTQETMTNAHSARDWFLATAGDDKHVAKHFAALSTNAKAVGEFGIDTANMFEFWDWVGGRYSLWSAIGLSIILSVGFDNFVELLSGAHAMDKHFSTTPAEKNLPVLLALIGIWYNNFFGAETEAILPYDQYMHRFAAYFQQGNMESNGKYVDRNGHAVDYQTGPIIWGEPGTNGQHAFYQLIHQGTKMVPCDFIAPAITHNPLSDHHQKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELKDGSEVSSHDSSTNGLINRYKAWRA

SEQ ID NO: 8610 - protein, 126 aa, Klebsiella pneumoniae
KGFVMANNTTGLTRIIKAAGYSWKGFRAAWINEAAFRQEGVAAIVAVAVACWLDVDAITRVLLIGSVLLVMIVEILNSAIEAVVDRIGSDFHELSGRAKDMGSAAVLLAIIIALITWGTLLWSHYH

SEQ ID NO: 8611 - protein, 453 aa, Klebsiella pneumoniae
HEVVMTDLVVAKFGGTSVADFDAMNRSIDVALLDANTRIVVLSASAGVTNILVALAGGLEPTERFSQLDALRQIQFNILERLRYPSVIREEIERLLENITTLAEAAALASSTALTDELVSHGELMSTLLFVEILRERGIQAQWFDARKVLRTNDRFGRAEPDIAAVAELTQQQLAPRLAEGLVVTQGFIGSEAKGRTTTLGRGGSDYTAALLGEALNATRVDIWTDVPGIYTTDPRVAPAAKRIDVIAFEEAAEMATFGAKVLHPATLLPAVRSDIPVFVGSSKEPKAGGTLVCKTTENPPLFRALALRRRQTLLTLHSLNMLHSRGFLAEVFGILARHNISVDLITTSEVSVALTMDTTGSTSAGDTLLTQALLTELSSLCRVEVEENLALVALIGNELSKACGVGKEVFGVLEPFNIRMICYGASSHNLCFLVPGDDAEKVVQKLHHNLFE

SEQ ID NO: 8612 - protein, 158 aa, Klebsiella pneumoniae
FISVRFGGSLYCSPDFFFSGLSHMAFAPARVAPAVAQRLQIPVQVLLYVGLFIFAQYLVNRWQVPLPANLVGMVMLLLLIVCRVIPVSWVRAGARWLLAEMLLFFVPAVVAVVNYAQLLMVDGWRIFLVIALSTLMVLGATAWVVDKVYRYEVGRLKK

SEQ ID NO: 8613 - protein, 202 aa, Klebsiella pneumoniae
KLAVAGSTRRESRRAPFLRTPGDAAHQRHDFPLRQPAKHLTYSGQTDLRGTMPELRDTGVRNVVCGENVVIYQPANLYDCQLGDNVFVGPFVEIQGNTRIGANSKIQSHTFICEYVTIGQRCFIGHGVMFANDLFREGKPNADRASWGRIEIGDDVSIGSGATILAVSICDGVVIGAGSVVTKSITEKGVWAGNPARLLRRL

SEQ ID NO: 8614 - protein, 189 aa, Klebsiella pneumoniae
NHHVRFNHNTPDPGYAISEVSHFREKTMKRPDCIRHWRELEGPDDATYPDSPERFSIGAPLGRGLRLNRLGIHHERLPPGRRTSYPHAESDEEEFIYVLEGYPEVWINGYLWKLEPGDSVGFPAGTGICHTFLNNTEQEVRLLVVGEANKKYNRIYYPLNPGYAATRQDRWVDHPPQFFGPHDGKPRKK

SEQ ID NO: 8615 - protein, 240 aa, Klebsiella pneumoniae
NKNVHIIVWLKSFDFIMDNRVTWGKDMDDAVLFNGCIINQEIIFNANMNELRPLAGDGECISLNAPTARCLLLLLQNCGKVISRDEFLAAVWETRGVVVSQNTFYQNISLLRKSLVKAGLSEDIIITVRQKGFSVAPNTLVIPLSDEECKNMNRVTLTHYQNNKVVDFISEEKEKPDTHLNLPLIENSSKHGSDLMANKPEEGEKASERLHVTFKIPIWLIALIVVMIVINIIVLVALNR

SEQ ID NO: 8616 - protein, 156 aa, Klebsiella pneumoniae
PPDVRPGLANLRAPPLRFGRRPPQSNYPPDTVRNPGQGPTLEHQTLKGGISRLAPRRLASTLQSLPPILHIKAQCSVSSYSKGSRGLSVLPRVHCIFTASSISLSLGWRQPGHHYAIRAGRNLPDKEFRYLRTVIVTAAVYRGFDQELLLTDNPIN

SEQ ID NO: 8617 - protein, 84 aa, Klebsiella pneumoniae
HECVVYEIMSNSSVLLALSLFVQDASLKYATENNLSEAQNYMQLWRQNGEKMDVKASLKIYLMMELFLKRMVLMANTSTIFRFA

SEQ ID NO: 8618 - protein, 261 aa, Klebsiella pneumoniae
NYGVCQRPGGFCRHQCRLRGLLYRTPGGLSGALLCGGSKVTERCRRRNRSDRFRPLTPRLEGAPPAFSHRFLSFHIVHFTGNIAAERREERSMLTIRQACPEDAPQLSAMGYASYHHHFAHLWRDADELALFLKQEYAEDALRRSLADATQHWLIAEAPSPVGFAKYSYQQRMADDGKIGTLLHKLYLMPGKTGHRYGEHIFHAVETRAKTAGESWLWLEVLAANPAARRFYERQGMQHIRDTTFHSASQQSTLHILAKPI

SEQ ID NO: 8619 - protein, 202 aa, Klebsiella pneumoniae
LRSVSRSKKRPPTTIVKKLQERVAKLAGGVAVIKVGAATEVEMKEKKARVDDALHATRAAVEEGVVAGGGVALVRVAAKLAGLTGQNEDQNVGIKVALRAMEAPLRQIVSNAGEEPSVVANNVKAGDGNYGYNAATEEYGNMIDFGILDPTKVTRSALQYAASVAGLMITTECMVTDLPKGDAPDLGAAGGMGGMGGMGGMM

SEQ ID NO: 8620 - protein, 542 aa, Klebsiella pneumoniae
  UNSURE (5),(29),(38),(49): Identity of amino acid at the above locations are unknown.
RRPVXLKYHIPCEYFFNERLLAITSVIAXAHLPRDTVXRSSAAASRAEXAPPAAAEDNTLSIHIDDMLRPWRGDLPGMIDRRTIRVLTTYSKTFFFIDKGTQRGATHDILIALENELNKQLAKDKKLKQRHLKLHIVFVPVSRDNLFIALNEGKGDIAAANLTITPSREAQVDFAQPLYSNVKELLISGPASPKVDSLEQLSGQTVFVRRSSSYYDSLQALNARFAGESRPPVILEAAPEALEDEDLLEMLNAGLIPLIVVDQHKALFWKQVFPKIQVHDNVVLRDGGDIAWAVRKDSPQLLTVLNNFVKKNRQGTTLGNTLLLRYLKNAKYVKNAAASKERRKFLAMVDVFRKYGDRYDVDWLLMAAQGYQESRLNQSVRSHVGAIGVMQVMPSTGKELKVGDIKQLDPNIHAGVKYMRWMMDRYYADEPMTRLDKALFTFASYNAGPARIARLRTMTKQRGFDPNVWFGNVENMAAEKIGAETVTYVSNIYKYYIAYRLIVDDMARKQKATAVPRQEPVAQPVKPQPSVATAATAQVPVI

SEQ ID NO: 8621 - protein, 63 aa, Klebsiella pneumoniae
FFHVAVERLGEIDLGFPRGRDSQIGSRNIAFTFIKRDKEIIPTDRHKNDMQLQVALFELFILR

SEQ ID NO: 8622 - protein, 125 aa, Klebsiella pneumoniae
RTNVLFFDDIMRSVMQLPHCPKCDSTYTYEDSGMYICPECAHEWNPAEATEESDILIVKDANGNLLADGDSVTVVKDLKVKGSSSMLKIGTKVKNIRLVEGDHNIDCKIDGFGPMKLKSEFVKKN

SEQ ID NO: 8623 - protein, 313 aa, Klebsiella pneumoniae
GNTVMPIRVQDELPAVNFLRNENVFVMTTTRATTQEIRPLKVLILNLMPKKIETENQFLRLLSNSPLQVDIQLLRIDARESRNTPAEHLNNFYCNFDEICDQNFDGLIVTGAPLGLVEFNDVAYWPQIKQVLEWAKDHVTSTLFVCWAVQAALNILYGIPKQTRAEKISGVYEHHILHPHALLTRGFDDSFLAPHSRYADFPAGLIRDYTDLEILAETEEGDAYLFASKDKRIAFVTGHPEYDANTLASEYFRDVEAGLNPEIPHNYFPQNDPQNKPRATWRSHGNLLFANWLNYYVYQITPYDLRHMNPTLE

SEQ ID NO: 8624 - protein, 67 aa, Klebsiella pneumoniae
IVRVAAFFARTDDSLAEESAHFLSFLLNLFPKSQILWRLMADLSFRECSGGNRAAQRGAACHSASVQ

SEQ ID NO: 8625 - protein, 341 aa, Klebsiella pneumoniae
RRGVAIMERKGIIAAGNMLVDHVHQIGQWPERGWLVEIVHSERATGGAPLNVLLTLAKMHAGLPLQAVGLIGEDNDGDYITAMLDQYHINRQLVQRTSSAPTSMTQVMTDAEGQRTFFHSPGANRLLDLPAFEPLDAPLKIFHLGYLLLLESLDRPDEVYGTRSARLLAQMRERGYEVSLDLVSRKGDPRYRPLVLPALKHLDYLTINELEASEFSGLEIRLPNGEPHVANIARAASALLDAGVRQRVVIHCPEGAWGVSRTEAGRWVPSWRLPPEEIIGSVGAGDAFCAGLLYGSHERWPLTASLQLAHACARASLQAANAIDGAKTLPELQAFIQLQDG

SEQ ID NO: 8626 - protein, 171 aa, Klebsiella pneumoniae
ASTVAVVVPSPAASFALEATSFTICAPMFSNLSSSSISRATETPSLVMVGAPKDLSRTTLRPFGPRVTLTASASTFTPRSIFTRASLPNFTSFAAISFIPQIRSGSCELSFNNCQDVAFGHDQYFFVVDLFSLHAVAIVENHDVTNFNVQRLHGPVFQDAAFTDSDDFATS

SEQ ID NO: 8627 - protein, 527 aa, Klebsiella pneumoniae
HSAFIFRWWTAAIVLTDRSAAMTATPVLEMRHIAKAFGKFYALKGVDLTVWPGEIHALMGENGAGKSTLMKILAGAYTATSGEILIDGKPQTIRGPKDALAAGITLIYQEMQLAPNLTVAENIFLGSELARGGLVQRKAMLSQAQAVIDRLGAQFKASDRVMTLTIAEQQQVEIARALHRQSRILVMDEPTAALSSRETQRLFELILRLRDEGMAIIYISHRMAEVYELSDRVSVLRDGQYVGSLVRDKLNAPELVRMMVGRPLSDLFNKERDIPRGQPRLRVEDLTDGGKVKPSSLVVHAGEIVGLAGLVGAGRSELAQLIFGVRKATAGVIEIDGEPVVIHSPREAIDLGIGFLTENRKEQGLFLELAAQENITMATLERDATWGMLNRRKAQTISDDAIQLLNIRVPHAQVRAGGLSGGNQQKLLISRWVAIGPRILILDEPTRGVDVGAKSEIYRIMNDMARQGVAILMISSELPEVVGMSDRVYVMREGVIAGELQAGDISQESIMTLATGVTDSHLKAGQL

SEQ ID NO: 8628 - protein, 137 aa, Klebsiella pneumoniae
PTAFSASPGTACTRASTCITPSAYASWRTTAMKLSMSPATAATWTICCSPTSCTIRGWSLRISRRASTSTSGRPGRSSAASAPSLFAAPLRATSSIPPCSANTLANCSAAAIPWSISSKAAAPVPAACSIRRPVRCR

SEQ ID NO: 8629 - protein, 63 aa, Klebsiella pneumoniae
NPPLNTHRGFLALPAHVNILCRVGKKSKKTSDKGAGFPFKNPNFSRGSWGVFTTPKNITFLHK

SEQ ID NO: 8630 - protein, 575 aa, Klebsiella pneumoniae
HGPSVAGLHQSVGNGAMSNAITEIDNTDLVFIFGYNPADSHPIVANHVINAKRNGAKIIVCDPRKIETARIADMHIALKNGSNIALLNAIGHVIIEEDLYDKSFVASRSEGFEEYRKIVEGYTPESVEEITGVSAQEIRACARMYASAKSAAILWGMGVTQFYQGVETVRSLTSLAILTGNLGKPSVGVNPVRGQNNVQGACDMGALPDTYPGYQYVKFPENREKFAKAWGVESLPAHTGYRISELPHRAAHGEVRAAYIMGEDPLQTDAELSAVRKAFDDLELVIVQDIFMTKTASAADVILPSTSWGEHEGVYTAADRGFQRFFKAVEPKWDLKTDWQIISEIATRMGYPMHYNNTQEIWDELRHLCPDFYGATYEKMGELGYVMWPCRDESDADQGTSYLFKEKFDTPNGLAQFFTCDWVAPIDKLTDEYPMVLSTVREVGHYSCRSMTGNCAALAALADEPGYAQINTADAERLGIEDEELVWVNSRKGRIITRAQVSDRPNKGAVYMTYQWWIGACNELVSENLSPITKTPEYKYCAVNVERIADQRAAEQYVIGEYNKLKSRLRESAMG

SEQ ID NO: 8631 - protein, 182 aa, Klebsiella pneumoniae
ETYSGDTNMASRGVNKVILVGNLGQDPEVRYMPSGGAVANFTLATSESWRDKQTGEMKEQTEWHRVVLFGKLAEVAGEYLRKGSQVYIEGQLRTRKWTDQSGQDKYTTEVVVNVGGTMQMLGGRQGGGAPAGGGQQQGGWGQPQQPQGGNQFSGGAQSRPQQQAPAAPSNEPPMDFDDDIPF

SEQ ID NO: 8632 - protein, 348 aa, Klebsiella pneumoniae
CAISYNIPARHPSTLQTTVMTTDAMMISGVLYALLAGLMWGLIFVGPLLVPEYPAMLQSMGRYLALGLIALPLAWLGRARLRQLSRHDWWTALGLTMMGNLIYYVCLASAIQRTGAPVSTMIIGTLPVVLPVFANLLYSQRDGKLPWRRLFPALICIAVGLICVNVAELRQGLPNFSPWRYGSGIALALGSVVCWAWYALRNARWLRENPHQPPMMWATAQALVTLPVSLAGYLAACAWLHGQQAGFPLPFGPRPAVFITLMLAIAVLCSWVGALCWNIASQRLPTVILGPLIVFETLAGLLYTFLLRQSLPPLLTLSGILLLVLGVVSAVRARPEKPMLQPLADEKK

SEQ ID NO: 8633 - protein, 159 aa, Klebsiella pneumoniae
NKSSPCPLCHPVPQWFHLRSRYPWQLRLRIHRRLPHSSLTTFTRANMKTLPATTPQAATLCLSPVAVWQMLLARLLEQHYGLTLNDTPFSDEKVIQEHIDAGISLADAVNFLVEKYGLVRIDRRGFDWLEQSPYLRAVDILRARQATGLLKRNRISAAQ

SEQ ID NO: 8634 - protein, 169 aa, Klebsiella pneumoniae
RMSSPMTPTTATLWGSRIRSSAMRSGASVTDRREVCYALYSLKSTFDGQRKLPVSIWWRDMTQQSPYSAAVAEQRHQEWLRFVALLQQAYAEDLHLPLLQLMLTPDEREALGTRVRIIEELLRGEMSQRELKNELGAGIATITRGSNSLKSAPVELRQWLEQTLLASDK

SEQ ID NO: 8635 - protein, 246 aa, Klebsiella pneumoniae
KVASMPYSIGEFARLCGINATTLRAWQRRYGLLKPLRTDGGHRLYSDDDVQQALKILDWVKKGVPVSQVKPLLSRPGARRTNNWLTLQETMLQRLKEGKIESLRQLIYDAGREYPRQELVTEVLRPLRSQVSANVPAIMTLREILDGIIIAYTSFCLEGDKKAPGDNFLITGWHLTDACEIWLEALKRTGQGHRIDVLPVPPAALAPEIFPQRNWLLVTSGKLSAARQRQVELWQQQVVSLEVIPL

SEQ ID NO: 8636 - protein, 412 aa, Klebsiella pneumoniae
HNRFSKKGIKMKKTLVLTTIALLVSGSAAAKTWVLTNAEEGMDKGNWQINSDQLKVKDHAFSIEQKVLHGGKQEGSKILTIHSKDGLTITLSPTRGMNLLRIEGFGSRMGWDSPVKEVVNPAFINLESRNGLGWLEGFNEMMVRCGYEWTGHPVTADGQIYTLHGKAGNTPASLVEVEVADSAPYEIRIRGLVKESTFKKADLQTLTELRYVPGSNSFSLHDVLTNHADYPHDYQIIYHSNFGTPILEEGARFLAPMSSISPFNDYAKSGLKTWQTYQGPTKDFDEMVFNIQPLADENHQTLAAVVNKAGDKGASIQFDTRQLPVLTLWKNTDTVKQGYVTGIEPGTSYAYPVTIEREQKRVKQLQPGASAQFDLTYTLLHDSAQVAAVEQKIAKIQGDNKVAENETPIAKE

SEQ ID NO: 8637 - protein, 505 aa, Klebsiella pneumoniae
MEESTMSSPLLIARTLDNALYLLPAMANRHGLITGATGTGKTVTLQKLAESFSEIGVPVFMADVKGDLTGIAAAGQSSEKLQARLEKIGVSDWEPHANPVVLWDIFGEKGHPVRATVSDLGPLLLARLLNLNEVQSGVLNIIFRIADDRGLLLLDFKDLRAITQFIGDNAKSFQNQYGNINSASIGAIQRGLLTLEQQGAEHFFGEPMLDIADWMRVDASGKGVINILSAEKLYQMPKLYAASLLWMLSELYERLPEAGDLDKPKLVFFFDEAHLLFNDAPQVLLDKIEQVIRLIRSKGVGVYFVSQNPADIPDAVLGQLGNRVQHALRAFTPKDQKAVKTAAQTMRANPAFSTEQAIQELGTGEALISFLDEKGSPSVVERAMVIAPCSRMGPVSDDERNGLLNHSPLYGKYEEEVDRESAFEMLQQGVQVATGQQSAPPAKGQQNGDDDGLLGGLKDILFGSTGPRGGKRDGIVQTAAKSAVRQVTNQIVRGMLGSLLGGRKR

SEQ ID NO: 8638 - protein, 323 aa, Klebsiella pneumoniae
GAFFLPRRQEISMANPLYQKHIISINDLSREDLELVLATAAKLKANPQPELLKHKVIASCFFEASTRTRLSFETSMHRLGASVVGFSDSANTSLGKKGETLADTISVISTYVDAIVMRHPQEGAARLATEFSGGVPVLNAGDGANQHPTQTLLDLFTIQETQGRLENLNVAMVGDLKYGRTVHSLTQALAKFNGNRFYFIAPDALAMPQYILDMLDEKGIAWSLHSAIDDVMAEVDILYMTRVQKERLDPSEYANVKAQFVLRAADLEGARANMKVLHPLPRIDEITTDVDKTPHAWYFQQAGNGIFARQALLALVLNSELAL

SEQ ID NO: 8639 - protein, 88 aa, Klebsiella pneumoniae
MLPSLLNPRAHSASLQVLQYILIPEKLAPPATPATPATPATPATPATPAPLPRGWSRSYALHDDKQTRTHGLRRIAVSRGVPARQSAL

SEQ ID NO: 8640 - protein, 74 aa, Klebsiella pneumoniae
AVASVPCWERCSGVAIQGLIQTYINFDGTLSSWWTKIAIGILLFIFIALQRGLTVLWENRQNAAVTRVSGAGSR

SEQ ID NO: 8641 - protein, 327 aa, Klebsiella pneumoniae
RRWSMANLLKRHEFWLGMFIIALCLLLGWRSEEFFTFGNIYDLANNYAMLTILACGLFVVLIAGGIDISFPAMTIIAQYGMVVMLQKVGGNFAVAFVLAGGIGVLLGLVNALLVNRLRVPSIIITISTLNIFYGLLLWLSKGVWLYDFPPWFEKGVMLFKYTDADGYDYGLGLPLLTMIAVVLLTAFIMNFTTVGRKIYAMGGNRESASRVGFSVLRLQLFVYGYMGLMSGAAGVVQAWTVMTVAPDSLLGYELTVLAAVVLGGTSLIGGRGTLTGTLLGVILLAVMQNGLNLLGVSSYWQTLITGAIIVVSISVTAWSQHQNRSLL

SEQ ID NO: 8642 - protein, 102 aa, Klebsiella pneumoniae
SLRSFFHLTERHIAMKKTRYTEEQIAFALKQAETGTRDGEVCRKMGISEATFYNWKKKFAGLGVTELRRLRQLEDENLRLKKLVADLSLDKEMLQEVLKQKF

SEQ ID NO: 8643 - protein, 345 aa, Klebsiella pneumoniae
RILPRTSAGPLRRRRQRRRTLLLMEAIMAPIAVTLLTGFLGAGKTTLLRHILNEQHGFKIAVIENEFGEVSVDDQLIGDRATQIKTLTNGCICCTRSNELEDALLDLLDSRDRGEIEFDRLVIECTGMADPGPIIQTFFSHQVLCERYLLDGVIALVDAVHADQQMDQFTIAQSQVGYADRILLTKTDVAGDTEKLRERLARINARAPIYTVIHGDIDLSQLFNTSGFMLEEKVVSATPRFHFVAEKQNDVSSIVVELDYPVDISEVSRVMENLLLSFAEQLMRYKGMLWIDGEPNRLLFQGVQRLYSADWDRPWGDETPHSTLVFIGIQLPEEEIRAAFAGLRR

SEQ ID NO: 8644 - protein, 350 aa, Klebsiella pneumoniae
TAIPSPLTSTIRWPGALFILILKCWRSIRRWRSNMQILLANPRGFCAGVDRAISIVENALTLYGAPIYVRHEVVHNRYVVDSLRKRGAIFIEQISEVPDGAILIFSAHGVSQAVRNEAKSRDLTVFDATCPLVTKVHMEVARASRRGEESILIGHAGHPEVEGTMGQYNNPQGGMYLVESPEDVLKLEVKNDARLSFMTQTTLSVDDTSDVIDALRARFPKIVGPRKDDICYATTNRQEAVRALAEQADVVLVVGSKNSSNSNRLAELAQRMGKAAYLIDDASDIQEAWVKDAACVGVTAGASAPDILVQNVITRLQELGGGEAVPLEGREENIVFEVPKELRVDVREVE

SEQ ID NO: 8645 - protein, 398 aa, Klebsiella pneumoniae
LMVPRFATLGRIPKGVWVLGGVSLLMDVSSEMIHSLLPLFMATTLGASVIIIGLIEGLAEATALILKVFSGAISDYVGKRKGLALLGYGLGALSKPLFAFAPTAGVVFSARMIDRVGKGIRGAPRDALVADVTPPEIRGAAYGLRQALDTVGAFLGPLLAVLLMFIWANDFHAIFWVAVIPAVLSILLLGFGLQEPKSAIAHKRSNPLKRENLKKLSAAYWWVVAIGSIFTLARFSEAFLVLRAQQMEIPLYTIPLVMVAMNLVYSLTAYPFGKLSDSMSHSKLLQWGLLVLILADIVLALSGHWSTLLIGVALWGIHMGMTQGLLAAMVAHTAPPELRGTAFGMFNLMSGLALLLASTGAGVLWETFGAASTFYAGAIICVVTLIGMRVMPSAYRQD

SEQ ID NO: 8646 - protein, 784 aa, Klebsiella pneumoniae
MYAPGDSFVCRLALTLIALRKRRCCAFVKGTAPGVAALAQATKSRIRGCSPGKALCAAIRDRLLSGQTATGPVPSPRWGEGEGLNQLELTNLPITQVLHAALHFFLLAGVERPRVRAAEITAHPAGNGNAGGVVVTAFRAGKALAGALELAGKTALVALIDRRIGPVVRHVLIAVIPHVFQRLEVMLDIRVLAVANEPPVGQRRVRRFEIDLVVRVDLLLHVEVEAVGVVTFVGYPFHHAKLGGVETAEAIAQVFARRAVQAKAVAGFFLPQIDSVAQALDDGHAFLTQRLAVVHMLVAVQRIDGFMDTDIAQRNGRAAVFEDLGDVVVGFQPHAAGAFHIQDRRHASLHSFQAGDTGHQRFTRQLQALVQQRPEGGFIAFRFQGDARQVETDHAEVIASIMHLLAVLVFPYPEEAAAAHRRFKRPGDFHHLIVVEDIRVHALAGALQRQLFDVVVRVAELMVQAVADREHQFREHRGFAIFTEAGNAVAKNRLLDQPRFPAGAKAEPEGDERRLAVGGMQCVDLILQRLEGVVALFFGTGAGIAFGIRDLPLFGDFAMLFEAFADERRQHFIDAVDGGAAVNMAGDLGDDLRRHRGGGRDRLRRLDLRVAHLKALGQHAFQVDQHAVEHREEGRVIEVMIVDHAALVGHHHIVGQQVLPGVVLGDDPGQQVALGRDDFTVLVGVFVEQRGVGLLDEAADLLIEAAALLTLAIAVMAILNVGARQLLIGAGHQLVFHRGLDLVDVDLGAALHLLANDFCDGGAIVCVIDSRCFSCTQNCFLNAL

SEQ ID NO: 8647 - protein, 174 aa, Klebsiella pneumoniae
TDYPTRNPYSSTDRYRSGPDVADDDMHAGALFAQVEAFQTVNPVCFLVVNRPAFPPQLNMNTRATVADPGFRYLPDTQGYRPIIPPALPVVNGSALHQQSASPSDTDTVSPPQKMHRLTFLSRPQNFCFSTSCSISLSRLRSATSFFSRRFSSSSCRRRRSSVTPRPANFFFQL

SEQ ID NO: 8648 - protein, 142 aa, Klebsiella pneumoniae
FSHPVFHHHHVRSWRSRAALCMPKIRKEDTMQALKIAVIGGGSSYTPELIEGIIVRYEQLPVTELALVDVESGREKVEIIAALTRRMLKHKGLEQVAVSVHFTLDEAIRGASFVLTQLRVGQLAARAADERLGLKYHLLGPG

SEQ ID NO: 8649 - protein, 257 aa, Klebsiella pneumoniae
GNHPPQLLSYDRRTRRRHYYGSANQYVTQGDTMKWDWIFFDADETLFTFDSFSGLQRMFLDYSVTFTAEDFQDYQAVNKPLWVDYQNGAITSLQLQHQRFDSWAERLNVPPGELNDAFMNAMAEICAPLPGAVSLLNALQGKVRMGIITNGFTSLQQTRLERTGLRDHFDLLIISEQVGVAKPDARIFDYALAQAGNPPRSRVLMVGDTAESDIRGGVNAGLATCWLNAHQRELPADLEPDWTVTSLSELEQLLCKH

SEQ ID NO: 8650 - protein, 406 aa, Klebsiella pneumoniae
CPCPSPSKGEGQLIPLNHQGVAMPVARHLLVASLSLFAAAAGAAQTHYAWVGTYNPNGEGLYRFTVDAKTGALRDKTLVSSLPNVAQLTVSRDGKTLYAASEVEKGVVQAWRIEKNGELTALNQVASGGAGPVYLSLTPDGKHLLVANYVSGSTAVLPVQEDGSLAEAVDRHQDEGPAGAERPAAAVEGSFAISDHNGPHAHMIAADPSGKYVYSTDLGLDRIYQYRLDSASGKLTPNDPPFIAASSPGAGPRHFVFTPQGDGLWLINEEASTLTFYHLDKQSGLLREGKTVSALPEGYKGTSFAAGLVLSNDGKQLYVANRLHNSIAHFTVLADGSLSHQEDIWTRGDYPRTLTLDNQGQWLYVMNQRSDNITRFSVAPKDGKLTFAFDYTPVGSPSQMVISAQP

SEQ ID NO: 8651 - protein, 275 aa, Klebsiella pneumoniae
FMLLAHISDTHFRSRGEKLYGFIDVNAANADVVSQLNALRERPDAVVVSGDIVNCGRPEEYQVARQILGSLNYPLYLIPGNHDDKAHFLEHLHPLCPQLGNDPQNMRYAVDDFATRLLFIDSSHAGTSKGWLTDETISWLEAQLFEGGDKPATIFMHHPPLPLGNAQMDPIACENGHRLLALVERFPSLTRIFCGHNHSLTMTQYRQALISTIPGTVHQVPYCHEDTRPYYDLSPASCLMHRQVGEQWVSYQHSLAHYAGPWLYDENISCPTEER

SEQ ID NO: 8652 - protein, 65 aa, Klebsiella pneumoniae
RRRPDRPSVGRRDGAAPPAGSPDGSVPAPPQRGAGWTSSSDRPAPGSPPAAGGSLPRPPSPSYRR

SEQ ID NO: 8653 - protein, 284 aa, Klebsiella pneumoniae
SHPPQPPLRFRLKYRQIPGVVNNRGSMQVDRTQQRAITRLCIQCGLFLLQHGAESALVEELSTRLGLALGMDSVESAISSNAIVLTTIKNGECLTSTRKNVDRGINMHVVTEVQHIVILAEHKLLDYRDVEKRFAQIVPLRYPRWLLVLMVGLSCACFCKLNNGGWDGALVSFCASTVAMYIRQVLTHRSMHPQINFCITAFVATTISGLLLRLPAFASTPTIAMAASVLLLVPGFPLINAVADMFKGHINTGLARWAIASLLTLATCIGVVMAMTVWGLRGWA

SEQ ID NO: 8654 - protein, 495 aa, Klebsiella pneumoniae
MSLPEEKIAKRALKAIEFICRQLSRFAKMTPVELMAYLRKNPKDAFCNIPHPKGNGHIHCGSLAWNKLNELVDLTIELDHGLGRRVGRKLAKEAVINAFVKRVLQEARGVDQETAMLLLKDALTILREKLVVIEHYLPCVLFPGDTPTEFSVGPVTFVRRSKFFDDKKSVLKHSIHVNTKAHIQCVKEAIAQGFPQERTHTKDKSRQLVRKLQSRAVKAYKDYPWIACVKVSDCDEAISKERAIQATEMALHIIRILLGAKPTREIRLAWSRSGALRSAHLHADVHGVIHASLCADSLEPVGVINWHEALIRANLELDILGSALIPIVNPVETTHLHQRLIDAINWFGDAVTDPNIHSSIVKYVSAIERLFFGKFEAGRTKLFAGRVRDVLKAFSCDEGDRVYSQALELYKTRSTLVHGEQFRTEDESFNIINLASELSRMCLLCSAQLYSMMLQAFENPDSAKLEEIMKRINDEGLNWLAEAAALGSAKNSPFS

SEQ ID NO: 8655 - protein, 409 aa, Klebsiella pneumoniae
PAIPILWCATCSTWARITPAPWPTGGSVLPTPGRILKSSALMSVSAGCGSTTSATAKPDLTPAPSAWCSSPRSGYDTPGAASADGPRVRCLLDAGGDVARARSADLADAGHFRLAAVAGGQSSARPAVGRGGLRSGRLLGAGGTDRFSRRQPAAPVDGGPVADVRRRLDPTDPHRDASRLGAGHGRHRRRPGGLPDRRSPRSHDPAGADGAWRGRHGLRLAGAHAVIPSGDGEAKMRFALLLLWLTILAPAAHAADWLTWRRVGEATLTWGPFTVYHSQLRTPNGRYDGPQQDRALIITYRRDIDREALVEATRDQWQAQGILQQEPRSEAWLRMLQGIWPDVAPGSQLAFVVSGGEGQFWYRASAAQTAFTPLGPRQSAAFSTRFLAIWLDPRTTYPELRQQLIGGTP

SEQ ID NO: 8656 - protein, 289 aa, Klebsiella pneumoniae
FSSPQHSSLREKSMELTAVPATQFSSVQLTDILNACFEAYLVPVTQSVEGFVQRFSAEGMSLVDSRVWLAGDEPAAIAIVARRGNAARLAAFALRPAWRGKGLGRKLMQELLMLLQQQGIETVFLEVIRDNHAAVAQYQSLGFTRRYGLCGYLSTELLAPVPGVLQLYPTLSLLRRAIEESNSQLPWLLDPLTFATLPCQVVTLEQRAFAVLTTAGSRPVLSFLWVEPAARRQGLARELLMALAQQFPGIGTSVTVPETFTPLFAAAGYTPLSLQQYEMTMDLADAKSA

SEQ ID NO: 8657 - protein, 448 aa, Klebsiella pneumoniae
IWPPWTAPTTPVDDSALKFEYRRFDWRFVNIITRALVALGQRPDYARIARHVINIDELFIDYARVFLPSHDRQAWDNVVRIAGGITEKNTPRNLQGRDSYVVALEQYLSTTRLHDTILDGLRTAVRYDKTYFDKIVASLLPLLEKLTTRKISQLLAPDYGDLNDPRPVFNWQQAIRQRAIIYVGLDALSDAEIAAAVGNSMFADLVSVAGHIYKHGVMDGLPQTEENPAIKLHCDEFSELMGDEFIPLINKGGGAGVEVTAYTQTLSDIEARIGDRAKADQVVGNFNSRIMMRVRESATAELLTKQLPQVDVLSNSISSGIADSADAQGNIGFSSNTQDRMSSIQVPLLEPASLVQLPKGQAFALLEGGQLWKLRIPLPDAAHDPLMPESITLIARYMEKQYDSTPIWWDRPETVVTAKNDPILGLNDSETTEKQTDDTPDTPPARER

SEQ ID NO: 8658 - protein, 354 aa, Klebsiella pneumoniae
AMRPTMMTYISEEPACLAQILRDYRQKLAPIETFARQHPVRRILLLATGSSLNAALCARYFFEQRFGVLLDIKEPYNFTHYDAIDPHADLVVAISQSGKSASTLEAMRKVQASGKSVFALTSDPQSPIGGASDGVLDINTGIESVGFVTRGFSATVLNLLLIALIIARKQEKASEVEEQHYLAELQRLVAAIPEVIVRTSRFIDRHSETLRSGERFVATGYGALVGVAKEFETKFTETVRVPSSGFELEAYMHGPYLEANARHVMLFIEDTPDARTRALRDYLAPSIGRAFTLTLGDEEDAQTLALNCPCEHHLAPLLLIVPVQMLAWHTAGLKGIDLAKRIFDDFDRVLKSKI

SEQ ID NO: 8659 - protein, 339 aa, Klebsiella pneumoniae
LKRPASPRAYSIIRPTAWPGWPTSWRRTMSSSKPGRLSSAAPSPARSRRARAIPSTSTTATWAPSAAALFEESNMNNAFKEALKAGRPQIGLWLGLCSSYSAELLAGAGFDWLLIDGEHAPNNVPTVLTQLQAIAPYPSQPVVRPSWNDPVQIKQLLDVGAQTLLVPMVQNAEEARLAVRATRYPPAGIRGVGSALARASRWNRVPDYIHQANDAMCVLVQIETREALKNLPQILDVDGVDGVFIGPADLSADMGHGGNPQHPEVQAAIEDAIQQIRQAGKAPGILMANEQLAKRYLELGALFVAVGVDTTLLARGAEALAARFTHTATTTTDNNKSVY

SEQ ID NO: 8660 - protein, 385 aa, Klebsiella pneumoniae
TETLSLPTPAVGGCLHNRRHDTRFHFQSRRKAALVFSGRLSAEQSDKESLMNHPQTILTGDRPTGQLHLGHYVGSLRQRVALQHNHQQFILIADLQGLTDNGSNPQKISHHILEVMADYLAVGIDTRLTTICLQSALPALAELSALYMNIVTVARVERNPTVKNEIAQKGFARSLPVGFLAYPISQAADITAFKAELVPVGDDQLPMIEQTNEIVHKMNSLTGEPVLRHCKALLSEVSRLPGVDGNAKMSKSLGNTLTLSATEEEIHHAVSAMYTDPTHLRVSDPGHVEGNVVFTYLDAFHSDKARVAEMKTHYQRGGLGDRQCKNELETCLQTLLAPIRERRATFIQDKGMLLELLRQGSERAHHLTQQTLHEVKRGLGLPVLF

SEQ ID NO: 8661 - protein, 342 aa, Klebsiella pneumoniae
WPMPGEGTMSAFYQKHFLKLLDFTPAEITALLELAAKLKADKKNGIEVQKLAGKNIALIFEKDSTRTRCSFEVAAYDQGARVTYLGPSGSQIGHKESIKDTARVLGRMYDGIQYRGHGQEVVETLAQYAGVPVWNGLTNEFHPTQLLADLLTMKEHLPGKAFNQMTLVYAGDARNNMGNSMLEAAALTGLDLRLVAPSACWPEAALVETCTALAKQQGGNITLTEDIAAGVKGADFIYTDVWVSMGEAKEKWAERIALLRDYQVNSAMLALTGNPQVKFLHCLPAFHDDQTTLGKQMAADYGLHGGMEVTDEVFESAASVVFDQAENRMHTIKAVMVATLSK

SEQ ID NO: 8662 - protein, 342 aa, Klebsiella pneumoniae
PMMPRSLSQTGPEKRRFTWPKGTPQIIALLLVLLVDSLVAPHFYQVVLQDGRLFGSPIDILNRAAPVALLAIGMTLVIATGGIDLSVGAVMAIAGATAASMTVAGHSLPVVLLAALAAGALAGLWNGILVAVLKIQPFVATLILMVAGRGVAQLITAGQIVTFDSPALAWLGSGSFLLFPTPVIVAAATLLLFWLFTRKTALGMFIEAVGINIRAAKNAGVNTRIVVMLAYVLSGVCAAIAGIIVAADIRGADANNAGLWLELDAILAVVIGGASLMGGRFNLLLSVVGALIIQGMNTGILLSGFPPELNQVVKAVVVLCVLIVQSPRFIGLLKGVRGRDKT

SEQ ID NO: 8663 - protein, 671 aa, Klebsiella pneumoniae
VKPPAEPAGVFKRHDAAKMHRKEEELVEKAKKMAWHLLAASVGLLTLSQLAHADSLDEQRSRYAQIKQAWDNRQMDVVDQLMPTLSTYPLYPYLQYRQITDDLMNQPALVVKNFIDANPTLPPARSLRSRFVNELARRSDWRGLLAFSPDKPTSTEAQCNYYYAKLSVGQSQEAWSGAKELWLTGKNQPGACEPLFSAWRDSGQQDPLAYLERIRLAMKAGNIGLVKSLAQQMPANYQSIASAVVALANDPNSVLTFARTTGATDFTRQMAAVAFASVARQDVENARLMIPSLVQAQQLNEDQTQELRDIVAWRLMGSDVTEEQAIWRDDAIMRSQSTPLVERRVRMALGTGDRHGLNTWLARLPMEAKEKDEWRYWQADLLLERGRDEEAQAILRSLMQQRGFYPMVAAQRLGEEYTFRIDKASGTIDPALASGPEMARVRELMYWNMDNTARTEWANLVTSRTKSQQAQLARYAFDQHWWDLSVQATIAGKLWDQLEERFPLAYNDLFARYVSGKDIPQSYAMAIARQESAWNPKVRSPVGASGLMQIMPGTATHTVSMFSIPGYSGPSQLLDPETNINIGTSYLQYVYQQFGNNRIYASAAYNAGPGRVRSWQGNSAGRIDAVAFVESIPFSETRGYVKNVLSYDAYYRYFMGQQDKILSDAEWRQRY

SEQ ID NO: 8664 - protein, 78 aa, Klebsiella pneumoniae
RWPPWAARWSFMTLSFSFSSPPSSASSSSLRIFPNGCARCKLLAFSPPVTWRVRWGGSSWPTLAIWWGARKCSPSASC

SEQ ID NO: 8665 - protein, 230 aa, Klebsiella pneumoniae
SKTPPRRLFKRNTIMSLPMLQVALDNQTLASAYETTRLIAEEVDIIEVGTILCVGEGVRAVRDLKALYPHKIVLADAKIADAGKILSRMCFEANADWVTVICCADINTAKGALDVAKEFNGDVQIELTGFWTWEQAQAWREAGIQQVVYHRSRDAQAAGVAWSEADISAIKRLSDMGFKVTVTGGLALEDLPLFAGIPVHVFIAGRSIRDAASPVEAARQFKRSIAQLWG

SEQ ID NO: 8666 - protein, 432 aa, Klebsiella pneumoniae
FLTPALRLRIQIMLLSVSGNIIQRHLPAHNFLPQLALPAGIAFCQTLIELAILNHARGQLEGQRHHVHGANMAIKHVVFVGALPTNFGVKVQAAGGESPGFKDLVHHQGIFFHTVRELIGIPAELRIAAVGINGAENAQRDGAGDFMVERVPRQSGVVGFNVHLDLIFQTKLLQETIHRRDIVIVLMLGGLLRFRLDKQRAAKANLMLVLHHHLQEAANLLALLAQIGIQQRFVTFAAAPQHIVFAAELVGGVHGGHYLRGRPGKYLRVGVGRRPGAIARVGKAVGGAPQQFHAGLLLFLRQHLGHDGEIMQILFQRRAFWRDVDIVEAVIRYVELVEKFKRHVRFAFGHFQRIARGLPGTLKRAGAKHIRAIPAEIMPVTGGKTQMICHAFSQHDFIRIIVAKRQRIIGFGSGKANAINLVEIGLHDELRN

SEQ ID NO: 8667 - protein, 652 aa, Klebsiella pneumoniae
KRTPLMIKFSATLLATLIAASVNAATVDLRIMETTDLHSNMMDFDYYKDAATEKFGLVRTASLIEQARAEVKNSVLVDNGDVIQGSPLGDYMAAKGLKEGDVHPVYKAMNTLNYAVGNLGNHEFNYGLDFLHKALAGAKFPYVNANIIDAKTGKPMFTPYLIQDTRVVDSDGQIHTLRIGYIGFVPPQIMTWDKANLNGKVTVNDITETARKYIPEMRAKGADVVVVVAHSGLSADPYQAMAENSVYYLSQVPGVDAIMFGHAHAVFPGKDFANIKGADIAKGTLNGVPAVMPGMWGDHLGVVDLVLNNDSGKWQVTQSKAEARPIYDAVAKKSLAAEDAKLVAVLKADHDATREFVSKPIGKSADNMYSYLALVQDDPTVQVVNMAQKAYVEHYIQGDPDLAKLPVLSAAAPFKVGGRKNDPASFVEVEKGQLTFRNAADLYLYPNTLVVMKVSGKEVKEWLECSAGQFNQIDPASSKPQSLINWDGFRTYNFDVIDGVNYQIDVTQPARYDGECQMIHPQAERIKHLTFNGKPVDPQATFLVATNNYRAYGGKFAGTGESHIAFASPDENRSVLAAWIGAQSKKEGAIHPAADNNWRLAPIHSNTPLDIRFETSPGDKAAAFIKEKAQYPMRQVATDDIGFAIYQLDLSK

SEQ ID NO: 8668 - protein, 312 aa, Klebsiella pneumoniae
IAAPLRRSGRSPTMNKDNVKLAIAPIGWTNDDMPELGSENTFQQIVSEMALAGFTGSEVGSKYPRDPAVLKPMLDIRGIQICNAWFSTFFANGQREKTIDEFVNHMNFLHAMGAKVIGCSEQSGSIQGLDKPILGDAKPCFSEEEWQRVAEGYNTLGRLAAEKGMQVCLHHHMGTGIQTTAEIDKFMSLVDERVFLLFDTGHAWYSEGGEAPMLAILKKYLPRINHVHLKDVRPPVIDQVRRDGLSFLDGVKKGTFTVPGDGVIDFRPVFKLLDDFGYKGWMVVEAEQDPALANPFEYAVKARKYIRETAGI

SEQ ID NO: 8669 - protein, 122 aa, Klebsiella pneumoniae
YGKPPAENAPPDVSEPASELLFQYLLQHLLVQTQVSHQFLQPQIFILQLPQTPQFGHAQTGEFLLPVIKSGFRNAHLSADFPVAGAGFGLFQSKRNLFFGIAGLFHGDVPLCEMEERPETSV

SEQ ID NO: 8670 - protein, 286 aa, Klebsiella pneumoniae
ICRPDKRSAIRQCNATGISMLDKQTRTLIAQRLNQAEKQREQIRAISLDYPSITIEDAYAVQREWVEMKIAEGRVLKGHKIGLTSKAMQASSQISEPDYGALLDDMFFHDGSDIPTDRFIVPRIEVELAFVLAKPLRGPNCTLFDVYNATDYVIPALELIDARCHNIDPETQRPRKVFDTISDNAANAGVILGGRPIKPDELDLRWISALLYRNGVIEETGVAAGVLNHPANGVAWLANKLAPYDVQLEAGQIILGGSFTRPVPARKGDTFHVDYGNMGAISCRFV

SEQ ID NO: 8671 - protein, 957 aa, Klebsiella pneumoniae
PARPEPLVFIKPKYGTENLMSDYKSTLNLPETGFPMRGDLAKREPGMLARWTDDDLYGIIRAAKKGKKTFILHDGPPYANGSIHIGHSVNKILKDIIVKSKGLTGYDSPYVPGWDCHGLPIELKVEQEYGKPGEKFTAAEFRAKCREYAAEQIDGQRKDFIRLGVLGDWSHPYLTMDFKTEANIIRALGKIIGNGHLHKGAKPVHWCVDCRSALAEAEVEYYDKTSPSIDVAFHAVDKAAVLAKFGVADVNGPVSLVIWTTTPWTLPANRAISLSPEFDYALVQVDGQALILAKDLVESVMKRVGATDYTILAAVQGSELELMRFKHPFLDFDVPAILGDHVTLDAGTGAVHTAGGHGPDDYTISQKYGLEIANPVGPDGAYLPGTWPSLDGINVFKANDIIVEMLRERGALLHVEKLQHSYPCCWRHKSPIIFRATPQWFVSMDQKGLRAQSLKEIKGVQWIPDWGQARIESMVANRPDWCISRQRTWGVPMSLFVHKETHELHPRTLELMEEVAKRVEVDGIQAWWDLDSRDILGDDADSYEKVPDTLDVWFDSGSTHSSVVDVRPEFAGHAADMYLEGSDQHRGWFMSSLMISTAMKGKAPYRQVLTHGFTVDGQGRKMSKSIGNTVSPQDVMNKLGADILRLWVASTDYTGEMAVSDEILKRAADSYRRIRNTARFLLANLNGFDPAKDMVKPEEMVVLDRWAVGCAQAAQEDILKAYESYDFHEVVQRLMRFCSIEMGSFYLDIIKDRQYTAKADSVARRSCQTALFHIVEALVRWMAPIMSFTADEIWGYLPGEREKYVFTGEWYEGLFGLADDEAMNDDFWDELLKVRGEVNKVIEQARADKKVGGSLEAAVTLYADADLAAKLNALGDELRFVLLTSGANVADYASASADAQQSELLKGLKVALSKAEGEKCPRCWHYTTDIGKVAEHAEICGRCVSNVAGDGEQRKFA

SEQ ID NO: 8672 - protein, 285 aa, Klebsiella pneumoniae
KKALKPAIKRELVSYLTAQFAMSLRQACRILSLSRTVFRYQPDTQRDEPVIMALTVAAERYPRYGFKKLFQVLRRQGKSWNHKRVHRIYCLLKLNFRRKGKQRLPVRNPVPLVTPEAMNQSWSIDFMHDALVCGRRFRTFNVVDDFNREALAIEIDLNIPAQRVVRVLDRIVANRGYPLKMRMDNGPELVSLTLAQWAEEHGVMLEFIRPGKPTQNAFIERFNRTYRTEILDFYLFRTLNEAREITERWLAEYNGERPHESLNNLTPKEYRLMAETPEISKSAWN

SEQ ID NO: 8673 - protein, 131 aa, Klebsiella pneumoniae
ICFTQLCVHSRSPVHNNVRPATWQDVSNGLPLGLREMELTMKRSFTLSSLLLTAATANTSAQSAEFASADCVTGLNEIGLISVTNLSGSQQDVEHAIARKADEQGASWYRIIQMYEEQQPDSWRVQAILYA

SEQ ID NO: 8674 - protein, 100 aa, Klebsiella pneumoniae
SLLTSNIKQHFISLFYTPITAAIPVQFHASLRWRTFRQANDYLFVNESLDRHNGLRIMPVVLPGGSMANCVRHSVLARLNADAGLPFFFPLLIGFPKPLI

SEQ ID NO: 8675 - protein, 281 aa, Klebsiella pneumoniae
LISTIASAFLLCSSPYARGDIMKVLLIYAHPEPRSLNGALKNFAIRHLQQAGHEVQVSDLYAMRWKAGYDADDSGAPPVGEFWRPTLDSKQAFAQGTQSADIVAEQEKLLWADIVIFQFPLWWFSMPAIMKGWIDRVYAWGFAYGVGEHSDRHWGDRYGEGTFVGKRAMLIVTAGGWAEHYSPRGINGPIDDILFPIQHGMLFYPGFEVLPPLVFYRTDKTDAGQFADQCAALAERLDTLWQTEPIPFRRQNHGDYLIPSLTLRPELAPGQSGLAVHLRSE

SEQ ID NO: 8676 - protein, 107 aa, Klebsiella pneumoniae
SSPTGATSIARRWWRPPATSGRHRAFCSRNRAAKPGYACCRGSGRTSRRAASWRSWSAAARGSSGTAPAPRRPPLPRSARASRRRSAPAFSPSGSIRAPLIPNCVSS

SEQ ID NO: 8677 - protein, 249 aa, Klebsiella pneumoniae
FIELTSQEKSFMTLQERRHDRLAVRLSLIISRLVSGETLFIRKLATEFGVSERTLRRDFRERLMYLDLDYYQGQCSLRSDIHSTRQEIDILTFAHRTGLAGVFPGFDRRLVSSLLDCDERPCLVWHQDRPHPPAGKLCFYRLVRAISGCQRITILTEGERHEAVAPYRLIALDGYWYLVAEHNRQLRVFRLDEIHLVRPSRETFIRSELLHQLSEDKHFISALPHFRFIQQSLNSFSPSESRGQSGQTD

SEQ ID NO: 8678 - protein, 333 aa, Klebsiella pneumoniae
YRYTKVDRDQTNSSLFNDDPVLHATWLYYQEGKSQTEVAAIMGVSRVTVVKYLQTARENGLVHINLDVNVFGSIDAALQIRDKFNLQRVIIVPDGEHAGKRDDTKLMRTRLSRAGGMYLNQVIENGDVLGVAWGRTIHQMSKTMTPKSCKNVTVIQMLGSMPSQPDLTIIESSSQIAYKLSGRVASLHVPAVVSSARLAMELQAEPIIRSNFDVLTRCTKAFFVVGNALDENPLIRVGVLNKKEMQTYRDLGAVGVICGRFYDKEGMPVVADVDQRILGISLAQLRQIERKIFLAGGERGYDATLGALLGGYVTDLIVDEGTAEFLLACELPH

SEQ ID NO: 8679 - protein, 349 aa, Klebsiella pneumoniae
CMEFSVKSGSPEKQRSACIVVGVFEPRRLSPIAEQLDKISDGYISALLRRGELEGKPGQTLLLHHVPNILSERILLIGCGKERELDERQYKQVIQKTINTLNDTGSMEAVCFLTELHVKGRNNYWKVRQAVETAKETLYSFDQLKTNKSEPRRPLRKMVFNVPTRRELTSGERAIQHGLAIAAGIKAAKDLGNMPPNICNAAYLASQARQLADTYSKNVITRVIGEQQMRELGMNAYLAVGNGSQNESLMSVIEYKGNPAEDARPIVLVGKGLTFDSGGISIKPAERMDEMKYDMCGAAAVYGVMRMVAELQLPLNVIGVLAGCENMPGGRAYRSGDVLTTMSGQTVKC

SEQ ID NO: 8680 - protein, 474 aa, Klebsiella pneumoniae
GVDTVIAELLINVLQIAGADIDVGFRIQQLRRAAVAGNAEHTDGMRRGARHNLHQSAGADRRAHFRVPGALLTGNRHRVALRNIFAANIAGKQVVIGQRETFFQLIPQLTGDRRLHAQIPPVLIEGIARQLRLLGFGATSDQVGPFGARGVIHIPVHQLTYPRHLRPGGQRRIDGARGFIDAEGILLAKTLRGDHRVEASLLHQRAKDRLRLLIPAALQQQIRLPVAPFVFLFRLHRQARQPGVEAMAIARPQRHPYPPLHQRRGLRTHDCVIAPDGLLFGYIATHQAPGDNIAQFLGLILIELLSLYQRRDHQAGIFHVLAGDAGEGDGGHLTGKVRRPGGAGEGEDAVWIVSQGDHGAGDALVVGGHLLGQRFHQPDIAGLHRQADPFEIGQRILLTGVAPGAEQRFTGAGLILARQPQLFRPAPGLLRLPHAQLGVVIVALRLGAGRLIRAKRQQAAPVAAPGQFIHEART

SEQ ID NO: 8681 - protein, 210 aa, Klebsiella pneumoniae
MKGTIFAVALNHRSQLDAWREAFQQAPYKTPPKTAVWFIKPRNTVIGDGEAIPYPQGETVQSGATVALIVGKTARKVAAEEAANYIAGYALANDVSLPEESFYRPAIKAKCRDGFCPIGTLSAVRNVDDLTIITEINGREADSWHTGDLQRNAAQLLSALSEFATLNPGDAILIGTPHSRVTLRPGDRVRILADGFPALENPVVAEGELA

SEQ ID NO: 8682 - protein, 526 aa, Klebsiella pneumoniae
APITSALPSIPAAILPVEPSCAFTRPRRVRFGKFSGPLRPWSASPLAQASAMWPSVSAPTSPKRSASSVAPIPKESSTMINARFILFSIHLALQKSDQISISLFSDTAIDCRCNFRGFIVQFNGRFDRFRGLLPAVLVFGMDHRQRTLSVDAVTQTRHLGKANAIVNGVRCLTAAAAHRNHCHAQRASIHRADKTFGISIDCFAQHRRRQIISIILDKVARPFLRRDHAAKDFRRFTVIQHRLQLRARLGIVRRQLAGDQHFHTQRHCHVEQARVAVFAGQELHRFANFNGVAGAGGQYLIHIGQQRGGAHAGAVGDTHDRFGQRGREFISRHKGAAADFDVHHQRIQPFRQLLRQNRGGNQRDGVHRRGNIAGGIETFVGRGKGAGLPDNCHANIFNNLAEAVVVREDIEARDRFQFVQRTAGMAEAAAGDHRYVTTAGGHHRPQHQRSDIPDAAGRVFIDDRTVKVEAFPVQNGTGIPHRHGQRNALRHRHIVEEDGHRQRGDLPFRDSIVADAVDEKADLFIA

SEQ ID NO: 8683 - protein, 401 aa, Klebsiella pneumoniae
RPATTTAARRENSPGRIALAFAFHHFDLHHADPQLTRGVAEDIALVSGLRVRRGDDQRVAARWVVKMQRRGSHVIIQSEHLLTFSNSHRNRLISVWAISFGGDHQIKFLRQRLFIFNLHVAAQLSIGPPPPRLGTRNTAELFNLFRGASDVKHEAVGLIANIVVDNFQRIDVALIALHIDKGVPEGGLAVPLRLINVLDLLLTPQLSLRDAPVGGERQLRRPQLAHFIAAIDPHEIIPWREIGQLEAQRRRVFTLRQRFYALVRYPQQQRQAEMAAGESDHIFLRVDGEILHFFGEIPQADHVRLPCQDFLFHIHENTGERLAGEAATPEADIVIAAENIQHRRAVIHGVAFHRQGLLLRFIAAQDEEQIAAIVLVEIIPGAVLHGQVIGRDHDDRVFEIG

SEQ ID NO: 8684 - protein, 429 aa, Klebsiella pneumoniae
QRATLTQHLNDDVIGFENINAVQGRPGARQVSAVRANRVGDFQTVFLADGVVVRTVAASGMHRTGTGIQRHVVAKDRRHVEIEERMLKAHQLKLRTLYRRQNSVVRRANALHYALNQVFRQDQRLAVNLHQRIVELRRQRDSAVGRQGPRRGGPDNQRHRTVDVGYAEFRQYRGFVYRVERDIDRRRGFVVILHFRFRQRGTAVYAPVHRFGAFMQVAITDDFAQRADDVGFGFEVHGQVRMRPVAQHAETDKVFTLAIDLLGGIFAALSAEFGSGKFLTRLAVFLLHFQLDRQTVAVPARNVRRVIARQSFGLNDNVFQNLVYRVTNMNAAIRIRRAIMQNEGFFAFFGCTNDAVQVIIGPTRQHSRFAFGEVATHREPCFRQIQGRFIVTHQILGSVFRFDKHQWLRPGWSAQIIRGPLTHHVRFAP

SEQ ID NO: 8685 - protein, 358 aa, Klebsiella pneumoniae
AGCTMSINTLAHVFTPHGNIVYTANDFRQTVRIAVAGTIALSISTFYDVQYGVFFVVYPLMLMSLVPMFNLHVARQFIFSAAVNCVEMVLIVGYLSQWPVIMTLVVFALYVMRFRFMSQGPLFLLGSMGVVCQSTMLNFMSYPTSNWHTLMFSNMEACVMAVALSALLHYLIPDIEPRKPPPRIEKDAARIRHESLLSGTVATIIFVVFQICDLSDSLSALMAGILILFPMHYRGAVISSIWRVVGVVLACLYILVVQLIIYDFSNHMILMMPLIGLGLAFSARLHVMEKVGAGVGFASITTIGIMFGQNLHPYQDLVFSDLYRITSVTVSLVVTLTLVFLMHRLLNCFAATRFVVSD

SEQ ID NO: 8686 - protein, 457 aa, Klebsiella pneumoniae
RLCTLSICAPQPACQPLSASAASRAVIASRASASMAMPSSFQASKLLTLIFRKRTSGCWKIHFEAVVKSLKRVPTPITRSASVAQQLLAQAACVADAAEVQGMRRDHGPIPGVVFGEGHPVALGKTGQRFARAGVFHPAAADDQRSTAAFDGRHGVRQLRVAGRAAVETVHAARKEGFRVIPGFALHVLRQAQRYRAGFRRVGQDAHGVDAGAHQLFRAGNAVPVFADCAESVIGADAEIVALFNLLEHRIRLAGGEDIARQQQQWDAVGAGGAGGGDHVGRSRTDGGGAGDNLPAQGLAGKTGSRVGHPLLVAPLIDAHIAAVLLQRLPQPQDVAMAENRENAFHELQLYAIHFQVLVIEELHQRLRRCQSLFAHDAQSLLFSICVWRRADAAGAVVHVTGIPVDYRQTFFSLNTNTEEIFHFARRIKLSTHFIRFTYIPDTFSGPFLPHQTAISP

SEQ ID NO: 8687 - protein, 145 aa, Klebsiella pneumoniae
SMSTSPSVIRRFVEYYAGLDAQPPAALAALYHPDATLSDPFGQHQGLFAIQRYFTHLLANVEQCRFTIDTPLCDGQRFAVTWTMHWSHPRIAGGETLALPGCSVVDIAGEQVLHQRDYYDAGEMIYEHLPLLGWAVRGVKRRVRS

SEQ ID NO: 8688 - protein, 64 aa, Klebsiella pneumoniae
QKRFIDHSFTKLSFKSPDLPHLKAKKTLNAKTSKNAIIRYFNIRHLCLRMGTFYGSSRDYSRSP

SEQ ID NO: 8689 - protein, 469 aa, Klebsiella pneumoniae
IKLTYIEKLMTMIKKLPLTMAVIAAFFPLTSVMAQEFTQEQIDAIVAKAVDKALADRQAKIDAAADKKVDVITNPQTTAASPDMAIPFGLKFSGYARYGAHFQTGDQKYVGVDGSYNGASAIGRLGNESNGGEFQISKAFKSAQGAIWDLNVMFDHWSDEVNLKKAYVGVTNVLESNPNAYIWAGRDFHQRPQQGINDYFWMNHDGQGAGVKNFDIGGVQFDVAAVSQVKSCSPEVMADETNPSRITCTGSSDTGDNGHYALTTKTHNIKAGPIDVEVYANYGFDSKAVDSDARLEAWQGGLVLSHTNDSGVNKVILRYSDNSDNSVYNKTDALTTVYASFEGSHKFTQQAQIEYLLAFHDYDNGKDNTDNRKNYGAIVRPMYFWNDVHSTWLEAGYQRVDYDQGGDNHGWKLTLSQNIAIGMGPEFRPMLRFYVTGGQVDNEHTAKVNGTQDQQLDSLNVGGMFEAWF

SEQ ID NO: 8690 - protein, 140 aa, Klebsiella pneumoniae
FCVTLLSSSGDNMSKTIATENAPAAIGPYVQGVDLGSMIITSGQIPVDPKTGSVPEDVSAQARQSLNNVKAIVEAAGLTVGDIVKTTVFVKDLNDFATVNATYEAFFTEHNATFPARSCVEVARLPKDVKIEIEAIAVRR

SEQ ID NO: 8691 - protein, 160 aa, Klebsiella pneumoniae
FDATRRTLPGLDIHRTFQRWIGAFGNCETGAAWLSSARVVKCWVKSRNERNPYPLLPAVRPGTQRRLPVINWRKVGMTSSHHGPYDQGYTRATMAYTKRSDLARASGPHKVCRNPDWSLQLDSMKSESLVIVDQNATVNTFPGLVHTARHTMGVGCKRSR

SEQ ID NO: 8692 - protein, 66 aa, Klebsiella pneumoniae
  UNSURE (59): Identity of amino acid at the above locations are unknown.
SIKTIIFLATSLVILVLHCSQKSPFITVSYLAEACYAHFPCTPNNEVTKARKDEEMCTXQQKKKRP

SEQ ID NO: 8693 - protein, 540 aa, Klebsiella pneumoniae
TTKTKHKFNIAFRLILKRSPMKPEDFRADAKRPLTGEEYLKSLQDGREIYIYGERVKDVTTHPAFRNAAASVAQLYDALHKPEMQDSLCWGTDTGSGGYTHKFFRVAKSADDLRQQRDAIAEWSRLSYGWMGRTPDYKAAFGCALGANPAFYGQFEQNARNWYTRIQETGLYFNHAIVNPPIDRHKPADEVKDVYIKLEKETDAGIIVSGAKVVATNSALTHYNMIGFGSAQVMGENPDFALMFVAPMDAEGVKLISRASYEMVAGATGSPYDYPLSSRFDENDAILVMDKVLIPWENVLIYRDFDRCRRWTMEGGFARMYPLQACVRLAVKLDFITALLKRSLECTGTLEFRGVQADLGEVVAWRNMFWALSDSMCSEATPWVNGAWLPDHAALQTYRVMAPMAYAKIKNIIERNVTSGLIYLPSSARDLNNPQIDQYLAKYVRGSNGMDHVERIKILKLMWDAIGSEFGGRHELYEINYSGSQDEIRLQCLRQAQSSGNMDKMMAMVDRCLSEYDQNGWTVPHLHNNADINMLDKLLK

SEQ ID NO: 8694 - protein, 468 aa, Klebsiella pneumoniae
IVETSATMRSIQLLTLSVIFALTGCLSLAPDYQRPVAPVPQQFSLSQNKLVTAKVGYQETGWRTFFVDPQVKSLISTALTNNRDLRMATLKVQEARAQYRVTDADRYPQLNGDGSTTYGGKLKGDTTTSSDYAAGLNLSYDLDFFGRLKNLSEADRQNFFASEEARRAVHILLIANVSQSYFNQRLAAAQLQVANDTLQNYQQSYAFVEKQLLTGSTTVLALEQARGMIESTRADIAKRQGQLAQANNALQLLLGSYQHLPDDSASSAVDLQGVTLPPSLSSAILLQRPDILEAEHSLQAANANIGTARAAFFPSITLTSSLSGSSSELSSLFNAGSAMWNFIPKIELPIFNAGRNQASLDLAEIRQQQQVVNYEQKIQSAFKEVADALALRQSLADQIAAQERYLASLNITLQRATALYRHGAVSYIEVLSAQRDIFTTRQTLLELNYSRQANEITLFTALGGGWME

SEQ ID NO: 8695 - protein, 424 aa, Klebsiella pneumoniae
TRRTVMTDSIPSGYKPLTCDTLPGYLSSRLTPSCEPGGLPDEWKVSEVGDGNLNMVFIVEGTHKIIIVKQALPWLRARGEGWPLSLSRARFEYNVLCQEAKYAGHTLIPQVYFYDPEMALFAMEYLTPHVILRKELINGKKFPKLAEDIGTFLAQTLFNTSDIGMPADQKKALTAEFALNYELCKITEDLIFTEPYYHAERNNWTSPELDDAVHKAWADVEMIQVAMRYKYKFMTEAQALLHGDLHSGSIMVTDTDTKVIDPEFGFMGPMAFDIGNYIGNLLLAFFSRPGWDANEQRRADYQEWLLQQIVETWFVFTREFRLLWDNKTQGDAWPTEMYQQNRAALEDAQAQFFATLLEDSLVNAGMEMNRRIIGFAGVAELKLIENTELRAECERRALTMARDLIVNARQFKNMDSVIQSAKVK

SEQ ID NO: 8696 - protein, 641 aa, Klebsiella pneumoniae
LQGTDMRFPNQRLAQLFTLLRNETLPQDELAQRLSVSTRTVRADITALNTLLAQYGAQFILNRGSGYQLKIDNPTSFQALEETAPKAQHVPRTAQDRITFLLVRFLTSAFSIKLEDLADEWFVSRATLQNDMVEVRERFQRYQLTLETRPRHGMKLFGSEVSIRACLTDLLWELTQQGDIAPPIGAEAFAEEVPALLEPVLQETLTRHHIRLTDAGERFVCLYGAVVVRRVSEGYPLADFSAEDVAQNVRDAARELTGELQRLAGKPLSPAEEEWLCVHIAARQVQDVDPETISADDDEALVNYILRYINSQYNYNLLDDAQLHADLLTHIKTMITRVRYQIMIPNPLLDNIKQHYPMAWDMTLAAVSSWGKYTPYTISENEIGFLVLHIGVGLERHYNIGYQRQPQVLLVCDTSNAMVRMIEAIMQRKYPQLEIAATISQREYEQRDAIEADFVISTVRIGEKDKPVVTIAPFPTDYQLDQIGKLVLVDRTRPWMLNKYFDAAHFRVVDKPMDQQTLFAELCQQLLEEGFVDAEFHASVVEREAIVSTMLGDGIALPHSLGLLAKKTVVYTVIAPQGIAWGDETAHLIFLLAISKREYEEAMAIYDIFVTFLRERAMSRLAATRSFDEFKTVAMECVSRF

SEQ ID NO: 8697 - protein, 408 aa, Klebsiella pneumoniae
TLMTDPVFALEPDVPRNVRLARWLLFRLLSGLREGSLTVREGAQTFQFGDPAAALRAEARVCAPEVYWRLLTGGSLAAAEAWMDGDWESHQLTALLQILARNGEVLGRLERGFRLLGKPVARLRHWTRRNTRAQARENIAAHYDLGNEFYAHFLDDDLLYSSALFTDDEQDLTQAQRAKMARLCDQLALNPGDHLLEIGTGWGALAEYAARHYGCRVTTTTLSREQHRWATERMARAGLQDRVEVLLCDYRDLRGEYDKLVSVEMIEAVGQRYLPAFFRTCQARLRPGGKMALQAITIQDQRYRDYSKSVDFIQRYIFPGGFLPSITAMSELMTRHTDFVVRNLFDMGPDYARTLAHWRQRFTHAWQDIEKLGFDERFRRMWLYYFGYCEAGFNARTISVVQLTAERV

SEQ ID NO: 8698 - protein, 268 aa, Klebsiella pneumoniae
SGMTPAEYEMTDLKASSLRALKLMDLTTLNDDDTNEKVIALCHQAKTPVGNTAAVCIYPRFIPIARKTLNEQGTPDIRIATVTNFPHGNDDIDIALAETRAAIAYGADEVDVVFPYRALIAGNEQVGFELVKACKDACAAANVLLKVIIETGELKEEALIRKASEISIKAGADFIKTSTGKVPVNATPESARIMMEVIRDMGVEKTVGFKPAGGVRSAEDAQQFLAIADELFGADWADSRHYRFGASSLLASLLKALGHGDGKSASSY

SEQ ID NO: 8699 - protein, 91 aa, Klebsiella pneumoniae
VLMTEMVSASVSPFLPSEVLALSEKPTTLAPRRCIEVSKERRVRVEASKKQLAITLCFSSSGCGLAFSFAAVASTSSRSSRLRSFMEMICF

SEQ ID NO: 8700 - protein, 96 aa, Klebsiella pneumoniae
VWMTYELEFDPRAWREWQKPGETVKKQFKNKLQQIVQNLRIESARLSDLPDCYKIKLKASGYRLVYQVRDSVVVVYVIAIGKREKAAVYHQANKRL

SEQ ID NO: 8701 - protein, 70 aa, Klebsiella pneumoniae
RQSTRLLTLSPSSPLKVLYNPKAFFTHAAWLHQACAHCAIFPTAASRRSLDRVSVPVWLVILSDQLGIVA

SEQ ID NO: 8702 - protein, 358 aa, Klebsiella pneumoniae
NLTTNNDSSDMTAQTWRAHYAQKYQYSLRLFLLLNFISSSLSLVTPLFTVVRFTLPCALIVVCSGLLLLWHWKWPQSKINIPTISLLFGMLWAWHVVTKAMLLTPPHFNYLVIALLSILFIGTIAFSNNITAFTLHSLPTFLACLIMAEGEQWLRMTYCFMLPIAGITLQNIIQKRSDAFTQGLMDKLMHERNTLNDLSMLDPLTGLYNRRGLQNRLDTLLALDGDNHYVLLLDIDHFKAYNDHYGHMMGDQALIRVSAAIRNAVRSRDIVARFGGEEFMVLLTNSSEETAWKTAERIRQRVYDLKIPHMFNESVATNVTISIGLTPLINDNIEQALARADGALYEAKNKGRNIILAS

SEQ ID NO: 8703 - protein, 260 aa, Klebsiella pneumoniae
TTQTGTTGRNHMVDQVKVAAVEQEPTEQSLRRNLTNRHIQLIAIGGAIGTGLFMGSGKTISLAGPSIIFVYMIIGFMLFFVMRAMGELLLSNLEYKSFSDFAADLLGPWAGYFTGWTYWFCWVVTGMADVVAITAYAQFWFPGLSDWVASLAVILLLLGLNLATVKMFGEMEFWFAMIKIVAIVALIVVGLVMVMMHFKSPTGVEASFAHLWNDGGWFPKGLSGFFAGFQIAVFAFVGIELVGTTAAETKDPGKVPAASD

SEQ ID NO: 8704 - protein, 81 aa, Klebsiella pneumoniae
ILETSHMARYFRRRKFCRFTAEGVQEIDYKDIATLKNYITESGKIVPSRITGTRAKYQRQLARAIKRARYLSLLPYTDRHQ

SEQ ID NO: 8705 - protein, 71 aa, Klebsiella pneumoniae
FAGTGTTAVQCSGYSFTMYFVTIKATADTIMPWMFAAGYFMAFTCHIFIEKLMVGASFKNPATASGLITPK

SEQ ID NO: 8706 - protein, 395 aa, Klebsiella pneumoniae
VIFAANANLPISDSPFRDRMVAHRDADVFHFGEHFKAVLAAFAAGAGGLHAAERLTQVAHVLGVDEHHPGFNTARQTQHFADVLGPDIRRQAVFHIVRQAQPFRFVFERQQAGDRAKNLFLGDAHTVVDIRQHRRAQEVAGFQMRRQVGRFIRAAGQQGGPLFDAEANVAGHFLPVLLANQRADLGVRIGRIAYAQAIGALGEAFNELGVDTLLNKDARAGGAAFAVDREDGEQRGVKRALDIGIFKNQHRRFSAQLHGVLFQTGVFHDVAAGGGAAGEGDGAHIMMAHQRVAGGGAVALHHIEYASRDPGFQRQLAQTIGGQRRQLGHFQHRGIPQRQARRHLPGGGHKRHVPRRHQRADANRLHEGVVQHLVVDRIGLAVHLLAYFGEKFEIV

SEQ ID NO: 8707 - protein, 193 aa, Klebsiella pneumoniae
WRFAMVKIGFIVEGDTESIIVNSPAFIAFLRTNNFELVTPVIDAKGGGNLLPKYVDNFVARLRNVGAERVCILTDLEDAASVADVRARIAHQDVDISFIAVKAVEAWFLADSEAMKKWLKVDTFNEELPEATTEMPWDRLKEISRELGKQGPGSSKTAFAKRMVTHHGFDIQSSASHPACPSAHELVDWFENQ

SEQ ID NO: 8708 - protein, 251 aa, Klebsiella pneumoniae
YFIAIRRRSSKIEYPHKARVKEPAVKILIVEDEKKTGEYLTKGLTEAGFVVDLADNGLNGYHLAMTSDYDLLILDIMLPDVNGWDIVRMLRAAGKGMPILLLTALGTIEHRVKGLELGADDYLVKPFAFAELLARVRTLLRRGAAVIVESQFQAADLSVDLVSRKVTRGATRITLTSKEFTLLEFFLRHQGEVLPRSLIASQVWDMNFDSDTNAIDVAVKRLRAKIDNDFEPKLIQTVRGVGYMLEVPDGR

SEQ ID NO: 8709 - protein, 822 aa, Klebsiella pneumoniae
RHSAGDDNGGTDMSQDPFQEREAEKYANPIPSREFILEHLTKREKPASRDELAIELNIEGEEQTEALRRRLRAMERDGQLVFTRRQCYALPERLDLLKGTVIGHRDGYGFLRVEGRKDDLYLSSEQMKTCIHGDQVLAQPLGADRKGRREARIVRVLVPKTSQIVGRYFTDAGVGFVVPDDSRLSFDILIPPEEIMGARMGYVVVVELTQRPTRRTKAVGKIVEVLGDNMGTGMAVDMALRTHEIPYVWPPAVEKQVSGLKEQVPEEAKAGRVDLRSLPLVTIDGEDARDFDDAVYCEKKRGGGWRLWVAIADVSYYVRPGTPLDAEARSRGTSVYFPSQVVPMLPEVLSNGLCSLNPQVDRLCMVCEMTISSKGRLTGYKFYEAVMSSHARLTYTKVWHMLQGDQELREHYAPLVKHIEELHNLYKVLESAREERGGISFESEEAKFIFNAERRIERIEQTQRNDAHKLIEECMILANISAARFVEKAQEPALFRIHDKPTTEAITSFRTVLAELGLELPGGNKPEPRDYAELLTSIADRPDAEMLQTMLLRSMKQAVYDPENRGHFGLALQSYAHFTSPIRRYPDLSLHRAIKYLLAKEQGHKGNSTETGGWHYSMEEMLQLGQHCSMTERRADEATREVSDWLKCDFMQDQVGNIFSGVIASVTGFGFFVRLNDLFIDGLVHVSSLDNDYYRFDQVGQRLIGESGGQTYRLGDRVEVRVEAVNMDERKIDFTLISSERAPRNVGKTAREKAKKSTSGKPGGRRRQVGKQVNFEPDSAFRKEKETARPKKEKKAKKPSAKTQKIAAATKAKRAAKKKIAE

SEQ ID NO: 8710 - protein, 303 aa, Klebsiella pneumoniae
KTSASRWATIRSRNGESDMGKLALAAKITHVPSMYLSELPGKNHGCRQGAIDGHKEIGKRCREMGVDTIIVFDTHWLVNSAYHINCADHFQGVYTSNELPHFIRDMTYDYDGNPELGQLIADEAVKLGVRAKAHNIPSLKLEYGTLVPMRYMNSDKHFKVVSISAFCTVHDFADSRRLGEAILKAIEKYDGTVAVLASGSLSHRFIDDQRAEEGMNSYTREFDHQMDERVVKLWREGKFKEFCTMLPEYADYCYGEGNMHDTVMLLGLLGWDKYDGKVEFITELFASSGTGQVNAVFPLPAQA

SEQ ID NO: 8711 - protein, 86 aa, Klebsiella pneumoniae
IHHAGRDAREGGNDTFQLGLTMNSTIWLALALVLVLEGLGPLLYPRAWRKMVASLSQLPDNLLRRFGGGLVVAGIVIYYMLRKSIG

SEQ ID NO: 8712 - protein, 169 aa, Klebsiella pneumoniae
DADAVARALAPRPGASMAASVHCEFTGGTDMLSGLNHLTLAVSQLAPSVAFYQQLLGMTLHARWDSGAYLSCGDLWLCLSLDPQRRVTPPEESDYTHYAFSISEADFASFAARLEAAGVAIWKLNRSEGASHYFLDPDGHKLELHVGSLAQRLAACREQPYKGMVFFDQ

SEQ ID NO: 8713 - protein, 392 aa, Klebsiella pneumoniae
ADGAGGGGAGRHQPDWRARNSHRYAAGGDFTGGDAERPEPARGLLLLADPDHWGDHRRQHQRNGMEPASEPELVMKKSWRNNVEFYLIGLLLLMVIAFSIAMPNIFWSVSNFQSIASQMPVLGILALAMAMTMLCGGINLSIIATANACSLVMAWVATSYPPGGATALATLLAGGGVAMIIGLCNGILIAGIRVSPILATLGMMTLLKGINILITGGSAIANYPQWVLWLNHAQWFGIPLPMWLFAVVAAGLWVLLEKSPLGRAIMLIGSNERATHYSGINTRRVLMWVYVISALLCAVAAFLMMSKLNSAKASYGESYLLVSILAAVLGGVNPDGGSGRIVGMVLALFLLQIIESGFNILGISPYLTMALWGVLLLCFIQARGMLGLERAG

SEQ ID NO: 8714 - protein, 119 aa, Klebsiella pneumoniae
RRFAITDGHTFHRHAAIFRNVLKQQAYRLRWCHIEFLQHGISLFFEFIVQSNIERGHYASGKGNFVMQYSITFELHSNLENASQNRLTHSIATVLNSSKLRVAARRLMARSRRKVTKIS

SEQ ID NO: 8715 - protein, 358 aa, Klebsiella pneumoniae
QPFAEWLLSPLSTTIDYNYHKELFMFIVESYAVAIIMCFITMICWGSWANTTKLVSNKKWEFPLFYWDYSIGLLLCSLLFAFTLGSMGEAGRSFIPDIQQASSSSLMSAILAGIIFNISNILLVASINLAGMAVAFPVGVGLALALGVITTYIGNPQGDPLILFLGVACVVIAIIFTAIAYGRVTLEADKSRRNKGLITAILAGIIMGWFFRFLADSMSDNFSQPASGLMTPYSALVLFAVGLFLSNFVLNTLVMKKPISGEPVNGKMYFSGSLRDHVCGWLGGMIWCVGLAFSLIASGQAGYAISYGLGQGATMIAVIWGVFIWREFASAPVGTNKLLLTMFISYIVGIVLIIAANQ

SEQ ID NO: 8716 - protein, 193 aa, Klebsiella pneumoniae
NILACAFPCRDVINIIIRLFWVMSHCMNTSVPAATLLRRITAADNAAIARVIRQVSAEYGLTADKGYTVADPNLDELYELYSQPGSAYWVVEQEGEVVGGGGVAPLACSEPDICELQKMYFMTSARGQGLAKKLALLALDYAREQGFKRCYLETTAFLTEAIGLYEHLGFEHIDGPLGCTGHVDCEVRMLKTL

SEQ ID NO: 8717 - protein, 89 aa, Klebsiella pneumoniae
RMPALKKQRIDLRLTDDDKSIIEEAAAISNQTITQFVVASASERAAEVIEQHRRMVLNEQSWSLVMEAITQPPAPNDRLKRAAKRLQTR

SEQ ID NO: 8718 - protein, 156 aa, Klebsiella pneumoniae
CWPAKWSHSSATCLMKRPGCSPSTSKSRKITCKEQNMEQITVVIGDRLGKGQKVAAGAEKAGARAVVVPGVAADMKLGDIMKAENATFGISFCGSGGAGAITAQTKYGYKAKYGMRSIDEGVTAINEGCNVLGFGFMDKEELGERLVEAWKKKYGA

SEQ ID NO: 8719 - protein, 62 aa, Klebsiella pneumoniae
AIAASRACNKAMVNESCIVSPQQPHQKLINNLIISVNPAMYNRFLHLKSTSLFLKNIQSIDL

SEQ ID NO: 8720 - protein, 359 aa, Klebsiella pneumoniae
KGYAAVIKRNLPLMITLAVFVLGYLYCLTQFPGFASTRVICNILTDNAFLGIIAVGMTFVILSGGIDLSVGSVIAFTGVFLAKAIGFWGISPLVAFPLVLVMGCAFGAFMGLLIDALKIPAFIITLAGMFFLRGVSYLVSEESIPINHPVYDTLSGLAWTIPGGGRLSAMGLLMLLVVVAGIFVAHRTRFGNQVYAIGGNATSANLMGISTRSATIRIYMLSTGLATLAGIVFSIYTQAGYALAGVGVELDAIASVVIGGTLLSGGVGTVLGTLFRGGDPGADSDLHQLRRYPQLMVDENRHRHFAVYLYRAAAWADRAVGKSAECGGDAGERGGESLRNAPPAGAGGAGRALRRPGTL

SEQ ID NO: 8721 - protein, 106 aa, Klebsiella pneumoniae
RGSAMPRIVLCCAAGMSTSMLVNKMKAEAQQRALALEIYAVAVAEFERELPHADVILLGPQVKYEAGRLTALAAPQGKAVAVIDMADYGMMRGAAVLDKALALLEH

SEQ ID NO: 8722 - protein, 168 aa, Klebsiella pneumoniae
VKGARLNARPSAHSVLFETADGGGVVYWQKLLLCCSAGGLQAVADTMNQAGGDVTNIIEQAPLPALAALRRRHKPRLPAGGIFENAATPESLLCRCEDVRCGDVAAADDWLQAKLTQRPLAVWLAAAAAERAAVPRPRGNAYCPRQAERRAVTATLLHHRARQGRQAQ

SEQ ID NO: 8723 - protein, 343 aa, Klebsiella pneumoniae
RLPASGGITMRKSVIAIIVIVLVVLYMSVFVVKEGERGITLRFGKVLRDDENKPLVYAPGLHFKIPFIESVKMLDARIQTMDNQADRFVTKEKKDLIVDSYIKWRISDFSRYYLATGGGDVSQAEVLLKRKFSDRLRSEIGRLDVKDIVTDSRGRLTLEVRDALNSGSAGTEDEVSTPAADDAIAKAAERVEAETNGKVQVINPNSMAALGIEVVDVRIKQINLPAEVSEAIYNRMRAEREAVARRHRSQGQEEAEKLRATADYEVTKTLAEAERQGRILRGEGDAESAKLFADAFSQDPGFYSFIRSLRAYEKSFQSNQDVMVLSPDSDFFRYMRSPDSARK

SEQ ID NO: 8724 - protein, 1208 aa, Klebsiella pneumoniae
KTTAMNIEQIFEKPLKRNINGVVKAEQTDDESAWIELDEYVITRELDGHLRQFFEVYAPATGPGRLQLADKMGVWVSGFFGSGKSHFIKILSYLLANREVSHNGVTRNALSFFEEKIDDALLLADIRKSVQHPTDVVLFNIDSRANVEDGVDAILKVFLKVFNELAGYCGDFPHIAHLERELDKRGQFDTFKAAFADITGSRWEDERDVYLMINDQMAQALSVATGQSEESSRQWIEQLDKNFPLDIKNFCTWVKEWLDSKGNRNILFMVDEVGQFIGKDGQMMLKLQTITEDLGVICGGRAWVIVTSQADINAAIGGMSSGDGRDFSKIQGRFSTRLQLSSSNTSEVIQKRLLVKTDAAIPALEAVWQEKGDILRNQLAFDTTTTATLRAYTNSREFVDNYPFVPWHYQILQKVFESIRTKGAAGKQLAMGERSLLDAFQSAAVQISADGLDSLVPFWRFYSSIESFLEPAVSRTIIQACQSPSLTEFDGKLLKTLFLIRYVDVLKSTLDNLVTLSIERIDTDKVELRRQIEASLNRLQAEMLISRIDDKFVFLTNEEKEIENEIRNIDVEFTTINKQLSTIIFEEILKNKRYRYPANKQDFDISRFCNGHPLDGANLNDLVVKVLTPLDSNYESYKGAHSNSLLMTDSKDCILICLPDEARTWQDLTMYAQTKAFLSKQSGQRPEQATLLAEKGRENGMREKTLKAQIEGLLAQADVWALGERLDKKSSSPLAIVDAACGYVIENSFSKLKLLRLSTGDVNRETHALLTVENDTQLDLGDMEESNPEAMREVDNWISMSIETHKPVYLRDILTTFGRRPFGWPEDEVKLLVARLARSGKYSFTLQGSEIALKQAWDAFNNSRRYSDLRLHKVRRHDEAQLTKAAQLMADIAGEPFNEREEQPLVSHIRELFGRWKSELTVFKTRAESGQNPGRKEIEEGLVLLNGILNEKEEYAVIEKITAAADDLKDFSEDWDDLVSFYKNQYATWQRLSIALNGSFKANRNALDKDETAQKALQELEAIYSKARPYGELHRIIPLIETVETINQRLVEEYRSHALQQIDNHINELKQSMQEMHVPADLQHSLLHPMQQSRKKVEQNGLIPQIMEEQAEVRALQFKANERLNGWVEEQRKKVPEPKTVPQPGIIDPVAKPEPKLKKTIYVNTRKTMERAAGVTTLDNAEQVDKALEQLRKTLMDAINAGERVQLQ

SEQ ID NO: 8725 - protein, 304 aa, Klebsiella pneumoniae
RPAAGSGADHHLPARHRSRGAGGGHPRPVAGTGHSAAGTAQRSLATHAAGDLAGRRAGQPAGVRGQRRRGAVLVPRQRRADRLYPARPAPVGGVQHPLSRHLARSAHHLSRTASAVDRRYTMKRILTLGLALLMLILAGCSTEVTEYRQQQPALDIFHYFQGRTEAWGMVQDRSGKQLRRFHVEIDGDVVGDTLTLHERFVYDDGEKQQRVWRIRRTGDNRYQGTAGDIEGVASGQAAGNAFHWRYSMNVEASGSRWLLHFDDWMFLQDGSHLFNKTEMKKFGITVATVTLFFTRTTAEERTAP

SEQ ID NO: 8726 - protein, 312 aa, Klebsiella pneumoniae
CRAAAERLERVRHPQSRRRDPYRHAPLSRHAAPRRPGTYSRRWFPGARKPGCRRRRAGMKQARIEWQGQVRDVLVNERDQVRLDDGTVLKEGEFRWLQPADGTLFALGLNYADHASELEFKPPTEPLVFIKAPNTFTGHQQQSVRPDNVEYMHYEAELVVVIGKTARRVSEAEAMDYVAGYTVCNDYAIRDYLENYYRPNLRVKSRDTLTPIGPWIVSKEAIPDPHNLALRTWVNGELRQQGTTADLIFSIPFLIAYLSEFMTLQPGDMIATGTPKGLSDVVPGDEVIVEVEGVGRLVNHIISQQAYEETLS

SEQ ID NO: 8727 - protein, 407 aa, Klebsiella pneumoniae
KKAASGCLFYVGHPKTRPSLPAVAAAVEALHGLGQHHIARQDRYQPWEVAQRQGLQLQVASQRRERQRDTHRHHHQGHGEQRPGGPALNERNAPGADHVHNQRLRQQPFDKPAGLEQGLHLHGIGVEHPPHQAEGEDIENRADRSEEDHKAPEIGRVPALRLADLLIIDVIKRDRHLGDIVQQVLNQQVQRQHRQKRQEGAGHQHAEDVAEVGAGGHFDVLEHVGEGAAAFDYPLLQHHQALLQQNDIRRLAGDIHRAVDRDADIRRAQRRGVVDAVAHKAHHVTFAFQQRHDTLFMQRRQAGEQRGAFGQRRQFVVAHGFDLAANHHFASIQSHFMAHLRRHQLAVAGEDLHRDAAGLQRLQRRGGGLFRRIEEGDVTFKDQVRLIGALVVAFAGRQVFGRHRHHP

SEQ ID NO: 8728 - protein, 418 aa, Klebsiella pneumoniae
NHKAPGADGRRRVDGDFFQLRCDHRRVFTAHFMQVRHDDAQACRRGVHREIKARFDNRGGDQRHDCNKGFHQHRAVANKAGIGFVGQQLRRGAGGDQRVEAGDRAAGDGDKQEREQRAFPQRAGTINVLGHRRHFQVRIEDNDPQRQADDHADFQEGGQIIARRQNQPYRQQGGNKRVANQGKGDGGVFKGQRRAPVRVVGNHAAEPDRGHQQHDTDNRHFTDAAWAQEAHVDPHKQGDRHRRADGKDTPRAFRQRFHHDERQHREDDDHNQEAAEQGDRARNRPHLLFNHLAQRGAVTPRGDKQHHEVLYRARQHHAGQQPQGARQIAHLRGQYRADQRASAGDRGKVVAKQHVAVGWHIVQAIVINDRRRGARRVKLHHLLRDVQAVITVGDEVHRNRCDDDPQGTDVLTAAQGDD

SEQ ID NO: 8729 - protein, 84 aa, Klebsiella pneumoniae
SEKARKALRILDFRHKKRRPLTSIDVPMVPKAGLEPARISTVDFESTASTDFATSALKGMRKRSGLYLSAAVMQATACRHCAKC

SEQ ID NO: 8730 - protein, 417 aa, Klebsiella pneumoniae
IKEARVTMITSNKNYFISCLFFLFFFIGWGCCYPYLSLWLTETIGINYTDVGLVYSFTAIVAVCVQPLFGFISDKLVYRKNLMWMLAIIITLFAPYWIYVFAPLLKINVFLGALAGGLYIGMAYGAGCGICEAYIDKVSRASGFEFGRARMFGGIGAAIGTFAAGKLYGIDQNMIFWLASGAGVCLLVIVWKMQISAHPQQGLLSGKASPVTLRDAVSLLKIKKFWFFALYVIGVGAVYETYDQQFAIYYSHFFESKARGAEVFGYLTTGQIFLDAIVMFFAPWFVNKIGPKNALLYCGLIMSLRIIGSAWAIGPVSISLIKLLHGFESSVLLVAALKYITANFNPLLSATVYLIGFQFSKSFSSIFLSTGIGHMYQSMGFTSSYIVLGGIALCFTLISFITLDKARVFSSQPVPAN

SEQ ID NO: 8731 - protein, 327 aa, Klebsiella pneumoniae
MSLAPRKPGFYIPLRKHISPDCKRDILFRRGTQIQAGDSLGAACYKRLIPAAKAKAVNHTRDIPQTFWRDDRLPWLELRSTWRSRQAYKRHSHPQLSVGAIIEGETRCLCAGQEYLLQPGDLIVIPPHAPHSCNPLHGRPRSYHMLYLDATWCHAQRPDIPPGASITSPQPLLRDSPLFASFQQVVALMSRGSLEQLPARLAQLLHALPLCAAAPQAPHHASALLFQCLAMDLPASPSLDKLAHDSALRKETVIRAVKQDTGLTPASLINMARIEYAKTRLRAGDPIADVGYQAGFADQSHFHKTFVSYTAATPRQYAQSRSISDNK

SEQ ID NO: 8732 - protein, 377 aa, Klebsiella pneumoniae
GRMAIGHFLFRGDKTACGGRILEGCPNHQFFDKDMACEGHKVTCGKHPGHYRICGGLDSDEIHGKRVAGTLHSRSSCPCKSRFIPSIDDTYEFSTGAAKADTAQSQVVEFPVLPRPIYDPQADNVTDTCKSEDNPLLNGVYIWTETTSAGHVFVSVHENNNIFLYTYGRYGRTDKSTFTGDGILDFFQDEDARKYYRYELYEMGARAFRIDDADPKIIRKFFENLWNGGVTPIQTPNMQDGTKRRGRTIDKYDVTGSNCTTHSVEGLKFAGSKVFEHGYTSTTTQLPIDIEEDFTIPVSLQRYLESKSADFSSILVVEMTNTFKQQYPNTENKSPQSIGGSAKIQQSAADSAAVAGSTSPYSGGTVGGSLGSTYDDE

SEQ ID NO: 8733 - protein, 449 aa, Klebsiella pneumoniae
CSSAWGLSGDFCTTSPSGYMLKHMEKLAELKRAKLLALSLLLIAAAIFITTLALPPSPWVGALKAISEAAMVGALADWFAVVALFRRIPLPFVARHTAIIPRNKDRIADNLGRFVEEKFLDTPSLVALIRRYQPALMLGNWFSQPENARRVGQHLLQVMSGFLELTDDARIQRLLRRAVHKAIDKVDLTQTSAMMLEGLTRDNRHQKLLDSLINQLIALLQRDSSRAFIARGIVHWLETEHPLKAKLLPTEWLGEHSAEMVTDAVNTLLDEVTHDRTHQIRQTFDRAVQKLIDNLKSDPDMAQKADNIKAWLKNDETFNHYLGEVWGDLRGWVKNDISSDDSRIKQRIAEAGQWFGETLLRDDALRESLNEHLEQAAHRVAPEFAAFLTRHISDTVKSWDARDMSRQIELNIGKDLQFIRINGTLVGGTIGLLLWLLSQIPSLLHLHIG

SEQ ID NO: 8734 - protein, 162 aa, Klebsiella pneumoniae
RRPALHLNPQQEAPYMKNATFYLLDNDATVDGLSAVEQLVCDIAAERWRNGKRVLIACEDEQQAIRLDEALWSRPPESFVPHNLAGEGPRGGAPVEIAWPQKRNSSPRDILISLRLNFADFATAFTEVIDFVPYEDNLKQLARERYKAYRMAGFNLNTATWK

SEQ ID NO: 8735 - protein, 210 aa, Klebsiella pneumoniae
VLPAIAPTGKAAGSPTIWGAISRMIWRSRGRDCGPSSADVKSSADQYQLTDRATKYAIVLIGLTFMAFFVFESLTRRPLHPMQYLLVGLSLVLFYLVLLALSEHIGFTAAWLAASLSGAVMNGIYLQAVLRGWRNSLLFVAALLLLDGVMWFLLHSEDSALLLGTGVLALALSVLMFLTRRVDWYALSLPKGTVPPTPAADDDKLRLWKE

SEQ ID NO: 8736 - protein, 453 aa, Klebsiella pneumoniae
RAAAAPGEKSRSPSPTGLDRLPPARRRAHYRSASRSRAYRPPRWRRPDSFWRARRPGRDLPPRRKFHGRCLCCPPGRSGTRGHGKSLGSVSCLFLLIQNFCDAASDHLQLLGVYAADIGFDNAFIRFIAAEVDGVFTLLQRVNQIAGLHAGRDFIKFNFGAGDIAARAVPHHPRGHAVESIELFDKRRHLVHHLLTALFARRQVVFNGAGQAENALFTHFHRPANAHRLALNPLDVLRFADHQPAGRPFNRFRAAVDNQVGAHAVVALQIFFRRRIDDQRYVMLARHFRGLRDVEHAFLHAVVGFDVQNRRGARSDRRRQLLGRTFVGVARFHQLTAAQRHHGANRRAEVDVVALRQHDFVIFNRRNVQVLQQPVAVFHQHRRYRLGNPRRRAGDNGRPFHIQQFGDVLAGFIHQVFHFKVLVHTGHRGFNHFRARRGNAQRRHAARSINHLF

SEQ ID NO: 8737 - protein, 150 aa, Klebsiella pneumoniae
IDAAGLRLFRHLFFETGNLFFHRRRPDIRNFMGTQRHIDGHAGAHVVAQHFDDLTHRFGAAGWSLGQLDHDHVAHPRAHYLFRRDQDIKAQAAVVRDDKADASVGEVTTNYLAGFRHEDADDARFAAALTVRAQRLSQHLVAVNTGFHLF

SEQ ID NO: 8738 - protein, 370 aa, Klebsiella pneumoniae
TSAASATQAAWARSCCATDADLVIGVGTRFSDFTTASKWIFQHPEVRFLNINVSNFDAWKLDGIAMLADAREAMTALDAALADSGWQAGWGAQIESVQSRQLKETQRVYQAVWQEKSFVPEIDDHLDRESVYREFRQITDSTLTQSSVLGVLNETLPAEAVIVAAAGSLPGDLQRVWRNRAENTYHVEYGYSCMGYEVNAALGVKLAQPQSEVYSLVGDGSFMMLHSELVTSLQERAKINVVLFDNMANGCINNLQMEHGMDSFGTEFRYRQPETGQLQGGLVPVDFATIAAGYGCKTWRVTTLDELRHALDAARRETVSTLIDIKVLPKTMVHKYGSWWNVGVAQTALSERIRKVAQMINEKRAQARDY

SEQ ID NO: 8739 - protein, 163 aa, Klebsiella pneumoniae
CRRAPGDLNKRAICMSKSVQSNSAVLVHFTLKLDDGSTAESTRSNGKPALFRLGDTSLSEGLEQQLLGLKEGEKKAFSLEPDAAFGVPSPDLIQYFSRREFIDAGEPEIGAIMLFTAMDGSEMPGVIREVNGDSITVDFNHPLAGRTVHFDIEVLEIDPALEE

SEQ ID NO: 8740 - protein, 835 aa, Klebsiella pneumoniae
TVRAFFLTRDQGVRTMRVLKFGGTSVANAERFLRVADILESNARQGQVATVLSAPAKITNHLVAMIEKTIGGQDALPNIADAERIFAELLQGLADAQPAFPLAQLKAFVEQEFAQIKHVLHGISLLGQCPDSVNAALICRGEKLSIAIMAGLLEARGHKVSVINPVEKLLAVGHYLESTVDIAESTRRIAASQIPADHMILMAGFTAGNEKGELVVLGRNGSDYSAAVLAACLRADCCEIWTDVDGVYTCDPRQVPDARLLKSMSYQEAMELSYFGAKVLHPRTIAPIAQFQIPCLIKNTGNPQAPGTLIGASRDEDDLPVKGISNLNNMAMFNVSGPGMKGMVGMAARVFATMSRAGISVVLITQSSSEYSISFCVPQSDCARAKRAMEDEFYLELKEGLLEPLAIMERLAIISVVGDGMRTLRGISAKFFAALARANINIVAIAQGSSERSISVVVSNDDATTGVRVTHQMLFNTDQVIEVFVIGVGGVGGALLEQIKRQQGWLKNKHIDLRVCGVANSQALLTSVHGLNLENWSAELAEAKEPFKLGRLIRLVKEYHLLNPVIVDCTSSQAVADQYADFLREGFHVVTPNKKANTSSLDYYHQLRHAASSSRRKFLYDTNVGAGLPVIENLQNLLNAGDELRHFSGILSGSLSFIFGKLDEGVSFSAATAMAREMGYTEPDPRDDLSGVDVARKLLILARETGRELELADIIVESALPPDFDASGDVETFMARLPSLDDGFASRVAKARDEGKVLRYVGNIEEDGTCRVKIAAVDGNDPLFKVKNGENALAFYSHYYQPLPLVLRGYGAGNDVTAAGVFADLLRTLSWKLGV

SEQ ID NO: 8741 - protein, 1234 aa, Klebsiella pneumoniae
FPHFQGRCCLPFSGLHMNTSNIKKYAPVARKQFRDAVMQKLTTLGIEADKKGNLQIAQATDLGDSVRYGQFSLDKSLASRRERLVKRAEKQGYDVLVEHIAYTWFNRFCAIRYMELHGYLDHGFRMLSHPTLEGGFEVLDHVPEVADALGLDKARLVEMKLAGDRDEELYRELLLAQCHALHGAMPFLFEAVNDEIELVLPDNLTRTDSILRGLVDTIPDEDWEQVEVIGWLYQFYISEKKDDVIGKVVKSEDIPAATQLFTPNWIVQYLVQNSVGRQWLQIYPDSSLKGKMPYYIEPAEQTPEVQAQLAAITPSSIEPESIKVLDPACGSGHILTEAYNVLKAIYEERGYRTRDIPQLILENNIFGLDIDDRAAQLSGFAMLMLARQDDRRILSPGRGVRLNIVSLQESKLDIAEVWTKLNFHQQVQRGSMGDMFTQGTALANTDSAEYKLLMRTLALFTSAKTLGSLIQVPQEDEAALKAFLDGLYRLAIEGDIQQKEAATELIPYIQQAWILAQRYDAVVANPPYMGGKGMNGELKEFAEINFSKAKSDLFSLFIERSISFCHQNSILSMITPYVWMFIGSFEDLRKEILRRHSISTLIQLEYNAFAPACIPVAAFTLTQDSLREYKGTFIKLSDFKGVDSQSPKVLEAVGREKCSWKYIASNSLFDTLPGNPLLYWVSQELSKTFNYNNGFEKLGELCSPRKGMATGDNNKFVRYWNEVDFSRSSLNIDNEYSWVPYNNGGEYRKWYGNIDRFIYWKDDGFAIKNFKDENGKLRSRPQGLDLKFKEMLSWTSLSSTYLGVRYYPNGFISDQNGNFLVPNNRFENDIYFILGWLCSSTANRIVKMLNPTMHILVSNISNLPIPMDEVTIKEVCDITRRCIDISKTDWDKYESSWGFIRPAIITSQIDLKSAVLLEIKNCKSMVNELERLEQRNNDIFALKFGVSDLLGYELTSDDITLNVKEVMLSTEIFSSKLITELLSYIVGTQMGRYSLDREGLVYAHEGNKGFSDLVEEGAYKTFPADEDGILPLMDSNWFDDDVTARVKEFVRTVWGEEHLQENLDFIAESLCLYAIKPKKGESSLDTIRRYLSTQFWKDHLKMYKKRPIYWLFSSGKEKAFECLVYLHRYNEGTLSRMRTEYVVPLLARYQGNIDLVNDQLKNAESGAATTRLKKELDGLSKKFNELRSFDDRLRHYADRRITIDLDDGVKVNYGKFGDLLADVKAITGSAPQEE

SEQ ID NO: 8742 - protein, 223 aa, Klebsiella pneumoniae
AANFQRWNMVRAKLKFRLHRAVIVLICLALLVALMQGASWFSQNSQKQRNPQLEELARTLAQQVVLNLAPLMRSETPDEKRINQLLTQLTHNSRVLDAGVYDEQGDLVARSGESVEVRDRLALDGKKAGGYFNQQIVEPVPGKNGPLGYLRLTLDTHTLATEAKQVDNTTNILRLMLLLSLAIGVVLTRTLLQGKRTRWQQSPFLLTANKPVEDEDDEKKGNL

SEQ ID NO: 8743 - protein, 232 aa, Klebsiella pneumoniae
NTSYIPDDEVTAMAFRDQPLGELALTIPRASALFRQYDMDYCCGGKQTLARAASRKALDVAVIEAELAKLAEQPLSRDWRAAPLAEIIDHIIVRYHDRHREQLPELILQATKVERVHADKPNVPKGLTKYLTMLHQELSSHMMKEEQILFPMIKQGMGAQAGGPISVMESEHDEAGELLEVIKHITHNVTPPPEACTTWKAMYNGINEMIDDLMEHISLENNVLFPRALGGK

SEQ ID NO: 8744 - protein, 374 aa, Klebsiella pneumoniae
  UNSURE (198): Identity of amino acid at the above locations are unknown.
SMAYQLNINWPEFLEKYWQKQPVVLKNAFPDFVDPITPDELAGLAMEPEVDSRLVSLKNGKWQASNGPFEHFDGLGETGWSLLAQAVNHWHMPAAELVRPFRVLPDWRLDDLMISFSVPGGGVGPHIDQYDVFIIQGMGSRRWRVGDKLPMRQFCPHPALLHVDPFPPIIDEDLQPGDILYIPPGFPHDGITHETALXYSVGFRGPNGRDLISSFADYVLENDLGGEHYSDPDLTCREHPGRVEEYELERLRTMMIDMIRQPEDFKQWFGSFVTTPRHELDIAPAEPPYEEEEVVDALLGGEKLSRLSGLRVLHIGDSFFVHSEQLDTTDAEALDALCRYTSLGQEELGSGLQNPAFVSELTRLINQGYWYFEE

SEQ ID NO: 8745 - protein, 306 aa, Klebsiella pneumoniae
LQILPTQPSYCEAITIGRKAMLKSPLFWKITTLIGCIVLLSLPLMMVRELINERADYRSEVVDAIEQSTSGSQKLAGPLIAIPITETLSRMENQKEVNYQRSWVYYWLPESLAVTANKTVKSRRVGISTGQVWHNALQIKASFDPLRLAALRKTNIVLGQPRLVVSVGDARGIGAIHAPEVNGNVLSVEPGLGISGDGAGIHMPMPALAEDNKPLEIAFSLDLNGTGEFSLVPLGRNSELQLTSNWPHPGFLGSFLPTQREVSAAGYRAHWQSSWFANDMGSYFKDDMEIPWSRLRAFKCRCEVLC

SEQ ID NO: 8746 - protein, 224 aa, Klebsiella pneumoniae
LQAYMGIRRYTDVLAKRSFLHAYYYKQVHQQDNTYPFEDFYRTNSKNPQAALMSMLSWWKSLSAPPSNEDIHLGIYAPYIRENLSKNNIGSLTEDKIHQIFSYTHATMDHVIKMSAETFGQPATKSLNKEERAVLFTKWIMGQTNQKGMTIAELLNYVLYGGTPSFMWERIYQAGKDEQYKFQHYGINSIAEVVGWARPDDTPPRNGRTNKALRALGYPVQVNI

SEQ ID NO: 8747 - protein, 114 aa, Klebsiella pneumoniae
GYHYTITIRKRDMVMRRFSPWLLAIVLSGCSALQGTPEAPPPATDHPQEIQRYQTAGLQKMATVSVLMYGSPMDVEAALKAKAEAAKADYYVIIMIDDTMVPGQWYSQAILYRR

SEQ ID NO: 8748 - protein, 75 aa, Klebsiella pneumoniae
AMSYTERVRKPLFTVHYGKEKSMFRWGIIFLVIALIAAALGFGGLAGTAAGAAKIVFVVGIILFLVSLFTGRRRP

SEQ ID NO: 8749 - protein, 338 aa, Klebsiella pneumoniae
FSSLSAQYIINADSDNPTTRQCTLAPGAQMNLNLLPDLALFVQIVDQGSFSAVARQNGITPSAVSRSVSRLEREMGCKLLQRTTRKLRLSDAGETIYQHAQQMLEAARQAMDSAGSRQTVAQGKLTLSVPKAVGRFVIHPLMMAFFHRYPQVDVCLRLEDRPLDFIDDGIDLALRITDTPSPGLHGKPLMPIRHVICATEAYLQQHGTPYTPQDLRSHSCISLGETPADARWKFRREGKTETVQTYGRYAANHTAVRLDAVRQHLGIGSLPLFTAREALANGDIVQVLPEWEFISSYSGDLWLLWAGDKHMPARMRAMIDYLSETVPALNAGSTEPAK

SEQ ID NO: 8750 - protein, 726 aa, Klebsiella pneumoniae
PPPLWITCSIYGVIMTPHVMKRDGCKVPFNSERIQEAILRAAKAAGVDDADYCATVAEVVSQQMQGRAQVDINEIQTAVENQLMSGPYKQLARAYIEYRHDRDSQREKRGRLNQEIRGLVEQTNSALLNENANKDSKVIPTQRDLLAGIVAKHYARQHLLPHDVVMAHERGMIHYHDLDYSPFFPMFNCMLIDLKGMLTQGFKMGNAEIEPPKSISTATAVTAQIIAQVASHIYGGTTINRIDEVLAPFVSESFKKHRKIAEEWQIPDAEGYARARTEKECYDAFQSLEYEVNTLHTANGQTPFVTFGFGLGTSWESRLIQQSILRNRIAGLGKNRKTAVFPKLVFAIRDGLNHKFGDPNYDIKQLALECASKRMYPDILNYDQVVKVTGSFKTPMGCRSFLGVWENENGEQVHDGRNNLGVISLNLPRIALEAKGDEAAFWALLDERLQLARKALMTRIARLEGVKARVAPILYMEGACGVRLKADDDVSEIFKNGRASISLGYIGIHETINALYGNQHMYDSEALREKGVAIVQRLRDAVDLWKEETGYGFSLYSTPSENLCDRFCRLDTAEFGVVEGVTDKGYYTNSFHLDVEKKVNPYDKIDFEAPYPPLANGGFICYGEYPNIQHNLKALEDVWDYSYQHVPYYGTNTPIDECYECGFTGEFECTSKGFTCPKCGNHDAARVSVTRRVCGYLGSPDARPFNAGKQEEVKRRVKHLGNGQIG

SEQ ID NO: 8751 - protein, 199 aa, Klebsiella pneumoniae
ISAYASGHCPPREGSFVLATRNCVMLTCESVRSTDSPHFAMLDALYARAFPWHEQRESEAKRQALSHPRYALEAWFDEGVFVGLSGCWQFAGYGYIEHLAIDDTLRSRGYGKQLLAQILTRAPLTILEIDPLTTAIAHKRLRFYQSMGFHANPWAHRHPTYHQGIADHELLVLSYPQPIGERQYQQFARDLGHEVMGRE

SEQ ID NO: 8752 - protein, 227 aa, Klebsiella pneumoniae
STTHSAASNGSRIMEQNKGFWYADWSFPIFVGLLSSGVFAGTHMYYLYGIGAFNEVAFVAMLKSGIDTGVYGAVAAFGASFLFARIIEGSLVGILDIGGAIQTGIGLGVPALLLGAGFVFPVANFAASLVTGLVLGLAVGYIIILARKFTINQSDSTYGADVMMGAGNASGRFLGPLIILSAMTASIPIGIGSLVGALLFYIWQKPITGGAILGAMILGSIFPVAIS

SEQ ID NO: 8753 - protein, 92 aa, Klebsiella pneumoniae
TDAQVFINSQWGCCSTINNPVQALGDNSNNLFLSRKLKAANRQGMMVVDILVTHPRSDRQLRKISQPDLIISIKFFVTRLVIFHNSYSLRLK

SEQ ID NO: 8754 - protein, 192 aa, Klebsiella pneumoniae
RAYQYRTRPLGDRQPANPRHLYWRGDGHDRMGAARMGIISFIFALAEDMLLAAIPAVGFAMVFNVPQRALRWCALLGAIGHGSRMIMMSAGFNIEWATFLAALLVGSIGIQWSRWYLAHPKIFTVAAVIPMFPGISAYTAMISAVKISHFGYSEEMMILLLSNFLKASSIVGALSIGLSIPGLWLYRKRPRV

SEQ ID NO: 8755 - protein, 175 aa, Klebsiella pneumoniae
RPHHQRGAAHRGAGMTRPAQHLLMALAFDVYWTLVVMLRERGLLIWLMLAIFAWLRLPAASRPPALLLAAAGCGLDACWALAGLIDFRGDSLLPLWMVALWLMFAVVWTRLTRTATLPGWVLATAATVGGPVAYLIGARLGAMTLLVPTALGVAAMACGWLVLMLLFHLGMGRQK

SEQ ID NO: 8756 - protein, 386 aa, Klebsiella pneumoniae
RLSHETSNFPALKRVFTGVFIVIIIRYLVRETLKSQLAILFILLLIFFCQKLVRILGAAVDGDIPTNLVLSLLGLGIPEMAQLILPLSLFLGLLMTLGKLYTESEITVMHACGLSKAVLIKAAMILALFTGAVAAVNVMWAGPWSSRHQDEVLAEAKANPGMAALAQGQFQQASDGNAVMFIESVNGNRFHDVFLAQLRPKGNARPSVVVADSGELSQQKDGSQVVTLNKGTRFEGTAMLRDFRITDFNNYQAIIGHQAVSADPDDTEQMDMRTLWKTHTDRARAELHWRFTLVATVFIMALMVVPLSVVNPRQGRVLSMLPAMLLYLVFFLLQTSIKSNGGKGKMDPAIWMWGINLLYFALAVLLNLWDTVPMRRFRARFNKGAA

SEQ ID NO: 8757 - protein, 117 aa, Klebsiella pneumoniae
PIIQKVRSHTRRCSHCLYVHGFRFFFTPLAGVLFAFPSRYWFTIGQSGVFSLGGWSPHIQTGYHVSRPTLRVHSLCILVYGTITLYRRTFQTVPLTHKLIQTLGCSPFARRYWGNLG

SEQ ID NO: 8758 - protein, 73 aa, Klebsiella pneumoniae
PEIQIMTTRPSLTEDQFVDMAFITSLLQMTDKWIYKLIKDGVFPKPIKLGRSSRWLKSEVENWLQERIDQSRK

SEQ ID NO: 8759 - protein, 178 aa, Klebsiella pneumoniae
SNSQREVIMQLDEQRLRFRDAMASLSAAVNVVTTAGEAGRCGITATAVCSVTDTPPSVMVCINANSAMNPVFQGNGKLCINVLNHEQEIMARHFAGMTGVTMEERFALSGWQQGALGQPVLKGSLASLEGEISQVQTIGTHLVYLVEIRNITLSPQGHGLIYFKRRFHPVMMEMEVAV

SEQ ID NO: 8760 - protein, 154 aa, Klebsiella pneumoniae
EMTHDNKLQVEAIKRGTVIDHIPAQVGFKLLTLFKLTETDQRITIGLNLPSGEMGRKDLIKIENTFLTDEQVNQLSLYAPQATVNRIDDYEVVGKSRPSLPDRIDSVLVCPNSNCISHAEPVSSSFAVKKRADDIALKCKYCEKEFSHYVVLAN

SEQ ID NO: 8761 - protein, 259 aa, Klebsiella pneumoniae
RTRQPYSARFPRMSMKNVGDLMKRLQKMMPAHIEPAFKTGEELLAWQKEQGRLRSEALERENRAMKMQRTFNRSGIRPLHQNCSFDNYRVECEGQMNALARARQYVEEFDGNIASFIFSGKPGTGKNHLAAAICNELLLRGKSVLIITVADIMSAMKDTFGNRETSEEQLLNDLSMVDLLVIDEIGMQTESRYEKVIINQIVDRRSSSKRPTGMLTNSNMEEMNKLLGERVMDRMRLGNSLWVIFNWESYRHRVTGKEY

SEQ ID NO: 8762 - protein, 294 aa, Klebsiella pneumoniae
GWGHFMDQAGIIRDLLSWLEGHLDQPLSLDNVAAKAGYSKWHLQRMFKDVTGHAIGAYIRARRLSKSAVALRLTARPILDIALQYRFDSQQTFTRAFKKQFSLTPALYRRSPDWSSFGMRPPLRLGEFTLPKHEFITLPPTQLLGVTQSYTCKLEEISDFRNQMRVQFWRDFLGNSPSIPPVLYGLHEPRPSLEKDDEQEVFYTTALTPEMANGHLQHAHPVTLEGGEYVMFTYEGLGTGLQEFILTVYGTCMPMLNLTRRKGLDIERFYPEDESRDQATPIQLRCEYLIPIRR

SEQ ID NO: 8763 - protein, 693 aa, Klebsiella pneumoniae
GVMQQQDNSASNMETASVLAQDLDSLLNQHFRGRVVRKDLTKQLKEGANVPVYVLEYLLGMYCASDDDEVVEQGLQSVKRILSENYVRPDEAEKVKSLIRERGSYKIIDKVTVKLNQKKDVYEAQLSNLGIKDALVPSQMVKDNEKLLTGGIWCMITVNYFYEEGQKTSPFSLFTLKPIQMPNMDMDEVFEARKQFDRDQWIDVLLRSIGMEPANIEQRTKWHLITRMIPFVENNYNVCELGPRGTGKSHVYKECSPNSLLVSGGQTTVANLFYNMASRQIGLVGMWDVVAFDEVAGITFKDKDGVQIMKDYMASGSFSRGRDSIEGKASMVFVGNINQSVDTLVKTSHLLAPFPDAMIDTAFFDRFHAYIPGWEIPKMRPEFFTNRYGLITDYLAEYMREMRKRSFSDAIDKFFKLGNNLNQRDVIAVRRTVSGLLKLLHPDGTYDKEDVRVCLIYALEVRRRVKEQLKKLGGLEFFDVNFSYIDNESLEEFFVSVPEQGGSELIPAGMPKPGVVHLVTQADSGMTGLYRFETQMTAGNGKHAVSGLGSNTAAKEAIRVGFDYFKGNLGRISTAAKFSEHEYHLHVVELHSTGPSTTTSLAALIAFCSILLAKPVQEQMVVLGGMTLGGVTNPVQDLAACLQVAFDSGAKKVLLPMASAMDIPTVPTELFTKFQVSFYADPVDAVYKALGVN

SEQ ID NO: 8764 - protein, 80 aa, Klebsiella pneumoniae
AVSQNITGTDCRRDSGGKPGVEGNEARCGKRTGDRLAQNATVITKMKFHFTTMLKYKFHFTTVIAQQNQRRAGVRWPPSL

SEQ ID NO: 8765 - protein, 164 aa, Klebsiella pneumoniae
HNPQYLRAKSPVFAVINSPPSHFAYSGDKLMKSLYRLSVGLILGVSFITSAAANDHKILGVIAMPRNETNDLTLTLPVCRVVKRIQLSADHGDVQLSGATVYFKASRGASHTLNVPAGIKEGSTTGWININSDNDNKRCVKKIAFSGHTVHSSDMASLKIIGDD

SEQ ID NO: 8766 - protein, 967 aa, Klebsiella pneumoniae
GVPHGWFQPEHGNLEIMEKTYNPQDIEQPLYEHWEKQGYFKPNGDESQESFCIMIPPPNVTGSLHMGHAFQQTIMDTMIRYQRMQGKNTLWQAGTDHAGIATQMVVERKIAAEEGKTRHDYGRDAFIDKIWQWKAESGGTITRQMRRLGNSVDWERERFTMDEGLSNAVKEVFVRLYKEDLIYRGKRLVNWDPKLRTAISDLEVENRESKGSMWHIRYPLADGAKTADGKDYLVVATTRPETLLGDTGVAVNPEDPRYKDLIGKFVVLPLVNRRIPIVGDEHADMEKGTGCVKITPAHDFNDYEVGRRHQLPMINILTFDGDIRESAEVYDTKGNESDVYSSEIPAEFQKLERFAARKAVVAAVDALGLLEEIKPHDLTVPYGDRGGVVIEPMLTDQWYVRADVLAKPAVEAVENGDIQFVPKQYENMYFSWMRDIQDWCISRQLWWGHRIPAWYDNDGNVYVGRSEDEVRQENNLSADVALRQDEDVLDTWFSSALWTFSTLGWPENTDALRQFHPTSVMVSGFDIIFFWIARMIMMTMHFIKDENGKPQVPFKTVYMTGLIRDDEGQKMSKSKGNVIDPLDMVDGITLPELLEKRTGNMMQPQLADKIRKRTEKQFPNGIEPHGTDALRFTLAALASTGRDINWDMKRLEGYRNFCNKLWNASRFVLMNTEDQDCGFNGGEMVLSLADRWIIAEFNHTVKAYREALDNFRFDIAAGILYEFTWNQFCDWYLELTKPVMNGGSEAELRGTRHTLVTVLEGLLRLAHPIIPFITETIWQRVKAICGITADTIMLQPFPQYDASQVDDAALADTEWLKQAIVAVRNIRAEMNIAPGKPLELLLRGCSKEAERRVNDNRSFLLNLARLESITVLPADDKGPVSVTKIVDGAELLIPMAGLINKEDELARLAKEVAKIEGEIGRIESKLANEGFVARAPEAVIAKEREKLEGYAEAKAKLIEQQAVIAAL

SEQ ID NO: 8767 - protein, 86 aa, Klebsiella pneumoniae
TTWQMAAKLREQLPGIIFQHKQSLRARQSERSVADGRSKTYLSGMLFLWQGHQGRHCFTLSGKAVLNRLTGKKGCSIEDEEWDRGP

SEQ ID NO: 8768 - protein, 65 aa, Klebsiella pneumoniae
YSFNKSIYYGFLCEFAAYSSPKTVIQFDSEVYKLIQLVPGKRTTMDMSISFRMGNITKGIFGILS

SEQ ID NO: 8769 - protein, 174 aa, Klebsiella pneumoniae
VVFLDADDDIADGFIEKRSQAATVSQADVVIFNGWYSGANNHQRAVHTKQPYEATLSRHEWIRHCVTRREWPHYLWLQMVRSSYIRQHSLCFQPGRSHKDIIWTVHLAANNGRFCTLDIKDYIYINNKASITHRPDYYDVRAISYVEVITEIIQVAEQEENKKNKGIFVPACAS

SEQ ID NO: 8770 - protein, 577 aa, Klebsiella pneumoniae
KNYKSDRSLTFHFKRCNEMSLIQNPILRGFNADPSIIRVEDTYYIANSTFEWFPGVRLHESKDLKNWNLLPSPLSTTTLLDMKGNPSSGGIWAPALSWADGQFWLVYTDVKVTEGAFKDMTNYLTTAKDIRGPWSDPIKLNGVGFDASLFHDDDGRKYIVQQTWDHREYHHPFDGITLTELDTNTLKLMPETARTIYRGTAVALVEGPHLYKLNGYYYLFAAQGGTVFTHQEVVARSKTLEADSFETEPGDVFLTNVDTPDSYIQKQGHGALVSTPEGEWYYASLCARPWNRPGESIYDPRGWSTLGRETSIQKVYWDDEGWPRIEGGHGGKTFVEGPKDAIFTESAGDNSQQDDFTSPALDPNWNTLRVPFTAKMGTTGDGKLTLIGQGSLANTHDLSLIARRWQAFYFDAAVKVKFEPFSYQQMAGLTNYYNDRHWSFVFLTWNEINGKVIEVGENNRGKYTSYLKDNAIKVPDGVEYVWFRTKVRKQTYSYEYSFDGVSFTEIPVQLDAAVLSDDYVLQSYGGFFTGAFVGLAAVDYAGYGTQAEFYQFEYQELGDALAADGSYSWEAGETRDK

SEQ ID NO: 8771 - protein, 386 aa, Klebsiella pneumoniae
YANKVSGYSLEDVLIKSALLVLEDGTQFHGRAIGATGTAVGEVVFNTSMTGYQEILTDPSYFRQIDTLTYPHIGNVGTNAADEESSQVHAQGLVIQDLPLIASNFRSTENFSSYLKRHNIVAIADIDTRKLTRLLREKGAQNGCIIAGDSPDAQLALEKAKAFPGLNGMDLAKEVTTAETYSWTQGSWTLAGDLPEAKAESELPFHVVAYDFGAKRNILRMLVDRGCRLTVVPAKTSAADVLALNPDGIFLSNGPGDPAPCDYAIEAIEKFLETDIPVFGICLGHQLLALASGAKTIKMKFGHHGGNHPVKDIDNNVVMITAQNHGFAVNEATLPANLRVTHKSLFDGTLQGIHRTDKPAFNFPGHPEPTPGRTIPGPCSTLYSIN

SEQ ID NO: 8772 - protein, 496 aa, Klebsiella pneumoniae
AMNNMSFMIWFSVYACAMITLGWYVSRKQKTGEDFLLGGRSLPMILTLGSTVGTMVGTGSSVGAVGFGYSNGWAGMLYGLGGAVGILLVAWLFAPVRKLRFMTMSEEMSYYTGGSKIIKNLVAILIFIASIGWLGAHILGGGLYLAWASGIDINVAKIIIALAFVVYVGIGGYSAVVWIDTIQSIVLFVGFILMAILAVHHVGGWSHIQQAVDPAAQSLFAVDKLGVLPALSLAMVIGVGVLATPSYRQRIYSAKTVSSVRQSFTITGLLYLGFSFLPAIIGMAVWTMNPQLENSGFAFLFATQVLPPVLAMAILIAGMSANMSSGSSDAIAAVSIMLRDLYTLVTGHMPAPEKAIRLSRIFLVLVIALALLFALTSNDIISYITKMISMIMSGMFICTMLGRFWTRFNWQGAVAALAGGAGASVAVLVDSDWLAFWGNPCIPAVLTSLVASVVVTLLTPASNMSREQALEMITRERESRPTPPPLPIGKRHTSRG

SEQ ID NO: 8773 - protein, 172 aa, Klebsiella pneumoniae
VRDNHSAIFFNNGNNMKYKKFAMGLLLLAGSQLAQAEQIGSVDTVFKWLGPDHKIVVEAFDDPDVQNVTCYISRAKTGGIKGGLGLAEDTSDAAISCQQVGPIELTDKIKNGKSQGDVVFQKRTSLVFKKLQVVRFYDAKRNALVYLTYSDKVVDGSPKNAISAVPIMPWNK

SEQ ID NO: 8774 - protein, 256 aa, Klebsiella pneumoniae
RHCNQTRWRMLEQVCQLARNAGDAIMEVYDGNQPINVASKKDDSPVTAADIAAHKVIVSGLQALDPDTPILSEEDPPSWEVRQHWQRYWLVDPLDGTKEFIKRNGEFTVNIALIENGKPTLGVVYAPVMKVMYSAQNGKAWKEECGVRKQIQVRDARPPLVVISRSHSNDPELQEYLEQLGEHQTTSIGSSLKFCLVAEGQAQLYPRFGPTSTWDTAAGHAVAVAAGAHVHDWQGKTLDYTPRESFLNPGFRVSIY

SEQ ID NO: 8775 - protein, 97 aa, Klebsiella pneumoniae
FKCNAILHYKIPLSGGIMATLNVRLDDKLKKEAYAVLEKLDMTPTEAVRLLFQYIAENGRMPVKSMTISDGEAALLRTVRERLENPRPGVKVSLDDL

SEQ ID NO: 8776 - protein, 129 aa, Klebsiella pneumoniae
AMRKKLLAMLAVSAFALGSASAFADLGEDMDTLAENLQVVQKTSDAGELKAALNKMRTAAVDAQKETPPKLEGKAADSAEMKDYRHGLDILIGQIDGALKLANEGKVKEAQAAAEEFKTTRNTYHKKYR

SEQ ID NO: 8777 - protein, 433 aa, Klebsiella pneumoniae
KMGNNVVVLGTQWGDEGKGKIVDLLTERAKYVVRYQGGHNAGHTLVINGEKTVLHLIPSGILRENVTSIIGNGVVLSPAALMKEMKGLEDRGIPVRERLLLSEACPLILDYHVALDVAREKARGAKAIGTTGRGIGPAYEDKVARRGLRVGDLFDKATFADKLKEVMEYHNFQLVNFYKAEAVDYQKVLDDVMAIADILTSMVVDVSDLLDQARQRGDFVMFEGAQGTLLDIDHGTYPYVTSSNTTAGGVATGSGLGPRYVDYVLGIIKAYSTRVGAGPFPTELFDETGEFLCKQGNEFGATTGRRRRTGWLDAVAVRRAVQINSLSGFCLTKLDVLDGLKEVKICVGYRMPDGREVTTTPLAADNWEGIEPIYETMPGWSETTFGVKERSGLPQAALNYIQRIEELTGVPVDIISTGPDRTETMILRDPFDA

SEQ ID NO: 8778 - protein, 449 aa, Klebsiella pneumoniae
FSCFSISEFIMQTYFDQVDRVRFAGPKTDNPLAFRHYNPDEIVLGKRMADHLRFAACYWHNFCWNGADMFGAGSFERPWQATGDALEMAKRKADVAFEFFYKLNVPYYCFHDVDVSPEGASLKEYLHNFAIMTEVLAEKQQQTGVKLLWGTANCFTHPRYGAGAATNPDPEVFAWAATQVVTAMNATHQLGGENYVLWGGREGYESLLNTDLRQEREQIGRFLQMVVEHKHKIGFGGTLLIEPKPQEPTKHQYDYDVATVYGFLKQFGLENEIKVNIEANHATLAGHSFHHEIASAIALGIFGSVDANRGDAQLGWDTDQFPNSVEENTLVMYEILKAGGFTTGGLNFDAKVRRQSTDKYDMFYGHIGAMDVMALSLKLAARMIEDGKLDQGLAKRYAGWQGELGQKIMSGQMSLDNIARYAEQHNLNPQPQSGRQELLENLVNTYIFG

SEQ ID NO: 8779 - protein, 108 aa, Klebsiella pneumoniae
RVILMTNRLELSGIICRTPLRKVSPSGIPHCQFVLEHRSVQEEAGFHRQAWCQMPVIISGHENQAITHSITVGSAVTVRGFISCHKAKNGLSKMVLHAEQIELIDSGD

SEQ ID NO: 8780 - protein, 371 aa, Klebsiella pneumoniae
IKTNQNLITIENTRKSTMSKVQTITRESWILNTFPEWGSWLNEEIEQEQVTPGTFAMWWLGCTGIWLKSEGGANVCVDFWCGTGKQSHGNPLMKTGHQMQRMAGVKKLQPNLRTTPFVLDPFAIRQIDAVLATHDHNDHIDVNVAAAVMQNCPADVPFIGPKTCVDLWIGWGVPKARCIVMKPGDVVKIKDIEIHALDAFDRTALITLPADQKAAGVLPDGMDQRAVNYLFKTPGGNLYHSGDSHYSNYYAKHGNEHRIDVALGSYGENPRGITDKMTSADILRMAESLNAKVVIPFHHDIWSNFQADPQEIRVLWEMKKDRLKYGFKPFIWQVGGKFTWPLDKDNFEYHYPRGFDDCFTIEPDLPFKSFL

SEQ ID NO: 8781 - protein, 270 aa, Klebsiella pneumoniae
KMTNMKLKFDLLLKSYHLSHRFVYKANPGNAGDGVIASATYDFFERNALTYIPYRDGERYSSETDILIFGGGGNLIEGLYSEGHDFIQNNIGKFHKVIIMPSTIRGYSDLFINNIDKFVVFCRENITFDYIKSLNYEPNKNVFITDDMAFYLDLNKYLSLKPVYKKQANCFRTDSESLTGDYKENNHDISLTWNGDYWDNEFLARNSTRCMINFLEEYKVVNTDRLHVAILASLLGKEVNFYPNSYYKNEAVYNYSLFNRYPKTCFITAS

SEQ ID NO: 8782 - protein, 492 aa, Klebsiella pneumoniae
KGANQYPSRYGLQPGARLMRIGMRLLLGYFLIVAIAAWFVLSIFVQEVKPGVRRATEGTLNDTATLLAALAREDLLAANPQQGRLAQAFHQLNQQPLNANIGGIKKVRNEYRVYLTDARGKVVFDSSGQATGQDYSRWNDVWLTLRGQYGARSTRSDPHDEASSVMYIAAPVMDKGRIIGVLSVGKPNLAMTPVIKRSERRILWAGGALLGIALLIGGGVVWWINFSIGKLVRYADSVTAERPLPLPEVGSSELRKLAQALESMRVKLEGKNAIENYVYDLTHELKSPLAAIRGAAEILREGPPPEVAARFTDNILAQNTRMQLLVERLLQQARLESRLEIKQQPVSIDALYQRLTEERNIALAAKAITLRWRESGMLVNGDGELLAQALGNLLDNAIDFTPQGGEIALAAEKRNEEVQLSVIDNGYGIPDYALERIFERFYSLPREDGHKSSGLGLAFVREVARLHHGDINLHNRPEGGVVATLRLHRPFT

SEQ ID NO: 8783 - protein, 295 aa, Klebsiella pneumoniae
NSYNNWWARASKWRFARSRTIANSFLRNACNSGGQIMVEALLLGLVAFIAQSEYALGTSLISRPIVTGLLTGLVLGDVQTGVIMGATLELAFIGSFSVGASIPPDVVTGGILGVAFAITSGAGTETALLLGLPIATLTLILKNIYLGMFIPMLSQKADGYAERADLRGIERMHLIAGFGLSLMLAAVVTVSFLVGSNAVKSLLDTIPEFIKHGLSVATGIIPALGFAMLARLLINKKVAPYFFLGFVLMAYLKIPVTGIAILGAIVAVVMVNVTALNSPRITTEQGVSDDDEDDF

SEQ ID NO: 8784 - protein, 328 aa, Klebsiella pneumoniae
QLYKVYSDDFHCFEPDMKLIRGIHNLSQAPHGCVLTIGNFDGVHRGHQALLQRLREEGRQRGLPVVVMIFEPQPLELFAADKAPARLTRLREKLGYLAESGVDYVLCVRFDRRFAALTAQDFISELLVRRLGVQFLAVGDDFRFGAGRQGDFLLLQKAGAEYGFDVTSTQTFCEGGVRISSTAVRQALADDDLLLAETLLGHPFSISGRVVHGDELGRTIGFPTANLPLRRQVSPVKGVYAVEVTGLGDKPIAGVANIGTRPTVAGVRQQLEVHLLDVVMDLYGRHINVILRKKIRNEQRFASLDELKAQIARDELTARELFGLTSQA

SEQ ID NO: 8785 - protein, 445 aa, Klebsiella pneumoniae
CGYNCGYIPVRLCLYPHRTLERILIMALSDVKVRSAKPEAKAYKLADGEGMVLLVHPNGSKYWRLRYRFGGKEKMLALGKYPEVSLADARARRDEARKLLANGVDPSENKKAVKVEQEQEAITFEVVARDWHASNQKWSASHSARVLKSLEDNLFSAIGKRNIAELKTRDLLVPIKAVESSGRLEVAARLQQRTTAIMRFAVQSGLIDYNPAQEIAGAVATAKRQHRAALELNRIPELLHRIDHYSGRPLTRLAVELTLLVFIRSSELRFARWSEVDFETAMWTIPGEREPLEGVKHSQRGSKMRTPHLVPLSRQALTILEKIKSMNGNRELIFVGDHDPRKPMSENTVNKALRVMGYDTKTEVCGHGFRTMACSSLIESGLWSRDAVERQMSHQERSSVRAAYIHKAEHLGERRLMLQWWADFLDANREKGVSPFDFAKLHGSM

SEQ ID NO: 8786 - protein, 224 aa, Klebsiella pneumoniae
RHHNRSHQARQHRRNTRVAPERQPVAIHQHRNRCPGAAGQRGDRALPVKACPETAKHGADKHPGHNHRDHFGDVADDVVGGQGKQQRQRNHQNQEDPRQANRFLRRGHMAGHQGVEVAQHNGHRGDGIRATGRHIGRHAGNQDRHRQHRRQHLSGKQESEAAVLQLRVHGPYRHTDDRRQEGEAQIQQAGNGKGLAHRGDGLRRVNTLAIRRRRQHADADHHRQ

SEQ ID NO: 8787 - protein, 200 aa, Klebsiella pneumoniae
LMDKIKLVAILRGIQPAEAADHIETLINAGFRYIEIPLNSPDWQQSIPAMVRQFGERAMIGAGTVLKVEQVDFLAEAGAKLIVTPNTAPAVIRRAVDKGMLVCAGCATASEAFSALDAGAQWLKIFPSSAFGADYIRALKAVLPPEVPVLAVGGVTPENLATWIQAGCAGAGLGSDLYRAGQAVERTREQAERFISASKS

SEQ ID NO: 8788 - protein, 133 aa, Klebsiella pneumoniae
ASCNMPSTTLRWSGWCSAATTAAAACRRRSLCPLCRWRRNPRRWLAASASCATPCITKLRRSPMGVVLRPPPTPAPASAPTRSPLAMRWTPWWKPTFAPSSPVCWRVNRCRRCSPAGGPSACTAASTIWLPAI

SEQ ID NO: 8789 - protein, 376 aa, Klebsiella pneumoniae
AAGKLRYLVRRRSIEQESRVGQRIPVTLGNIAPLAVKPFRPGKLALVCEGGGQRGIFTAGVLDEFMRAGFNPFDLMLGTSAGAQNLSAYMCNQQGYARKVITRYTTSRQFFDPMRFVRGGNLIDLDWLVEATSQQMPLAMNYAEAQFALGKELWLCACRGDDYSASYFSPTPQTWLDLIRASSAIPGFYRSGVLLDGVSYLDGGVSDAIPVQEAARRGAQTIVVIRTVPSQMFYTPQWFKRMERWLGESSLQPLVNLVHHHETTYRAIQQFIEKPPGKLRIFEIYPQRPLRSMALGSRLPALLEDYKTGRQCGRYFLATVGKLLADQPPLLRHAPRIARPAPVVVPPVPVANEAPQATIIPAPQANDPSFDHEDLA

SEQ ID NO: 8790 - protein, 442 aa, Klebsiella pneumoniae
RNLNLIFSSYQYVYYAFIELFTNRMKVKVKHLQRFFSSDASGGIVLIIAAALAMVMANTSVTSGLYHSFLETPVQLRVGALEINKNMLLWINDALMAVFFMLIGLEVKRELIQGSLASRRQAVFPVIAALGGMIVPALVYLAFNAQDRVAREGWAIPAATDIAFALGVLALLGSRVPTALKIFLMALAIIDDLGAIVIIALFYTHDLSMLSLGVAAAAIAVLVALNLSGVRRTGIYILVGAVLWTAVLKSGVHATLAGVIVGFMIPLEEKHGKSPAKALEHVLHPWVAFMILPLFAFANAGVSLQGVTLAGLTSLLPLGIMAGLFIGKPLGISLFCWLAPEAEVGFSAGGDHLQANYGGGDPVRDWLYDVDFHRHIGLWQRGSRVDQLGQAWHSDRLSAISGRRLPHTASARDGYSPRGITFLQESPSGSPGHYQGEKHVTY

SEQ ID NO: 8791 - protein, 160 aa, Klebsiella pneumoniae
PGLNQENPMSLQSVRQFFAEHAPDIEIIELNQSTATVALAAAAHNVEPGQIAKTLSLKIKDKIVLIVARGDARLDNKKLKETFGAKARMLSSDEVVTWTGHPVGGVCPFGLENPLAVYCDVSLRHYQEVLPAAGAIHSAVRIEPERMAQLTDATWVDVCL

SEQ ID NO: 8792 - protein, 215 aa, Klebsiella pneumoniae
RLTKGIRVMKFVKIMIIASAFYLTYAHAREIHQAVDEPAAPYNLRWGMSYDEARNTPLYSLEVSDINYAGKDPDLIISTLTPQEVGALKYQEMKLYFDKNKGLKSVFVSADVDSSQQAYKVDDGREALALYNEEVKVLDREYGPATIKEEFIAERGKFYQSLAACIAKQQEWYNKRLDLNKITNCSTWQRTYKKGRVTVLLYIEPRQVSKHYIYK

SEQ ID NO: 8793 - protein, 265 aa, Klebsiella pneumoniae
LLAKGLTMFLIILIKSLIIGGLVGVGVGAGAARMFHAPTTQGMGAFRTLGELNSCEGDPASHFSFGLGFFFNAWASSVAAGSFTQDVDHRIIPNWGAAALMLKNRNVGETLHDPKKMAISCGIIGMIVVAFLNLTASSVPEALQVTAVKVLVPAANLLVNTVMPVIFWLAAIDAGKKSGFWATIFGGAAQLIMGNAVPGLVLGILIGKGVEESGWNRVTKVMMVAIVALFVLSGFFRGFDMKMIESFHLTVPNWLDMIHNSLSGK

SEQ ID NO: 8794 - protein, 107 aa, Klebsiella pneumoniae
VLKKTALSCAASPFAAIPGRQCRQQSPPPPPATPAPPASHSPFSFPPFPLSPLLPTDPTQIHLKFFSHNSLPHHSTQPNAPHPSPISTPQLFPPTLPTIIPIYSRKF

SEQ ID NO: 8795 - protein, 198 aa, Klebsiella pneumoniae
PQENTPDLLSGRPQPAQKAPPHACHRQQRPVLIGIDQCWSMDFVSDNLFNGTRFRALTVVDNFSRECVAIHGGKSLKGEYVVGVMERLRVLGKRLPVRIQTDNGSEFILKSLDKWAYEHGVTMDLSRPGKPTDNPFIESFNGSLRDECLNIHWFLSLEDAQDKLDNWRREYNHERTHSSLNDMTPAEFIRSLRKDEDL

SEQ ID NO: 8796 - protein, 981 aa, Klebsiella pneumoniae
KTPLAGWQGAGGSQRGDHRLLFNQLRFRFRVAFQLLALFSDNCFRRAGDKAFVSQLALDAANFTFDFGHFFRQTRQLIFFIDEARHRDQQLGAVDNLGHRDRTFIIGRQHGNAFQTRQVQQEAAVVVHTTLGLFAAAAQQQFQRFARSDVHFRTDVTHGDDRLLQPFGVGQRRVIHLRSIVLRERLQHDGVGGDPADRFHALPDGLGNERNDRMRQAQQTFQHGHQRMASPAQLRFAATVHNRLGQLQVPVAELVPGELVQDAGGDIEAEVIQRFAICFHGVVEFRDDPAVGQGEHHFAAVEAAILIFGVHQHEAAGVPQLITEVTVTFQTLHIPVDVAAGRGQRRQGEAQGVGAVRLDAVRELFLGTLADFIRQLRLHHVAGTFFQQLRQGDTVNHIQRVNDVTLGLGHLLAFVIADQTGHVDGLKRYLRLAIFIFDEVHGHHDHAGDPEEDDVEAGHHHAGRVELTQGVGVFRPAEGGEGPQRGGEPGIENVFILTQGNVGAQVVFLTHFVFATAYVDVAVVVIPCRDAVTPPQLTGDTPVLNIAHPGEVHIFVLLRHELNITVFNGFDCWLGQHVRAHVPLVGQHRLDHHAAAIAVRDGQVVRFDLFQQAEGVNCRNNGFTRREAFQFLELRRDLAGVDVGFIAFGVVDFRAFADVAVKGKDVDHRQLVTTTHFVVVKVVRRGDLHAAGAFFHVGVLVAHDRDAAVNQRQHHEFANQIFVARIFRVNGHAGIAQQGFRTGGGDHQVIFTVSGFRAIGQRVADVPHGTFRFAVFHFEVGNGGAQFRVPVNQAFAAVDQVFFVQANKDFFHGIGKPLVHGEALALPVHGVAETAHLTGNGAAGFRFPLPDFVDKGVAAVVVAGFPFFSGNLTLNHHLGSDTCVVGTGLPQSVFALHALVANHGIHDGLLEGMTHMQTAGDVRRRDHDAEALLAFITIRFEIALLFPVLVKRLFDILWVVCLFHYFQVAVFRLKPAMRYAL

SEQ ID NO: 8797 - protein, 67 aa, Klebsiella pneumoniae
DGRKTGDFSLARHCFQGGDQHPHRSTRKYVMKRLALALLLFISKELVVASVLTPEADHYDSYLLVDT

SEQ ID NO: 8798 - protein, 182 aa, Klebsiella pneumoniae
TMRKLNILILAALTAVSGSAMAVGFTVEQGKNFTNLNMEMGKSSSGLYAESHWLKNTDDGSQTGGVGAGYNLEVGPVMLNAGAKAIYLGPKKGDNGVAFPVGGGVNVALTDSIHVFGEGYVAPDGLNNSVKNYVEANGGVSWSPIGPVTLKVGYRHVSVDGKEGRPNHTLIDGAYVGGGVTF

SEQ ID NO: 8799 - protein, 142 aa, Klebsiella pneumoniae
PECFAMTPRRDWQLQQLGITQWSLRRPGALQGEIVISLPEHIRLVMVAETPPSLTEPLIGDILRALAVTPDQVLQLTPERVAMLPQDSRCNSWRLGTEASLPLAGAQVSTPAFDELQTSAPARRALWQQICAHEHDFYPQHG

SEQ ID NO: 8800 - protein, 665 aa, Klebsiella pneumoniae
PITLRLFTESTSGSRPFQAADTKKEILAMNAAVKRLDVICIGRVAVDLYAQQIGSRLEDVASFAKYLGGSSGNVAFGTAIQGLKSAMLARVGDEHNGRFLRETLNRAGVDTEYLITDKSRLTALVMLGIKDQETFPLIFYRDNCADMALTPDDISEEYIASSRALAVTGTHLSHANTRAAVLKALEYARRHGLRTALDIDYRPVLWGLTSLGDGETRFIESGPVTSQLQEVLHLFDLVVGTEEEFHIAGGSTDTLTALKNVRNATKATLVCKRGPMGCVVLEGDIPDSWDQVPLQQGVRVEVLNVLGAGDAFMSGLLRGWLNDESWEQACRYANACGALVVSRHGCAPAMPTKVELDDYLQRAESVPRPDVDERLNHLHRVTSRRQQWPELCIFAFDHRKQLADLARETGRDEACIPQLKLLLLAAAEAAAQEAGLDQRSGILADGTYGQRALNAITGKGWWIGRPIELPSSRPLRLEHGNIGSQLIDWPLEHVVKCLVFYHPDDPAALRAEQDALLLEVWQACNKSGHELLLEVILPENGPDKDERHYHTMLEHFYQLGIKPDWWKLPPLSSASWQQITALIEREDPWSRGILILGLDAPSDKLRAGFAEAAAHPMIKGFAVGRTIFGQPSRRWMQGELSDEALIEEVKRNYLTLISYWREARR

SEQ ID NO: 8801 - protein, 508 aa, Klebsiella pneumoniae
HHLKVTSIMSAEAHQEILRTEGLSKFFPGVKALDNVNFSLRRGEIMALLGENGAGKSTLIKALTGVYHADRGTIWLEGQAISPKNTAHAQQLGIGTVYQEVNLLPNMSVADNLFIGREPRRFGLLRRKEMEARATALMASYGFSLDVREPLNRFSVAMQQIVAICRAIDLSAKVLILDEPTASLDTQEVEMLFTLMRQLRDNGVSLIFVTHFLDQVYAVSDRITVLRNGSFVGCRETRELPQIELVKMMLGRELDHNALQRAGRTLLSDKPVAAFEGYGKKGTIAPFDLQVRPGEIVGLAGLLGSGRTETAEVIFGIKTADSGKAWIKGKPQTLRSPHQASCLGIGFCPEDRKTDGIIAAASVRENIVLALQAQRGWLRPIPRREQNEIAERLIRQLGIRTPSAEQPIEFLSGGNQQKVLLSRWLLTKPQFLILDEPTRGIDVGAHAEIIRLIETLCADGLALLVISSELEELVGYADRVIILRDRRQVAEIPLAELSVPAIMNAIAA

SEQ ID NO: 8802 - protein, 243 aa, Klebsiella pneumoniae
KELKMATPHINAEMGDFADVVLMPGDPLRAKHIAETFLEDVREVNNVRGMLGFTGTYKGRKISVMGHGMGIPSCSIYTKELITDFGVKKIIRVGSCGAVREDVKLRDVVIGMGACTDSKVNRLRFKDHDFAAIADFGMVRNAVDAAKALGVDARVGNIFSADLFYTPDPSMFDVMEKYGILGVEMEAAGIYGVAAEFGAKALTICTVSDHIRTHEQTTAAERQTTFNDMIKIALESVLLGDKE

SEQ ID NO: 8803 - protein, 278 aa, Klebsiella pneumoniae
KIMKLIANGLNKQFFSSFLPPPDCEIDGVVAAIAYGDDKTALLDHCLKNHHRLDIWMRYDHTVPVSPSLLAKFLANTKNNIFCKLVPDRLHSKVIWWKGYGAYIGSANLTDRAWHTNIEAGIFFTESDLYSSNLIEQLEEFFDSLASLDCCVDLSDDIINEQRLLLKSKLELEKKEQELIKKRKVPEWGGVNFIDNKKSKDKRKESFHKEWESTLSIIQNISSQINDYRPIWVSEDTPMFWQNDHFYMLITISKFISKIILILLRIFIVLTVKTHKQH

SEQ ID NO: 8804 - protein, 119 aa, Klebsiella pneumoniae
VIALGHHITGLMSNHNPLAHELIGASELAGDRAWRLPLADEFQDQLESNFADMANIGGRPGGAITAGCFLSRFTRKYNWAHLDIAGTAWRSGKAKGATGRPVALLSQFLLNRAGFNGEE

SEQ ID NO: 8805 - protein, 81 aa, Klebsiella pneumoniae
SAPNADDGKIFSHCAPASSALNASEAVAQPAHTSIPLSTARRITAGAVLGVTISFAPASARKSTCSTFSTVPAPIIARSPN

SEQ ID NO: 8806 - protein, 98 aa, Klebsiella pneumoniae
TTAKPRRNRPMIPRTHRQLVSVEVMWPAQTLPLPLQQAVEALTQGETPDQIIARMNLQGFQAWREATSPQGEHDIFQIRLDEAHEARFLCRYITLPLH

SEQ ID NO: 8807 - protein, 561 aa, Klebsiella pneumoniae
KEAKSNVAQFVYTMHRVGKVVPPKRHILKNISLSFFPGAKIGVLGLNGAGKSTLLRIMAGIDTEIEGEARPQPGIKIGYLPQEPQLNPEHTVRESVEEAVAEVVNALKGLDEVYAKYAEPDADFDKLAAQQGKFEEIIQAHDGHNLNVQLERAADALRLPDWDAKIANLSGGERRRVALCRLLLEKPDMLLLDEPTNHLDAESVAWLERFLHDFEGTVVAITHDRYFLDNVAGWILELDRGEGIPWEGNYSSWLEQKDQRLAQEASQEAARRKSIEKELEWVRQGAKGRQSKGKARLARFEELNNVEYQKRNETNELFIPPGPRLGDKVLEVSHLRKSYGDRVLIDDLSFSVPKGAIVGIIGPNGAGKSTLFRMMSGQEQPDSGTITLGETVKLASVDQFRDAMDNSKTVWEEVSGGLDIMKIGNTEMPSRAYVGRFNFKGVDQGKRVGELSGGERGRLHLAKLLQVGGNVLLLDEPTNDLDIETLRALENALLEFPGCAMVISHDRWFLDRIATHILDYQDEGKVEFFEGNFTEYEEYKKRTLGADALEPKRIKYKRIAK

SEQ ID NO: 8808 - protein, 72 aa, Klebsiella pneumoniae
RNKKKTKKIKVFLYRHALVEARHFLGLYRKKVMDNSHVKTSFNKSISFISLFQGISSLSDIFFFIKLMRKIF

SEQ ID NO: 8809 - protein, 344 aa, Klebsiella pneumoniae
KERKSIMSTLRLLLSDSYDPWFNLAVEECIFRQMPATQRVLFLWRNADTVVIGRAQNPWKECNTRRMEEDHVRLARRSSGGGAVFHDLGNTCFTFMAGKPEYDKTVSTAIVLAALNSLGVTAEASGRNDLVVKTDSGDRKVSGSAYRETMDRGFHHGTLLLNADLSRLANYLNPDQKKLQAKGITSVRGRVANLVELLPGITHQQVCEAIQEAFFSHYGERVDAEVISPDNTPDLPNFAETFARQSSWEWNFGQAPAFSHLLDERFRWGGVELHFDVEKGHITRAQAFTDSLNPAPLEALAARLVGCQYRAEVLQQQCEALVGDFPEQEAELKELSAWIAGAVR

SEQ ID NO: 8810 - protein, 83 aa, Klebsiella pneumoniae
TSGKRKQGMSSDIIIIDDKPASAQAANLFEMGRANSKNKGARTAPLESDYASNGSRRIIVSVRSGPVEMISTGTPVSSSIRWM

SEQ ID NO: 8811 - protein, 184 aa, Klebsiella pneumoniae
GMPDMNTALSPVSSQPELFPLAVMAQHDYLLTATSGLTPYAQRTIRRATNLLDKYLRQPGISFTSSTAARDWLRLQLAGQEREVFMVLYLDNQHRLLESETLFAGSINHVQVHPREVVKSALRFNAAAVVLVHNHPSGDPEPSQCDRNITGRLKEALALVDVNTLDHLVIGSDGIVSFAERGWI

SEQ ID NO: 8812 - protein, 150 aa, Klebsiella pneumoniae
FYYEAAIDIICYRCIVNAQGFQGGNMRILSLFLVVFALTGCSGTTIGGNEDKLTPAYLKQHLIVGKTTKAEVRQYFGAPDSGHTTVTASGKESWYYSVDKGINLVSLAGSMIPVTGASQAADAVDKSSQKDSNSLMIFFDEKGVVENWVR

SEQ ID NO: 8813 - protein, 201 aa, Klebsiella pneumoniae
RMNDPILEYRLKRLEERIGDDRFLKNQGSGNEIGFWIFDYPAKQELQVREYLHFLFKKLDKKYTYRTLNIFQVIIDMLEERKLFDRICQREPELGLETLKKHLAAPLSQKKIAEYIARTVDLPAQQFVILTGLGNAWPLVRGHELMSALQDVMGFTPLLMFYPGTYSGYDLSPLDGIHSRNYYRAFRLVPETGPAATLTPR

SEQ ID NO: 8814 - protein, 549 aa, Klebsiella pneumoniae
CRSDSRHAARHHFNLPGDGVDIGQVGAGNFNADRALDAGGEHVDAVADRRHPQVRQSRQAHGFIQLLDDLLHGHPRSPLILRLELNGGLHHLQRRRVGGGFGLAGFAEHPCHFRHRHDQLIGFLQHIRRLRSGDPRQRGRHIQQVALVDLRQKLAADPVKRPDNRQDRQERDQQGGLRPVQDLQQQRVINADQKAVQRIAALRRDLAADPEAHQDWDRHDRQQRRPGHRPGFGEGQRTEQFALLAFEGENRDKRQGDDQQADKQRRADLHRGLGNDFPACVVAELLSRVLMFPLLQPLMGVLNHHDGGIDHRPHRNGDPAQRHDVGVEPLEMHHDKGEAQAERQGDNRHQRRAHVPQEQGADQGDDDKLFQQLVAEVVDGAVDKLAAVVGGDHFHPFRQAALQRRQLLFDRGDHLAGVLAGAQDHHAAGHFAFAVKLGDSAAHLRADLHPRDVAKIDRHAVIPGLQYDIFEVVERLQVAAGAHHIFGFRQFDGRAARLLVRGVQRRFHLAEADAVLGQLHRVDDNLVLLDHTAHRRHFRDVRNGFQLIF

SEQ ID NO: 8815 - protein, 388 aa, Klebsiella pneumoniae
AVGELPALAGPLRRPVAVRRKHQLPNGRALTAMLSLQNISKRFDGKPALSALSLDIHEGEFVVLVGPSGCGKSTLLRLLAGLEPVSEGQIWLHNENITAATPRERNFAMIFQNYALFPHLSVRDNITFGMKVRKEEKSSWQPRVDKVAQMLQLEALLDRKPAKLSGGQRQRVAMARAIVRNPRLFLMDEPLSNLDARLRSEVRDSIMALHQQLKTSTIYVTHDQTEAMSMADRIVVMNGGHVQQVGRPEYLYANPANLFVAGFIGSPAMNLLSLPCANGEVLLGEQRHPLPPRHRDQTRVWLGVRPEHITDRVEEGHLRLPATVLQRELMGADYLLHVSTPIGTLRFSRRHRGTVPEKGESLPIGFSPADVHLFHAETQHNLAPVHQA

SEQ ID NO: 8816 - protein, 96 aa, Klebsiella pneumoniae
FTGDGLYFTHRALPRIFNSNQILIGFDLCCHWIFKIAILFSINFTKGCASSLRGSSIHKGCALFYLYDLKMFNYVSALLIGNSHNEIEDYCGARHI

SEQ ID NO: 8817 - protein, 118 aa, Klebsiella pneumoniae
NVCLDQQRAGNARAEYQFSLRGANGMEKNSTTRHVAIVEKCVMTEMAWRYIFSREDNRRYHIHLFKNVSMLRAAEIPFPWSTIIFSLSGSRSSRAESLLFVHEMARCRPEVQTFICGY

SEQ ID NO: 8818 - protein, 74 aa, Klebsiella pneumoniae
RPCEGANMHMLKFYLVSTGNRHFITSNESATGEPLIMLEGCTLSNTVKPEHVSGFTVWGGTEGDRSNGMLVYFM

SEQ ID NO: 8819 - protein, 182 aa, Klebsiella pneumoniae
RGGENSGHGSGVGQPGRSPKSIAWPDQDASAVQYSGFPPGRTKPSASANGTILPSVDSATRTLQLRLQVNNPDEALKPGMNAYLQLTSESEPMLLIPSKALIDSGSEQRVITMDNEGRFVPKRVQVFHESNGVTAIRSGLQEGEKVVASGLFLIDSEANIAGALERMRAQAPDAAAPAAHAH

SEQ ID NO: 8820 - protein, 420 aa, Klebsiella pneumoniae
ALGDLILFPAGDRPQPAALRLQGENDIFPHRGSGDNAVGFAILRTEADPEAGRLMRGAQGLRFAFDPRLPAVRRFNAEDHFGGFRASGTQQAGEAYNFTRADLQVERGDGSFFTVAFKRRYRFIAQQGTARPLQGIVVQFATQHHFHQLNLRQLAGLTAADEAAVAQHGDAVADRIDLVEKMGDEDQADAVIPELAHQGEQHLHLLGIEAGGGLVEDQHLGRQVDGPTDSDDLLHRHRKAVQRLAHVEGKAVGGHQRRRSGLHLFTSQQTKPPRFTADEQVIRHRHIGQQVHFLVDGADPQLLGMGGIFGRNSLAFQPDSAAIGMVNAGQRFDQRRFSGAVFAQQGHDFAAPQAKVDVIQRLNAGEEFTKSFGAKDLLVCLGAHNRCHLQMMSGYPGSRWASRGFWNAAFYPLPPGRGME

SEQ ID NO: 8821 - protein, 254 aa, Klebsiella pneumoniae
RPGDGRPPQQLNGRHMASLTLKNTALILGSMLIGGALTAALYIRLTPTHSAAPAAEQQRKVLFWYDPMYPNTRFDKPGKSPFMDMDLVPKYADEESAAAGAPGVRIDPTQTQNLGVKTAAVTRGPLRYAQTFPANISFNEYQYVIMQARAAGFINEVYPLTVGDKVKQGTPLLELTIPDWVEAQSEYLLLQETGGTATQVEGILERLRLAGMPDDDIRRLKATRKIQTRFTLKAPIDRVITAFDLRAGNEHRQR

SEQ ID NO: 8822 - protein, 89 aa, Klebsiella pneumoniae
YSIELIYISILYPIGQDHSAYYFEPRMIFPIKACFDSGTSRRLCDFMEEMYSHTASFSETNLPHKSLFLHGAMEFCKIKRTYSLLSVSI

SEQ ID NO: 8823 - protein, 764 aa, Klebsiella pneumoniae
AVSELLSIALFLASVVLYAWKAGRNTWWFAATLTVLGLFVVLNITLYASDYFTGDGINDAVLYTLTNSLTGAGIGKYILPGVGVAVALVAVFGALGWVLRRRRHHPHHVGYSLAALLLALASVDASPAFHQISELVKSQSREGDPDFAAYYKEPSKQIDNPQLNLVYIYGESLERTYFDNDAFPNLTPELGRIKAEAIDFSNTMQLPGTDYTIAGMVASQCGIPLFAPFEGNASASVSSFFPQNICLGDILKNSGYENYFVQGANLRFAGKDVFLKSHGFDHLYGAEELKTTVADPTYRNDWGFYDDTVLDETWKKFEELSQSGKRFSLFALTVDTHHPDGFISRTCERKRYDVDGKKNLSFSAVSCSQEHIAALIEKIKASPYFKNTVIVVSSDHLAMKNSAWDYLNKHDRSNLFFVLRGDKPQQETLAVKRNTMDNGATVLDILGGDNYIGLGRSSLSGQSLSGIFMNMKEKVLAWKPDVIRLWNFPKEMKNFTIDSQKNMIAFSGSHFRLPLLLRVSDQRVEPLPESEYSAPLRFQLADFAPRDNFVWVDRCYKMGQLWSPELALSTDWCVSQGQLGGEQKVQHVDKPQWHGKTAFRDTLIDMERYKGNVDTLKIVDNDIRYKADSFVFNVAGAPEEVKQFSGISRPESWGRWSNAQLGSDVKIEYKEPLPEKFDLVITAKAYGPNANKPIPVRVGESEQVLTLDNDVTTTTLHFDNPTRSNTLIITPPDPQTTNEGNILGHSPRQLGIGMVEIKVVKSEG

SEQ ID NO: 8824 - protein, 529 aa, Klebsiella pneumoniae
TGADGARQRAAPQPARLRLRSGFRPFNHPRRTPLTAGARPMNTFRQDSLAGIVVFLVALPLCLGIAQASGLPPFVGLLTGIIGGLVVTALSPSRFAVSGPAAGLVTIVVAAIESLGSFSVFLMALVLAGVLQLLFGILRAGRFISLVPASVIKGMLAAIGILLIMQQIPVALGTAEETGLADVVQGNAAFSVKAIAVAAGGLLVLWLWGSPLIRRVKSLRWIPGPLIAVLLGCVTTLLLTHFAPQQLAALPRITLPAFGSLGDLLGELESPAWNAWRNPSVWVVAVTLALVASLETLLSQEALKKLRPQNPPPSPNREMVAQGVGNLLSGVLGAMPITAVIVRSSVNVSNGAQSKLSIFIHGVLLLICGLWFSGLLTLIPLASLAAVLLYTGYKLATPRLFIEQFRQGAAQYVPFLATIGGIIACGMLAGIGIGLATQMAFSLWRSHRHSLQLARYDDHYVLRIQQNLTFMHNPHLLALLAKIPEKSVVIVEHDSVGYLDPDVRAVLDDFAENAPQRGIRLNQWPLASR

SEQ ID NO: 8825 - protein, 364 aa, Klebsiella pneumoniae
RSGLMQAFGVLDRYIGKTIFNTIMMTLFMLVSLSGIIKCVDQLKKSGQGSYDALGAGLYTILSVPKDIQIFFPMAALLGALLGLGMLAQRSELVVMQASGFTRLQVALAVMKTAIPLVLLTMAIGEWVAPQGEQMARNYRAQQMYGGSLLSTQQGLWAKDGHNFVYIERVKGNDELGGVSIYAFNPERRLQSVRYAASAKFDSENKVWRLSQVDESDLTDPKQVTGSQMVSGTWKTNLTPDKLGVVALDPDALSISGLHNYVKYLKSSGQDPGRYQLNMWSKIFQPLSVAVMMLMALSFIFGPLRSVPMGVRVVTGISFGFIFYVLDQIFGPLTLVYGIPPIIGALLPSASFFLISLWLMMRKA

SEQ ID NO: 8826 - protein, 198 aa, Klebsiella pneumoniae
IMKDYKPRYEELYRYYQVWLTDFTKLTVRSGMCHQNIYHHHTLTVGSLKFPGEEEVIAIVPQCLHRIIYGRAAAPLTVNEDLSVSLFTQEHLLAHHPMLEGILLSECVRLKQRPLANKLISLFRQFSGSELRLKLVWLCWYDLMLGNCLDDWTDNLRFKKDKEMDIWINDRQAENPALTSMMDEYVCFAWRTTAEPLS

SEQ ID NO: 8827 - protein, 348 aa, Klebsiella pneumoniae
QNRDEEIRHYGRHRDPFLYPNHSRREDSAMNTQPVIGISGCLTGSAVRFDGGHKRMGFVMDELAQWVAFKPVCPEMAIGLPVPRPALRLVQTPVGEIRMRFSHAPHEDVTEKMADFANAHLATLGELSGFIVCAKSPSCGMERVRLYDEKGNRGRKEGVGLFTGALMARYPWLPVEEDGRLHDPLLRENFVERVFALHELNALRARGLTRHGLLAFHSRYKLQLLAHHQAGYREIGPFVASLHEWEDLEAFFEVYREKLMAILKQPASRKNHTNVLMHIQGYFRDQLNSRQRGELREVILNYRAGLLPILAPLTLLKHYLAEYPDRYLQAQNYFDPYPQDLALRLTVN

SEQ ID NO: 8828 - protein, 151 aa, Klebsiella pneumoniae
GDSLMNTQNHQFAKHTAITASVVPDELRIGFWPQHFGSIPQWITLEPQIFAWMDRLCADYHGDIWNFSTLSNGGAFMAPESEHDEKWALFNSMNGNGAELTSEAAGIVACLMAYSHQAWRTECDTMTVHYYRLRDYALNHPECSDIMHIID

SEQ ID NO: 8829 - protein, 74 aa, Klebsiella pneumoniae
PWQERRMKIFQRYNPLQVAKYVKILFRGRLYIKDVGAFEFDKGKILIPKVKDKLHLSVMSEVNRQVLRLQTEMA

SEQ ID NO: 8830 - protein, 499 aa, Klebsiella pneumoniae
KRKDCHLIGNAYTGVPAWTRGCLMPDFLSFINEILWGSVMIYLLLGAGIWFSWQTRGIQFRYVRKFGRSLKKSLHPQPGGLTSFQALCTSLAARVGSGNLAGVTLAIAAGGPGAVFWMWVSALLGMASSFAECSLAQLYKERDSRGQFRGGPAWYMARGLGMRWMGVLFSILLLLAYGFIFNTVQANSVAHALRYAFDLPAAVSGGVLAVVVLLAILRGLRGVARLMQWIVPFMALLWIATSLLIGLWHITALPTIFATIFRCAFGWQEAAAGAVGYTISQALTSGFQRGMFSNEAGMGSSPNAAAAAASWPPHPAAQGVVQMIGVFIDTIVICTASAIIVMLAPRPDNEYTLNGIQDLQHAMSVLVGGWGAGFIALIVLLFAFSSIVANYVYAENNLVFLRLDKPRYIWGLRILTVLMVLLGTMVSLPVVWQSADIIMALMAMTNLTAILLLSPTVRIIASDYLRQRRLGIQPTFDATRYPDIDQQLAPGAWNELPRE

SEQ ID NO: 8831 - protein, 275 aa, Klebsiella pneumoniae
SAKESAMSLLAKSRKEGQIQHITPQSAGWRYIGFDVWMLKKGQTVTLESGDRELCLVLVAGLASVKTQHADFPNLGKRMSPFERTPPWSVYVPPQDKVEVTADSDLELAVCSAPGKGRFPARLIRPEDVGVEHRGKGRNQRRVHNILPDSAEADCLLVVEVYTDEGATSSWPSHKHDTAQPGKETQLEETYYHRFDPPQGFAFQRVYTDDRSLDACMAPYNHDVVMVPRGYHPVAAIAGYDSYYLNVMAGPDRKWLFTWEDDHAWINTPEYPRHD

SEQ ID NO: 8832 - protein, 104 aa, Klebsiella pneumoniae
VAEEVSPELDPHLVTKIGDFLELTGIALGHAKQLSRGQSDKLMFRQGKFAKTQRRAHTERAPVRRAAVERRRQRELFLKRSGEGLLGVETVLQRNIKDWTGGQA

SEQ ID NO: 8833 - protein, 324 aa, Klebsiella pneumoniae
PYEDTLMWKRLLLVTAVSAAMSSMAIAAPLTVGFSQVGSESGWRAAETSVAKEEAAKRGITLKIADGQQKQENQIKAVRSFIAQGVDAIFIAPVVATGWEPVLKEAKEAKIPVFLLDRSIDVKDKDLYMTTVTANNVLEGQLIGDWLVKTVDGKPCNVVELQGTVGASVAIDLKKGFADAIAKASNIKIIRSQSGDFTRSKGKEVMESFIKAENNGKNICMVFAHNDDMAIGAIQAIKEAGLKPGKDILTGSIDGVPDIYKAMIAGEANASVELTPNMAGPAFDALEKYKKDGTLPEKLTITKSTLYLPDTAKEELEKKKNMGY

SEQ ID NO: 8834 - protein, 212 aa, Klebsiella pneumoniae
KNEDITMTRLKNANMLLALFLGLAALNASAETEKTTVDSAKSAASNAGEAVDNSINKVGDFMDDSTITARVKAALIDHKDINSGDISVKTENKVVTLSGDVTSAEQKSQALSVAKEVKGVSHVNDKLTVHHKSSSETATLKGYAGDTAITSEVKAKLLADDIVPSRNVKVETNAGAVHLTGTVASAAQAERAAEIAKAVSGVKSVRNDLSVK

SEQ ID NO: 8835 - protein, 199 aa, Klebsiella pneumoniae
SRRDLCRERSVSLQTNKIIQLFFHYFIVLNNKSFITRFEDNIMRLPYVIFTLAMLASVSTAQAIPNMWTSGFGMGVTEYIITSPDKVVFNLNCTGNPDAQNILQHGVDLTLPDGTSVSSQDDGTEITVVMDSSQYPLPSFLGWRNGDNAWVSFIDALSQAANFDVYVNDKKVGTFSPGLKNTQKELSDLSGCRTTHYSD

SEQ ID NO: 8836 - protein, 338 aa, Klebsiella pneumoniae
KCRERVMKTLGEFIVEKQHEFSHATGELTALLSAIKLGAKIIHRDINKAGLVDILGASGAENVQGEVQQKLDLFANEKLKAALRARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGNTYSINEGNYIKFPQGVKKYIKYCQEEDKATQRPYTSRYIGSLVADFHRNLLKGGIYLYPSTASHPEGKLRLLYECNPMAFLAEQAGGKASDGKERILDIIPESLHQRRSFFVGNNHMVEDVENFIKAFPDA

SEQ ID NO: 8837 - protein, 314 aa, Klebsiella pneumoniae
AGRDEPMAKGTTSTPHDAVFKQFLTQADTARDFLAIHLPPALRQRCDLDTLQLESASFIEESLRAWYSDVLWSLKTASGEGYIYVVIEHQSSPDAQMAFRLMRYAIAAMQRHLDGGHTKLPLVVPMLFYHGATTPYPWSLNWLDCFADPQLASELYISPFPLVDVTVIPDDEIVRHRRVALLELIQKHIRQRDLMGIVEQLTTILLSGDANDRQLKTLFNYLLQTGNARRFGRFIHEVAQRVPQHRERLMTIAERLQEVGRRKGKREGRLEGRQEGQHAEALRIAQRMLDDGIARETVVKITGLAADEIAALAH

SEQ ID NO: 8838 - protein, 203 aa, Klebsiella pneumoniae
RHSLNGITMNTLRIGLVSISDRASSGVYQDKGIPALEEWLARALTTPFELQTRLIPDEQAIIEQTLCELVDEMGCHLVLTTGGTGPARRDVTPDATLAIADREMPGFGEQMRQVSLHFVPTAILSRQVGVIRKQALILNLPGQPKAIQETLEGVKDADGNVLVHGIFASVPYCVQLLEGPYVETDGRVVEAFRPKSARRETLS

SEQ ID NO: 8839 - protein, 515 aa, Klebsiella pneumoniae
FALLIHLPGRLPPRLNQPGDAMEPFLSLRHVSKTFHANRALNDISIDFMPGEVHCLAGQNGCGKSTLIKIISGVYRPDEGAAMTLGGKTWPKLTPAASVAHGIQVIYQDLSLFPNLSVWENIAINHYHRGVLVRRSELRRSAEQAMRSINVSLPLDAAVESLSIARCQLVAICRALAQDARLIIMDEPTASLTHQEVEGLLHVVRQLRERGICIVFVSHRLEEVMAVSDRISVLKDGNLVGTLPAAEVTTRRLGFLMTGQEFDYQVRDLWQGQGSTPVLEVRNLSRKGEYHNVSLKVEAGEVVSIVGLLGAGRTELCLSLFGMTRPDSGEILINGQPVRLRSNQDAIRHGIGYVSEDRMSRGLVMSQSIENNIISTVFHKVKGACGLLSDSKAQQLVARMVNALTIKAPDTHLPVNTLSGGNAQRVSIAKWLAISPKLLILDSPTVGVDIANKAGIYHIISDLAAHGIAVLMICDEIEEAWYQSHRILVMKQGELTHSFLPDSSTQQQIAEVVNG

SEQ ID NO: 8840 - protein, 1259 aa, Klebsiella pneumoniae
IMSLWKKISLGVLIVLVLLLGTVGFLVGTTTGLHLVFKAADRWVPGLEIGKVTGGWRDLTLDNVRYEQPGVAVTAGQFHLSVRLRCLWDSSLCVNDIALRDIYVAVDTKKMPPSAPVEEEDSGPLNLSTPYPITLSRVALHNVNVKIDDTAVSVRDFSTGLNWQEKNLTLTPTSLQGLLIALPKVAKVAQEQVVEPKIDNPQPQEKPLGETMTDLFSQPVLPAMTDVHLPLNLNIQAFRGEQLRLTGDTDITVYNLLLKVSSIDGQMKLDALDIDSDQGKVSASGSAQLQDNWPVDITLAGTLNVDPMKGEKVQLKVGGEVRKTLKVGVDLSGPVVATLRADAQLAEAGLPLNMELKSKQLAWPFSGEKQFQADDVQLKFSGKMTDYALAFSTAVKGQSLPSAKIDLNAKGNERQINLDKLTVNALEGKTELKALLDWQQAISWRGELTLDGINTAKEVPDWPSKLNGRIKTQGSLYGGSWQMSVPELKITGNVKQNKVDVAGSLQGNSYLQWKIPGLHLALGPNSADIKGELGVKDLNLDATIDAPHLDNALPGLGGTAKGLVKVRGTVDAPQLLADITARALRWQELTIAQVNVKGDVKSTDQIGGNLDVRVDRISQPGVNISQVQLNAKGTEKQHELRLRVQGDPVSGQLTLAGSFDRQAERWKGSLSDTRFQTPVGPVALTRSIALDYRNLEQKISIGPHCWTNPNAELCVPETIDAGASGRARVNLNRFDLAMLKPFMPEATQASGVFTGNADVSWDTTKEGLPQGKVTLSGRNVKVTQVVNDAPLPVAFDTLNLSADLHNNRAELGWLIRLTNNGQLDGQVQVTDPQGRRNLGGNVNISNFSLAMINPIFARGEKAEGRLNARLRLGGNVKSPQLFGQMQLSGVDIDGNFMPFDMQPSQLAMNFNGTRSTLQGTVNTRQGQIALSGNADWTQIDNWRAQIAAKGSRVRITVPPMVRLDVSPDVVFTATPSLFNLDGKVDVPWARIVVNEVPESAVGVSSDEVMLDKNLKPIKQQSASIPINSNLTIHVGNNVRLEAFGLKARLTGDLKVAQDKQGLGLNGQINIPDGRFHAYGQDLIVRKGELLCSGPPDQPLLNIEAIRNPDATEDDVIAGVRVTGSADQPKAEIFSDPVMSQQEALSYLLRGQGLSSGQSDSAAMTSMLIGMGVAQSGQVVGKIGETFGVSNLALDTEGVGDSSQVVVSGYVLPGLQVKYGVGIFDSLATLTLRYRLMPKLYVEAVSGIDQALDLLYQFEF

SEQ ID NO: 8841 - protein, 238 aa, Klebsiella pneumoniae
MIALEMRNLGGGEILHACPQESLDKPLPCIVFYHGFTSSKLVYSYFAVALAEAGFRVIMPDAPEHGARYQGDEAGRMQRFWPILQQNFREFPALREAIIAEGWLEGERLAVAGASMGGMTALGIMTHHPELNSVACLMGSGYFRSLSQTLFPSPDFDVDSLNEWDVSHQLASLARRPLLLWHGDADDVVPPEETFRLEQALRQGDLAARLTCVWQKGVRHRITPEALATTVAFFQQHL

SEQ ID NO: 8842 - protein, 924 aa, Klebsiella pneumoniae
QVGFATPVGNAAFALASAEGLFMLKNYTRQLFAQLSRHLPRRLVQRDPLPDARHLASGPIPESLGQHCLNVAAMDDQEIWRAFDSHPEGLNEGEVAAKILKHGDNQIPAQKPSPWWVHLWTCYRNPFNLLLTVLGIVSYSTEDLFAAGVIALMVGISTLLNFIQEARSTKAADALKAMVSNTATVLRVVNEQGESRWLELPIDQLVPGDIIRLSAGDMIPADLRILQARDLFVAQASLTGESLPVEKVARSRDPLQQNPLECDTLCFMGTNVVSGSAQAIVFATGGRTWFGQLAGRVSEQESEPNAFQKGISRVSMLLIRFMLVMAPVVLLINGYTKGDWWEAALFALSVAVGLTPEMLPMIVTSTLARGAVKLSKQKVIVKHLDAIQNFGAMDILCTDKTGALTQDKIVLENHTDVSGKVCERVLHAAWLNSHYQTGLKNLLDTAVLEGVELDAARGLAERWQKVDEIPFDFERRRMSVVVKEDDAAHQLICKGALQEILNVSTQVRYNGDIVPLDDTMLRRIRRVTDTLNRQGLRVVAVATKYLPAREGDYQRADESDLILEGYIAFLDPPKETTAPALKALKASGITVKILTGDSELVAAKVCHEVGLDAGEVVIGSQIEAMSDDELAALAKRTTLFARLAPLHKERIVTLLKREGHVVGFMGDGINDAPALRAADIGISVDGAVDIAREAADIILLEKSLMVLEEGVIEGRRTFANMLKYIKMTASSNFGNVFSVLVASAFLPFLPMLPLHLLIQNLLYDVSQVAIPFDNVDDEQIRKPQRWNPADLGRFMVFFGPISSIFDILTFGLMWWVFHANTVEMQTLFQSGWFIEGLLSQTLIVHMIRTRRIPFVQSRAAWPLFAMTLVVMAVGIALPFSPLASYLQLQALPLSYFPWLVAILAGYMVLTQAVKGFYSRRYGWQ

SEQ ID NO: 8843 - protein, 574 aa, Klebsiella pneumoniae
KRQLALPFCVLFRDTFVLDSLRLQRVGAESAFLVLFVLGKVTFEELNLTFILVIQNVGGNTVKEPAVVRDNHRAARELQQGVFQRAQGFDIQVVGWFIEQQDVTADLQQFRQVQTTTFTAGQLANAFTLVDAFEVKTAHVGAARHLGVADLHDIQAARHFFPHGLTVVHRVAELIDGSQLNGFTQGDGAGIRLFLAGHHAEEGGFTRAVRTDDADDSAFRYREAQIVNQNAVAVGFAQMADFQNFIAQTRARRNEQFVSLVTFLIFNVVKLFKARQAGFALRLTAFRALANPLEFFLDRFAACGFLRSFLRQTLVFLLQPGGVVAFPRNTFAAVKLEDPAGDVIKEVTVVGNRHHGAFEVVQEAFQPGDGLGVEVVGRFVEQQHIRFFQQQTAQRDAAAFTTGKISDFRIPVRQAQGVGRALQLDVQVVAVVRLDNLFELALLCGKLIEVRIRLGVFGIDFVQPLQRVNHFGDRFFHGLAHGVLRVELRLLRQVADFDAGLRTRFTFDLGVDTGHDAQQGRFTGAVQTEHTDFRAREKAEGDIFQNMTFRRNHFADTMHGINELSHVGLRLFLF

SEQ ID NO: 8844 - protein, 419 aa, Klebsiella pneumoniae
SLFCSARCMENKMKRAFIMVLDSFGIGATEDADRFGDVGADTLGHIAEACAKGEADHGRKGPLNLPNLTRLGLVKAHEGSTGKIAAGMDGNAEVIGAYAWAHELSSGKDTPSGHWEIAGVPVLFDWGYFSDQENSFPQELLDKLVKRANLPGYLGNCHSSGTVILDQLGEEHMKTGKPIFYTSADSVFQIACHEETFGLDKLYELCEIAREELTEGGYNIGRVIARPFVGDKAGNFQRTGNRHDLAVEPPAPTVLQKLVDEKNGHVVSVGKIADIYANCGITKKVKATGLDALFDATIKEMKEAGDETIVFTNFVDFDSSWGHRRDVAGYAAGLELFDRRLPELMELVGEDDILILTADHGCDPTWTGTDHTREHIPVLVYGPKVKPGSLGHRETFADIGQTIAKYFGTSDMEYGKAMF

SEQ ID NO: 8845 - protein, 92 aa, Klebsiella pneumoniae
YMKLKIIAMMAALFFSANALAAIQITERQARNMDDVQSLGVIYINHNMATEHEAEQALSQMSDAQGAKYFQPILMHEPETNGPLRASAVIYR

SEQ ID NO: 8846 - protein, 427 aa, Klebsiella pneumoniae
PMKLYNLKDHNEQVSFAQAVTQGLGKHQGLFFPHDLPEFSLTEIDDMLAQDFVTRSAKILSAFIGDEIPQDVLQQRVRAAFAFPAPVSKVQEDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKATLGLNSANSINISRLLAQICYYFEAAAQLPQEARNQLVISVPSGNFGDLTAGLLAKSLGLPIKRFIAATNANDTVPRYLQGGEWAPKATQATLSNAMDVSQPNNWPRVEELFRRKIWRLSELGYAAVDDETTKAAMRELKAIGYISEPHAAIAWRALRDQLQPGEYGLFLGTAHPAKFKESVEEILQETLPLPKELADRADLPLLSHNLPADFAALRKLMMG

SEQ ID NO: 8847 - protein, 190 aa, Klebsiella pneumoniae
  UNSURE (23),(24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(59),(60),(61),(62),(63),(65),(66),(69),(70),(71),(72),(73),(74),(76),(80),(81),(82),(85),(86),(90),(132),(142),(143),(144),(151),(160),(162): Identity of amino acid at the above locations are unknown.
PDVWLTVSWRKHLDKPSHHTGSXXXXXXXXXXXXXXXXXXXXXXXXXXXXXXXXXXRVXXXXXGXXGGXXXXXXGXGRGXXXKEXXGKEXEGKKRGGEERREGKRRRGGGRRGERKEKKGGERERGREKKEXGGEGEKGRRXXXGGREEGXRKGGGEERXKXREREGGEKGREKEEIWEGEERRMERRGT

SEQ ID NO: 8848 - protein, 95 aa, Klebsiella pneumoniae
AVHWEALTMMNKKFWIRWVSIALICAAYYATVLYFDLVFALNFTETISQGGEFTPSQCTRFVKELAQNHSDSALASIIGFAVCVPLILLIFKKVK

SEQ ID NO: 8849 - protein, 231 aa, Klebsiella pneumoniae
GGLCTIIEATMHTLSTLFPAVFPALALSHFVALLSPGPDFFLLIGYAVRYRIRGSIGLCLGIAAGNALYIVLAIVGWGLLRQAPLLFLLIELLGAGYLLWIGSLLIRSRPATLAMESVRAARPGFGRQLLLLGLGSSLLNPKNALFYLALMTSLLGPAVTLLQQTVSGLWMVSVVFFWDLLLVSAIALPQIQRRLGAIVWRVERAAGAILMLFGLGIIWRFLHDLAVRLYA

SEQ ID NO: 8850 - protein, 965 aa, Klebsiella pneumoniae
RWIWPTRSRLSQECALDRKKTARAVDKPLFSRIISLRNGEEGDAMRKTELLAFLQNQTDFFDPDNLSEVFTASWLARRFAMQRNTASHYLNQLVAQDVLVKINTRPVYFLHKKAFCQQFYPLSRSEYASMAELLAESDRQPEQADHFSLLTGHDGSLRKPIEQMKTALFYPNGGLPLLITGDSGTGKSYMAELMHEFAIAQGLLAPDAPFVSFNCAQYASNPELLAANLFGYVKGAFTGAQSDKAGAFEAANGGMLFLDEVHRLDAQGQEKLFTWLDRKEIYRVGETAQGLPISLRLVFATTEDIHSTFLTTFLRRIPILVSLPDLQHRSREEKEALTLQFFWQEARTLAARLQLTPRLLQVLTQYVYRGNVGELKNVVKYAVASAWARSPGREMLTVTLHDLPENVMAATPALSEAMGQQEPLLIEPQTSLVWLLRARDPVQGLIYDVQCRVLAQYEAVLNKKTVWEEAQRSMGEEIETLFDRLIFDNHDSSSSQMLLLIAHQVREEYYRLEKRFNIQFNGNCLYALSHYLIHRSRQPQSTINNEKARQLEDFLVQKFPLLYRFCEAILGALTLKLDIEPQRIDLLLLVLWFHKNGAISQQQVTRAIILAHGYATASSIANVANRLLKSQLFESFDMPLDVTPEAIANQVMAYIESHALASGLIILVDMGSLNAIHRHFNRRLSTPMAIINNVSTGMAMYVGERILQGVMLEDIVREIGDDLAIEHQLYYPQTDKPRAILTTCATGLGAAANLSALLKASIPEALGIDIVACDVETLADPARREPMLSRYEVLAIVGTLDPHLADLPWISLDSLISGEGSRPLMRIFGELATAEQVSEINNLILKNFSLRRVIESVTILDTAKVINQVEQFLLRYEHLAGRDVPNDRKVALYVHISCLIERLIRHASPAQYTGGQCPDRELATLREAFSVIESGYSVKIPVVELCYIHDILTRETEFIQEDQDF

SEQ ID NO: 8851 - protein, 107 aa, Klebsiella pneumoniae
RRSCRWALWLACLSVSRWGLACSAGWPLKLKWASLPEATTCKQIMAVGILCGIGFTMSIFIATLAFGSVDPALINWAKLGILIGSVLSAVVGYLILRQRVTDTRLAV

SEQ ID NO: 8852 - protein, 258 aa, Klebsiella pneumoniae
RRPCPRENVMHINYLEDDDLAFLPECSEAHLEAFTRILTHGENGKPRLSSTLLRNETFLAMEGHPERYRRNWQLIAGELQHFGGDSIANTLRRHGKFYRAILLDVCKRLKAKVDKQLSTPQIEQQLLAHFLQHSWNKLNAEQKAQFLAAVECRSHELDSLMAHLLRHRKLSEGVTLLLDERLTAILRTHAAVSVIGHGLVRGAGLGGPLGAALNSVKAVSGSAYRVTIPAVLHIACLRQMLQPPSDTAEIGEKYPARS

SEQ ID NO: 8853 - protein, 77 aa, Klebsiella pneumoniae
IIHCRSLNKTNFINAVNQFDHLIPRNDGHGLPLGLLLSRFLFKRANLQHRNTHLLQHGSAMNETSTTYEVETLYPFG

SEQ ID NO: 8854 - protein, 451 aa, Klebsiella pneumoniae
GQCCFSTPGSQVFCVPRWYFIRGLRLFDRYDAGEQAVLVHIYFSQDKDMEDLQEFETLASSAGVEAMQVITGSRKAPHPKYFVGEGKAVEIAEAVKATGASVVLFDHALSPAQERNLERLCECRVIDRTGLILDIFAQRARTHEGKLQVELAQLRHMATRLVRGWTHLERQKGGIGLRGPGETQLETDRRLLRNRIMQILSRLEKVEKQREQGRRSRAKADIPTVSLVGYTNAGKSTLFNQITAAEVYAANQLFATLDPTLRRIDVPDVGETVLADTVGFIRHLPHDLVAAFKATLQETRQATLLLHVIDAADVRVQENIDAVNTVLAEIEADEIPALLVMNKIDMLDDFEPRIDRDDENKPIRVWLSAQTGVGVPLLFQALTERLSGEVAQHTLRLPPKEGRLRSRFYQLQAIEKEWMEDDGSVSLQVRMPIVDWRRLCKQEPTLVDYVV

SEQ ID NO: 8855 - protein, 144 aa, Klebsiella pneumoniae
PTRWRVAISFGSTGWPNSQASPSLAGSRPVSIFMVVDLPQPLEPRKPKISPRAMRKLTWSTATKLPKRMVRPRASMAISSSRLSRGGITTALCARRCASGSRAINACSRVWLPVWALSSVALPVASTSPAFIATSQSKRSASSM

SEQ ID NO: 8856 - protein, 127 aa, Klebsiella pneumoniae
TARWSRAGRHPESGHKIRCRGRNGRQCSPAPGRGCCGESSGAGGRQAYPADESRAPDAPAPRRCAQGSAAAPSAGGSPSRRPSRPRPPPGCRRSADASTPPARRPAPRRAARRRGRQTEKSAPLRAR

SEQ ID NO: 8857 - protein, 558 aa, Klebsiella pneumoniae
PYLWLSPLMEGDTMHWQTHTVFNQPTPLNNSNLFLSDTALREAVVREGAGWDGDLLASIGQQLGTAESLELGRLANSNPPELLRYDATGARLDDVRFHPAWHLLMQGLCANRVHNLAWQEDAREGAFVARAARFLLHAQVEAGTLCPITMTFAATPLLQHALPAPFRDWLSPLLSDRYDPHLAPGGQKRGLLIGMGMTEKQGGSDVLSNTTRAEKTAEGFYRLVGHKWFFSVPQSDAHLVLAQAPAGLSCFFVPRLLPDGQRNGVRLERLKEKLGNRSNASSEVEFYDACGWLVGDEGDGVRQILRMGGLTRFDCALGSHALMRRAFSVALYHALQRQAFGKNLVEQPMMRQLLGQMALRLEGQTAFLFRLARAWDRRDDARESAWARLFTPAAKFAICKAGIPFVAEAMEVLGGIGYCEESELPRLYREMPVNSIWEGSGNIMCLDVMRVLSKQPAAMELLAAECAEVKGQNRHLDRAWRQLQQLLKRPAEEQGREIARLVYRLGAGAQMLRHASPPLAEAWCRMMLDTRGGIRLDAPTLDDLLLRAMGRGRQAPQA

SEQ ID NO: 8858 - protein, 74 aa, Klebsiella pneumoniae
RAIWLVSRIYQFNLLGMQNHFAQAVLCLMARDEPSNGYCATDRYTVSNGLVFVTANNNGHLTPCLPVKTGFLLH

SEQ ID NO: 8859 - protein, 399 aa, Klebsiella pneumoniae
TAVWKWSNSPAGIPHLIKGEYSSDVGTGVDSYSLMQPLGVVAGITPFNFPAMVPMWMFPLALACGNSFVLKPPALAPTAAVRLAELLKEAGLPDGVFNVVHCSNEDAEQLYTDPRIAAVSFVGSSGVAEYIYKTASAHGKRVQAFGAAKNHAIVMPDADLDATVNAIMGGAFGSAGERCMALPVVVAVGDETADKLIARLKPLVEALKVGPGCMRGQEENEMGPVVSDTHQKKVLGYIDKGESEGAKLVVDGRKLRVPGYDAGYYVGGTLFDHVTPEMTIWREEIFGPVLGIVRAADYNSALELVNSHEFGNGSAVFTSNGHTAREFVHDVQAGMVGVNVPVPVPMAFHSFGGWKRSVFGALNVHGPDGVRFYTRMKTATVRWPAGQQTVSEFSMPTLG

SEQ ID NO: 8860 - protein, 330 aa, Klebsiella pneumoniae
MKRCGAVMPNSLTWCDLPEDVSLWPGLPLSLSGDEVMPLDYHAGRSGWLLYGRGLDKRRLTAWQRELGAALVIVASWVVEDYQVIRLAGSLTPRATRLAHEAGLDVAPLGKIPHLRTPGLLVMDMDSTAIQIECIDEIAKLAGTGELVSEVTERAMRGELDFTASLRQRVATLKDADASILLQVRDALPLMPGLAQLVLKLETLGWKVAIASGGFTFFAEYLRDKLHLDAVFANELEIHDGKLTGNVLGDIVDAKYKANTLRKLAEKYEIPTAQTVAIGDGANDLPMIKAAGLGIAYHAKPKVNEQAEVTIRHADLMGVFCILSGSMNQK

SEQ ID NO: 8861 - protein, 91 aa, Klebsiella pneumoniae
SPGWRRAAPYPGYGSLYIKRLRNTVGPRKRSAAGQAVPDSVPVIVPDGGYALSGLQSPVYQTVTHTVGPRKRSAAGQAVPDSVPVIVPDGG

SEQ ID NO: 8862 - protein, 475 aa, Klebsiella pneumoniae
FAGWRCAYPAYELMPVGRIRRSRRHPAIYSLWEVTVFLAQEIIRKKRDGQALSDEEIRFFINGIRDNTISERQIAALAMTIFFHDMSMPERVSLTMAMRDSGTVLDWKSLNLNGPIVDKHSTGGVGDVTSLMLGPMVAACGGYVPMISGRGLGHTGGTLDKLEAIPGFDIFPDDNRFREIIKDVGVAIIGQTSSLAPADKRFYATRDITATVDSIPLITASILAKKLAEGLDALVMDVKVGSGAFMPTYELSAALAEAIVGVANGAGVRTTALLTDMNQVLASSAGNAVEVREAVQFLTGEYRNPRLFDVTMALCVEMLISGKLAADDAEARAKLQAVLDNGKAAEVFGRMVAAQKGPSDFVENYANYLPTAMLSKAVYADTEGFISAMDTRALGMAVVSMGGGRRQASDTIDYSVGFTEMARLGDRVDGQRPLAVIHAKDENSWQEAAKAVKAAIKLDDKAPEITPTVYRRITE

SEQ ID NO: 8863 - protein, 480 aa, Klebsiella pneumoniae
GAGWPLSAPFALATRLTFFISLATIIAFFAFTWIMIHSVKAHFEERDVHDLRQLSTTLETVLNHADYPQARRLEIVRNIIAGYANVFICLDDGQGNILFQSPDGPDLSHMLSTPGLAMQLRDGNVISWTDPQPRAMAHDNHPLETRAWRLIMLPLGKQADGKPAYHLLMALSIDFHLHYINELKAKLISAASIISLLIIAIVLFVVYQGHKPIRQISRQIQNITSRDLDVRLDPQAVPVELERLALSFNHMLERIEDVFTRQSNFSADIAHEIRTPITNLVTQTEIALSQSRSQQELEEVLYSNLEEFSRMSRMVSDMLFLAQADNNQLIPEQQALDLADEVHKVFEFFEAWAEEKAVALRFVGSHCRVIGDPLMLRRAISNLLSNAIRYTPAGQAVTIQLSENAGKIRLVVENPGTPIAAEHLPRLFDRFYRVDPSRQRKGEGSGIGLAIVKSIVGAHHGSVAAQSDLRSTRFIVVLPK

SEQ ID NO: 8864 - protein, 88 aa, Klebsiella pneumoniae
LITCDLRLKLVQRRKPLLVTYLFTQYYIDMATVEVHYNVQQMYFELLTHARNRWTGANIGDARYRFVTQPCHFYRIDPFNRGNLTTQR

SEQ ID NO: 8865 - protein, 89 aa, Klebsiella pneumoniae
APGCREYRRRSSPHGWCRAPGSPAPPAPRRWRASNGYAPPRQGRDNGDRAPDGWRYQRRDASALPPRAPADQPPTCHRRSLTRRRCRWA

SEQ ID NO: 8866 - protein, 63 aa, Klebsiella pneumoniae
LFIRTPIVCKTIDYRSKKLINEFSRCTEVLTFRITFHVQYFTDSVFLKFYCMLTDFPTCVVTT

SEQ ID NO: 8867 - protein, 96 aa, Klebsiella pneumoniae
TGLLRPGIGILSFTTIQPEHDMGMVVVVFCPFDNPEETDHRFELHHTVHQLSDIPFELLVILQEILSGMILVKQICSECPQARIALYQFVDMVVQK

SEQ ID NO: 8868 - protein, 131 aa, Klebsiella pneumoniae
YITRFSRREAMTYGQAYLSGWKETFNFSGRASRQQFWTFFLINVLIAAAPVAAWSLATLVDPHYGLLSFVVIPFAALWLLLMAIPLLAVGCRRMHDIGRSGIWFVLGVIIPWFAIISLALCCLRSAPAPSR

SEQ ID NO: 8869 - protein, 125 aa, Klebsiella pneumoniae
SPARHASPARSLPRPARRCRPVSRSHRCIRSESPWSPCPSPAGPGCANGEFYPMARRPAPPHAPVASHGESANRPNGSPGNPRPPRRQRSLTRRPAHAATPSADVYPDRDHTAASRCARRDNPAA

SEQ ID NO: 8870 - protein, 184 aa, Klebsiella pneumoniae
RRNRLKTASCGVEVIRFFMAIRLPEREGKPDSITGFYPVGFDDNFLGSASENSMAASPAGRHQHGLVIKLPVVTADIEVVAGMVFKVGRQPVHQQGGHHARRHNPAERVINAVQRIVARVDNHQMVSYFFGKTLDAFVQRPASPLAFHQKQRNLFFQQLQGAVEKFSGAHRLRPLPLHLFENTH

SEQ ID NO: 8871 - protein, 98 aa, Klebsiella pneumoniae
CRRRNGRSCAPSSRCRPSGQSSALYPAPRCPAPPPGQSPRDRPPAGSSTSPIHCRSSTGPNGRSRSIPLQLRHLPAAAHRHRIPTATDRRPLLWRRSF

SEQ ID NO: 8872 - protein, 319 aa, Klebsiella pneumoniae
REFRMQNRLTIKDIARLSGVGKSTVSRVLNNESGVSERTRERVEAVMQQHGFSPSRSARAMRGQSDKVVAIIVTRLDSLSENLAVQTMLPAFYEQGYDPIMMESQFSPALVEEHLGMLARRNIDGVVLFGFTGIDEAMLAPWRDTLVLMARDAPGFASVCYDDEGAITLLMQRLYDRGHRHISFLGVPHSDVTTGERRHLAYLAFCKKHRLTPTAALPGLGMKQGYDTVASVLTAETSALVCATDTLALGASKYLQQQGRDALQLASVGSTPLMKFLHPEILTVDPGYAESGRRAARQLIEQIAGSVDPRQIVIPAALN

SEQ ID NO: 8873 - protein, 282 aa, Klebsiella pneumoniae
RDNRREAGMQGVPLQFSDEKDRARFRHLEQLPGVELYHAHISRYAFEPHTHEAFGIGVIEQGAERFRYRGSQHIAAANSIVTMNPDELHTGEAETADGWRYRMIYLEPDRLEAITGVRDWWFSEVVREDPLRSRQIGQLIYGLWHSDDPLAQQGLLLDLVDTFRPLAHHASAQGEAGHRFDRVRDYLHDNYMRPITLDELAQVATLSPYHFQRQFKAHYHVTPHQMLMAIRLWRAKAFLTHGMPAAEVAIAVGLTDQSHLTRAFTQRYGITPVRYQKQVARR

SEQ ID NO: 8874 - protein, 370 aa, Klebsiella pneumoniae
VLRRAGCTAARGAGRAVPSGRHAERSFWSASGAVRHSALLYPSAGQRGAVPVHHRHAALRRPAVRRDLDHALVASAHCRRRNPGPAGLLGGGHRRGAGSPSARLLRRRGDDLRASSPAGLGGARREAEGALMMTVLITGASSGIGAGLAKSFAADGHLVIACGRDASRLAALQQLSPNISVRLFDMTDRDACRQALTGCFADLIILCAGTCEYLDHGQVDAALVERVMATNFLGPVNCLAALQTQLEAGDRVVLVSSMAHWLPFPRAEAYGASKAALTWFANSLRLDWEPKGVAVTVVSPGFVDTPLTRKNDFAMPGRVSVDRAVAAIRHGLAKGKNHIAFPTGFSLALRLLASLPSGIQRLLLRRMVRS

SEQ ID NO: 8875 - protein, 110 aa, Klebsiella pneumoniae
IPRRDAGYRSVCGSYWNNHHLSGSEQFCDREACNDPLSPTEHAILRYMSWGYSLSDIAIQLNRNIKTIRAHKFNAMTKLGVRSDIGLLNAADILLHLPLNSTTSAVKQVA

SEQ ID NO: 8876 - protein, 255 aa, Klebsiella pneumoniae
SDSLMTEAQRHQILLDLLAQTGFVTVEQVMSRLGISPATARRDINKLDESGKLKKVRNGAEAISEQRPRWTPMNIHQAQNLDEKVRIARAASQLIAPGESIVINCGSTAFLLGRELCGKPVQIITNYLPLANYLIDQEHDSVIIMGGQYNRSHAITLSPHGSENSLYAGHWMFTSGKGLTAEGLYKTDMLTAMAEQKMLNVVGKLAVLVDSSKIGERAGMLFSQAGQIDVVITGKQADAAILKQLEDQGVSVIRV

SEQ ID NO: 8877 - protein, 293 aa, Klebsiella pneumoniae
YFTRYDHGSVVTYIVCAGHEYDFNIHPGNDMAIKSLADRLQASEGTSTGSGGVMLPGQGKFGVVISKIPVMQSGLKVIFNENLPDYELSFCRSHDELTLLQLRRAVLVVADISGEIAHPRAVCERYYSLMTQYRDIHWVFMVSDSLYPLAVELLIRPESSLISESEPVNRLIEVICAGSRAAEQISRTLFAGDEDSDFASYHSAAMLTLSERKVLRLLAKGWGINQIAALLKKSNKTISAQKNSAMRRLSLRSNAEMYAWINSAQGMQELNINSAYGEQMEWKKIVQPAMSPS

SEQ ID NO: 8878 - protein, 287 aa, Klebsiella pneumoniae
PIERTYPLFRQECPMAIAMQRFCINRKIAPALNIEAFFRLVNRLGLNKVELRNDLPSGKVTDDLSHQQVRELAARYHIEILTINAVYPFNRRSEEVRQLTESLLKEAQAIGAKSLVLCPLNDGSEVPASETLGALRDLAPLFAFYGIHGLVEPLGFPQSSLRSAHQAQTLIHDARVPFKLLIDTFHHHLYPQAADEFSQVEVADIGLVHLSGVDDSRPREQLTDAERIMLTPKDRLGTCEQVKALEARGYQGVYAFEPFAPELAQWSEADIECEIEQSIALIQRHCA

SEQ ID NO: 8879 - protein, 1176 aa, Klebsiella pneumoniae
VTGRGMDSNTQGFTSYWRNTLADTESGKGAFERKEEDSFTQWMNVEQGRLGEDIVQSFFEGEDEQVKTVEVLLRPQVWIRLLKHGKERTAGAPGIITPLVTSALLNREGFLFPKSPATIPRDLLEPLPKGTFSIGEMPEYDKYKTTHDSITFGPGNEDELRDETDEQRVERYARYQQLWQKYLKDTDELLKNVAGRWLASPEQYELAGYGYIIKANQPGGASLHILPMYDHLLSCKKEVPLLARFASKDKFPVEQLLASNAMFSERLGHSGDKFPLAVAQRDALSHYLTQQPGDILAVNGPPGTGKTTLVLSIIATEWVRAAVNKTEPPVVIATSTNNQAVTNIIEAFGKDFATGTGPMAGRWLPDVKSFGAYFPSSSRKAEAVKKYQTEDFFNRVESLEYVEDARCFFLEKARAAFPSKECHSPEQVVDLLHQRLVEISAELEQIEPAWDDLNAIRQERHAISDDLEQYIQDKRTLLLNSTNEISLLTQGKKQWEQYRAGESIMYALFSWLPAVRTKRHYQMKLFLEARFGERMTAFQGSQPDGIDAFIDGLIEQAHKEQAGYQQQIDLAEDISRRESEAAIRWHDITHSLGNPGETELSLHEADELADTQLRFPAFLLATHYWEGRWLMDMAAIDNLQKEKGLKGAKAIKARWLRRMKLTPCVVMTCFMLPHHMLIREHVGGKKFDDGYLYNFADLLIVDEAGQVLPEVAAASFALAKKALVIGDTEQIAPIWNSLPGIDIGNMVEENILPGGTQEELTEAYALVCDFGKSASSGSVMKVAQFNSRYQYDPDLARGMYLYEHRRCFDNIIGYCNTLCYHGKLQPKRGEEKETIFPAMGYLHIDGKGMQANGGSRYNAFEAETIAAWLAAHKEEIEHHYGEPLHKVVGVVTPFSAQVSTIKSSLRQLDINCSGDENSLTVGTVHSLQGAERAIVLFSPVYSKHEDGSFIDSDSSMLNVAVSRAKDSFLVFGDMDLFEIQPGSSPRGLLAKYLFASTDNALQFEFQERQDLSTSQTQISTLHGVEQHDAFLNQTFDATNQSITIVSPWLTWQKLEQTGFLASMLQARARGIDITVVTDKTFNTEHADFEKRKEKHQRLNEAVERLNEMGITTKLVNRVHSKIVIGDEGLLCVGSFNWFSATRDEKYQRYDTSMVYRGESLKSEIKTIYSSLEQRQL

SEQ ID NO: 8880 - protein, 315 aa, Klebsiella pneumoniae
PPSRKTTWACPWSVSPELRGVIMPFVQTVPVFKLYGEECGWPTPDLLHCESILQRSSLYQWHIRVHQHAEMVQLLYLHQGRAEIEIEGATAVMTESCIQVVPALCIHGFNFSPGTQGFVLSLALPLLSRFENQFGRPLDVLSVPQCVPVGRSRGRMHTLFSALREEYCEEHDAREMMLYSLLGTLLVWLNRQCHPASPAEDKAERKRSMMRHFARLIESHYRQHLPLAEYAKLIGLSVTHLNYLCREFYGCSALGVLHQRLMLEARRNLQYTRMTITQLSDYLGFSDAAYFSRFFRRYSGMSPKAFRETIKDNAS

SEQ ID NO: 8881 - protein, 315 aa, Klebsiella pneumoniae
TRTRRWTIATSGSASSMSIRCLTRKAGRPSCGAKRLTASSGAGTAGPTGTTAFMRTGYAVRSTWCRASPRRRTTEMNSCLYQGVLRHRRLQPKAHHFVYRLFMAWLDLDELDRLPEAGIRRNRLAAAAWYDADYPLGAPLKAQVLNRLESLTGCRPAGRVMLLTQLRYFGFHFNPVNFYYCYDEADTLRWVLAEVRNTPWNERHYYAVDGQQARPLEKAFHVSPFNPMDMVYHWRFNAPGKTLHMHIENHQASKVFDATLALSRVPLTRANLRGMLLRLPLMTLKTVLAIYWQALRLWLKRVPLYNHPVSRSERS

SEQ ID NO: 8882 - protein, 126 aa, Klebsiella pneumoniae
SAARYSLRLSYPYLSAALAILLQALPQFVLTIVIGLIDGLVHRDLRRFGAGHESGFVYHHARRMIGSSLAATGLAWLAWLAWLAWLAWLAWLAVPVFLESRYIVIPGVMLSGLAGSVATGAFKKHL

SEQ ID NO: 8883 - protein, 288 aa, Klebsiella pneumoniae
IAARIARQLQLSIPPCTFFVKIRRNYLQGLDMLILISPAKTLDYQSPLATTRYTQPELLEYSQQLIGIARKLSAPQIGKLMSISDKLADLNATRFHDWHPDFTPQNARQAILAFKGDVYTGLQAETLTEDDFDFAQQHLRMLSGLYGVLRPLDLMQPYRLEMGIRLENPRGKDLYQFWGDTITEKLNQALRDQGDDIVINLASDEYFKSVKTPKLQGQLIKPVFLDEKNGKFKVISFYAKKARGLMSRYIIENRLTQPEQLKAFNSEGYFFDADASEKGELVFKRHEQ

SEQ ID NO: 8884 - protein, 233 aa, Klebsiella pneumoniae
TGARMQQPRIWLVEDEQSIADTLVYMLQQEGFQVSVFGRGLPALEAAAHQAPDVAILDVGLPDISGFELCRRLLTRYPALPVLFLTARSDEVDKLLGLEIGADDYIAKPFSPREVCARVRTVLRRLQKFAAPSPVVRVGEFVLDEQAAAISWFGQPLNLTRYEFLLLKTLLHAPGRVFSRQQLMELVWIDAWESFDRTVDTHIKTLRAKLRAVNPEKAPINTHRGMGYSLGRG

SEQ ID NO: 8885 - protein, 404 aa, Klebsiella pneumoniae
VAQRAAAHRRGRARRQRPSLHFFVLRKKDAPPAGGNTRTTQQRESSESRMDKIKKRWAGYFVGLLVVLAAAAWWLLRPPGLPAGFASSNGRIEATEVDIASKIAGRIDTILVKEGQFVHQGEVLARMDTRVLNEQRLEAAAQIKEAESAVLAARALLDQRQSEMRASEAVVKQRQAELDSTAKRHVRSNALSQRGAVSAQQLDDDRAAAESARAALESAKAQVSAARAAIEAARTSIIQAQTRVEAAQATERRILADIDDSELKAPRDGRIQYRVAEPGEVLAAGGRVLNMVDLADVYMTFFLPTEQAGLLALGSEARLVLDAAPDLVIPANISFVASVAQFTPKTVETSDERLKLMFRVKARIPPELLAQHLEYVKTGLPGMAYVRLDKQQPWPEALAVRLPQ

SEQ ID NO: 8886 - protein, 191 aa, Klebsiella pneumoniae
NVQRSVYKPGKVELMEQQLTIEMIADAFSYDITGFDCGEKALNTFLKEHLKRQHDGQILRGYALVSGDTVPRLLGYYTLSGSCFERGMLPSKTQQKKIPYQNAPSVTLGRLAIDKSVQGQGWGEMLVAHAMRVVWGASKAVGIYGLFVEALNEKAKAFYLRLGFIQLVDENSNLLFYPTKSIEQLFTDDES

SEQ ID NO: 8887 - protein, 487 aa, Klebsiella pneumoniae
SGQREMLSVRRVQRLHHRECVMAILYNIFTVFFNQVMTNAPLLLGIVTCLGYILLRKSVSVIIKGTIKTIIGFMLLQAGSGILTSTFKPVVAKMSEVYGINGAISDTYASMMATIDRMGEAYSWVGYAVLLALALNICYVLLRRITGIRTIMLTGHIMFQQAGLIAVSFFIFGYGMWTTIICTAVLVSLYWGITSNMMFKPTQLVTDGCGFSIGHQQQFASWIAYKVAPYLGKKEESVEDLKLPGWLNIFHDNIVSTAIVMTIFFGAILLSFGIDVVQAMAGKTHWTVYILQTGFSFAVAIFIITQGVRMFVAELSEAFNGISQRLIPGAVLAIDCAAIYSFAPNAVVWGFMWGTIGQLIAVGILVGIGSSILIIPGFIPMFFSNATIGVFANHFGGWRAALKICLVMGMVEIFGCVWAVKLTGMSAWMGMADWSILAPPMMQGFASIGLAFMAVIILIALAYMFFAGRALRAEEDAEKQLAEASAQ

SEQ ID NO: 8888 - protein, 414 aa, Klebsiella pneumoniae
RQALTDPQRQIDGKRVFNLGQHKALAHFRHPAGDFAVRNMEQAGVQLEVLPDGQFAIEREGLRHIAHPLAGGDILRVDRLAEQPGFTFAGGQQAGEHLHGGGFAAAVGAEEAEDFTAGDAEINVVDGNKVAEAHGQAARFDGDLFLTAVARWDNYRPMRPTLCFWQQGDKRLLQGLAAGLGFELCSAAGRQHLAGVHRHQPVKALGLFHVGGGHQHAHRRLALTNIVDKLPELRPGEGIDAGGRFIKDQQLRIVDQRAAQAELLLHPTGEFSGGAIAKRRQPGTLQQLVDAQFALGFIVAEQAGEEVDVFIHRESVIEVFPQPLRHPRDFRAHLAAVMHIAHIAAKHHHVPLLDGPRPGDQRKQARFADAVRANQANHTPCRDRQTDIAQRDGGAKLLTNVFQQGDGGRGILRR

SEQ ID NO: 8889 - protein, 79 aa, Klebsiella pneumoniae
LGKRESGLGVGKALKKFGKNAFGVGNIGEGILAANGLFNHRYQVVSDLRRGRQDRRYLPLPGITLQNIGNPQKPFRICH

SEQ ID NO: 8890 - protein, 1107 aa, Klebsiella pneumoniae
IQWRHGHSQRAAGGRESGRQRPVPDRLGGQYRRRAGAHARAGPGCRCPCRPRALRKGTMIEWIIRRSVANRFLVMMGALFLSLWGTWTIVHTPVDALPDLSDVQVIVKTSYPGQAPQIVENQVTWPLTTTMLSVPGAKTVRGFSQFGDSYVYVIFEDGTDPYWARSRVLEYLNQVQGKLPAGVSAEMGPDATGVGWVFEYALVDRSGKHDLAELRSLQDWFLKYELKTIPNVSEVASVGGVVKEYQIVVDPMKLTQYGISLGEVKSALDASNQEAGGSSVELAEAEYMVRASGYLQTLDDFKNIVLKTGDNGVPVYLGDVARVQIGPEMRRGIAELNGEGEVAGGVVILRSGKNAREVISAVKEKLASLQSSLPEGVEVVTTYDRSQLIDRAIDNLSYKLLEEFIVVALVCALFLWHVRSALVAIISLPLGLCFAFIMMHFQGLNANIMSLGGIAIAVGAMVDAAIVMIENAHKRLEEWEHQHPGEKLSNDTRWKIITEASVEVGPALFISLLIITLSFIPIFTLEGQEGKLFGPLAFTKTWSMAGAALLAIVAIPILMGFWIRGKIPAESSNPLNRFLIRIYHPLLLKVLHWPKTTLLIALLSILTVVWPLNRVGGEFLPQINEGDLLYMPSTLPGISAAQAADMLQKTDKLIMTVPEVARVFGKTGKAETATDSAPLEMVETTIQLKPQDQWRPGMTMEKIVEELDKTVRLPGLANLWVPPIRNRIDMLSTGIKSPIGIKVSGTNLADIDAIAGQIEVVARSVPGVTSALAERLVGGRYLNIDIHREKAARYGMTVGDVQLFVSSAIGGAMVGETVEGVERYPINIRYPQSYRDSPETLRQLPILTPLKQQIVLGDVAEVKVVTGPSMLKTENARPTSWIYIDARDRDMVSVVHDLQQAIGKEVKLKPGISVSYSGQFELLERANQKLKLMVPMTLMIIFVLLYLAFRRVGEALLIITSVPFALVGGIWFLYWMGFHLSVATGTGFIALAGVAAEFGVVMLMYLRHAIEAEPSLENPQTFSVDKLDEALYQGAVLRVRPKAMTVAVIIAGLLPILWGTGAGSEVMSRIAAPMIGGMITAPLLSLFIIPAAYKLMWLSRHRGKRSQ

SEQ ID NO: 8891 - protein, 198 aa, Klebsiella pneumoniae
TAWRERRSAPYFSPEGCYAEVMKTNTITAGAVLRLTQESDIALLPAIERSAAQAFRQIPSLAWLADSEVISVARHHDYLETEHSLLAVAAGQPVGFILTEPLDDALFIVEVAVHQAWQQQGIGRMLLERVIESARQMGYPAVTLTTFREVPWNAPFYTRLGFAMLDELTLPAGLAAKREQETRHGLPPESRCAMRLAL

SEQ ID NO: 8892 - protein, 306 aa, Klebsiella pneumoniae
FQRRNMVQSTIQNLPVVTRMSWSIDIISCITDRFVELTATEKRIAQFILDDIAAAAELPIAEIARLTQTSQASVTRFARALGCKDVRELKMKLAQSLAVGQRFILDVPDLEGVQGIYESIISVLETNRRALDIEALKRAVSWLSDARQILALGMGGGSTICAQEIQYRLFRLGLPVVSQSDGLLVRMMSSAVTPQDVVIVLSLGGYTREIIESAAIASQYGAKVIAITPAGTPLAEQADLVLPLLVRENDYIFKPSTSRYAMLAMVDVLATELAMANKTQAKGKLRRIKLALDSHRGGVDRQPLGD

SEQ ID NO: 8893 - protein, 219 aa, Klebsiella pneumoniae
YTGRTERRITMTERVYYTSDATDGRAQIIACTAEADGRYAIELDRTLFHPQGGGQPADRGWIAGQVVETVVVRGERVLHILSQLLPLGEVEMKIDASARQLHARLHSAGHLLGLAGEQLGWQPVKAHHWPGEGRITFASRNSAALPDASALLALVKAWQAQDLPRQVTFADGMRKVGFGELPAYPCGGTHVARLAELGDIVISQIKMKKGQLVVSYTLA

SEQ ID NO: 8894 - protein, 245 aa, Klebsiella pneumoniae
NGGRCASITPEREKETAMRLTIILVGPARAENVGAAARAMKTMGFRELRIVDSEAHLAPPARWVAHGSGDILDGITTYPTLAEALHDVDFTVATTARSRARFHYYATPQQLLPLLEEKAQWMNHTALVFGREDAGLTNEELALADVLTGVPMAADYPSLNLGQSVMVYCYQLASLMQQTAPAAAAADHHQLQALRTRTLALLSRLGVEDDAKLADWLSQRLGLLQQRDTAMLHRLLHDIEKNLPE

SEQ ID NO: 8895 - protein, 268 aa, Klebsiella pneumoniae
DFFRIIAMVIMVMILSDCRQSYYIARNTGRNIMTLSDHQRAKSALNANDLNAAQGYLTGEKYNNRYRPVSGEESWGSLQYRAAKIVANAAANGQKVRNDALYLAYISLFEAEEGVPEHPDIMLGYMHKAMALLLANPQLLDKIDSKNVSTLPSQFTLERYAVWQYLYDGGEIDWTKKAPEGEGYTIAGESYQTWNIKLKKAIWNRGDAFLTNIGKQQFIHDAIDYSQFPVIACTARRKGWHLTLPADYREQNFRGGGRFDWASCRAVE

SEQ ID NO: 8896 - protein, 136 aa, Klebsiella pneumoniae
LTFSKYVRKGKCEMAEPTLSEKLRTGNLFAEQCPSRDVLKHVTSRWGVLILVALREGTHRFSDLRRKMGGVSEKMLAQSLQALEQDGFIDRVSYPVVPPHVEYSLTPLGLQVSEKVAALADWIEVNLPSVLANHGE

SEQ ID NO: 8897 - protein, 232 aa, Klebsiella pneumoniae
ADHSHSIYLACRLQSLLDFCEQHSGFLMTNTMKKNDKRWIGDLLGGSLMVRESRTIAELLLSEPDETAWQQQIINENILQASSTSTANRYARTLRLRLMTLDRECWKLIADGSESERLQMLLVALMIQSPIVAEFIAEVVNPARQQFKEKLGMNCWSEFVDENLRLHPELAAFSDSSIQKMGNNLIKALAEAGYLDSPRRRNLQNVFLLPDVATALHRLNKAELLPILEGNA

SEQ ID NO: 8898 - protein, 188 aa, Klebsiella pneumoniae
RSISLCILAPVAIARADDAGFREVDGEGLSSALVRRWAQEKTTPPEGGAVVVNTGRDPTSCRSLSTYNPQRNVDRHTSMRCRKASESGGAHTRPPWCAAHPVRPASMHQYDKLHHVLCLRRAPRLDSGPGCTADNRRHYERPATGRWSSSGCCLVCVVNCRKQIFALLKLKLIEQIERLVDARHRFHI

SEQ ID NO: 8899 - protein, 90 aa, Klebsiella pneumoniae
SRWLAMRVKLGISGIFHNEANRGDRQAAPALSMRQRGDLVGGQAGDFHHRLAGNTVVQHPLCDAQRLGMLSFLSAFKPAFPFAFSTAYFL

SEQ ID NO: 8900 - protein, 91 aa, Klebsiella pneumoniae
SSARRSWIPRRNAMFAPTPSPSVAPSPPSSWMTIARPQRAPARRWNRRKPRSPPPAPPSKLPAPALFRRKPASKPPRRPSGGSSPILTIAS

SEQ ID NO: 8901 - protein, 578 aa, Klebsiella pneumoniae
APASRRPWRPRQAPSAPAGSWLRGERRSGRPPGRRRWRPWPAPSREASRCGSVGSRRRRTSATGPPSTGAAGCRRENRSVPPAPSRRPDRSPPRPTAGRADDWPPATAARRKWPASARSADRARATSPPASSKHRTRGPSADAAPGVSYPLRGELHHADGAGVKSGFAVAEVVEPHPAETLIKAELFNILPGVGKTLPPVGQGAGVIRAHVEQVAHHKIGMAGHQLAHCRDAGQKAAREDVALDKIDAFAVVAIALILNGDRLQGHFTARAQARLAGAEEGREVALAHRLNHLHRHQFVVLAAQIAVVAEQHLDAILQPGAGHALGSPAVLLPGKGGGGDPATVMAGGVLGQRPPAGANLQQMIAGVERQLVAQTRHLGPLGLGQILLVVGKQRAGVEQVVIQKVGIKFVAEVVMGGNVLPRLGAGVAASPVAQAGDRLTQQTKAALQTPQHLAVARKDLQQRRQLVALPVAVHPGLGRRQAAAGQQTPVHLRRADPRLGAQRGGGVAKLKSLRPFAHGERAFAEAAQQTKEQPAREPHVARHIWFKRKDGIGHERSLLLTGWLYSGTRFSHSRSACQ

SEQ ID NO: 8902 - protein, 420 aa, Klebsiella pneumoniae
IFHREGEMMHRISHWLSRHAAALFFPAALILYDFSAYLTTDLIQPGILHVVRDFNADVALAPASVSLYMAGGMALQWLLGPLSDRIGRRPVLLTGALIFTLACLATLFTTSMTQFLIARFVQGTSICFIATVGYVTVQEAFEEKRSIRLMAVITSVVLVAPIVGPLSGAALMHFIHWKALFGIIAAMGLVAWLGLLLTMPETVRRGDVPFSPLGVLRDFRNVFRNRIFLLGAATLSLSYIPLMSWVAVSPVILMDAGGLTTSEFAWSQVPVFSAVIIANLSVARWVKDPTRPRFVLSAVPVQMLGLAILIVGNLVWPHVWLWSVLGTCFYAFGIGLIFPTLFRFTLFSNDLPKGTVSASLNIVILSVSALSIEGARWLWFHGGRLPFHLLAVAAGIVAACCLAGLLRHQRGQAVIEARQS

SEQ ID NO: 8903 - protein, 565 aa, Klebsiella pneumoniae
SARLRPPTASVAPLNRSIYSSGEFTLLAVTGDVAHTASADFRVFRHLADIGGVMPAARAFLTFSFTQCDFQPFEQFALLRISGRARIVCDVRPGGQQDKSQFIAQRIELSRQIGISIQRDCRFQRAADFLIRTRLLDHLVDFATHLQQLIPEIVVHRFVVGQAEQTFIPLAGEDIFLTLARQIAPDFICGEGHDRRHPAHQRFHDMEQRGLTAATRHAVRLGGVLAVFDDVEVERAHLDGAEAHQALHHFMEVVGFVGFQDIFLCRLRAADRPAVQHHHLFRFNHVFRRIETVKVRQQEARGITDTTIAVRSAFEDLVRDRHFAGVVGGSHPQAQDIGAELVHHVLRANGVADRLGHFAALTVDGEAVGQYLTIWRFAFHRRGNHQRGHEPAAMLVRTFQIHIGGVTGEFRTHVNHGRVGRPGVKPDVEGIRHFLVAVGVIAKNVAGIEIPPRLDAVNFNAFCHFFHQFKGTRVQFMGFFMHEQRHRHAPGALTGDTPVRAVSDHRFDTRLAPVRDPLHAFDLFQRLRAQAFLIHAHEPLRSGAEDDRRLVAPAAWIAVLQFLNV

SEQ ID NO: 8904 - protein, 316 aa, Klebsiella pneumoniae
PFCRRARQALLDIIRERSMSHINYNHLYYFWHVYKEGSVVGAAEALFLTPQTITGQIKALEERLQGKLFKRKGRGLEPSELGELVFRYADRMFTLSQEMLDIVNYRKESNLLFDVGVADALSKRLVSGVLDAAVVESEQIHLRCFESTHELLLEQLSQHKLDMIISDCPIDSTQQEGLFSVKIGECSVSFWCMNPAPTKPFPACLEERRLLIPGRRSMLGRKLLNWINVQGLKVEILGEFDDAALMKAFGAAHNAIFVAPTLYAHDFYHDESIVEIGRMDSVMEEYHAIFAERMIQHPAVQRICNRDYSSLFTEPR

SEQ ID NO: 8905 - protein, 64 aa, Klebsiella pneumoniae
AIRLSSSWLRHSTAARNCAFCSAFSLFQLCCRKCASNCCSICGVDSCLSTFAFSRLHTSSRIAR

SEQ ID NO: 8906 - protein, 477 aa, Klebsiella pneumoniae
KKRLMLPVKARTEKRFSVRLQLTPSYIMALAMKVISQVAQQRKTLEEAVTTALELAAGKSDGAEVSVSKTTGIGVSTRYGEVENVEFNSDGALGITVYHQNRKGSASSTDLSPDAIARTVQAALDIARYTSPDPFAGVADKDLLAFDAPDLDLFHPAEVSPDDAIELAARAEQAALKADKRITNTEGGSFNSHYGIKVFGNSHGMLQSYCSTRHSLSSCVIAEDDGDMERDYAYTIGRAIEDLQSPEWVGEECARRTLSRLAPRKLSTMKAPVIFANEVATGLFGHLVGAIAGGAVYRKSTFLLDSLGKQILPEWLTIEEHPHLLKGLASTPFDSEGVRTERRDIVKDGVLTQWLLTNYSARKLGMKSTGHAGGIHNWRINGRGLSFAKMLKEMGTGLVVTELMGQGVSGVTGDYSRGASGFWVENGEIQYPVSEITIAGNLKEMWRNIVTIGDDIETRSNIQCGSVLLPEMKIAGQ

SEQ ID NO: 8907 - protein, 250 aa, Klebsiella pneumoniae
GETSMKLTPNFYRDRVCLNVLAGSKDNAREIYDAAEGHVLVGVLSKNYPDVASAVADMRDYAKLIDNALSVGLGAGDPNQSAMVSEISRQVQPQHVNQVFTGVATSRALLGQNETVVNGLVSPTGTPGMVKISTGPLSSGAADGIVPLETAIALLKDMGGSSIKYFPMGGLKHRVEFEAVAKACAAHDFWLEPTGGIDLENYSEILKIALDAGVSKIIPHIYSSIIDKASGNTRPADVRQLLEMTKQLVK

SEQ ID NO: 8908 - protein, 257 aa, Klebsiella pneumoniae
PEQSEVNLLPPIVSFSLRFVIIRRQSFTHFAMAVMLSHAFILMFITQKGTTMATPTFDTIEAQASYGIGLQVGQQLSESGLQGLLPEALVAGIADALEGNQPQVPVEAVHRALREIHERADAVRRERFQAMAADGQKYLDENREKEGVNSTESGLQFRVLTQGECPIPARTDRVRVHYTGKLIDCTVFDSSVARGEPAEFPVTGVIGGWIEALTLMPVGSKWELTIPHNLAYGERGAGASIPPFSTLIFEVELLDII

SEQ ID NO: 8909 - protein, 364 aa, Klebsiella pneumoniae
LMKSAPRRVITKTNLYPESYRLTEKTIMSLKLGVIGAGAIGKEHIRRCTQVLQGATVVAVSDINADNARAAVALPGVQAEVYADGHDVINASDVDAILVTSWDPTHEEYTLAAIAAGKPVFCEKPLAMTAEGCRRIVDAEMKAGRRLVQVGFMRPYDEGYLALKKVIDDGDIGAPLMLRCAHRNQSVGENYTTDMAITNTLIHELDVLRWLLNDDYRSVQVRFPRSTSHTHARLKDPQIVSFETKKGTLIDVEVFVNCQYGYDIQCEVVGETGIARLPEPSAVQMRKSASLSTAILTDWKDRFIKAYDVELQAFINDVKAGQLHGPSAWDGYAASVAADACIKAQGTSEPVEVTLPECPAFYKR

SEQ ID NO: 8910 - protein, 348 aa, Klebsiella pneumoniae
RRRRRVKENSMESVTLSLPEAYDLALEVLSANGFSADHAAAIARNVTAGERDGCASHGLWRLLGIVDTLRKGKVSPDAEPQIHDQAPGIARADAGGAFSLLAYERVLPLLLEKARHNGIAALAINRCVHFSALFADIEPLTEAGLVGLACTPSHAWVAPAGGTRPLFGTNPIAFGWPRQDKPPFIVDMATSAAARGEIQLHQRAGKALPEGWGIDSQGQPTTDAAEVLNGAMLTFGGHKGSALAAMVELLAGPLIGDMTSAESLAWDNGAGGLPYGGELILALDPQRFLGAQAPEQLARAETLFMGMQEQGARLPGERRFACRQQSERQGVAISRSLHDEICALRQGG

SEQ ID NO: 8911 - protein, 102 aa, Klebsiella pneumoniae
LTMSEVNGDVYVAATAKGIGFAGETIVVQGDTVGMARIYFTSSQHRFHLADKTCEYFIQLQRFCVTEFTGNAGPISQIVQPVSLLYQTSTKARCHITIQSPF

SEQ ID NO: 8912 - protein, 237 aa, Klebsiella pneumoniae
ITPRAGGNARKRLITSPERKKSMLQVYLVRHGETQWNAERRIQGQSDSPLTAHGERQAWQVGERARTLGITHIITSDLGRTRRTAEIIAEACGCSVIADARLRELDMGVLEKRHIDSLSEEEEGWRRQLVNGTPDGRIPQGESMQELSERMHAALASCLELPAGSRPLLVSHGIALGCLVSTILGLPAYAERRLRLRNCSISRVDYQQSPWLASGWVVETAGDVSHLDAPAMDELQR

SEQ ID NO: 8913 - protein, 179 aa, Klebsiella pneumoniae
CGTSFRFLILTLISIIFFSIMRGRPVTEDELFARRPLGMRMAMVVRQWRAIIDSAITDTGLTQSSWTVLMQLHQLGDNVSVSELAEVQGIELPPLMRTLSLLEKQGYLVRSTSPYDKRIRLLTLTAEGRAILEKLSCVIETYQERVTQTIPEADLATFSATLNQIACRLRNIREEDNKI

SEQ ID NO: 8914 - protein, 106 aa, Klebsiella pneumoniae; identical to SEQ ID NO: 8560

SEQ ID NO: 8915 - protein, 303 aa, Klebsiella pneumoniae
NCWRKEPTMSAEISPLLVRTPAAARPLWLRLRRSSPFTLTVLMCCLALLWVSPFIWMLATSFSATTFGDDMASLLPRLPLTLDNFRDAWQSADWLSLYANTLIFTFGTFFVQLLTITTAGYVFACHEFRGKQTLFLLFLVQLMIMPVVMMVPNMLTLKTFGLLNTLTGVMMPYFTSAFGVFLMRQAFLAIPKELEEAALMEGCRWWQVLFRVLLPMSWPSVLAFATVSITYHWNEYLWPLMMLNDPDKQVLTVGLVSFAMGAESGGQWGTIGAGTLMVCLPLMLAFILFQKQFLRSFGFSGIK

SEQ ID NO: 8916 - protein, 453 aa, Klebsiella pneumoniae
PVRRATMSANHAAFNLIFRFVENYISPIAGRISSQRHVMAIRDGFISAMPFMIVGSFLLVFAYPPFSPDTTWGFARAWLDLAKEFEGRILTPFDMTMGIMSIYICAAISYNLGKHYEKSNQLDPFMCAMLSIMAFLLIAAPKTNGTLPVDSLGGTGIFTAILVAIYCVEMMRFLKAHNIGIRLPDQVPPMIKNSFDLLIPVLVVVLTLYPLSLFIQHHFDMLIPQAIMAIFKPLVSAADSLPAILLAVLIGHLLWFAGIHGAAIVSGMLQMFWLTNLGMNQQALAQGAPLPHIFMEAFWTFFIVVGGSGATMGLVFCYLRSRSAHLRSIGRLSVVPSLFNINEPVIFGTPIVMNPVFFIPFLLAPMVNAVLAWAAMKLDLIGRVISVVPWTAPAPIGGAWALGWDFRAAILVIVLACVSAIIYFPFFKVYEKQLLAQEAEEAERAEQESQQTA

SEQ ID NO: 8917 - protein, 137 aa, Klebsiella pneumoniae
SVRSNSMRHYEIVFMVHPDQSEQVPGMIERYTGAITAAAGTIHRLEDWGRRQLAYPINKLHKAHYVLMNVEAPQEAIDELETNFRFNDAVIRSMVMRTKHAVTEASPMVKAKDERRERREDFANETADDSEAGDSEE

SEQ ID NO: 8918 - protein, 416 aa, Klebsiella pneumoniae
VKRRLAMSSFDYLKSAIKQKGCTLQQVAEASGMTKGYLSQLLNAKIKSPSAQKLEALHRFLGLEFPRRQKSVGVVFGKFYPLHTGHIYLIQRACSQVDELHIIMGYDDTRDRELFEESAMSQQPTVPDRLRWLLQTFKYQKNIRIHAFNEEGMEPYPHGWDVWSHGIRAFMSEKGIEPNRIYTSEEADAPQYLEHLGIETVLIDPKRTFMNISGGQIRENPFRYWEYIPTEVKPFFVRTVAILGGESSGKSTLVNKLANIFNTTSAWEYGRDYVFSHLGGDEMALQYSDYDKIALGHAQYIDFAVKYANKVAFIDTDFVSTQAFCLKYEGREHPFVQALIDEYRFDLVILLENNTPWVADGLRSLGSSVDRKEFQSLLVSLLKENEIEFVHVKESDYDARFLRCVELVKQLMGEQG

SEQ ID NO: 8919 - protein, 288 aa, Klebsiella pneumoniae
TRRRRPMIALTGATGQLGHYVLQDLLNTVPASQIVAIVRNPAKAQALSQQGVVVRQADYSDEAALTAALQGVDKLLLISSSEVGQRAVQHRNVINAAKAAGVKFIAYTSLLHADTSPLGLATEHIETEQMLADSGIAYALLRNGWYTENYLASAPPALEHGVFIGAAGEGKIASATRADYAAAAARVIASEGHEGKIYELAGDNAWTLSDLAAELSKQSGKNVVYQNLSEADFAAALKSVGLPAGLADMLADSDVGASKGGLFDDSRTLSTLIGRPTTSLAESVKGIL

SEQ ID NO: 8920 - protein, 94 aa, Klebsiella pneumoniae
NTFGSWTLANIKSAKKRAVQSEKARKHNASRRSMMRTFIKKVYAAIEAGDKAAAQKAFNEMQPIVDRQAAKGLIHKNKAARHKANLTAQINKLA

SEQ ID NO: 8921 - protein, 506 aa, Klebsiella pneumoniae
PASGLGAERGRRHGGLSGLRRHPADAQKRLRHARPGERGSGGGGDPPRSGEGQKPHRLPHRFQPGPASAGQSAIGYPAPAVAQDGALMNIAIIGSGIAGLTCAWRLAGHHQVTLFEAGATPGGHTATVDVATPQGTWAIDTGFIVYNDRTYPRFMGLLSELGIGGQKTQMSFSVHNPASGLEYNGHSLTSLFAQRRNLLKPAFWGLLSEIVRFNRLAKLALTEALDPGATLESFLTRHRFSPFFARHYILPMGAAIWSSSLQEMRRFPLPLFLRFFENHGLLDIRDRPQWYVVPGGSREYVRALLARLGDRLDLRLNAPVQQVDRHPAGVTLRLASGEAHFDQVIFACHSAQALAMLAAPTDSEREVLGDIGWQRNEVVLHSDPRWLPERQRAWASWNYRLSDGDRARACVTYNMNILQGLPAGAPLFCVTLNPDAPVDDRYVWQRFVYEHPLFNPQSWSAQLRREEINGQQRSWYCGAYWYNGFHEDGVRSALDVVQGIAAAEDN

SEQ ID NO: 8922 - protein, 67 aa, Klebsiella pneumoniae
PESGQGDAAGGTETKVLRPAQKRQAVHFLRGAYRISVRRGCGLLMQSRTVYHWQSRRDDRAITLRIR

SEQ ID NO: 8923 - protein, 118 aa, Klebsiella pneumoniae
RRAGRAAGRSLEKEIRRISMKEQFTTTVRVAGKGESKSRAFADALNHVQAAVMKSSSRILLRIEPQDVTVVHAREAVRKEAFLFFFLRRERRTYSVELDVTVNVTAIDLDKVDFVTQT

SEQ ID NO: 8924 - protein, 165 aa, Klebsiella pneumoniae
ALAGLSSIIMMSLDIPCFLFPEVYVQLTSFTDYGLRALIYMASLPEGRMTSISEVTEVYGVSRNHMVKIINQLSRMGYVTAVRGKNGGIRLGKPAGQIRVGDVVRDLEPLSLVNCSSEFCHITPACRLKQALAEAAQSFLKELDNYTLADLVEKNQPLYKLLLVE

SEQ ID NO: 8925 - protein, 374 aa, Klebsiella pneumoniae
RAAGPPASRPLRLPSAVKNHALHFLGYHANPKEMNMSIIKSYAAKEAGADLSLWEYDAGELQPEDVEVEVEYCGICHSDLSMIDNEWGMSSYPLVAGHEVIGRVAALGSAAQDKGLKIGQKVGIGWTARSCGHCDACISGNQINCLEGSVPTILNRGGFANKLRADWQWVIPLPESIDLASAGPMLCGGITVFKPLLTHHVTATSRVGVIGIGGLGHIAIKLLRAMGAEVTAFSSNPAKEQEVLAMGADRVVNSRDPEALKALAGQFDLIINTVAVDLDWQPYFQALAYGGNFHTVGAVMKPFPVPAFTLIGGDRSISGSATGNPSELRTLMKFAGRSKVAPTTELFPMSQINEALKHVREGKARYRAVLKADF

SEQ ID NO: 8926 - protein, 497 aa, Klebsiella pneumoniae
PRYGIFRIYLTLPASPAISTTLNILNGIFDCLSSDNKETCDMAYQTVNPANNQLIKTYPAHSDADVEAALQQADALYHSAWAKGDIEPRLAVLHKLADLIDSRAEELAKIASQEMGKLIKQSRGEVKLCAQIARYYADNAKSFLAPVKYPSELGEAWVEHHPIGVLLAVEPWNFPYYQLIRVLAPNLAAGNPVIAKHASIVPHCAETFAHLVREAGAPEGAWTNLFISQDQVAKIIADDRVQGAALTGSEKAGSVVAAQAAKHIKKSTLELGGNDVFVVLDDADLERAVKIGVQARLNNAGQVCTAAKRFILHENIADAFLTKFSEAFRQVKIGDPLDESTTLGPLSSKDALDTLSKQVDEAVKNGAKLHLGGKAVAREGNFFEPTILTGITRDNPAYFEEFFGPVAQIYVVKNDEEAIQLANDSHYGLGGAVFSQDIERAKRMASAIETGMVYINWLTDTAPELPFGGVKRSGYGRELSDLGIKEFVNQKLVVVRR

SEQ ID NO: 8927 - protein, 159 aa, Klebsiella pneumoniae
LGDGGLGRDPPAAGGDPGAGRSLDDVQPAPRCGGAGTEPSGDPAGGAAPSRRPTDGRSGRLRQCGRRGEGHGNQRRPGAAAGDGLQPARPSSAAGSGGLWRSGAGRGNSPGTERSGAYLRSGEARLPPRHRPGGQCAEKSAGRHANLWREKAFRRAKRF

SEQ ID NO: 8928 - protein, 132 aa, Klebsiella pneumoniae
SACGSSPAITCCFSSPGCRAFRPRRREAALMEGATRTQVFFKVTLPLLRPTLSFVITTALIYSITQIDHVAVMTRGGPDNATTVLLYYIQNLAWDTHDLGKASAATFLTLAGLFAFSLINLKLLEKGAHYER

SEQ ID NO: 8929 - protein, 185 aa, Klebsiella pneumoniae
  UNSURE (17),(18),(19),(20),(21),(22),(23),(24),(25),(26),(27),(28),(29),(30),(31),(32),(33),(34),(35),(36),(37),(38),(39),(40),(41),(42),(43),(44),(45),(46),(47),(48),(49),(50),(54),(55),(56),(57),(58),(59),(61),(63),(64),(66),(67),(68),(69),(70),(75),(76),(77),(80),(84),(98),(126),(137),(138),(146),(157),(185): Identity of amino acid at the above locations are unknown.
LSRGANTSINHLIIRDXXXXXXXXXXXXXXXXXXXXXXXXXXXXXXXXXXRGYXXXXXXKXGXXKXXXXXGGEVXXXRRXGGKXEKERKEGGKKGERXRGGGGGGGEGKEKRKRGGRERGEEKRRXRGGKGKREEEXXGGEERKEXEKEGEKRGERXGKGREGRRGGKKKRFGRERREGWRGGGX

SEQ ID NO: 8930 - protein, 64 aa, Klebsiella pneumoniae
CRSGRPHLVVNRSEEPEKKMMSGQLKPHVSPLLQVHNHMLIEFLVETFRWVKLLVSTWVLPTLV

SEQ ID NO: 8931 - protein, 118 aa, Klebsiella pneumoniae
VVLGDWRAGIYGRRQGRPDRHCRRGAELRETAGAAGEDRRQRLGAARQPGGALGYLWREGPPGAGDGLRSRPPAAGAPAQSQRGAERRTEHYFPHRGRPRPAAARLQRPPRHHPVYRR

SEQ ID NO: 8932 - protein, 102 aa, Klebsiella pneumoniae
RSSGILNISLEEIAIRKARFTEHQIIAVLKSVEAGRTVKDVCREAGISEASYYNWKAKFGGMEASDIKKMKDLEDENRRLKQMFADLSLECRALKDVIEKKL

SEQ ID NO: 8933 - protein, 79 aa, Klebsiella pneumoniae
PPSGFIRYLELIMFGNLGQAKKYLGQAAKMLIGIPDYDNYVTHMQTNHPDRPYMTYEEFFRERQQARYGGDGKGGVRCC

SEQ ID NO: 8934 - protein, 94 aa, Klebsiella pneumoniae
SKPGSRELFYGESPIMNDIELSQAQRDLLRDRLSKYCAETFDLELEQFDAEFFVDFIAKELGPLFYNAGIEEAIRTHQAWSERIQEEMDLKKVY

SEQ ID NO: 8935 - protein, 78 aa, Klebsiella pneumoniae
ANTGYLINWYLGKMRALLGDERLAALRQHCFFENQLADGQDNPLWRRVMLREGKLVRRTCCQRYRLPDVQQCGDCTLK

SEQ ID NO: 8936 - protein, 833 aa, Klebsiella pneumoniae
GHRGAIALTTTQTLAAQQIRQRFLLGHNRIREDLRFRLIGGAGDANAGDHIVFGGIRVTNRFDIQQRLIRRTGAQQLPFADNQVLTIGVETAVRNINLPVEAQPLLVLRHFQITGQTRFQAEGFQTNVVADVNGQVAVDRDAGALLLNRLEVFIQHHFIRGDADRALRHLVDHDPRPGHIHFAVEIEQAWRGGKHHIRRYIETHHRRHRDPHPAAFRRNLRPPVIDLRPVGVTAEGDLPLAGVHRPLQGRARAVEVHRQLARLHIKRHKVAVDIHPAQLHLAEQLRTFHIAAQTQTGVEPSLCLFTTSENRVDHRQREVADIDVAAEVTPPLRVGDLHLPIQLTIVGQADKPAQLGAIVVQVGAEVKRIERHRQRRVVDDLGHLDVAPAEGHFALRQSLFGGVPAHIGITSKHAAGLGRLRHKRLEHRQIEAVEIHPRPSAGARVNGFRHAELGVRVGPAVWPDADFLLQIAIVQRNAARQRYRPHRRLEAGIAQRALPAFGLTIEAACQRQLAGNRIALHAQPQLMLFLCTFGIELHLADIDPRLADAIHPHVQVTANLIGGFHIPFDVDLGDGQLLPAQRPGGDIGQQLRRIDSAAHFYQALRRPAEPRQRIIQVRRIDGGVEIKILHPQLAFDISAVRAQRQMQSRDFPLQIAVTLQRARHIHFVLLHVAGNFQLRHRHLPAAAVQAALGLDPAVKLRRPVRHLFGGVDAVEGQLAAPADRLLPVEQRLQLGFPFQGIDRQLVEIDLPFIAFGVEVDFRRRQRLTFHRGGEGQRIVGHFAAELQLDIVGLELLLAAERPGELLTLQFHIERQPGLRQLRIRAQRGHDRPA

SEQ ID NO: 8937 - protein, 204 aa, Klebsiella pneumoniae
LRSGWRCCRRTAAATAGGWAQRRRCRWRAPRCPPPLLMNSRPARRLAGRSGNKSAHMNTISTLSTADLTKAWHIEKRAHAFPWSEQTLASNQGERYRNYQLSVDGEMAAFAITQVVLDEATLFNIAVDPAYQRRGLGRALLEHVIDEVEKLGVVTLWLEVRASNVAAIALYESVGFNEATIRRNYYPTTDGREDAIIMALPISM

SEQ ID NO: 8938 - protein, 922 aa, Klebsiella pneumoniae
SPGGEVAAMKLTPQDTSPPVALLEHVGQQFGATIALRDISLAIPARRMVGLIGPDGVGKSSLLSLIAGARTIEQGNVMVLGGDMRDVHHRREVCPKIAWMPQGLGKNLYHTLSVYENVDFFARLFGHDKAERELRINELLQSTGLAPFRDRPAGKLSGGMKQKLGLCCALIHDPQLLILDEPTTGVDPLSRAQFWELIDNIRQRQPAMSVLVATAYMEEAERFDWLVAMNAGEVLATGSATELKAQTGSQTLEQAFIALLPEAQRRAHRAVVIPPRDSREEEIAIEARGLTMRFGNFVAVDHVNFRIARGEIFGFLGSNGCGKSTTMKMLTGLLPASEGEAWLFGQPVDPKDIATRQRVGYMSQAFSLYSELTVRQNLELHARLFHIPDGEIPGRVAEMCERFMLTEVEDALPVDLPLGIRQRLSLAVAVIHRPEMLILDEPTSGVDPVARDMFWQLMVDLARQDQVTIFISTHFMNEAERCDRISLMHAGKVLASDTPQALVEQRGSNSLEEAFIAWLKEAQPSSPVPEEPTSAVASHSGHTAPRQAFSLRRLFSYSRREALELRRDPVRSTLALLGTVILMFIMGYGISMDVEDLRFAVLDRDQTLSSQGWSQNLAGSRYFIEQAPLRSYDELDRRMRDGELAVAIEIPPNFGRDIARGTPVQIGVWVDGAMPNRAETVRGYVQAMHLAWLQEMAGRQSSPQRDTSLISIETRYRYNPDVKSLPAIVPAVIPLLLMMIPAMLSALSVVREKELGSIINLYVTPTTRSEFLLGKQLPYIVLGMFNFFLLCALSVFVFGVAHKGSFLTLTLAALLYVTIATGLGLLISTFMKSQIAAIFGTAIITLIPATQFSGMIDPVASLEGPGRWIGQIYPTSHFLTIARGTFSKALNISDLWGSFIPLLIAVPLVLGLSVLLLKKQEG

SEQ ID NO: 8939 - protein, 300 aa, Klebsiella pneumoniae
RRGGAQVEERMELDINELLNFSPLMKTFTFNAWVVAGFTPITRGSTLDYYINRPQGMKGYIINLTLRGQARAKAGDGFLLCRENDLLLFPPGVPHHYGRDEHSEYWDHLWIYFIPRPYWIDWLKWDQTTHGIGKTTINDPDQLQQLRDLFYEVIRHHSASVPLSEALAMNALERLILRCFQQQPISNRHAHDPRINAICDYLNAHIAQEVKIETLAAMVFISPSRLAHLFKNELGQTVYAWRDTQRINRARWLIQSTSLPLNKIALSVGYSDPVYFTRLFRKHNGIPPGEYRKRYAEMKG

SEQ ID NO: 8940 - protein, 750 aa, Klebsiella pneumoniae
KSLGYKGRVTMKKILIMTPDIEGPVRNGGIGTAFTALATTLAKKGYDVDVLYTCGDYSESSVSKFSDWSRIYSTFGINLLSTGLIKEINIDAPYFRRKSYSIYLWLKENNIYDTVISCEWQADLYYTLLSKKNGTDFENTKFIVNTHSSTLWADEGNYQLPYDQNHLELYYMEKMVVEMADEVVSPSQYLIDWMLSKHWNVPEERHVILNCEPFQGFVTRDDVTVKINEKPASGVELVFFGRLETRKGLDIFLRALRKLSDEDKESISGVTFLGKNVTMGKTDSFTYIMNQTKNLGLAVNVISDYDRTNANEYIKRKNVLVIIPSLVENSPYTVYECLINNVNFLASNVGGIPELIPQEHHAEVLFIPTPVDLYGKIHYRLKNINIKPGLAESQDNIKEAWFVAVERKNNRAFKKIDEANSPLVSVCITHFERHHLLQQALASIKSQTYQNIEVILVDDGSTTEDSHRYLNLIENDFNSRGWKIVRSSNNYLGAARNLAARHASGEYLMFMDDDNVAKPFEVETFVTAALNSGADVLTTPSDLIFGEEFPSPFRKMTHCWLPLGPDLNIASFSNCFGDANALIRKEVFEKVGGFTEDYGLGHEDWEFFAKISLQGYKLQIVPEPLFWYRVANSGMLLSGNKSKNNYRSFRPFMDENVKYNYAMGLIPSYLEKIQELESEVNRLRSINGGHSVSNELQLLNNKVDGLISQQRDGWAHDRFNALYEAIHVQGAKRGTSLVRRVARKVKSMLK

SEQ ID NO: 8941 - protein, 506 aa, Klebsiella pneumoniae
ILPGQLCQKVFHLHKTNRSLLRMSKNIMHSRHDEYHKLTRGERIGYGMGDFAQNLVFGTIGGFLALHMLTVNTISTATAGFIFLFVRIINVFWDPMVGTYVDKRTSKAGKYRPWLLRAGVPLVILSALLFAPIPGVKGSVAFAFIIYLALDLVYSLVNIPYGSLNASLTRDPESIDKLTSTRMMLANSANLLVYTLFPMFVQMAAPKDRSLKDTGFFGLELNLGNYTDPSANYAWFGVYAIYMIIGAVALFICYKCTKERVVATAEQTANVKTTDLFHELRHNRPLVILGMFFMLAFTFMFFMNTVNGFFNQFVVGHSEWMGAVGLVASIPGIAFPVFWPKLKKIFGKKGFFHLFLAMFIVGELLTYVWSREGMHDALWLAYIATFIKQWGLTSATGFMWALVPEVIAYGELKSGKRNAAIINAIMGLFFKIGFTIGGAIPLWLLAVYGFNESGAVQSASAIDGIIMTAVWIPIALAAISMVIMQVYPISDKHVTDINRQLDEIRV

SEQ ID NO: 8942 - protein, 722 aa, Klebsiella pneumoniae
LTPGFTMDTKKLFKHIPWVILGIIGAFCLSVVALRRGEHVSALWIVVASVSVYLVAYRYYSLYIAQKVMKLDPTRSTPAVINNDGLNYVPTNRYVLFGHHFAAIAGAGPLVGPVLAAQMGYLPGTLWLLAGVVLAGAVQDFMVLFISSRRNGASLGEMIKQEMGPVPGSIALFGCFLIMIIILAVLALIVVKALAESPWGVFTVCSTVPIALFMGIYMRFLRPGRVGEVSVIGIVLLVASIWFGGVIAHDPYWGPALTFKDTTITFTLIGYAFISALLPVWLILAPRDYLATFLKIGVIVGLALGIVILNPDLKMPAVTQYIDGTGPLWKGALFPFLFITIACGAVSGFHALIASGTTPKLLANETDARFIGYGAMLMESFVAVMALVAASIIEPGLYFAMNTPPAGLGIVMPNLHEMGGENAAMIAAQLKEVTVHAAATVSSWGFVISPEQILQTAKDIGEPSVLNRAGGAPTLAVGIAHVFHKIIPMADMGFWYHFGILFEALFILTALDAGTRAGRFMLQDLLGNFVPFLKKTDSLVAGIIGTAGCVGLWGYLLYQGVVDPLGGVKSLWPLFGISNQMLAAVALVLGTVVLVKMQRTKYIWVTVIPAAWLLLCTTWALGLKLFSSNPQMEGFFFMAQQYKEKIAAGGELTAQQIANMNHIVVNNYTNAGLSILFLVVVYSIIFYGIKTWLNVRNNKVRTDKETPYVPVPEGGVKTSSHH

SEQ ID NO: 8943 - protein, 244 aa, Klebsiella pneumoniae
LGEGADGPRGPDGGGIMQQLKQQVFEANMDLPRYGLVTFTWGNVSAIDRQRGLVVIKPSGIAYESMTVDDMSVVDLQGHVVEGRWRPSSDTATHLALYRRYPDLGGVVHTHSTHATAWAQAGLAIPALGTTHADYFFGDIPCTRALSAQEVDEAYELNTGQVIIETLGEANPLHTPGIVVYQHGPFAWGKDAHEAVHNAVVMEEVARMAWIARGINPQLQPIDSWLMNKHFQRKHGPNAYYGQK

SEQ ID NO: 8944 - protein, 169 aa, Klebsiella pneumoniae
GTRGTVPLPLHYSAAALMPEHASPGPVRRPGRLGWIALLPGVLIGFCLGAWMLAITLEWLGEAFFWRNTCASHSEQVLLATWQWWKSSAGAPMWLVEDLAIVSDTLQKGSAALIASLSGQSGLFWTETVTSVIRCALQSAIKLPLPFCCAGYFIAGATTVCADHCYRAD

SEQ ID NO: 8945 - protein, 72 aa, Klebsiella pneumoniae
HHGGCPVKSVRYFTLNFSGFTTAACEKQGYLRLIAGDHVFYTDKRYFNDPSLFDRLTINQPLHPGARSYCSR

SEQ ID NO: 8946 - protein, 190 aa, Klebsiella pneumoniae
GIMGNTKLANPAPLGLMGFGMTTILLNLANSGLFAFDVAILAMGIFYGGIAQIFAGLLEYKKGNTFGLTAFTSYGSFWLTLVAILLMPKMGLADAPNAHFLGMYLGLWGVFTLFMFFGTLKAARMLQFVFLSLTVLFALLAIGHLVDNEGIVKVAGWVGLICGASAIYLAMGEVLNEQFGRTVLPIGEPR

SEQ ID NO: 8947 - protein, 404 aa, Klebsiella pneumoniae
RFVGLIHSATDCGAAGARVERAAAEETGGMMRGLRNIYNLGVKELRSLLGDKAMLALIVFAFTVSVYSSATVMPGSLHLAPIAVADMDKSQLSSRIINAFYRPWFLEPELITADEMDAGLDAGRYTFAINIPPNFQRDVLAGRQPEIQVNVDATRMSQAFTGNGYIQNIITGEVNSFVARYRDNSVLPVELAVRMRFNPNLEQERFGAVMAIINNITMLAIVLTGSALIREREHGTIEHLLVMPVTPFEIMLAKIWSMGLVVLVVSGLSLVLMVQGILQVPIEGSVPLFMLGVALSLFATTSIGIFMGTLARSMPQLGLLMILVLLPLQMLSGGSTPRESMPQLVQDIMLTMPTTHFVSLAQAILYRGASFAIVWPQFLTLLAIGGVFFTIALLRFRKTIGEMA

SEQ ID NO: 8948 - protein, 98 aa, Klebsiella pneumoniae
ELTGGCRRPDKAFVPPSGTKMATVSAVSCPAALRLPGLVYRDLREDPVGRISVAPSGTKAGMAPEVSSPAALRLPGREWDSAERFAKKHPPPSNKKAG

SEQ ID NO: 8949 - protein, 451 aa, Klebsiella pneumoniae
SQTGRIVSGRYNHAVSTGLSKTQGICMQILMGLIGMVALLAIAVLLSNNRKAINLRTVLGAWIIQVGIGALILYVPAGRAALLAMSNGVASVIAYGNEGISFIFGGLVSDKMFEVFGGGGFVFALRVLPVIVFFSSLIAVLYYLGIMQLVIRILGGALRAVLKTSRTESLSATANIFVGQTEAPLVVRPYIATMTRSELFAVMCGGLASVAGSVLAGYAQMGVPLEYLIAASFMAAPGGLLFAKIIVPETEKPDDNPAHDSQSADADKPANVLDAAASGAASGMQLALNVGAMLLAFIALIALLNGILSGVGGWFNHPELSLQMILGWIFSPLAWVIGVPWHEATVAGSFIGQKLIINEFVAYMNFGEYLKADAEVAAAGLQVISDHTKAIISFALCGFANLSSIAILIGGLGGMAPNRRQDIAQLGLRAVAAGTLSNLMSATIAGVFLAL

SEQ ID NO: 8950 - protein, 586 aa, Klebsiella pneumoniae
RKQGYSGENVLKIRQLCVTSLLLVSGVASAANVRLQVEGLSGELEKNVRAQLSTIQSDEVTPDRRFRARVDDAIREGLKALGYYEPTIEFDLRPPPKRGRQVLIAKVTPGEPVRIGGTEVILRGGARTDSDYLALLKTRPAIGTVLNHGDYDGFKSSLTRVALRKGYFDSEFLKSQLGVSLDRHQAFWDIDYDSGERYRFGHVTFSGSQIRDEYLQNLVPFKEGDYYTSQDLAELNRRLAATGWFSSVVVAPDFAKSRKTKVLPLQGVVSPRKENTVETGVGYSTDVGPRVKATWKKPWVNSYGHSLTSSVSLSAPEQQFDFTYKVPLLKSPLEQYYLMQGGFKRTDLNDTQADSTTLGVSRFWEMSSGWQRAINLRWSLDHFTQANVTNTTMLIYPGVSVNRTRSRGGLMPTWGDSQRYSVDYSNTMWGSDINFIVMQAQDVWIRTLYDRHRFVVRGNLGWIEADNFDKVPPDLRFFAGGDRSIRGYKYKSISPKDDDGKLIGASKLATGSLEYQYNVSGKWWGAVFVDSGEAVSDIRESDFKTGAGVGVRWQSPVGPIKLDIARPIGDKEEHGLQFYIGLGPEL

SEQ ID NO: 8951 - protein, 379 aa, Klebsiella pneumoniae
PNKGARNMPSIFEKYHLKQVINTSGRMTALGVSTPRPEVVEAAMAGMNQYFEMKDLVNKTGEYIAKLLDVEGATVVSCASAGIAQSVAAVLVKDSDWLLENLHVTPIENNEIVLPKGHNVNFGAPVGTMVALGGGKLVEAGYANECSAQQLAAAITPRTAAILYIKSHHCVQKSMLNVAQAAEVARQHNVPLIVDAAAEEDLQCYYRMGADLVIYSGAKAIEGPTSGLVIGKTQYVEWVKRQSMGIGRAMKVGKEGILGLTCAIEHYLTASKESGQQMVDKMTPFIEQLNTLNGVTARVVWDSAGRDIARAEIKFDEVTTGVKTGDLVNALKQGEYAIYFRGYKANEGIIEADVRSVNAQQLEVVARRIAEVLNKEKQA

SEQ ID NO: 8952 - protein, 135 aa, Klebsiella pneumoniae
YTKGDDCLYGCCPKYLAKHRLVLGWQMRIEMKILLNWSPLRQLFTYIQERFTFLVLLCWPAIIWLFCRVGVWLTDNVYELLGKSPAQSFTVYLQPFMTPGTLLRISISWVVLLFILFSMAMAFTWGLRRFMNRHK

SEQ ID NO: 8953 - protein, 433 aa, Klebsiella pneumoniae
PLWGYQKQIWSIYMAWNQPGNNGQDRDPWGSSKPGGNSEGNGNKGGREQGPPDLDDIFRKLSKKLGGLGGGKGGLGGGNSAQGPRGPMGGRIVGIVAAAAVIIWAASGFYTIKEAERGVVTRFGKFSHLVEPGLNWKPTFIDNVQAVNVESVRELAASGVMLTSDENVVRVEMNVQYRVTDPERYLFSVTSADDSLRQATDSALRGVIGKYTMDRILTEGRTVIRSDTQRELEETIRPYNMGITLLDVNFQTARPPEEVKAAFDDAIAARENEQQYIREAEAYTNEVQPRANGQAQRILEEARAYKTQTVLEAQGEVARFAKILPEYKAAPEITRERLYIETMEKVLSHTRKVLVNDSKNGNLMVLPLDQMLKGAAAPAAKSDSSDASDLLRLPPASSSSSASTSSTSSSTGGSIMDQRRANAQRNDYQRQGE

SEQ ID NO: 8954 - protein, 215 aa, Klebsiella pneumoniae
LCLMKKLPDHLSRECIIAAIRAYDAGVAHQFKSARLYEIEFEGRRYPSKAIVGLAATLATGTEFTPTDFSGGIKSKCVRLLLDQGFTIASQGAGYDEVALFPDEGQTTMEFVEGAAMQVVINRYERDRQARQAALRLHGCRCQVCGLDMASRYGEIGQGFIHIHHLIPLSGIKQDYRLNPETDLIPVCPNCHAMLHRRDPPFTPEELKARLRPAD

SEQ ID NO: 8955 - protein, 374 aa, Klebsiella pneumoniae
EVIMNIKGKHYRTVWVSGDGKAVEIIDQTKLPFKFEVVALTSAEMAATAIQEMWVRGAPLIGVVAAYGIALGMNHDASDVGLQRYYDLLIKTRPTAINLKWALDRMIATLKDLCVSERKDVAWALAAEIAEEDVALCEQIGLHGAEVIREIAQKKPAGSVVNILTHCNAGWLATVDWGTALSPIYKAHENGIPVHVWVDETRPRNQGGLTAFELGSHGIPHTLIADNAGGHLMQHGDVDLCIVGTDRTTARGDVCNKIGTYLKALAAHDNHVPFYVALPSPTIDWTIEDGKTIPIEQRDGKEQSHVYGINPQGELSWVNTAPEGTRCGNYAFDVTRARYITGLITERGVCAASESALADRFADLKSKSLQDEQH

SEQ ID NO: 8956 - protein, 151 aa, Klebsiella pneumoniae
AMIIGNIHHLQPWLPAALREAIEHVIAQVSEATPLGKHDIDGDNLFYLISEDTTEPQAARRAEYHARYLDIQIVLRGSEGMTFSTLPPGELQTDWLAEKDIAFLAEGQQEKTVILNEGDFVVFYPGEVHKPLCAVGAPAKVRKAVVKMLMA

SEQ ID NO: 8957 - protein, 303 aa, Klebsiella pneumoniae
RNFFAQVTTMKIAFDVDVIKDLGITRMVHQVAEWGYKYIEQSPHPQINPFYKHPRASREIMAEYKQALRDTGLELSSFICVYRWSGPDELRRQAAVKNWKRLVEIAVEMGVQVINTEFSGDPNQPEICDEMFYRSMEELLPIFEREGIRVEIQAHPWDFCEENNETVDIVKSFRSDNVKYVYSVPHTFFYDKGVGDVASMLRYAGSDLSHVLIADTRNHTKHCRYIVNPPGVDAVVHQHVGVGEGDVDFDALFRTLREMKFAEQTFKVGGEPIVATSLFGYPEKMKYQAVETRELIERELLRR

SEQ ID NO: 8958 - protein, 437 aa, Klebsiella pneumoniae
NCVMSYANRPLNRQDYKTLTLAALGGALEFYDFIIFVFFAAVVGELFFPADIPEWLRQVQTFGIFAAGYLARPLGGIIMAHFGDLVGRKKMFTLSILLMALPTLAIGLLPTYSSVGIIAPLLLLLMRILQGAAIGGEVPGAWVFVAEHVPEKRIGIACGTLTAGLTVGILLGSVVATLINTSLTPQGIHDGGWRIPFLLGGVFGLVAMYLRRWLQETPIFLEMQQRKALAQELPVKAVALKHQKAVVISMLLTWLLSAGVVVVILMSPVWLQKHYGFAPAITLQANSIATIMLCIGCLLAGLAADRFGASRTFIVGSLLLAVASWAFYHLAGASPQRLFLLYGTVGLCVGVVGAVPYVMVRAFPAEVRFTGISFSYNLSYAIFGGLTPIAVTMLMGVSPMAPAWYVLALSLMGLGLGIWLRQELTAPTGMPEGELQR

SEQ ID NO: 8959 - protein, 264 aa, Klebsiella pneumoniae
PGVIGIRAANVRRHDDPGDRRADAAQDIGQHHHDAGIDAGVFRRADVDPYRLNKHAQRRFTGKQPEQQQRSGGDDHRRRKQQKRSAAEPRQGRGIKGDDLPGGDQLRHPAPGHHQDQRRHKGLDLKDRHEDAVPQSGQRARGQRGQQHHRQAVPGDGHRGGRRAGNRHHRPYRQVDAAGGDHQRHANRQQRHRRGAVENIDRAAKQAAILEHHLIKMGRHQAVYQQNQQQGNNLRGALRPGEASLLRAGLRKRSRHHGLLLMPQ

SEQ ID NO: 8960 - protein, 182 aa, Klebsiella pneumoniae
DRVMSSRILTSHFSGLEEFLQQHAALLAKSTDGTVAVFANNAPAFYALTPARLAQLLELEARLARPGSDIALDPQFFEEPAAAPVAVPMGKFAMYAGWQPDADFQRLAALWGIALSQPVTPEELAAFVAYWQAEGKVFHHVQWQQKLARSVQISRASNGGQPKRDVNSVSEPDSHIPRGFRG

SEQ ID NO: 8961 - protein, 420 aa, Klebsiella pneumoniae
KRSINTAYRRRRSIKPCIHHGYNGDSFSISRVRGRKTMSLITDLPAIFDQFSEARQKGFLTVMDLKEQNVPLVGTYCTFMPQEIAMAAGAVVVSLCSTSDETIEEAEKDLPRNLCPLIKSSYGFGKTDKCPYFYFSDLVVGETTCDGKKKMYEYMAEFKAVHVMQLPNSASDAASRALWKTEILRLQQVIEARFGTPISEAALREAIVLKNRERRALAHFYRLGQLNPPALSGGDILKVVYGATFRFDKTALIDELHAMAERIHQEWQQGKRLEPRPRILITGCPIGGAAEKVVRAIEENGGWVVGYENCTGAKATERCVAEEGDVYDALTDKYLAIGCSCISPNDQRLQLLSQMAEEYQADGVIDVILQACHTYAVESLAIKRHLRQQHDLPYMAIETDYSTADLGQLSTRVAAFIEML

SEQ ID NO: 8962 - protein, 397 aa, Klebsiella pneumoniae
DIPMKTQVAIIGAGPSGLLLGQLLHNAGIHTVILERQTPQYVLGRIRAGILESGTVDLLREAGVAQRMDAEGLVHHGVEFLFDGQRVPVALSELTDGKSVMVYGQTEVTRDLMAARAASGAPIVYGVSEVAIHDAKSDRPTITYLSEGETCRLECDFIAGCDGFHGVSRQSIPAGILQTYESVWPFGWLGLLADTPPVNPELIYAHHQRGFVLCSQRSLTRSRYYLQVPLSDKVEAWSDERFWQELKSRLPEELASRLVTGHSLEKSIAPLRSFVVEPMQYGRLFLVGDAAHIVPPTGAKGLNLAASDVNYLWRILREYYHRGRSDLLAAYSQLALDRVWKGERFSWFMTRLLHDFPDQNAFDAKMQAADRRYYLGSRAGLTTIAENYVGLPMERVA

SEQ ID NO: 8963 - protein, 149 aa, Klebsiella pneumoniae
GDTMHDSLTIALLQAREAAMAYFRPIVKRHNLTEQQWRIVRILAERPSMDFHDLAFRACILRPSLTGILTRMERDGLVLRLKPVNDQRKLYVSLTPAGTALYESAQAEVEETYRLLEAQFTTEKLQQLTSLLEEFIALGVPAGRGDEEE

SEQ ID NO: 8964 - protein, 116 aa, Klebsiella pneumoniae
IVTMPSRTTTRYVYLIRKIMMRELTAFEIENVSGAGWLQDGLAALGSKVGAAAWTMGTDALSINLPLLGTLNLADLAPDLGKTLGESIGSSIGGTIESTLASLPVIGGLLNKLLGN

SEQ ID NO: 8965 - protein, 287 aa, Klebsiella pneumoniae
GATMLAKSIPLGIYEKALPAGECWLERLKLAKALGFDFVEMSLDETDARLARLDWSPEQRLALVKAVAETGVRVPSMCLSAHRRFPLGSEDDAVRHQGLEIMRKAIQLAQDVGIRVIQLAGYDVYYQQANDETRRRFRDGLKQSVEMASRAQVTLAMEIMDYPLMNSISKALGYAHYLNNPWFQLYPDIGNLSAWDNDVQMELKAGSGHIVAVHVKDTKPGVFKNVPFGEGVVDFERCFETLKQTGYCGPYLIEMWSETSADPLAEVAKARDWVKARMARAGLMEAA

SEQ ID NO: 8966 - protein, 460 aa, Klebsiella pneumoniae
LTAISPREHTMSNTSWIERYVMPAALRIAGQKHVLSVRDGIILNMPFMLIGSFFLIFAYLPIPGYADMMSSLFGEVWRDKMLYPVKATYDIMALISSFGIAYRLAEKYRTLDPLSAGAMSLVAFMMTIPQNTLFTPVHGAAEVIKGVIPVSMVGSQGLFVAIVISLLSTEIYRLVASRNLVIRMPDGVPPAVAKSFLALIPGFCVLAVVLALRLAVEASPFGDINSMIATLIGIPMHHVGGTLPGMIISVILIGILWTLGLHGDAIVLVFIQPVWLSNMSENLTAFQNGQPIPHIITQQFYDLWIAPGGTGALLGLVIFMLLRSRSQQMKQLGKIAAPGALFNISEPMVFGIPLVMNPYFFLPFILTPVLLVIVSYTAMATGLVAPPAGIALPFTTPIFISGYLATGGHISGTVLQVVNLAISLVVYYPFFRAWDRLKAKEEHASAQPQASAAIADADRA

SEQ ID NO: 8967 - protein, 158 aa, Klebsiella pneumoniae
GAAMKLHESLAQNHSIRLQAEAETWQEAVKIGVDLLVAADVVEPRYYQAILDGVAQHGPYFVIAPGLAMPHGRPEEGVKKTGFALVTLKKPLIFNHEDNDPVDILITMAAVDATTHQEVGIMQIVNLFDDEANFDRLRACRSEQEVLDLIKNATAAAV

SEQ ID NO: 8968 - protein, 321 aa, Klebsiella pneumoniae
EKYIMTDKLTSLRQYTTVVADTGDIAAMKLYQPQDATTNPSLILGAAQIPEYRKLIDDAVAWARSQSSDRAQQILDASDKLAVNIGLEILKLIPGRISTEVDARLSYDTEASIAKAKRIIKLYNDAGISNDRILIKLASTWQGIRAAEQLEKEGINCNLTLLFSFAQARACAEAGVFLISPFVGRILDWYKANTDKKEYAPAEDPGVVSVSEIYEYYKQHGYETVVMGASFRNVGEILELAGCDRLTIAPALLKELSESEGAVERKLVYTGEVKARPERITESEFLWQHNQDPMAVDKLAEGIRKFAIDQEKLEKMIDELL

SEQ ID NO: 8969 - protein, 344 aa, Klebsiella pneumoniae
NLNIQEKTMLGFNQDEYLTSAREIIAARKQAETVADDIYDSGCSALFFASVGGSLAPMMAINEFAKELTSVPVYLEQAAELIHRGHKKLNKDAVVVTLSKSGDTKESVAIAEWCKAQGIRVVAITRHADSPLAAAASWHIPMCHKNGVEYEYMLLYWLFFRVIFRHGEFADYARFASQLELLPENLLQAKRQFDPRADSIAAQYHDCDYMMWIGGAEMWGEVYLFSMCILEEMQWKRTKSVSSAEFFHGTLELLEKEVPLFLVKGEGRCRALDERVERFAEKITDHLVVIDPRDYPLNGIDDAFRWVMAPCVVSTLLVDRLAAHFEHHTGHDLNIRRYYRQFDY

SEQ ID NO: 8970 - protein, 89 aa, Klebsiella pneumoniae
ARDIFDGQPVLHAEFSSGMVEVSLMLLNQTAMSKVWFTFGLVARVYHRHYCHTILSEGAIIRAVYIHLPEIVMDPDPTPHPRWSNLSFR

SEQ ID NO: 8971 - protein, 129 aa, Klebsiella pneumoniae
GGCMPHFIAECTDNIREQADLPGLFAKVNEALAATGIFPIGGIRSRAHWLDTWQMADGRQDYAFVHMTLKIGAGRSLESRQDVGDMLFALIKSHFATLMESRYLALSFAMEELDPTLNYKQNNVHALFK

SEQ ID NO: 8972 - protein, 245 aa, Klebsiella pneumoniae
FLCINLDVLRVFIVLKDTLRYNLNDDFCIERPTVSLFDKTHLVAQADALPGRNTPMPVATLHAVNGHSMTNVPAGMEVALFAMGCFWGVERLFWQLPGVYSTAAGYTGGYTPNPTYREVCSGQTGHAEAVRVVYDPQVISYEQLLQVFWENHDPAQGMRQGNDHGTQYRSAIYPLTPEQTEAAKASLARFQAAMNDAHDTRHITTEIATAKPFYYAEDDHQQYLYKNPHGYCGIGGIGVCLPPQA

SEQ ID NO: 8973 - protein, 70 aa, Klebsiella pneumoniae
ACSICQFTVPAKFTFRQLMTYNKTLIRFNRVFGFTFQLRFILLHQRLLLEQEPMIGGNKNSAGIKSATQA

SEQ ID NO: 8974 - protein, 307 aa, Klebsiella pneumoniae
ITGIVVINLQRLDLNLLRTLDVLLSENNVTRAAQRLNLSQPSVSIQLARLREIFADPLLMPGPRGMQPTARADELRQPLRAALAALEQAVAPVSPFDPATAAETWRVAATDYMASAILLPMLAGLRQASPGSRLAVFELQPARLEQQAASDTVDIFFHTREGAPPGLHQRLLFRECYVLAGRVEHPALRPGLSLETFCQLEHVIVSPDGGGFSAATDIALANLGLMRRVVLSVPHFLFMLETLRNSDLVAVLPERLVRGQSGLVVVEPPLAVAGFEMLMLWHERWHRDPAHQWLRQFIVNSLEEQTC

SEQ ID NO: 8975 - protein, 294 aa, Klebsiella pneumoniae
DYGMNKPDGLQAFEQPLASLPCTLRQLILERIQNLTHYEPVIGIMGKSGTGKSSLCNELFRGEVSPVSDVNACTRDVLRFRLRSGRHSLVIVDLPGVGENGRRDQEYRALYRRILPELDLVLWVIKADDRALTVDEQFWHDVMQPYRQKVLFVINQADKIEPCHEWDTLTSKPSPHQQGNLKAKQAAIMAMFKLHHPVCVVSASTGWGIEEMVAAMMRCLPDRATSPVVTQLQERLCTEPVKSQARDSFGDAVGRVFDTAESSSFLPAPLKTVIHTVRDAMVSVARAVWDWIFF

SEQ ID NO: 8976 - protein, 299 aa, Klebsiella pneumoniae
GAGMCQHSIANIDINKDYDESLGTEEVHYQSFSRMAAFFGRDMQAHRHDRYFQMHYLDTGQIELQLDDHRYSVQAPLFVITPPSVPHAFITESDSDGHVLTVHEELIWPLLEVLYPGTRETFGLPGICLSLADKPDELAALAHYWQLIRRESTAQLPGREHTLALLAQAVFTLLLRNAKLDDHAASGMRGELKLFQRFNQMIDSHYHQHWTVPDYARELHLTESRLTDICRRFANRSPKRLIFDRQLREAKRLLLFSDSAVNEIAWQLGFKDPAYFARFFSRQVGCSPSSYRAQKVPVS

SEQ ID NO: 8977 - protein, 475 aa, Klebsiella pneumoniae
GFIMSKVNQQDIDKLIELVGGRGNIATVSHCITRLRFVLNDPAIARPKEIEQLRMVKGCFTNAGQFQVVIGTEVGDYYKALLATTGQTSADKEQVKQAARQNMKWHEQLISHFAEIFFPLLPALISGGLILGFRNVIGDLPMSNGQTLAQMHPSLKTIYDFLWLIGEAIFFYLPVGICWSAVKKMGGTPILGIVLGVTLVSPQLMNAYLLGQQVPEVWNFGLFTIAKVGYQAQVIPALLAGLALGFIETRLKRIVPDYLYLVIVPVCSLILAVFLAHAIIGPFGRLIGDGVAFAVRHLLTGSFAPIGAALFGFLYAPLVITGVHQTTLAIDMQMIQSMGGTPVWPLIALSNIAQASAVVGIIIASRKQNEREISVPAAISAYLGVTEPAMYGINLKYRFPMLCAMIGSGLAGLLCGLNGVLANGIGVGGLPGILSIQPTYWQVYAMAMAIAVVVPIILTSVVYQRKYRQGTLQIV

SEQ ID NO: 8978 - protein, 293 aa, Klebsiella pneumoniae
GAIMNEYIAVDWGSTQLRAWRMRDGECIDKLKLPCGVTRLNGQRAEAVFQQQLAPWRGDPALPVVMAGMIGSDAGWQPVPYLACPLALEALNGQLYEVAEKVWIVPGLKVAQAADYDVMRGEETQLLGAWQLMPAECYVMPGTHCKWVQVQNGVVRQFATAMTGELHHLLLNHSLLGQQLPAQLPDEAAFALGMEKGLNQPALLSGLFSARTARVLGALAATSVSDYLSGLLIGAEVATFSERYRASRVVLVGEHSLSARYQQAMAARGLAVSCCSGEAAFLSGIARMIDGQD

SEQ ID NO: 8979 - protein, 117 aa, Klebsiella pneumoniae
MYVITANVKKKGQSTSQMTNDKDYHMILVIIIVVRGETMLQRALGSGWGVMIPGALIVALGYAGVSADVWRVLVAVGMLMSAAMIWHRQLRHFILLPSCVALIGGIMLMIVDIKLRG

SEQ ID NO: 8980 - protein, 307 aa, Klebsiella pneumoniae
GETMRLPIILDTDPGIDDAAAIAAALFAPELDLQLMTTVAGNVSVEKTTRNALQLLHFWNADVPLAQGASMPLVRPLRDAASVHGESGMEGYDFVEHQRQPLAKPAFQAIRDALMHAAEPITLVAIGPLTNIALLLTQYPECVFNIRRLVIMGGSAGRGNFTPNAEFNIAIDPEAAAKVFHSGLEIVMCGLDVTNRALLAADYLATLPTLNQTGKMLHALFSHYRSGSMSSGLRMHDLCAIAWLARPELFTLQPCFVAVETQGTWTAGTTVVDIEGRLGQPANAQVALDIDVEGFQRWAAEVIALAP

SEQ ID NO: 8981 - protein, 88 aa, Klebsiella pneumoniae
ILAMPTVSPCTTMVSPAKPIPLAVAATYTSPFTSLIVNYFHKSKYENSTCNNSAGGDAMSVACGSLANAACSPAGTTLWPDAKRHAVQ

SEQ ID NO: 8982 - protein, 296 aa, Klebsiella pneumoniae
QQAMLLREHGLFVFISLSDKELAMRLASRFGRINQIRRDRPLTHEELMSHVPSVFGSDKHESRSDRYTYIPTITILESLQREGFEPFFACQTKVRDQSKREHTKHMLRLRRAGQLTGHQVPEIILLNSHDGSSSYQMLPGLFRGVCTNGLVCGQSFGEVRVPHKGNVVEKVIEGAYEVLGVFDRVEEKRDAMQSLALPEPARNALANAALKYRFGEDHQPVTVSQLLTPRRREDYSDDLWTVYQRVQENLMKGGLSGRTAQGKSSRTRAVTGIDGDVKLNRALWVMAENMLDFFGR

SEQ ID NO: 8983 - protein, 241 aa, Klebsiella pneumoniae
VANMQTPHILIVEDELVTRNTLKSIFEAEGYDVFEATDGAEMHQILSENDINLVIMDINLPGKNGLLLARELREQADVALMFLTGRDNEVDKILGLEIGADDYITKPFNPRELTIRARNLLSRTMNLGTVSEERRSVESYKFNGWELDINSRSLVSPNGEQYKLPRSEFRAMLHFCENPGKIQSRAELLKKMTGRELKPHDRTVDVTIRRIRKHFESTPDTPEIIATIHGEGYRFCGDLQE

SEQ ID NO: 8984 - protein, 122 aa, Klebsiella pneumoniae
GENMTITGNFIGGKTVISSSNETMPVYDPATGKAVREVTVSTAQEVSEAIQVARDAFDSWSRTTPLRRARVLFNFKMLLEQHVEELAGIIVSEHGKVWSDALGELNRGMEVVEFACGDPAPD

SEQ ID NO: 8985 - protein, 331 aa, Klebsiella pneumoniae
GLCIMGKQRLTTAQALVKFLDNQYLEVDGVELKFVKGIFAIFGHGNVLGLGQALEQDSGDMRVYQGRNEQGMAHAATGFARQALRRQIIACTSSIGPGAANMITAAGTASANRIPLLLLPGDVFATRQPDPVLQQIEQSYDLSISTNDAFRAVSKYWDRITRPEQLMSACINAMRVLTDPAETGAVTLCLPQDVQGEAWDYPESFFARRVHRLDRRPASDAQLADAVAAIKSSRRPLIVCGGRVKYSGAGEPLSRFAERYGVPFAENHAGNGTVVSSHPLNLGGVSDTGCLGEKLLRDRCRPGDRRRHPLQRFYHRLEMDFPAPGGAFPEY

SEQ ID NO: 8986 - protein, 188 aa, Klebsiella pneumoniae
GLRMTLRSILAASLLLLPLLATAHNFVDGQRVAPVGVADRGELILDKDKFSYKNWNSAQLAGKVRVVQHIAGRSSAKEKNANLIEAIKAAGFPHDRYQTTTIVNTDDAIPGTGMFVRNSIESNKKLFPWSQFIVDSNGLVRKAWQLDEKSSAIVVLDKNGRVQWAKDGALTQQEVQQVIDLLHKLLNK

SEQ ID NO: 8987 - protein, 458 aa, Klebsiella pneumoniae
RMRIHILGICGTFMGGLAMLARSLGHEVTGSDANVYPPMSTLLENQGIDLIQGYDPSQLEPRPDLVIIGNAMTRGNPCVEAVLENNIPYMSGPQWLHDFVLRDRWVLAVAGTHGKTTTAGMATWILEACGYKPGFVIGGVPGNFDVSARLGDSPFFVIEADEYDCAFFDKRSKFVHYCPRTLILNNLEFDHADIFDDLKAIQKQFHHLVRIVPGKGKIILPENDINLKQVMAMGCWSEQELVGEQGHWQAKKLNADASQWEVLLDGEKVGEVKWALVGEHNMHNGLMAIAAARHVGVLPADAANALGSFINARRRLELRGEANGVTVYDDFAHHPTAILATLQALRGKVGGTARILAVLEPRSNTMKMGVCKDDLAPSLGRADEVFLLQPQHIPWQVAEVAEACVQPAHWSADVDTLAEMVVKTAHPGDHILVMSNGGFGGIHQKLLDKLAQKAAAAE

SEQ ID NO: 8988 - protein, 473 aa, Klebsiella pneumoniae
GYSMTRYQHLATLLAERIEQGLYRHGEKLPSVRSLSQEHGVSISTVQQAYQLLEQQQMIVPQPRSGYFVAPRKAQPPVPPMSRPVQRPVEITQWDQVLTMLDARYDKSIIPFGGGSPDVTQPSLKPIWRELSRAIQHNLTEVLNYDELAGRRELREQIARLMLDGGSVVTADDLVLTSGCHSALSLALLSVCQPGDIIAVESPCYYGTMQMLRGLGLKTIEIPTDPETGISIEALELALDQWPIKGVILVPNCNNPLGFIMPDARKRAVLNLAQRYDIVIFEDDIYGELATEYPRPRTIHSWDIDGRVMLCSSFTKTIAPGLRIGWIAPGRYYDKLLQMKYAASGTNVPSTQLAACNFIREGHYHRHVRRMRQIYQRNIEIYTCWLREFFPCGICVTRPKGGFMLWVELPEQVDMVCVAKQLCRLKIQVAPGSLFSAAGKYRNCVRINCALPPTEKHKAVMVKLGEAVKVAME

SEQ ID NO: 8989 - protein, 347 aa, Klebsiella pneumoniae
SSLISFPHEGTGMGNRMWMIRGDGGKLYDDFRDKQIVGIGWSQLAPLVKPGLSRAQLLALYQEADPLTKLGTARSGASQVWRFVNEIQKGDWVITYSPANRTYLLGKVTSDFQYHPEWVEEGMGIARQVKWNTQEIDRDRLSVATKNTLGSTLTVFQLPEYALEELLQDKKPTADVITQNPIAMDEDEVVSDPLRDMEMLAFEGIKDRINSLDWDEMQNLVAGVLRSMGYKTQVSPAGADRGKDIIASPDGFGFENPRIIVEVKHRREQMGSQQIRSFIGGRHKDDRGLYVSTGGFTKDARYEADRSTIPLTLWTLDDLVRALIENYEQVDIETKLLVPLKKTFLPA

SEQ ID NO: 8990 - protein, 311 aa, Klebsiella pneumoniae
KSLIHCKSLSDIKEGVGMVKLVGNDSSKIKYLENKLIENGYHFHSSGVDKDYRAYQLRVFNYLVSQNVSEQNINSFFAEVDNSYTRGFPSESELDWYRNDPRASLWLSCELYEKLKEETPKYNIDFLSPEALQPDHNVRIEAIRHCMDEWPMYFTTPAEFIKDKSIEWAELLDQHDLFRSVRSSKVDVCSWLRDYLRGNTSIGLKRICGNSSEEIMSWCYASYFIWRKNNLHSPDSVELFIRKFKSAWSTQKNRNKNKEEKKLVTMSVNISQQAHDMLRDMSMKDSMSNNAIIESAILRLYNSKNSKVRFK

SEQ ID NO: 8991 - protein, 64 aa, Klebsiella pneumoniae
FRLINIINRHSLFTTIPLIHATPSAMTLPEGLVYSTGWPSPALKKLILCKIINDGSQTGFYSHF

SEQ ID NO: 8992 - protein, 401 aa, Klebsiella pneumoniae
VALIFAFYELKGSSKAKKSPGSKGPGRISTKAELAGQVVEELLHAVKEAFRTRAVVFPGRTAEALLQLFQQLLLLLIQPHRRLHHHAAQQIALRAAANGFHAFSTHAEQLAGLGFTWNFQVHAAVERWDLDLTAQRRHGEVDRNFAVQVIAFTLKDSMLLHLNLNVQIACRRAMFAGFAFARQTDPVTGIHARRNFNRQGFGLFYAAMAMTFIARIFNQRTASLAVRTGLLYRKKALTHLHLACAMTGRTGLRFAAGLGAAAVADVALFQRRNTDLFSDAAHRFFQRQLHVVTEIGAACRALTTTSAAKDIAENIAKDIAEVGTAAKTAAAAHAALFEGRVAVLIVGRTLLGISQDFIRFFDFFKFGFSLFITLVAVRVIFHGQALISLFDFTLFRCFGNA

SEQ ID NO: 8993 - protein, 868 aa, Klebsiella pneumoniae
ESIMQFKELESGLRQKFTDNRIVFWHDPEQRFTDSLNELDLDNVALLDMRGVSVLATKKRLEIDEPEQKFLLYFTSEVPAREQDWLLDIRLYSTEFHADYAAITLNSLGIPQLGLREHIQLRKAFFTVKRTQILKGWVTERETESSLDKKMLAVVVGASTFETKEILFALIQQFVAARQQDDSALENTFAVLKKLGLDEVLWEILRVELGYQFESPSLENLLLKLFCTDLWAQGDEAHRDWLSKNVLVTAAGRASSLAFIGAWRNDRRYKAEYDYCAEDLQQTLQPKEHYNYSSPYALAKCETFEAIEQLIIRGLVTQLQEESTTLDRDAFKALVSERSAKYWSQTRPEYLSIWNAIRQAERLLNLRNHYTDGFNFPNTAAFWKAYCDEIYRFDQTYRLFNEYAAPVHSKGAMILHELDKFIEELYSNWYLAELSRGWNKLLEAENRMQAWQFSGIPLQRNFYKENVKRQFDTSQVKRVFVVISDALRYEVAEELGRHINHEKHFSAELRSQTGVLPSYTQLGMAALLPHESLSYLPDNSGVVYADGMSTSGFEKRATILAKVNGVALKAKDLQNANNQEVNEQIRNASVVYIWHDTIDAMGDKAATEDKTFEACRSAITELKDLVSRLRSRFNASRIFVTADHGFLFQQQALVEQDKTKLESKAKDTIEANKRFIVGHQLPESEFCWHGKLADTAGSSDESEFLLPKGVQRFHFVGGARFVHGGAMLQEVCVPVLKIRALEKKAAEKQPQRQPVSVVARDQVIKLVNSIDKVGFIQTSAVNDLNEPRTLNIFIVDENNQVVSGTETVCFDSDNEDMGKRTRDVTMKLMGTAFNRKNKYVLILENADSATEYGRYPITIDLAFQDDFF

SEQ ID NO: 8994 - protein, 117 aa, Klebsiella pneumoniae
VLAMRIFVYGSLRRKQGNSHWMTNAQWLGAHSVDDYQLYSLGHYPGAVPGEGTVHGEVYRIDASTLAELDALRTKGGEYARHLIQTPYGSAWMYVYQRSVEGCTLIANGNWLDRDQY

SEQ ID NO: 8995 - protein, 396 aa, Klebsiella pneumoniae
LRQIWRSAGRCQGHHWQCSTGGIMDQHPLVIKGYKSIAELSLVESPPFITFAGANGAGKSNITDALAFFGAVVKTGATQAIRDFGGFQQIHCYKLRKENRTTASLHLQIELGGKKFTYDLTIKTMDKKPTITEKLVIDGDIHIDRKHPDTLMIRLSDDEETPATYIPNYSSDMTALMLLGKSELYAFLTNIVVFRIDPLRAKEPDSAKTDSTFLDSHGRNIASVLAALESNSEFKEQILEWMELIVPGMENVSTEKQKLDGSTVLTFKEQGTRARFPAHLISDGTIFTLCIMTAILSRAQQTGMTIIEEPERGIHPKAIGELVQLMRENASLNHPIVITTHSESIVRNLEPDELWFVSKKEGKTQLMHASDAGVDKKEIPLDTAWLMNMFDGGLPW

SEQ ID NO: 8996 - protein, 638 aa, Klebsiella pneumoniae
MGKIIGIDLGTTNSCVAIMDGTTARVLENAEGDRTTPSIIAYTQDGETLVGQPAKRQAVTNPQNTLFAIKRLIGRRFQDEEVQRDVSIMPYKIVAADNGDAWLDVKGTKTAPPQISAEVLKKMKKTAEDYLGEPVTEAVITVPAYFNDAQRQATKDAGRIAGLEVKRIINEPTAAALAYGLDKEVGNRTIAVYDLGGGTFDISIIEIDEVDGEKTFEVLATNGDTHLGGEDFDTRLINYLVDEFKKDQGIDLRNDPLAMQRLKEAAEKAKIELSSAQQTDVNLPYITADATGPKHMNIKVTRAKLESLVEDLVNRSIEPLKVALQDAGLSVSDINDVILVGGQTRMPMVQKKVAEFFGKEPRKDVNPDEAVAIGAAVQGGVLTGDVKDVLLLDVTPLSLGIETMGGVMTALISKNTTIPTKHSQVFSTAEDNQSAVTIHVLQGERKRASDNKSLGQFNLDGINPAPRGMPQIEVTFDIDADGILHVSAKDKNSGKEQKITIKASSGLNEEEIQKMVREAEASAESDRKFEELVQTRNQGDHLLHSTRKQAEEAGYKLPADDKTAIESALTALESSLKGEDKADIEAKMQALAQASQKLMEIAQQQHAQQQAGSADAQASNAKDDDVVDAEFEEVKDKK

SEQ ID NO: 8997 - protein, 157 aa, Klebsiella pneumoniae
EAKMNYHQYYPVDIVNGPGTRCTLFVSGCVHECPGCYNKSTWRVNSGMPFTAGMADRIIADLNDTRIKRQGLSLSGGDPLHPQNVADILKLVQRVRAECPGKDIWVWTGYKLDELNEAQMQVVNLINVLVDGKFVQDLKDPALIWRGSSNQVVHHLR

SEQ ID NO: 8998 - protein, 278 aa, Klebsiella pneumoniae
QKRIAMHDAQIRVAIAGAGGRMGRQLIQAALQMEGVALGAALEREGSSLVGSDAGELAGAGKAGVAVQSSLAAVKDDFDVLIDFTRPEGTLNHLAFCREHGKGMVIGTTGFDDAGKQAIRDAAQDIAIVFAANFSVGVNVLLKLLEKAAKVMGDYTDIEIIEAHHRHKVDAPSGTALAMGEAIAGALNKDLKDCAVYSREGYTGERVPGTIGFATVRAGDIVGEHTAMFADIGERIEITHKASSRMTFANGAVRSALWLKDKKNGLFDMRDVLDLNSL

SEQ ID NO: 8999 - protein, 231 aa, Klebsiella pneumoniae
RRRILVTTLKPLLARNRSWALQKCQHDPDYFEKWVDGQRPHSLWIGCSDSRVPAEVLTGSQPGELFVHRNIANMLDPTDDNVMSVLQYALHYLEVERVVLCGHYGCGGVQAALSLPTLPLAQESSALARRIGQLRHTLHHEIAQIADGCGVAASSDASASVSTDAEPSRHALDALVEANVRAQFARLLESEPVQTVLASGRPLSLHGCVYDLASGHLTTLVEHLSPQEHAP

SEQ ID NO: 9000 - protein, 216 aa, Klebsiella pneumoniae
GAGMERITLAENIISTCREMNASGLNQGTSGNVSARYTGGMLITPSGIAYSKMTPDMIVFVDDKGISEAGKIPSSEWLFHLACYKARPELNAVIHTHAVNSTAVAIHNHSIPAIHYMVAVTGTDHIPCIPYYTFGSPELADGVSKGIRESKSLLMQHHGMLAMDVTLEKTLWLAGETETLADLYIKCGGLYHDVPVLSEDEMTIVLEKFKTYGLKA

SEQ ID NO: 9001 - protein, 175 aa, Klebsiella pneumoniae
VVLIMHHVVSATTNPAKIQAILQAFDEIFGEGSCHIESVAVESGVPEQPFGSEETRAGARNRVANARLARPNADFWVAIEAGIDDDSTFSWVVIESASQRGEARSATLPLPDVILEQVRAGEALGPVMSQYTGIDQIGRKEGAIGVFTGGRLTRSSVYHQAVVLALSPFHNAIYR

SEQ ID NO: 9002 - protein, 258 aa, Klebsiella pneumoniae
QGTFMDYPQILSPIISFLHCPTPQAWIDEARKPENLPLLLTDHMVCELKAAQNAMLLVRRYVADKADADELLACLKPYEDFTYRRGPEPDFVTLHKRINKSAMPQTDDPWGRQLLDSMILLIKEELHHFWQVREMMLARDIPYVKITASNYARGLRREVRSHEPVMLIDKLICGAYIEARSCERFAALAPWLDDDLQKFYLSLLRSEARHYQDYLDLAQKIAGEDISERVRQLGEAEAALILRPEAEFRFHSGVPVAA

SEQ ID NO: 9003 - protein, 73 aa, Klebsiella pneumoniae
DVLIKQNLPGGTSAVVPPDPMPNSEVKRRSADGSVGSPHVRVGNCQASNKAESPVERPGFLFYLLFVGERSPE

SEQ ID NO: 9004 - protein, 105 aa, Klebsiella pneumoniae
GVLIMTVRILAVCGNGQGSSMIMKMKVDQFLTQSNIDHTVNSCAVGEYKSELNGADIIIASTHIAGEITVSGNKHVVGVRNMLSPADFGPKLLEVIKAHFPQDVK

SEQ ID NO: 9005 - protein, 60 aa, Klebsiella pneumoniae; identical to SEQ ID NO: 8602

SEQ ID NO: 9006 - protein, 169 aa, Klebsiella pneumoniae
IRLMSKSICSTGLRWLWVVVAVLIIDLGSKFLILQNFALGETVSLFPSLNLHYARNYGAAFSFLADSGGWQRWFFSGIAIGICVVLTVLMYRSKATQKLNNIAYALIIGGALGNLFDRLWHGFVVDMIDFYVGDWHFATFNLADSAICIGAALIVLEGFLPKPTVKEQA

SEQ ID NO: 9007 - protein, 357 aa, Klebsiella pneumoniae
HTMMTPEQKFARWVRVSIAAFLGIFAWFIVADIWIPLTPDSTVMRVVTPVSSRVSGYVSHVYVHNNSQVKKGDLLYELDPTPFINKVEAAQIALEQAKLSNQQLDAQIAAARANLRTAQYTARNDKVTLDRYQRLSTMQNVSQSDLDKVRTTWQTSEQSVSALNAQIQNLLIQRGERDDKRNVTLQKYRNALEEAQLNLAWTKVRAETDGMVSNLQLNPGIYATAATAVLALVNNNTDIVADFREKSLRHTAVNTDAAVVFDALPGQVFPAHVTSSDAGILAGQEAVNGQLSQPEQSTRWVRDAQRMRIHVALDQPLDKPLPTGARATVQLYNSEGPFARTFAGLQIHLVSWLHYVY

SEQ ID NO: 9008 - protein, 159 aa, Klebsiella pneumoniae
GSMMITLLRVDHRLLHGQVAFSWTQYVGADCILIANDSVPGDELRKTTIKLAKPPSVKLVIKNINDSIEAIKSGVTDKYNLFIVVESVNDAWRIASAIDEIKSINLGGIKAKEGSKNISKAINLLPTEIEQLQQLVGKGVEVEIRQVPNDRKQLFAECV

SEQ ID NO: 9009 - protein, 329 aa, Klebsiella pneumoniae
KPVIESGLPSLSGKRMAMKKRMTSTPHDAVFKRFLRHPETATDFLTLYLPEAIRQRCDFSTLRLQSASFIDEDLRAWYSDVLWSVQTTCGTGYVYVVIEHQSSPDSHMAFRLMRYAIAAMQRHLDAGHKTLPLVVPMLFYHGATSPYPFSLNWLDEFADPQLAKTLYGCPFPLIDVTVMPDDDIVQHRRVALLELMQKHIRQRDLSGITESLAAVVMLGYTNRRQLRMLFHYMLQYGNTAEPGVFLRRLARRLPQYEETLMSIAQKLKQEGRQQGRLEGREEGHLEGLQEGSRREALRIAGSMLQNGLDKEMVQKITGLSTDELQPLCG

SEQ ID NO: 9010 - protein, 139 aa, Klebsiella pneumoniae
THSIIWLSVQMELCRLQSEAGYEGTSMKSTDSENDSFLKWGLNCNMTPCFGARLVQEGNRLHYLADRACITGEFSNAESLKLDEVFTRFIRQMESMLTTGEINPRHAHCVTLYHNGFTCEADTLGSCGYVYIAVYLTHR

SEQ ID NO: 9011 - protein, 380 aa, Klebsiella pneumoniae
KTPMAKQDYYEILGVSKTAEEREIKKAYKRLAMKYHPDRNQGDKEAEAKFKEIKEAYEILTDAQKRAAYDQYGHAAFEQGGMGGGGGFGGGADFSDIFGDVFGDIFGGGRGRQRAARGADLRYNMELTLEEAVRGVTKEIRIPTLEECDVCHGSGAKAGSKPQTCPTCHGAGQVQMRQGFFAVQQTCPHCQGRGTLIKDPCNKCHGHGRVEKTKTLSVKIPAGVDTGDRIRLAGEGEAGEHGAPAGDLYVQVQVKQHAIFEREGNNLYCEVPINFTMAALGGEIEVPTLDGRVNLKIPGETQTGKLFRMRGKGVKSVRGGAQGDLLCRVVVETPVGLNEKQKQLLKELQESFGGPTGENNSPRSKSFFDGVKKFFDDLTR

SEQ ID NO: 9012 - protein, 440 aa, Klebsiella pneumoniae
WRQIMFKPLTLVAVGLSLALSGAALAKEKIDFMFPAPVDGKLTMEMTRVIKQFNDSQQDVEVRGIFTGNYDTTKIKAESAQKAGQPPALVIMSANFTTDLALKDEILPMDELFKYGDQKAGDFLHKEFWPAMHKNAQVMGTTYAIPFHNSTPILYYNKTMFDRAGIKQPPQTWAELLADAKKLTDESTGQWGIMLPSTNDDYGGWIFSALVRANGGKYFNEDYPGEVYYNSPTAIGALRFWQDLIYKDKVMPSGVLNSKQISAAFFSGKLGMAMLSTGALGFMRENSKDFELGVAMLPAKEQRAVPIGGASLVSFKGISEAQKKAAYQFLTYLVSPDVNGAWSRFTGYFSPRKASYDTPEMKAYLQQDPRAAIALEQLKYAHPWYSTWETVAVRKAMENQLAAVVNDAKVTPEAAVQAAQKEADALMKPYVDKTALAEVK

SEQ ID NO: 9013 - protein, 255 aa, Klebsiella pneumoniae
RGQITEPKTSTLMSEMIYGIHAVQALLERAPERFQEVYILKGREDKRLLPLIHALEAQGVVIQLANRQFLDEKSEGAVHQGIIARVKPGRQYQENDLPDLLAQLDQPFLLILDGVTDPHNLGACLRSADAAGVHAVIVPKDRSAQLNATAKKVACGAAENVPLIRVTNLARTMRLLQEENVWIVGTAGEADHTLFQSKMTGPMALVMGAEGEGMRRLTREHCDELISIPMAGSVSSLNVSVATGICLFEAVRQRS

SEQ ID NO: 9014 - protein, 312 aa, Klebsiella pneumoniae
EFKMVKVYAPASSANMSVGFDVLGAAVTPVDGTLLGDNVTVEAAEQFSLQNLGRFASKLPTAPQENIVYQCWESFCREIGKTVPVAMTLEKNMPIGSGLGSSACSVVAALVAMNEFCGKPLNETRMLALMGEMEGRISGSIHYDNVAPCYLGGMQLMIEENGIISQQVPGFDEWLWVLAYPGIKVSTAEARAILPAQYRRQDCIAHGRHLAGFIHACYTRQPQLAAKLMKDVIAEPYRTKLLPGFSEARQAAMEMGAQACGISGSGPTLFALCDKPDTAQRVADWLGAHYLQNQEGFVHICRLDTAGARVVG

SEQ ID NO: 9015 - protein, 64 aa, Klebsiella pneumoniae
WNKMENGFFTVDYESMAGVVTTLVAHNIFSPFSQEIDDLPFTFVTPLGAQYDDVVTHFSKSPFA

SEQ ID NO: 9016 - protein, 432 aa, Klebsiella pneumoniae
GGFFLALASAQQAAQHAADDLIGDLANRAFRCGLHDTVAFSAARAGAAEQDIFQAAKQPVVIAVLLALRRRSRLLPGGDLHPLLQHFESRLAVHLLLILTVQRRVVQQTIALVIADRPHSRAGGDNHRPLDHRRAAFLIEEGDQRLAGAQLLDRLLGTEGRVGAHGLGGGFHRLLVLRRKSAQGMLHAVAQLAEHGVGNIRRVLRDKVDADALGADKADHLFNFIQQHLRRVVEQQMRLIEEEHQLRFIEVAGFRQALVELGEHPQQAGGVQLRHLVELFGAKDIDHPFTAGIDAHPVGNIQHRLAEEVLGALLLQGQQPALDGADRGAVNIAVLVLERLGVIADKLGDGAEVFEVEQQQAAVVRDAENNVQYAALHLVEIEQARQQQGAEIGDRRPHRVALLAKDIPEHHRVGVRLPVADADLLQPRLQFL

SEQ ID NO: 9017 - protein, 73 aa, Klebsiella pneumoniae
LTYFDFITIAHLLANTKNLHFPHGIKSKNKDKDEWLLVIFYLGVIRPLAVAGFLKDAPTINFSIKIWHVKAIK

SEQ ID NO: 9018 - protein, 492 aa, Klebsiella pneumoniae
MVNLSACRKGVIAMKVDWLFKNVTVIDGSGGPQYRADVAVKGDRIMAIAPALDVAAEQVIDGQGRVLAPGFIDVHTHDDINVIRMPEYLPKLSQGVTTVIVGNCGISAATATMRGEVPDPMNLLGEQQHFIYPTVEAYAHAVEAARPSLNVGTLIGHTALRNNHMDDLFRPANETEIAGMRVQLRDALRQGALGLSTGLAYASAFQSTTEEVMALAEELAAGKGVYTTHLRSEFEPILEALDEAFRIGRHGNVPVVVSHHKCAGAKNWGRTKETLAFFDEMRQQQDIACDCYPYSASSSTLDMKQVTDEFDIVITWSEAQPEQAGKTLQQIADEWQVSLHDAAARLMPAGAIYHNMDEQDVRRVMRYPVTMIGSDGLPNDPMPHPRLWGAFPRVLGHYSRDEQLFPLTTAVHKMTGLSAARFQLADRGLVKIGYFADLVLFDPQTVRDVASFSDPKRPADGIEAVMVNGVMSYGSDKKITGRAGRFLRRRMD

SEQ ID NO: 9019 - protein, 461 aa, Klebsiella pneumoniae
VINFPSEDLASTVRKDMLNSILVILCLIAVSAFFSISEISLAASRKIKLKLLADEGNVNAQRVLKMQENPGTFFTVVQIGLNAVAILGGIVGDAAFSPAFHSLLSGYLSPELSEQLSFIISFTLVTSLFILFADLTPKRIGMIAPETVALRIINPMRFCLLVFRPLVWLFNGMANMIFRIFKLPMVRKDDITSDDIYAVVEAGALAGVLRKQEHELIENVFELESRTVPSSMTPRESVIWFDLHEDEQSLKNKVAEHPHSKFLVCNEDIDHIIGYVDSKDLLNRVLANQSLVLTGGVQIRNTLIVPDTLTLSEALESFKTAGEDFAVIMNEYALVVGIITLNDVMTTLMGDLVGQGLEEQIVARDENSWLIDGGTPIDDVMRVLDIDEFPQSGNYETIGGFMMFMLRKIPKRTDAVKFSGYKFEVVDIDNYRIDQLLVTRIDNKPTVLVPKQAETAESQNA

SEQ ID NO: 9020 - protein, 251 aa, Klebsiella pneumoniae
  UNSURE (247): Identity of amino acid at the above locations are unknown.
LHFVPVIRTLAIYTHEQDINMRSRRKAMPGRFELTSSLAKIWHAPDHFRLLDPLPPMHRRGIIAGFLLVIIGILLPSDDSQSPASTSREANLNLQSQSQPQAGGNQAVPLPPITNTPTVSDADQMAPVAPEPIQDEQPDQAQTQQPAASQPYQSSSQQSAPGIEQQWRTYRIESGKTLAQLFRDHGLPATDVYAMAQVEGAGKPLSTLQSGQTVQIRQNANGVVTGLTIDTGNGQQVLFTRQSNGSXVRAR

SEQ ID NO: 9021 - protein, 134 aa, Klebsiella pneumoniae
NHPVHRPRRRLDGITRGVLIMNSLSKIALFTLLSGAVFAAQAANPHAGMAMHEEPAAAQAQSIRGKGVIKAIDMDSKKITIAHEAIPAVNWPPMTMRFTITPQTQLNNVKDGDSVDFTFVQQGNLSLLQDIRAQ

SEQ ID NO: 9022 - protein, 370 aa, Klebsiella pneumoniae
ILPVCCYSLCLFSSKLLTLLQFLSIFPLCVIPLSDYNVLRLIIMHKRLVVNIFSSLLLGAALISAPVYAAEKTVVNISKVDGMPWFNRMGEGVVQAGKEFNLNASQVGPSSTDAPQQVKIIEDLIARKVDAITIVPNDANVLEPVFKKARDAGIVVLTNESPGQPSANWDVEIIDNEKFAAEYVEHMAKRMGGKGGYVIYVGSLTVPQHNLWADLLVKYQKEHYPDMHEVTRRMPVAESVDDSRRTTLDLMKTYPDLKAVVSFGSNGPIGAGRAVKEKRAKNKVAVYGMMIPSQAASLIKSGDITEGITYDPATAGYALAAVASTLLNGKTIEPGFELKELGKAEVDSDKHIIRFHKVLLVNKDNIDSLY

SEQ ID NO: 9023 - protein, 492 aa, Klebsiella pneumoniae
GDTVMKKINHWINGKNVAGADYFHTTNPATGEVLAEVASGGEAEINQAVAAAKEAFPKWANLPMKERARLMRRLGDLLDQNVPEIAAMETADTGLPIHQTKNVLIPRASHNFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPTDPNTQVGALISQQHWEKVSGYIRLGIEEGATLLAGGADKPSDLPAHLKAGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 9024 - protein, 226 aa, Klebsiella pneumoniae
CGYVYGFSCHYYAKNSEHSAAISGKRSEDFRCELAIIPSTCLPYILKETDMSLLNVPAGKDLPEDIYVVIEIPANADPIKYEVDKESGALFVDRFMSTAMFYPCNYGYINHTLSLDGDPVDVLVPTPYPLQPGSVIRCRPVGVLKMTDESGEDAKLVAVPHTKLSKEYDHINDVNDLPELLKAQITHFFEHYKDLEKGKWVKVDGWDNAEAAKAEIVASFERAKQK

SEQ ID NO: 9025 - protein, 68 aa, Klebsiella pneumoniae
VLYVVICIKDVCDFIDPEQGKKVRVRMMGAGDKCKFRRLKYKQKSSPFRHETGKYSGNQRIVKQIDQQ

SEQ ID NO: 9026 - protein, 157 aa, Klebsiella pneumoniae
RRYVTIGITAAHYEERAMANPEHLEEQREETRLIIEELLEDGSDPDALYTIEHHLSADDFETLEKVAVEAFKLGYEVTEPEELEVEEGDMVICCDILSECALNADLIDAQVEQLMTLAEKYDVEYDGWGTYYEDPNGEDGDDDDEEYVDEDDDGVRH

SEQ ID NO: 9027 - protein, 459 aa, Klebsiella pneumoniae
TDNVERNMTTSTLQHNDNKAVEVENRVIKKLFRRLITFLFVLFVFSFLDRINIGFAGLTMGKDLGLTSTMFGLAATLFYVTYVLCGIPSNIMLAKVGARRWIAGIMVVWGIASTCTMFATSPHTLYILRMLVGIAEAGFLPGILVYLTWWFPAYHRARANALFMIAMPVTMMLGSILSGYILALDGLWNLKGWQWLFLLEGLPSVVLGVVTWFFLNDTPDKANWLDNEEKQALKAMIDREREHAAIVPASPRSTLREVLTPAVLMYTLAYFCLTNTLSAINIWTPQILQSFNTGSSNIMIGLLAAIPQFCTIFGMIWWSRRSDRRKERKMHTILPYLFAAAGWLLASATHHSLIQLIGIIMASVGSFTAMAIFWTTPDRVISLQSRAVALAVINAIGNVGSAVSPLLIGILRDTTGSFSSGLWFVAGLLIVGALVLTRIPMSQREDAAAAPGLAAQKGH

SEQ ID NO: 9028 - protein, 156 aa, Klebsiella pneumoniae; identical to SEQ ID NO: 8616

SEQ ID NO: 9029 - protein, 410 aa, Klebsiella pneumoniae
KDSVMKYHSAPLIPHKSALMSAPANLLAEEVCLPAALLKKSALENNISWMQRYADARGVSLAPHGKTTMTPWIFQAQQRAGAWGIGVGSVWQASAAMASGIQRVLMVNQLVGKANMQVVAQLKAHYRAVDFICCVDSEVNVRALSAFFADQGQTLDVLIELGVPGGRCGCRSVDDALALAQRVSDLPGLRLRGLELYEGVLHGDDPQPQVEALLQQAAALACRMEPLVDGEFILTGAGTVWYDVVCNIWLAAAKPRRCRIVIRPGCYITHDRGIYDLAQQELIARDPIACDLAGDLTSALELMAMVQSVPEADRAVVNFGKRDCAFDAGLPQPIAHYRNGQELALRAESIVSTGIMDQHCMLRLAPGSDVQVGDILLFGTSHPCLTFDKWKTLLLVDDDYNVLDELDTLF

SEQ ID NO: 9030 - protein, 209 aa, Klebsiella pneumoniae
RPGVFHWLALASTKETHPMQNNQRWEPDWFLQSLLNNHIDKLVERYSCLRAFRTDLFYQDHTAKYFLQDHQQLEWDIRKLMNRMMQLEAVVGFFWVIEWTEDHHYHAHVVFWLDGSKTQNTYPWAQQAGLYWSDITDREGWYHRCEFKEHYEANINIPVRYSDPDSITNIRQVMAYMTKIQQKQGMPLFGCNEVPERPSSGRPRKNVSK

SEQ ID NO: 9031 - protein, 66 aa, Klebsiella pneumoniae
EHFVQKSHTSQMQLHHHQHYQGLPYRQIDEIDDKILEANQILTSYWSFFILFNRSYRLLSYTTSIH

SEQ ID NO: 9032 - protein, 295 aa, Klebsiella pneumoniae
IHLVSRQNKESAMTTKMISEETLQPQAQEETRITPRDLRRVFWRSFQMEFSWNYERQMNLAFVYALIPVLKKLYPRREELAAALKRHLVFFNTTPHIVTLLLGITTAMEEKNSQQKNMDATAIDNVKASLMGPLAGLGDSFFWGTLRLIATGIGTSLALKGNILGPIMFLLVFNVPHILVRWCFTRWGYVLGTGVLQRIQKSGMMESLTYGASIIGLMVVGAMTASMIDITIPLSFGAGEAKTQVQDIINDILPCMLPLVSFGIVYWLLGRKVKPLSIIGGMALVGILGSWIGLF

SEQ ID NO: 9033 - protein, 65 aa, Klebsiella pneumoniae
LNTVGPPVKLYQTPFPSLCRMAANALSGLQSSVYQTVTQHVGPRKRSAAGQAVPDSVPVVVPDGG

SEQ ID NO: 9034 - protein, 463 aa, Klebsiella pneumoniae
EVNVAKAPKRAFVCNECGADYPRWQGQCSACHAWNTITEMRIAASPQVARNERLSGYAGNAGVSKVQKLSDISLEALPRFSTGFKEFDRVLGGGVVPGSAILIGGNPGAGKSTLLLQTLCKLAEGMKTLYVTGEESLQQVAMRAHRLGLPTANLNMLSETSIEQICQIADEEKPQLMVIDSIQVMHMADVQSSPGSVAQVRETAAYLTRFAKTRGVAIVMVGHVTKDGSLAGPKVLEHCIDCSVLLDGDADSRFRTLRSHKNRFGAVNELGVFAMTEQGLREVSNPSAIFLSRGDEITSGSSVMVVWEGTRPLLVEIQALVDHSMMSNPRRVAVGLEQNRLAILLAVLHRHGGLQMADQDVFVNVVGGVKVTETSADLALLLAMVSSLRDRPLPQDLVVFGEVGLAGEIRPVPSGQERISEAAKHGFRRAIVPAANVPKKVPEGMQIFGVKKLSDALSVFDDL

SEQ ID NO: 9035 - protein, 351 aa, Klebsiella pneumoniae
PNCVSDSWRRAPPMSGWVSSTTCWGPDNTRRRRFCQGAAGRSRVILEVARKVEQLAPEAFILNFTNPAGIVTEAVSRYSTAKIIGLCNVPINMQHMIVGMLGAQESEVKLRFAGLNHMVWVHKVLQGREDVTGKVIDMLCDGKALSMNNIKELPWPEEFLRALKAIPCPYHRYFWLTPAMLAEEIAAAKTKGTRAEQVMKVEQELFALYADPQLEEKPEQLSFRGGAYYSEVAVELINAIYNNLGAEMVVNTRNNGAIHGLDDDAVVETNSIIDAQGARPLAFGPLPPAMNGLTQQVKAFERLTIEAAVHGCRESALLALVTNPLVGNVTDAQALLDEVLTINRQWLTQFN

SEQ ID NO: 9036 - protein, 267 aa, Klebsiella pneumoniae
GSGVTHRFIDTHCHFDFPPFAADEVASLARAAQAGVGRIIVPAISAERFSRVLALAAQHEALYAALGMHPIVIEEHTDEGLAQLEALMAQRPPKLVAVGEIGLDLYRDDPQFDRQQALLEAQLRLAKRYDLPVILHSRRTHDKLAMLLKKHALPRTGVIHGFAGSLQQAERFVQLGYKIGVGGTITYPRASKTREVMARLPLSALLLETDAPDMPLNGFQGQPNRPEQAARVFEALCELRPESPAAIEEGIMHNTLALFSLPPVSVW

SEQ ID NO: 9037 - protein, 258 aa, Klebsiella pneumoniae
GAGVNYTVGIDSGSTATKGILLADGVIVRRFLCPTPFRPADAIHEAWETLRAGLTETPFLTLTGYGRQLVDFADKQVTEISCHGLGARLLAPDTRTVIDIGGQDSKVIQLDAGGNLSDFLMNDKCAAGTGRFLEVISRTLGASVEQLDAITDGVEPHAITSMCTVFAESEVISLRSAGVAPEAILAGVINAMARRSANFIGRLSAQGPLLFTGGVSHCAAFARMLESHVGMAVTTHPDAQFAGAIGAALIGQRQRRRG

SEQ ID NO: 9038 - protein, 91 aa, Klebsiella pneumoniae
FQSLRINTIPFITTECFQHIPNPTGKQFCTPCFEFTEEQPLNCRNVFHYTRMYIWICNRVPEPIDSVNKALVKVSSFYWIDYGYQSRTEDV

SEQ ID NO: 9039 - protein, 352 aa, Klebsiella pneumoniae
SAPVLMKECFMSAFTPASEVLLRHSDDFESARVLFAGDLQDDLPARLDTAASRAHTQQFHHWQVLNRQMGDTVRFSLVAEAADVAECDTLIYYWPKNKPEAQFQLMNLLSLLPVGSDIFVVGENRSGVRSAEQMLAEYAPLNKVDSARRCGLYHGRLEKQPTFDADAFWGEYTLDNLTIKTLPGVFSRDGLDVGSQLLLSTLEPHTKGKVLDVGCGAGVLAAALASHSPKVRLTLCDVSAPAVEASRATLASNGLAGDVFASNVFSEVNGRFDMIISNPPFHDGLQTSFEAAQALIRGAVRHLNSGGELRIVANAFLPYPQVLDETFGFHEVIAQTGRFKVYRTIMTRQAKK

SEQ ID NO: 9040 - protein, 163 aa, Klebsiella pneumoniae
TKTVATAPAGKGLPLRLAERIHYKVRENGRYQSKTVYTVMALNLAGKKETLGRYLSESKGANFWLSILSDLQNWGIEDILIACVGGLTGFPEAINNIYPQTEVQLCVIHQISNSIKYVASNDHKAFMADLKPVYRAGSKEAAETVLDELEAKWDQQYPVLLKS

SEQ ID NO: 9041 - protein, 155 aa, Klebsiella pneumoniae
ATAVIRKLPDGQGVSCVVGWTKELSMSIKRYGVEGGTGTGGQHLPFARAVEAGGWLYVSGQTPMKNGEVVEGGIVDQSRLAIQNCVDIMTEAGYTLPDVVHVKVILTDARYFQSFNKVFREFFGDNPPARICCVADLVVDCKVEVDVTCFNAARQ

SEQ ID NO: 9042 - protein, 182 aa, Klebsiella pneumoniae
MKGVLMKLWPVVTGVAIALTLVACKSPTPPKGVQPISGFDASRYLGKWYEVARLENRFERGLEQVTATYGARSDGGISVVNRGYDPVKKRWNESDGKAYFTGAPTTAALKVSFFGPFYGGYNVIRLDDDYQYALVSGPNRDYLWILSRTPTIPAAVKQDYLNTARELGFDVDRLVWIRQTPR

SEQ ID NO: 9043 - protein, 163 aa, Klebsiella pneumoniae
LEMVSIIKCKVNLMKKLNLLSLLPVMLFPLLIAGNAHAARPYSGFLPAAVNNKSGNIFWCDAHRQVRKLCTATEVDSMGWFIVVRSKPSRDCPGGIWGWITPSKDDVATGYTITPGKEFNLTMKDMCSPDMKVTFRPNKKDPRYDDLVGIYAGKEAFRYKQIK

SEQ ID NO: 9044 - protein, 72 aa, Klebsiella pneumoniae
PVAVICIEMNTGTVTSPFIYNKRAVYESLPHEQYSRLHIRQRPAASKSGHRNGRVIVVGPVSIACQEGYYVC

SEQ ID NO: 9045 - protein, 153 aa, Klebsiella pneumoniae
EDKVMQVILLDKVANLGSLGDQVNVKAGYARNFLVPQGKAVPATKKNVEFFEARRAELEAKLADVLAAAEARAEQINALESVTIASKAGDEGKLFGSIGTRDIADAVTAAGVKVAKSEVRLPNGVLRNVGEHEVNFQVHSEVFAKVIINVVAE

SEQ ID NO: 9046 - protein, 675 aa, Klebsiella pneumoniae
CQEVVCMSHLFYGVAYYDEYMPEDRLAKDIALMRETGINVVRIAESTWSTLEPEEGQYNFYHIDRVLEAMHEAGIAVIVGTPTYAVPAWLAAKHPDILVTTVAGQQKYGPRQIMDIVNPTFRRYAEKIIRTLMAHVQHHPAIIGWQLDNETKHYDNIGRYMQEGFVRSLQEKYPDLRQLNRDFGLDYWSNRIDRWQDFPPVENTINASLACAFSRYQRQQVTEYLAWQAAIVREYAQPHQFVTHNFDFEWRGYSYGVQPRVDHFAAAQALDIAGVDIYHPSQAHLTGREIAFGGAITRSLKPGQNYFVLETQAQGFAQWTPFPGQLRLQAFSHIASGAAMVSYWHWHSIHNAFETYWKGLLSHDFSRNPTWQEATTIGADFARLSPQLAELKAENDVALLISNEAMDALNHFLPGDARGNIYNDIFRRFHDALYDHNISLDIIHDVNEETSRYRVLIVPGLYAADEGLLTRINDYIARGGRALIGFKSGFSDENVKVRSSAQPGVLRQSCGVSYSQFTLPEETTVSSCCAEIDCRNDNQAELWMELLTPDDGTRTLLRYQHPAWGEYAAATEADYGQGRALYVGFLPQKGLISQLFDVLTADLTLNSRTSAYRYPLVVKKMRNRAGNNIHFLFNYSGEAMDVVSETLGTALLSGETVYVGQPLRLRAWEFTIIES

SEQ ID NO: 9047 - protein, 66 aa, Klebsiella pneumoniae
GKEVIQPQVPVRLPCYDFTPVMNHKVVSALPKVKLPTSFATHSHGVTGGVYKARERIHRSILIYDY

SEQ ID NO: 9048 - protein, 549 aa, Klebsiella pneumoniae
PQFFVFHMRGPWPRLLRRLIMTLSPYLQEVAKRRTFAIISHPDAGKTTITEKVLLFGQAIQTAGTVKGRGSSQHAKSDWMEMEKQRGISITTSVMQFPYHDCLVNLLDTPGHEDFSEDTYRTLTAVDCCLMVIDAAKGVEDRTRKLMEVTRLRDTPILTFMNKLDRDIRDPMELLDEVENELKIGCAPITWPIGCGKLFKGVYHLYKDETYLYQTGKGHTIQEVRIVKGLNNPDLDAAVGEDLAQQLRDELELVQGASNEFDKDLFLAGEITPVFFGTALGNFGVDHMLDGLVEWAPAPMPRNTDTREVTATEEKFTGFVFKIQANMDPKHRDRVAFMRVVSGKYEKGMKLRQVRIGKDVVISDALTFMAGDRSHVEEAYPGDIIGLHNHGTIQIGDTFTQGEMMKFTGIPNFAPELFRRIRLKDPLKQKQLLKGLVQLSEEGAVQVFRPIANNDLIVGAVGVLQFDVVVARLKSEYNVEAIYESVNVATARWVESTDVKKFEEFKRKNEVQLALDGGDNLTYIAPTMVNLNLTQERYPDVVFRKTREH

SEQ ID NO: 9049 - protein, 97 aa, Klebsiella pneumoniae
PFSLHVIDLSYCLKKRHKPQQPRSLRSLIGSPLGSRAIINISFTFLKCDVTHSVTSPIVYSLSAGETLTNNNPTRIPLCGSAYFLSQQFPQLCRLWR

SEQ ID NO: 9050 - protein, 64 aa, Klebsiella pneumoniae
SLSFVICDVLCPFFFTFAVMTYIHEGDKLSGLSIYIKYFAYFANNLFLHIVIRLFIFGFHHFEI

SEQ ID NO: 9051 - protein, 151 aa, Klebsiella pneumoniae
SLSFRFVSGNRMAWRSLPLSDELIWRAPLPTAEHALAESIREKIATLRPHLLDFLRLDEPAPRHALTLAEWSQPIALRSLLATWSDHIYRHQPTLPREQKPLLSLWAQWYIGLLVPPLMLALLNEPQGLSLAPEHFHVEFHESGRAGLLLD

SEQ ID NO: 9052 - protein, 62 aa, Klebsiella pneumoniae
QTSFVSITKDNKKIHMYKNKCDLFCHFNTSFRLRLPVIIPRAVLLFRHNNMNYIVIIDVILY

SEQ ID NO: 9053 - protein, 195 aa, Klebsiella pneumoniae
LVTLASFFKEPEMTKQPEDWLDDVPGDDVEDEDDEIIWVSKSEIKRDAEELKRLGAELVDLGKNALDKIPLDTDLRDAIELAQRIKKEGRRRQLQLIGKMLRNRDVDPIRQALDKLKNRHNQQVALFHKLEQIRDRLIDDGDDAVAEVLNLWPEADRQQLRSLIRNAKKEKEGNKPPKSARLIFQYLRELAENEG

SEQ ID NO: 9054 - protein, 261 aa, Klebsiella pneumoniae
KIFSNAGFAKGNMRMDIVGQLQEGMRRFSAQESRVATFILQNLSFTASASIDELAASAGVSPATITRFARSVGCDDIRDLRKQLAQASERRASWLTPDSAALPVAWRDKLSSLGVTLTRQLGHTAEAAVEKCKSRLLSARAVHCFALGAQDVTLAALLQHQLLPSGIAINLCQDAALMRLTASTLNDDHLLLVLATAEANPVLQSATLQARTQGVTIIALTPEQHALGDMASAILPLPADPQQARYALLLLVDLLNDTLIA

SEQ ID NO: 9055 - protein, 568 aa, Klebsiella pneumoniae
LLLSGRLWRPSLQQESTMNHLPHWWQNGVIYQIYPKSFQDTTGSGTGDLRGVTSRLDYLQKLGVDAIWLTPFYVSPQVDNGYDVANYTAIDPPYGTMADFEPLVDDAKAPRIRIVLDMVLNHTSTEHEWFRQSLNKESPYRQFYIWRDGEPDALPNNWRSKFGGNAWQWHADSGQYYLHLFAIEQADLNWENPAVRAELKKVCEFWADRGVDGLRLDVVNLISKDQTFPCDLDGDGRRFYTDGPRVHEFLQEMSRDVFTPRNLMTVGEMSSTSLEHCQQYAALDGRELSMTFNFHHLKVDYPGGEKWTLARPDYVALKALFRHWQQGMHNRAWNALFWCNHDQPRIVSRFGDEGEYRVTAAKMLAMVLHGMQGTPYIYQGEEIGMTNPHFSSISDYRDVESHNMFIERAAQGQSPDELLAILASKSRDNSRTPMPWHAGENGGFSDGEPWIGLGDNYQEINVEAALADPDSVFYTYQQLITLRKTLPLLTWGDYEDLLPEHPSLWCYRRQWQGQTLVVAANLSRELQAWQPAEAPGEWKMIISNYAETTPRPTGLTLRPFEAIWWLQG

SEQ ID NO: 9056 - protein, 70 aa, Klebsiella pneumoniae
DSVSLRLPYTVNLATEYKSLTHYTKGTQSHPKVLPLLVRTRFQVLFHSPRRGSFRLSLTVLVHYRSVRSI

SEQ ID NO: 9057 - protein, 256 aa, Klebsiella pneumoniae
AASSPASRLRCLPSWGLSWWVPPPPKPKTREKSLPRAINSIPLRIIMFYVFALIVIMSVTPWSSVVPSKSPFVELFVLVGLPAAASLINFVVLTSAASSANSGVFSTSRMLFGLAQDGQAPKMFAKLSKRAVPAKGLTFSCMCLLGGVVMLMVNPSVIAAFTMITTVSAILFMFVWTIILCSYLAYRKNRPQLHEKSSYKMPLGKVMCWVCMAFFVFVLVLLTLEDDTREALMVTPLWFVLLGAGWLFAGKKRLAK

SEQ ID NO: 9058 - protein, 173 aa, Klebsiella pneumoniae
HISSFYPCVSRRATVSGTSVAIKKAVECAFEVRMKRHYIFASHGSFANGLLNSVELILGKQPDIHTLCAYVEEEVDLTQQVEALVARFPAQDELIVITDIFAGSVNNEFVRFLSRPHFHLLSGLNLPLIIDLLISAAEDDTEKLITEALTNAKESIQYCNQTIASAMTMDKDF

SEQ ID NO: 9059 - protein, 91 aa, Klebsiella pneumoniae
SPPSICAPGMNIAKDNVVAKIQGMDPVWVNLGGPPSPSPGLIKTPRQFSIQVSRLAGQNLPHQQMGRSSPASIAPPAPCSCACRSTTRMKR

SEQ ID NO: 9060 - protein, 251 aa, Klebsiella pneumoniae
KPTSDPSLPPGGPLARRFPRRFIKPSSPRHASVVIASHNPGFDKWLNEMRVTMRKTWLPWLILSPSLLFLLLFTWFPLGRSVYDSLFDTRMASDGAQYVGLDNFARLFADNVFWQSLGNNLLYILLTVVPGVTLALLLAVALSENHRVNRWLRTAFFFPMIIPMVSAAALWLFIFMPGLGLLDHYLAKLFGPMNNNWLGRSNSALLALALIGVWKFAGYYMLFFLAGLQSIPASTPGSGADGGGYPHAGLF

SEQ ID NO: 9061 - protein, 174 aa, Klebsiella pneumoniae
SDYSVTLMSPSMKSFKNSVVAALAVSAFTLSGAHAASWQDSLNSAASQLSGSNAQASGGMSVSSLTSLLNGSSQSLTASSMNNAAGILSYCAKQKLASVTSADNVKNQVLDKLGLSTPEKQKQDTSYLDGLQGLLNSKNGQQLDLNTLGNSSLAKQVKTKACDLVLKQGVNFLS

SEQ ID NO: 9062 - protein, 307 aa, Klebsiella pneumoniae
MKNSLHLVHWKPYSFHFLRAHSMANNPTQLTILQDEIRRRYDTLSKRLKQVARYILDNSNSVAFDTVASIAQQADVPPSTLIRFANAFGFSGFNEMKQMFKQHLMEETANYTERARLFRQTTSDESSPPETPTEILNMFTMVNNQALQQLAMQTSSDDLERAVALLGEAENIYVIGLRRSFSVASYLTYALRHLDRKAFLIDGLGGMFTEQLSLVGPKDVVVAVSFSPYAREVVELVELGAQRKARQIAITDSQVSPLAAFSDVCFVVREAQVDGFRSQVASLCLAQTLAVSLALNSSQESEAKQKA

SEQ ID NO: 9063 - protein, 128 aa, Klebsiella pneumoniae
RTGSPAAAAAAPGPGSTAATACAACGSAAWLATAATCAAARTTATPAAACCAAACRAATGDADRRSAAASRPAAACATACCRVAARHRGTAAGRAAAARRAAAERAQRDGHSDERRRASWGPSLTVKC

SEQ ID NO: 9064 - protein, 301 aa, Klebsiella pneumoniae
HWTSLVYNSGRMSTFKPLKILASRRQVLKAGLAAMTLSGVASQVSAKEQPLKTSNGHSKPAAKKAGGRRIVMLDPGHGGIDTGAIGHNGSKEKHVVLAIAKNVRSILRSNGIDARLTRTGDTFIPLYDRVEIAHQHGADLFMSIHADGFTNPSAAGASVFALSNRGASSAMAKYLSDRENRADEVAGKKATDKDHLLQQVLFDLVQTDTIKNSLTLGSHILKKIKPVHKLHSRNTEQAAFVVLKSPSIPSVLVETSFITNPNEEKLLGTTAFRQKIATAIANGIISYFHWFDNQKAHSKRR

SEQ ID NO: 9065 - protein, 192 aa, Klebsiella pneumoniae
DMKSLRVMLCALPLALTGCSTMSAVNWSAAYPWNWFGASTEVTEQGVGKLTASTPLNEQAISDALGSDYRLRSGMKTDKGNIVHYFEALKNNSVALTINGDNGAISRIDVRDADIKTARGVKIGTPFSDLYSKAFGNCQKGSHDNGAVVECQAEGSQHISYAFTGHWSGPDELMPSDDTLKNWKVSKIIWRR

SEQ ID NO: 9066 - protein, 694 aa, Klebsiella pneumoniae
RRGSACSPSISANWKICLPPNCHFSLTEKNMSRRELANAIRALSMDAVQKANSGHPGAPMGMADIAEVLWNDFLKHNPQNPDWVDRDRFILSNGHASMLLYSLLHLTGYDLPLSELKQFRQLHSKTPGHPEHGYTPGVETTTGPLGQGLANAVGMAIAERTLAAQFNRPGHEIIDHHTWVFMGDGCLMEGISHEACSLAGTLGLGKLIGFYDHNGISIDGKTEGWFSDDTAERFRAYHWHVIGDIDGHDPQAIKQAITEAQAVKDKPSLIICRTIIGFGSPNKAGSEESHGAALGEKEVALARQQLGWKYPPFEIPKEIYAGWDARPRGEKAEHAWNEKFAAYQQQFPELAAELTRRMNGALPEDFAATARDYVAKLQAEPAKIASRKASQNALNAYGPHLPELLGGSADLAPSNLTIWSGSTSIKEDPAGNYIHYGVREFGMTAVANGIALHGGFIPYTSTFLMFVEYARNAARMAALMKARQIMVYTHDSIGLGEDGPTHQAVEQLASLRLTPNFSTWRPCDQVETAVAWQAAIARQGGPTALILSRQNLAQMPRTPEQVQDIARGGYVLKDAGGKPDLILIATGSEVEITVLAAEKLLAKGVNVRVVSLPSTDVFDAQDEAWRESVLPSDVSARVAVEAGIADYWYKYVGLKGKIVGMTGYGESAPAEQLFPFFGFTVDHIVATAEQVLNG

SEQ ID NO: 9067 - protein, 165 aa, Klebsiella pneumoniae
SVSSSPPLAALPACLAACFKPLPASWLAGETAADTGLADPDAAPPPTREPAAFAAAPLPPPVLAPIPALLTPVAPPMPPAVLPPAMLAFSAEASPPPAALAAPPPVPAAPSAPAAGAAAPAVATVATAAAAPAAPAAAMPPIAEPPPIDVPLIMPPISSGMVLVR

SEQ ID NO: 9068 - protein, 360 aa, Klebsiella pneumoniae
APWSGLSGVGRFMLFRVIFFLFLAVLPCSQAWSAPTQQRFNDWLVTCNNQNFCVTRNVGLHHGLVMTLSRSAGAVTDASLRIELGGTGNPVATLAPIAPRLLLDGKPLPLTDKRWHIEDKLIKTADSVTIDAFLQQVQEGKALSLANGLQTISLQGLKAALFFIDDRQKRVGSETAWVGKGEEPPLSVPPAPALRAVASAETAQSPLGREELNDLMDYGNERMTNSHCSLDPFRREIRVTALTDDKVLLMTSCESGAYNTVWLAWLVSRQRPYVARQVRLTLPFQPPGEAPREIELINASYDDRRHELVTLDKGRGAGDCGIQTRWRFDGQRFSLSRYAQQPTCDNWQGPDAWPTLWITR

SEQ ID NO: 9069 - protein, 345 aa, Klebsiella pneumoniae
TISPAAIRIRPDWPDLPRYLGQIARTPRLYGDAPIEPRLGQWAEAWFAREIAVPFAVNLASGAIDALERLLCALLLPGDGVVVEDPCFLSSINMVRYAGFTPCPVAVDAEGMDPDGLEEALRNGARAVILTPRAHNPTGCSLTETRAHALREVLARYPQVLAIVDDHFALLSATPWHSPLPASTQRWALVRSMSKTLGPDLRLAFIASDAATSAALRLRLNAGSQWVSHLLQDLTLACLTDEAFIASMTETRRHYRQQNEKLAAALARHGFSHATPGDGLNFWLPLPAASQPYALRLARAGWLVREGEVFGIRTPSHGLRLSLGRLSDAEISRLAADIAQALDAP

SEQ ID NO: 9070 - protein, 233 aa, Klebsiella pneumoniae
GEHPGGRLYRHWYASFWRIGCAGDGEITRISFLRERLMKLKTTLFGNVYQFKDVKEVLAKANELRSGDVLAGVAAESSQQRVAAKQVLSDMTVADIRNNPVIPYEEDCVTRLIQDDVNETAYQRIKHWTISDLREYVLNDEVTSDDIAFVRKGLTSEVVAAVAKICSNADLIYGGKKMPVIKKANTTIGLPGTFSCRLQPNDTRDDVQSIAAQIYEGLSFGAGRRGDWRQPGH

SEQ ID NO: 9071 - protein, 157 aa, Klebsiella pneumoniae
PMTPLKAGDIAPKFSLPDQDGEEVNLTDFQGQRVLVYFYPKAMTPGCTVQACGLRDNMDDLKKAGVEVLGISTDKPEKLSRFAEKELLNFTLLSDENHQVCEQFGVWGEKSFMGKTYDGIHRISFLIDADGKIEHVFDDFKTSNHHDVVLNWLKENA

SEQ ID NO: 9072 - protein, 308 aa, Klebsiella pneumoniae
PESPFEETLMKPDAAQVKTFLLQLQDNLCQQLSAVDGAPFIEDAWQREGGGGGRSRVLREGRVFEQAGVNFSHVHGDAMPASATAHRPELAGRSFEAMGVSLVVHPLNPYVPTSHANVRFFIAEKPGADPVWWFGGGFDLTPYYGFEEDAVHWHRTARDLCLPFGEEVYPRYKKWCDDYFYLKHRQEQRGIGGLFFDDLNTPDFDHCFALMQAVGNGYADAYLPIVERRKATPYGERERHFQLYRRGRYVEFNLVWDRGTLFGLQTGGRTESILMSMPPLVRWEYDYQPEPGSPEAALSEFIQVRDWL

SEQ ID NO: 9073 - protein, 191 aa, Klebsiella pneumoniae
LPSPVGILVVTANIVKRDLIRDPGPESFDVCHRACRRSFPVSSVSTPTPTYGENIGVMAITRVYSTWVIGGAAIIAILLSCVGKLAAAIQIIPVPVMGGVSLLLYGVIGASGIRVLIESKVDYSKAQNLILTSVILIIGVSGAKVHIGAAELKGMALATIVGIALSLIFKLISVLRPEEVVLDAADSEEFK

SEQ ID NO: 9074 - protein, 310 aa, Klebsiella pneumoniae
SKKPIPPSVCRGPLAAACSRTIPATTCRVLPRKSMKGSPSAPGDAVIGVNPVTDDVENLSRVLDTVYGVIDKFNIPTQGCVLAHVTTQIEAIRRGAPGGLIFQSICGSEKGLKEFGVELAMLDEARAVGAEFNRIAGENCLYFETGQGSALSAGANFGADQVTMEARNYGLARHYDPFLVNTVVGFIGPEYLYNDRQIIRAGLEDHFMGKLSGISMGCDCCYTNHADADQNLNENLMILLATAGCNYIMGMPLGDDIMLNYQTTAFHDTATVRQLLGLRPSPEFERWLETMGIMANGRLTKRAGDPSLFF

SEQ ID NO: 9075 - protein, 255 aa, Klebsiella pneumoniae
LIQLNGMVISGERRTLPANTKETAMKHDHFIVQSPATPAQQLLLLFHGVGDNPVSMGQIGSWFAPQFPDALIVSIGGVEPCGPNGRQWFSLQGVTEENRQQRIDAIMPTFIEIVRYWQEKSGVSPLATALIGFSQGAIMSLESIKAAPDLASRVIAFNGRYATLPETATTATTIHLIHGGEDRVIDLAWAVSAEEALQQAGGDVTLDIVDDLGHAIDDRSMQLAIERLRYTVPKHYFDEALSGSTPKGDDIIEML

SEQ ID NO: 9076 - protein, 371 aa, Klebsiella pneumoniae
HFDTIPRIVAAWPFREGFMLEMLMQWYRRRFSDPEAIALLVILLAGFGIMFFFSGLLAPLLVAIVLAYLLEWPTVRLERIGLSRTWATSLVLILFVGILLLLAFVVLPVAWQQGIYLIRDMPGMLNKLSDFAATLPRRYPALMDAGIIDAMAENMRTRMLTVGDSVVKYSLASLVGLLTLAVYLVLVPLMVFFLLKDKEQMLNAVRRVLPRNRGLAGQVWKEMNQQITNYIRGKVLEMIVVSVATWIGFILFGLNYSLLLAVLVGFSVLIPYIGAFVVTIPVVGVALFQFGAGTEFWSLFAVYLIIQGLDGNLLVPVLFSEAVNLHPLVIILSVVIFGGLWGFWGVLFAIPLATLIKAVVHAWPDGLAVDD

SEQ ID NO: 9077 - protein, 103 aa, Klebsiella pneumoniae
IFFTGTLSPDGSGPVLFSLANMVKPGTFNPDSMADMMTPGVTIFMQVPSYGDELQNFKLMLQSAQYIADEVGGVVLDDQRRMMTPQKLREYQDRIREVKDANA

SEQ ID NO: 9078 - protein, 125 aa, Klebsiella pneumoniae
NVVTMRTDFRGQSVMDKERIIQEFVPGKQVTLAHLIAHPGAELAKKIGVPESGAIGIMTLTPGETAMIAGDLAMKAADVHIGFLDRFSGALVIYGSVGAVEEALLQTIGGLGRLLNYTLCELTKS

SEQ ID NO: 9079 - protein, 97 aa, Klebsiella pneumoniae
VHNTKPISWGNIMFQQEVTITAPNGLHTRPAAQFVKEAKGFTSEITVTSNGKSASAKSLFKLQTLGLTQGTVVTLSAEGEDEQKAVEHLVKLMAELE

SEQ ID NO: 9080 - protein, 100 aa, Klebsiella pneumoniae
EENTMEALGMIETRGLVALIEASDAMVKAARVKLVGVKQIGGGLVTAMVRGDVAACKAATDAGAAAAQRIGELVSVHVIPRPHGDLEEVFPISFKGDSNI

SEQ ID NO: 9081 - protein, 285 aa, Klebsiella pneumoniae
AMTTVFIAGSISISRLHAKVQERINKIVSSNFNVVVGDADGADSSIQECLRNYQANNVTVYCTGETPRNNIADWPVHRVYSKAKVGSRAYFTAKDLEMARSSDYGLMIWDCKSTGTLSNVIELLRERKKSVVFINKDKDFVTISDISGLEHLLTFMSPHARTKAEEKIGLTSKIASISHEQFSLDVSVEDKTAAMPDEQTGQDPFNENAAQTESMKLRSELMSALKQHIVNAHLSQSQAAKVFGVTQPRISDLTRGKVDLFGLDALVNMAATAGLHVEMHVRRTA

SEQ ID NO: 9082 - protein, 290 aa, Klebsiella pneumoniae
LPATGRTCRSRVALTLNRPTIHVGPRKRMDCTPHPSRSLASGFFVSKSLCLIYVKQDGYGTIRKKRYNPAIFFVAAPQRRKRMKIVEVKHPLVKHKLGLMREHDISTKRFRELASEVGSLLTYEATADLETEKVTIEGWNGPVEVEQIKGKKITVVPILRAGLGMMEGVLEHVPSARISVVGIYRNEETLEPVPYFQKLVSNIDERMALVVDPMLATGGSMIATIDLLKNAGCTSIKVLVLVAAPEGIAALEKAHPDVELYTASVDKGLNEHGYIIPGLGDAGDKIFGTK

SEQ ID NO: 9083 - protein, 551 aa, Klebsiella pneumoniae
GVLTMRRSTVFALVGAVLLLSATSAMAAGVDLAQSNTSMNSLLRLIQNASNQWAPRLHDYALWLLGCLAVIQLVWTFAPLVMRGAELGDILHELVKFILVIGFFYAMLDHATEWGGAIVNSFRQAGAHAAGLGSAELMPGDMFSTAVDFSRQVLTAGVSMFSPITSVVVAVSALIVLMCFTFIAALVFVTLVEAYVIINAAVLFMGFGGSQWTREYALAPIRYAVAVGAKLFVLTLIVGLIMQVSAEWSAAYTNDEASLMTLVGLSLVCAYLTKTIPELIGGMISGTSMGGGSAIGGMAAAGAAGAAAAVATVATAGAAAPAAGALGAAGTGGGAASAAGGGLASALNASMAGGSTAGGIGGATGVSSAGIGASTGGGSGAAAKAAGSRVGGGAASGSASPVSAAVSPASQEAGSGLKQAAKQAGRAAKGGDDDTDQQAVAQQRQMTPKEGTGGNGKAVAQGAEVATRALGVLGAISVPGMESSHGLSLGGTGSPPPVPGGDSPTPDDGAEPTTQAESNIIRPTSDTARTENVGALNVPGMDSGVNSQSEA

SEQ ID NO: 9084 - protein, 327 aa, Klebsiella pneumoniae
RDTTALKNGYNGALATRQRCGCIISGGAMSQVQSGILPEHCRAAIWIEANLKGDVNALREASKIFVDNVATFQAKFPDAKLGAVVAFGNNVWRQLSGGERADELKDFPVYGKRLAPSTQYDLLIHILSARHEVNFSVAQAALAAFGDAIDVKEEIHGFRWVEERDLSGFVDGTENPAGEETRREVAVIKDGVDAGGSYVFVQRWEHNLKQLNRMSVPDQEMMIGRTKDANEEIDGDERPVTSHLSRVDLKEDGKGLKIVRQSLPYGTASGTHGLYFCAYCARLYNIEQQLLSMFGDTDGKRDAMLRFTKPVTGGYYFAPSLERIQAL

SEQ ID NO: 9085 - protein, 163 aa, Klebsiella pneumoniae
LRATMKRIAIVGAVGAGKTTLFNALQGNYSLARKTQALEFNDRGDIDTPGEYFSHPRWYHALITTLQDVDTLIYVHAANDTESRLPPGLLDIGSRKHLIVAISKTDLPDANVAAVRQLLDGMGFQAPVFALNGCDPQSVAPLENYLSELSQKEEGPGEETHYR

SEQ ID NO: 9086 - protein, 278 aa, Klebsiella pneumoniae
VMFAVSSKRVLPGFTLSLGTSLLFVCLILLLPLSALVMQLAQMSWAQYWDVITNPQVVAAYKVTLLSAFVASIFNGVFGLLMAWILTRYRFPGRTLLDALMDLPFALPTAVAGLTLASLFSVNGIYGEWLAKFDIKVTYTWLGIAVAMAFTSIPFVVRTVQPVLEELGPEYEEAAETLGATRWQSFRKVVLPELSPALLAGIALSFTRSLGEFGAVIFIAGNIAWKTEVTSLMIFIRLQEFDYPAASAIASVILAASLVLLFSINTLQSRFGRRVVGH

SEQ ID NO: 9087 - protein, 297 aa, Klebsiella pneumoniae
MKIAAFDIGGTALKMGVMARDGRLLETARQSINDSDGDRILQAMLSWLAAHPSCEGIAISAPGYIDPHSGLITMGGAIRRFDNFAMKSWLETRTGLPVSVENDANCVLLAERWQGKAAEMANFLVLTIGTGIGGAIFCQHQLINGARFRAGEFGYMLTDRPGGRDPRRYSMNENCTLRVLRHRYAQHIGAPLDSVTGELIFDRYDAGDPVCQRLVAEFFNGLGHGLYNLVHIFDPQTIFIGGGVVERPGFLTLLRQHLAWFGIADYLDTVSHGNDAGLIGAVYHFNQLYRSPDDDRH

SEQ ID NO: 9088 - protein, 449 aa, Klebsiella pneumoniae
IIGADTKEINFFGQMTSNGRRSRCFHHYADLNGFVKCFTFVTQFLFVDFDLFLQRTHFFNRDDHREHNAQLTESGGTQDGANLVAQDLFTIHRNTHGTPAEERVLFFREVHVRQLFVAADIHGTDDNGLRATGLSHRFISRKLFFFSWQRVTVHEQEFGTIQTYAFGAVALSTFDIANGTNVGADFNLMAVEGNRRQIFQFRQFGFFFRNLSLQTTQRFNLLVRRVDQNLVVHRVENQIVAVFHLCRDAAGAHDGRQFQGTRHDRGVGGTTARIGDETQHFFQVQLCGFRRGQIGGDEDDFILNRTQIDDCQTKDVAQQALTDITYVSRTFFQVFIIQLFQGSGLTVDNFIGCRVGSHVLIFNQGYDFLLKLLIFQQHNMPFEDGFFFFTESFTSFGFDDLQLGGGLGAAAQETFDFLINLIGRNFLPVDDNFIFLQQQCFAEGDTRGC

SEQ ID NO: 9089 - protein, 755 aa, Klebsiella pneumoniae
ICLAGAEALCRAPMNLLKYYQQYRDKWWALPLVLPALLLPVARWANTYTMLNGHMVFLYYLPLALVLSLMMFFGWAAIPGIIIGLLLTLAHGMMFEQSIGVLFHFLIPCVLCWGGYRIFVPQRQQVSHGNVRLMPHRLFWQMLLPSVIFLILSQIAEYLGLHPRTTEMTGVTPFSLRSLITFQALMVGCLTGMPLCYFVLRVIRNPFHLRGFISQVRLQIDPKIKKIEIICWATVLILLLWLLLMPLNDSSTIFSTNYTLSLLMPVMLWGAMRFGYRFISLIWTPVLIAVIHFHYRYLPIYPSYNTQLAITSSSYLVFSFIVAYTAMLATQQRLIYARVRQMAFLDPVVHMPNLRALSRALNGTSWSTLCFLRIPELELLGRHYGVLLRIQYKQMLANHLRTLLQPNEAVYHLAGHDLVFRLNSEGHQARIHLIDRSLRQFRFHWDGVPLQPRIGMSYCNVRSPVKHLYLLLGELNTIADMSLASGHPENLQRRGAGHVQQDLKDKVVMMNRILKALEHDHFVLMAQPIQGIRGDRYHEVLVRMEGESGELTGPNEFLPVAHEFGLSTRVDQWVIEHTLAFMDANRRALPGLRLAINLSPVSLSRSQFPQEVEALLQAYNIEPWQIIFELTENYALSNPELVCQTLEHLRALGCRVAIDDFGTGYASYARLKTMNVDILKIDGSFIRNLLASSLDYQVVDSICRLARMKNMQVVAEYVESPEIRQAVITLGIDYMQGYDIGVPVPLTQLAEEMTG

SEQ ID NO: 9090 - protein, 239 aa, Klebsiella pneumoniae
VSSAKRRKGQVKKLITANDIRAAHARGEQAMSVVLRASIITPEAREVAELLGFTITEDDGAAPAATAADSDKTESQRIRETILAQLPEGQFTESLVAQLMEKVMKEKQSLEQEAMQPGFEAVTGKGGIKVIDGSSVKFGRFDGAQPHCVGLTDLVTDQDGSSMAAGFMQWENAFFPWTLNYDEIDMVLEGELHVRHQGETLVAKAGDVMFIPKGSSIEFGTPSTVRFLYVAWPANWQSL

SEQ ID NO: 9091 - protein, 469 aa, Klebsiella pneumoniae
CREALTKQLMHARLHTGAACQPQIDNPLSGNMSGDNFGHLLVHRLNHRPDLPGVAALVLLRLLKPDAAIPGQSQGDMVAAGGFIRRIRHPALFNDGDPGGAAADIHHPGVIELQQIGHRGRLIQHMTDLQPGGLQDIDRNARIGAGRKRGRRMGEAAAQLLLESRKMSAHEGDGAEEVPDDAVAHHIGPVKTYRNRLAIAVDHHRHHVAGAQIDAQPQRRLAGGGRLVTQGSGFLQSRRKPALFVVRHVHPLYDSKRIHQHAAAQTNEGPRAGYPFPGWGGDGHGGPALAAQPKPGDARPVFDEDAGVDGIRHLVHVVDIARVHRRRMVAAAFQLHRQGDGLFNVRHPHHRQHRHHQFSNSKRMAGGRFHKQQAGLRRHLQTNRRGDFARVATDPVAADRAFAALVNIFQQQRLELFGLRRREFHRLLAFHQAHQFVGNAIDHDQHLLVGADNVVIKRGAFDDRLRGAR

SEQ ID NO: 9092 - protein, 106 aa, Klebsiella pneumoniae
WSMASCSLTPPLYRTSLRTKRPAARCRAGPMCWSSRRWRRATSATKSPQRLGGYRAIGPLIQGLAAPLHDLSRGCSVEEIIELALVASVPRQTDASRIPDSSTLVE

SEQ ID NO: 9093 - protein, 369 aa, Klebsiella pneumoniae
FCCYQFIAVMLPGFAANNSPVCYAFWLCTSSMFIPYTGKHSCNNLFQEDLSMNQLDSIKQFTTVVADSGDIESIRHYHPEDATTNPSLLLKAAGLASYSGLIDDAIAWAKKQGGGREAQVAHACDKLAVNFGAEILKSIPGRVSTEVDARLSFNREKSIEKARHLVALYQEMGIDKSRILIKLASTWEGIRAAEVLEKEGIHCNLTLLFSFAQARACAEAGVYLISPFVGRIYDWYQARKPLEPYVVEEDPGVKSVRNIYDYFKQHKYNTIVMGASFRRTEQILALVGCDRLTIAPPLLKELQASDTPVVRKLIPASQILPRPVPLSEAEFRWEHNQDPMAVEKLAEGIRLFAVDQRKLEDLLAAKLSL

SEQ ID NO: 9094 - protein, 74 aa, Klebsiella pneumoniae
ISALHAADAASGAALYAPAHPAHRKVHPAAKFAAPPPGRAPAPRAASGPRTAAPDSDPPDGPAAPSPAVWSPWL

SEQ ID NO: 9095 - protein, 81 aa, Klebsiella pneumoniae
PNGQRWAPTWNCPPRMTPCRRFTSPINSSTKRVDGSRHTRSGASACSMLPWLMTTTRSATSIASSWSWVTNTLVNFSSSCS

SEQ ID NO: 9096 - protein, 224 aa, Klebsiella pneumoniae
KTIQNFVYSDGVSSSFPDTANNPKDRQSMQVQVRKLEGSWDLGYALHKHTLSSVYLGDDEYGHPRFDNTRSEPGEALYQLKYRGDWNQIAPLAAQIQATLLPLFGKIGLIIPMPASTTRARQPVDELAAELGRITGIPVFNNIVVKAPAPQGAPQLKNLHSREEKDAALQGRFSINPCITNEGRWDALLLDDLFDTGATMAAVCNALRTYNKINRVYAAAITWK

SEQ ID NO: 9097 - protein, 67 aa, Klebsiella pneumoniae
NRVHSHKNAFPNEFMSIKDGLTPKGGGFERPSARPAKSKSCKLLDSGENIASVYTLFSKLDHQETTE

SEQ ID NO: 9098 - protein, 187 aa, Klebsiella pneumoniae
SRLQCLYRCRSRYCPSSCTACVMEGAMINALGLLEVEGMVAAVDAADAMLKAANVRLLSHEVLDPGRLTLVVEGDLAACRAALDAGAAAARRTGCVISRREIGRPEEDTQRLIGGFQPPPPAPMPPADPASSEALLTLLASVRQGMTAGEVAAHFAWPLDKARQALEQLFSAGTLRKRSSRYRLKNP

SEQ ID NO: 9099 - protein, 411 aa, Klebsiella pneumoniae
PRWQSPTAGGKKRRGCMQAELQTALFHAFDTLNLQQMKSFNVPPVTLHGVGALAACGPQAQSRGLRHLFVMVDSFLHQAGMTAGLERSLAMKGIAMTLWPCPAGEPCVTDVCAAVAQLRDARCDGVVAFGGGSVLDAAKAVALLVANPEQTLGEMTEHSELRPRLPLIAVPTTAGTGSETTNVTVIIDAVSGRKQVLAHASLMPDVAILDAALTEGVPPHITAMTGIDALTHAVEAYSARHATPFTDSLAMGAIVMIGEALPKAVGCGQDLAARENMLLASCMAGMAFSSAGLGLCHAMAHQPGAALHIPHGLANAMLLPTVMEFNRMVRRARFSQIGRALTGKKTDDREAIAAVRELIAEVGLTMRLTEAGATSAHYAAWAQAAQEDICLRTNPRTASREQIIELYAAAQ

SEQ ID NO: 9100 - protein, 350 aa, Klebsiella pneumoniae
PGWQQHGRRIYAVGERLLPVDAELRRNRYGAGGRAACAPSGGNAGRQSGGRHVHPERLQHRIRYPVDGALPVRRLAGKLAIAMNDFITEAWLRANHTLSEGGEIHLPADARLTPSARELLESRHLRVKFLDRQGRLFVEDDEQTPQPVHVLTSSDHPPQACCELCHQPVGKKPDTLTHLTADTLVAKNDPRLAFRAVLDSTIALTVWLQIELAEPWQPWLTDIRSRLGNIMRADALEEPLAAQSIAGFSEVQLHRLSHQPLRYLGHDHLVPEARHGRDVALLNLLRGKVREAEVTAAQVFITPQFAVQRADILQALNRLSSAVYVMMILGVTDSPPALSQLQQLGGEDDH

SEQ ID NO: 9101 - protein, 255 aa, Klebsiella pneumoniae
GNRQILLVSKCLPWWQGVRTTENIMMQDLRLILIIVGAIAIIALLVHGFWTSRKERSSMFRDRPLKRMKSRDDESENDDFDDNVEGVGEVRVHPVTHAPHGAHGEHEAPRQAPQHQYQPPYERQMQQPARPEEPVRQPPQPPRQAPVPPQQQPAPHAAPQPGWQQPQPAQPPVQPQHQPQPVVQQPVAPQPVTPTVAQPQPAAPQQPAPQPVAASQPAIAEPQPVEPQQPAAPQPKERKETVIVMNVGAHHGGPA

SEQ ID NO: 9102 - protein, 273 aa, Klebsiella pneumoniae
RPDKISEHSHRMLKKEQCLAMVSSSAPTPRSGVYYFSQGWKLIGLPGIRRYVFLPLLVNVLLMGAAFWWLFTRLGSWIPSLMSHVPDWLQWLNYLLWPVVVLSILLVFGYFFSTIANWIAAPFSGLLAEQLEARLTGATPPDVGVFGIMKDIPRIMNREWQKLAWYLPRAIVLLLLYFIPGVGQTVAPVLWFLFSAWMLAIQYCDYPFDNHKVPFKTMREALRSRKVMNMQFGALTSLFTMIPVLNLVILPVAICGATAMWVDCYRDRHASWK

SEQ ID NO: 9103 - protein, 124 aa, Klebsiella pneumoniae
LNVKGLSMLTMYGIKNCDTIKKARRWLEAHQIEYRFHDYRADGLERAQLDTFIAELGWQALLNTRGTTWRKLDESLRNSIDNADAAAALMLEMPAIIKRPLLCAPGRPMLLGFSEASYQQFNEV

SEQ ID NO: 9104 - protein, 261 aa, Klebsiella pneumoniae
STANNRRLSEEYTMTRRAIGVSERPPLLQTIPLSLQHLFAMFGATVLVPILFHINPATVLLFNGIGTLLYLFICKGKIPAYLGSSFAFISPVLLLLPLGYEVALGGFIMCGVLFCLVSFIVKKAGTGWLDVMFPPAAMGAIVAVIGLELAGVAANMAGLLPADGQSPDSKTIIISMVTLAVTVFGSVLFRGFLAIIPILIGVLVGYALSFVMGVVDTTPIAEAHWFALQTLYTPRYGGVGYLHHIARRDGGDCRARWAFWW

SEQ ID NO: 9105 - protein, 238 aa, Klebsiella pneumoniae
KMKKQAELYRGKAKTVYSTDNPDLLVLEFRNDTSAGDGARIEQFDRKGMVNNKFNHFIMSKLAEAGIPTQMEALLSDTECLVKKLDMVPVECVVRNRAAGSLVKRLGIEEGIELNPPLFDLFLKNDAMHDPMVNDSYCETFGWVSKENLARMRELTYKANDVLKKLFDDAGLILVDFKLEFGLFKGEVVLGDEFSPDGSRLWDKNTLDKMDKDRFRQSLGGLIEAYEEVAHRLGVKLD

SEQ ID NO: 9106 - protein, 626 aa, Klebsiella pneumoniae
RSLKMKEPNKIDGNRRDLLKGLGIAAVVSLLPETGNAAQNNAAPKAAWDIPFTGEIPDTLPEGYNILLITCDQERYFERYPFPVPGRERLMKTGITFTNHQNTANVCTPSRSVMYTGLHMPHTRMFDNLGFPWMNYDLDPELRTVGHMMRELGYYTAYKGKWHLTREIDQPVAGKSVEEMDLGEIPTPRLHEIMEKYGFSDYHGIGDVIGKSKGGYFFDSVTTGQTISWLRNTGRPLNDENKPWFAAVNLVNPHDVMFIDTDEHGEQVQWKGPMDKENHTLLPTQPPHNQIYQQSWPDYPLPANRHQPLDEPGRPAAHKEYQNARAVMEGQFPDEDRRWRKLLDYYFNCIRDNDQHLEAILNELDNLQLTQNTIIVFTADHGELGGSHQMHGKGSSVYKEQIHVPMIIRHPAYPGNIRCNSLTNHLDLVPTLIGLTGRDRSLREKVLEGRKGQDMSPLLAHPEQAGLNALRPGSLYCYGMILYMDAQYTAKFRKLAGEKLPHDQFKKAIASLHPEFSHRSGIRMINDGHYKFARYFSLKQHHIPASLAELLENNDVELFDLVNDPEENHNLAREPEKYRDLLMTMNDKLNQLTAAEIGEDDGSYMPPFEGSQWDLTAAQMHQYMRD

SEQ ID NO: 9107 - protein, 469 aa, Klebsiella pneumoniae
KIMNQQDIEQVVKAVLLKMKDSSQPAGTVHDMGVFASLDDAVAAATVAQQGLKRVAMRQQVIQAIREAGEKYARELAELAVTETGMGRVEDKFAKNVAQARGTPGVECLTPQVLTGDNGLTLIENAPWGVVASVTPSTNPAATVINNAISLIAAGNSVVFAPHPAAKKVSQRAITLLNQAVVAAGGPANLLVTVANPDIDTAQRLFKYPGIGLLVVTGGEAVVEAARKHTNKRLIAAGAGNPPVVVDETADLPRAAQAIVKGASFDNNIICADEKVLIVVDSVADELMRLMEGQQAVKLTAAQAEQLQPLLLKNIDERGKGTVSRDWVGRDAGKIAAAIGLQVPAQTRLLFVETPASHPFAVTELMMPVLPVVRVANVEEAIALAVQLEGGCHHTAAMHSRNIDNMNQMANAIDTSIFVKNGPCIAGLGLGGEGWTTMTITTPTGEGVTSARTFVRLRRCVLVDAFRIV

SEQ ID NO: 9108 - protein, 116 aa, Klebsiella pneumoniae
KGMNAGWRCAFPACTSHAETDMKLAVVTGYVVCTVRHEGLAHDKLLMVEMLNARGEPDGQCAVAIDSIGAGCGEWVLLVSGSSARQAHAHGASPVDLCVIGIVDEAAADGQVLFHK

SEQ ID NO: 9109 - protein, 151 aa, Klebsiella pneumoniae
SKMKNTEFIPADFDAHGRLRLPLLFWCVLLLQARTWVLFLMAGASRQQGDAILNLFYPDHERFWLGLLPGVPAVLAFLLSGYRQRLPRLWRAMRWLLVLSQVLLLLWQPMLWLSGESPSSLTIALLVADGYALWWLLTSRRLGACFHQTTF

SEQ ID NO: 9110 - protein, 306 aa, Klebsiella pneumoniae
HRTNHNQCVTRCPAGGEKMGQQDDIQSVLFHDKSRASEVDIVAVQSQVVYGSVGNSIAVPAIKQHGLRVLAVPTVLFSNTPHYETFYGGIIPEEWFVGYLQALEERDALRELRAVTTGYMGSAVQIERLAQWLTRVRARHPGLCILVDPVIGDVDSGIYVKAEIPDAYRQHLLPLAQGITPNLFELETLSGQRCRDRQEAVAAARSLLSDTLKWVVITSAPGEADSTINVLVVTADAVEVVVHPRVETDLKGTGDLFCAELVSGLLSGLALGAATQAAAQRVLEVMNWTAAQGCDELILPPLEQSR

SEQ ID NO: 9111 - protein, 69 aa, Klebsiella pneumoniae
IPKKRMRSISGLLLSAASCSTRSLKDNQLSSFSMYSFSWPITAHTPFYSQDVDYYDEFFCIAIYCVTTI

SEQ ID NO: 9112 - protein, 239 aa, Klebsiella pneumoniae
AYVEVHLNAPAQLSLPLYLPDDETFASFWPGDNPSLLAALQNVLRQEHSGYIYIWSREGAGRSHLLHAACAELSQRGDAVGYVPLDKRTWFVPEVLEGMEQLALVCIDNIECVAGDEPWEMAIFNLYNRILESGKTRLLITGDRPPRQLNLGLPDLASRLDWGQIYKLQPLSDEDKLQALQLRARLRGFEMPEDVCRFLLKRLDREMRSLFMTLDQLDHASITAQRKLTIPFVKEILKL

SEQ ID NO: 9113 - protein, 760 aa, Klebsiella pneumoniae
KMDEQLKQSALDFHEFPVPGKIQVSPTKPLATQRDLALAYSPGVAAPCLEIEKDPLAAYKYTARGNLVAVVSNGTAVLGLGNIGALAGKPVMEGKGVLFKKFAGIDVFDIEVDELDPDKFINVVAALEPTFGGINLEDIKAPECFYIEQQLRERMNIPVFHDDQHGTAIISTAAILNGLRVVEKNLSDVRMVVSGAGAAAIACMNLLVALGMQKHNIVVCDSKGVIYKDREPNMAETKAAYAVEDDGKRTLDDVIDGADIFLGCSGPKVLTQEMVKKMARAPLILALANPEPEILPPLAKQVRDDAIICTGRSDYPNQVNNVLCFPFIFRGALDVGATAINEEMKLAAVHAIAELAHAEQSEVVASAYGDQDLSFGPDYIIPKPFDPRLIVKIAPAVAKAAMDSGVATRPIADFDAYIEKLSEFVYKTNLFMKPIFSQARKEPKRVVLAEGEETRVLHATQELVSLGLAKPILVGRPSVIEMRIQKLGLQIKAGVDFEIVNNESDPRFKEYWSEYYQLMKRRGITQEQAQRAVISNTTVIGAIMVHRGEADAMICGTIGEYHDHYRVVQPLFGYRDGVSTAGAMNALLLPSGNTFIADTYVNHDPSPEELAEITLMAAESVRRFGIEPRVALLSHSNFGSADCPSASKMRKTLELVKARAPELMIDGEMHGDAALVESIRNDRMPDSPLKGAANILVMPNMEAARISYNLLRVSSSEGVTVGPVLMGVAKPVHILTPIASVRRIVNMVALAVVEAQTEPL

SEQ ID NO: 9114 - protein, 361 aa, Klebsiella pneumoniae
NCADFSCLPQTRGDFAVTDKTSLSYKDAGVDIDAGNALVDRIKGVVKKTRRPEVMGGLGGFGALCALPQKYREPVLVSGTDGVGTKLRLAMDLKRHDTIGIDLVAMCVNDLVVQGAEPLFFLDYYATGKLDVDTAASVINGIAEGCLQSGCALVGGETAEMPGMYHGEDYDVAGFCVGVVEKSEIIDGSKVTDGDVLVALASSGPHSNGYSLVRKIIEVSGVDPQTTDLDGKPLADHLLAPTRIYVKSVLDLIASVDVHAIAHLTGGGFWENIPRVLPDNTQAIIDESSWQWPSVFNWLQTAGNVSQHEMYRTFNCGVGMIIALPAAEADKAIALLNDKGENAWKIGYIKASDSEQRVVIA

SEQ ID NO: 9115 - protein, 69 aa, Klebsiella pneumoniae
VPRLDGAAPSLLLLVGLRPLGTKKGSAGLPSPTRLVPWITHRSQHLVEPLKPAKRRSGTKKGRAGPKST

SEQ ID NO: 9116 - protein, 114 aa, Klebsiella pneumoniae
YEKEPVNLLEFSHQFNQMLNSFLLIFAFSGEGHYGALGQAQSLQFEQAFGAGAFAVGGYSDLRSEAFSFFNKLSSRAGVQTVRSGNGNFLLEHYISPTYRFSVVDLKSSLTTRL

SEQ ID NO: 9117 - protein, 301 aa, Klebsiella pneumoniae
HIMDQKQIEDIVRSVMASMGQPQSQPQAPAASTPACHAACASEAVVESCALDLGSAEAKAWIGVQHPHRAEVLTELKRSTAARVCTGRAGPRPRTQALLRFLADHSRSKDTVLKEVPEAWVKAQGLLEVRSEISDKNLYLTRPDMGRRLSPEAIDALKAQCVMDPDVQVVVSDGLSTDAITANYEEILPPLLAGLKQAGLKVGTPFFVRYGRVKIEDQIGEILGAKVVILLVGERPGLGQSESLSCYAVYSPRVATTVEADRTCISNIHQGGTPPVEAAAVIVDLAKRMLEQKASGINMSR

SEQ ID NO: 9118 - protein, 412 aa, Klebsiella pneumoniae
KTMEINAIPRRLAFTAGGQQLINWGISFYMPGTFAGAIAADKGWSLPQIYLGLTLAMLMMAAVSPFVARLLARFGGRLVVTSGTLLIAASCAMMAWRPSLAGWYGAWLLTGIGMRLSLYDALFAAVVNLYGQQARKTISHITLAGGLASALFWPLGEALLTIMPWQNALRIYALFGLLSAWLSYQLPRQRLNSAAKSPASPATAEGDRRNGARYAIFIALITFISNGTSTHLPEFISHFGLPVAVGMLWGFGQTGARLGEVLAGPRVTSLTLTRFTALAMPLCFLLGLSSTTYAGCAAGFVLGYGAINGLVTIVKATLPLALFSAESYASRTGLLLIPGQLMAAVSPFAYAWLNHRLGIIGGMWVSTGLTLIVAGLALAMVREAGKAQDERNVEYPAAAVDQPIAKNNLAEE

SEQ ID NO: 9119 - protein, 233 aa, Klebsiella pneumoniae
KRVENRVYQSLRFRTACGHCMKNIVVLISGSGSNLQAIIDACGRKQINGTLRAVFSNKADAFGLERARLAGIPAHALAQSQFADREAFDRQLMHEIDAYAPDLVVLAGYMRILSPAFVSHYQGRLLNIHPSLLPKYPGLHTHRQVLENGDEEHGTSVHFVTDELDGGPVILQAKVPVFAGDSEEEITARVQAQEHAIYPLVISWFVDGRLRMAGNHAWLDERQLPPQGYAADE

SEQ ID NO: 9120 - protein, 73 aa, Klebsiella pneumoniae
RKEEARMEWLIKHWWILVLVFLVGVIINVIKDLNRVDHKKFLNNKPDLPPHRDFNDKWDDDDDWPKHDQSKKP

SEQ ID NO: 9121 - protein, 513 aa, Klebsiella pneumoniae
TRWDAAREHYAAQSVKLAHPHYRTEVMFRQLKKTLVAIAIASLTLGSIGPAFADSADTLPDMGTSAGSTLSIGQEMQMGDYYVRQLRGSAPLINDPLLVQYINGLGMRLVAHANSVRTPFHFYLINNDQINAFAFFGGNVVLHSALFRYSDNESELASVMAHEISHVTQRHLARAMEDQKRNAPLTWVGALGSILLAMASPQAGMAALTGTLAGTQQGMISFTRQNEEEADRIGIQVLQRSGFDPQAMPMFMGKLLDESRYSTRPPEMLLTHPLPESRLADARNRANQMRPVVVQSSADFYLAKARTLGMYTNGDNKLGTDLLNAWDKGNIRQQHAAQYGRALLAMESNNFDQARKTLQPLLNADPQNGWYLDLATDIDLGQKKTSDAINRLKNARELRTNPVLQLNLANALLQGGQPGEAATILNRYTFTYKEDGNGWDLLAQAEGALGNRDQELAARAESMALVGQLEQAISLLSSASSQVKLGSLQQARYDARIDQLRDLQARFRPYQKM

SEQ ID NO: 9122 - protein, 126 aa, Klebsiella pneumoniae
FIFCMIRFFFNLVSALHGITNFKRWMATFITLVAFVLIQIHLFRTQATKSSSNRAFSETVRSYNECRFVWNKLNIKNRAFDPLNIRYGDFIYSFYHIKFIPLVKSCFNGRSPDVGSCRSTTRSSPD

SEQ ID NO: 9123 - protein, 95 aa, Klebsiella pneumoniae
IPFCHRSIMLAGKTASEIFDNIRHLVQSGGLQPGKVLPPVRELASQLAVNRNTVAAAYKPLVNSGLAVSHGSHGTAIKSAGHTARRWREVTQRPR

SEQ ID NO: 9124 - protein, 207 aa, Klebsiella pneumoniae
PSLCALSAAARRAAAALPAAVPRWRAATRQQAVAQAAAGRLAAAERRSASPVAARQAAAQQAAAGVAVVRAAAQVAAVASQAAEPHAAQAVAAVEPGPGAAAAAAGEPVLQDAQAAASGARKAAGTGAAAPDEGLHAPHARRAGRESPDERGLLLRLQHYHQSRRFPTHRRATSYVSVGDRETSKNVLYGWSRNHVPVKRLWRSRQQ

SEQ ID NO: 9125 - protein, 376 aa, Klebsiella pneumoniae
SMSCPVIELAQQLIRRPSLSPDDAGCQALMIERLRAIGFTVEPMDFGDTQNFWAWRGHGETLAFAGHTDVVPAGDADRWINPPFEPTIRDGMLFGRGAADMKGSLAAMVVAAERFVAQYPNHRGRLAFLITSDEEASAKNGTVKVVETLMARNERLDYCLVGEPSSTEVVGDVVKNGRRGSLTCNLTIHGVQGHVAYPHLADNPVHRAAPMLAELVNIEWDKGNEFFPPTSMQIANVQSGTGSNNVIPGDMFVQFNFRFSTELTDEMIKSRVIALLEKYQLRYSVEWWLSGQPFLTGRGKLVDAVVNAIEHYNEIKPQLLTNGGTSDGRFIARMGAQVVELGPVNATIHKINECVNAADLQLLARMYQRVMEQLVA

SEQ ID NO: 9126 - protein, 405 aa, Klebsiella pneumoniae
VPCCFLNTDNIFNFRQTANGFRQHIATGTGRHIIQNLRQVSMFGDSFKVLEQAFLGRTVIIRSDRQAANNTAIVKTFGQANRLCGCIGSRSSDNRNTPVGQLQRHHHHVAMLFMAQRCGFTGSPYRNDRRGSVGDMVINQFFQACPADITVFIHRRDKRYNTSREHGPSSEQKCDKILNVTFGAVIKARDPTPSGMLYGGFFYAFLMLPHLFKGRTGLTASLQHYLVITALGADRPGIVNTITRHVSSCGCNIEDSRLAMLGDEFTFIMLLSGSWNAINLIESTLPLKGAELELLIVMKRTTARPPQAMPNTVWVQVEVPDSPHIIERFTALCDTWNMNIAELVSRTQPGDGDSAQLFIQITAHSPATQNAANIEQAFKALCTELNAQGSINIVNYSQHDEQDGV

SEQ ID NO: 9127 - protein, 384 aa, Klebsiella pneumoniae
RVCCNGVWPIRKNARNRREIMSIEIANIKKSFGRTQVLNDISLDIPSGQMVALLGPSGSGKTTLLRIIAGLEHQTSGHIRFHGTDVSRMHARDRKVGFVFQHYALFRHMTVFDNIAFGLTVLPRRERPNAAAIKAKVTKLLEMVQLAHLADRYPAQLSGGQKQRVALARALAVEPQILLLDEPFGALDAQVRKELRRWLRQLHEELKFTSVFVTHDQEEAMEVADRVVVMSQGNIEQADAPERVWREPSTRFVLEFMGEVNRLQGVIRGGQFHVGAHRWPLGYTPAYQGPVDLFLRPWEVDISRRTSLDSPLPVQVLEASPKGHYTQLVVQPLGWYDEPLSVVLTGDEAPSRGERLFVGLQNARLYNGTERIEPRGELALAESA

SEQ ID NO: 9128 - protein, 103 aa, Klebsiella pneumoniae
SNSCRRIKIISDVTSVFHAMLPAIKITAPNSPRLRVNDRAMPASSAGDSSGSTTLRKLCQRVAPSVSAASSYSGPNSSSTGCTVRTTNGMLVKAIATAIPSQV

SEQ ID NO: 9129 - protein, 98 aa, Klebsiella pneumoniae
CFHCRTFTSASIDPISFLCLNTPIAHLRVYFKDPFVSQAPSMRKRHRFNRRMTRIVLLISFLFFFGRFVYSSIGAWYHHQDKKASQESSLTVEPSPRE

SEQ ID NO: 9130 - protein, 79 aa, Klebsiella pneumoniae
CVCWENNVDKAQLVEIANTEMPFGKYKGRRLIDVPEEYLLWFARKDQFPAGHLGELMALTLLIKTEGLSDLVQPLKKAR

SEQ ID NO: 9131 - protein, 118 aa, Klebsiella pneumoniae
CYRWRLALFFGSLCKRKIQAVSLFFAGDSVPCYSLKNFIIDLVNVFSLKIYNMNNACHMAISAGINYQGRSDPRLLFSKVVFGYRLVNGRCRIFYITFILRLTRLAHHRQRQSGNDQR

SEQ ID NO: 9132 - protein, 264 aa, Klebsiella pneumoniae
AVRRAFLLTPQEGSVIFDDQIRGPIEFQQPRNWDDLIIRRTDGSPTYNFCVVVDDWDMAITHVIRGEDHINNTPRQINILKALNAPVPVYAHVSMINGDDGKKLSKRHGAVSVMQYRDDGYLPEALLNYLVRLGWSHGDQEIFTREEMIEFFSLGAVSKSASAFNTDKLLWLNHHYINTLPAEYVATHLQWHIEQENIDTRNGPQLAELVKLLGERCKTLKEMAQSCRYFYEEFAEFDADAAKKHLRSVARQPLEVVRRLAAGD

SEQ ID NO: 9133 - protein, 96 aa, Klebsiella pneumoniae
LTPRTARMGSMKPLVRRRSTSTSRLTSARCSSLRVLKNRFASRRSRRARPRFHRSNSLRRMRLRSLAGNSRNLRSRPYNRNTSRSLLCSSLSRRNR

SEQ ID NO: 9134 - protein, 69 aa, Klebsiella pneumoniae
LRNRRFASDTFRRQHPVGPYILDFACCAIRLAIGLDGGQHDDAAPAGYRARDGVFYASGIMSLKSMVMR

SEQ ID NO: 9135 - protein, 323 aa, Klebsiella pneumoniae
RTRRRRSANCSSWEVKMIIDQCRKLALRAPARVVFPDALDVRVLKAAHYLQQQGLAHPILVASPFALRQFALGERLPLTGVQVIDPHSNLAMREAFAAAWQARAGDKAPADAVDKLADPLMFAAAMVSAGQAEVCIAGNLSSTASVLRAGLRLIGLQPGCKTLSSLFLMLPQYAGQPLGFADCSVVPQPTAAQLADIAIASAETWQAIAGEAPRVAMLSFSTHGSARHPCVANVQQATEIVRQRAPQLMVDGELQFDAAFVPDVAAHKAPGSPLQGRANVLVFPSLEAGNIGYKIAPAAGRISRHRAADPGPGRPASRPLARL

SEQ ID NO: 9136 - protein, 148 aa, Klebsiella pneumoniae
GISRRADGGDSPGGGQSVLLANAASATGGDVPAIVRGALPNFPARSAAHDGCSGPGFPLRSRRRRGSGRSVAGGRGGTFSRTEPGGMGGFSPATRESGRPVAGGARRQSPGGDAARAAGQSDRCPSLPPAGRPGAEDDRRYRRRCRWL

SEQ ID NO: 9137 - protein, 413 aa, Klebsiella pneumoniae
RIARRHQRIVPLSGMILQLHIEACRTAEAADRRRAAGDNPRFVNLIKRFGGAFNNGKGGAGLRVALVPVFETNEHTGHVLPIAAGAGANGSEHRLDVLLLVIEEVIFRLLHHLQRLLLGAAARQLDRGGEHPAILQRQERGRQMQKQEHHPAEQEDVDQHPAQRAVQDFADEGFVAAGAAVEGAVEPAEEACSFMGFTWLNRLKQRGAKGRGEDHGHQHREDHRRDDSDRELAIDGAGGAAEEGHRHKYRRQHHRDPYQRALNLSHRFTGRLAWRQALLAHDALDVLHHHDGVIHQQADRQHHREHRQGVNAVATGIQHRESAHQHHRHGDGWDQGGAEVLQEQIHHEEDQQDCLQQGFHHVGDGSLHEGGGLVGDLIFQTVGEKLRQLIEAIDHALRGGHFVGAGSQLDPEA

SEQ ID NO: 9138 - protein, 81 aa, Klebsiella pneumoniae
TSARIMGAQLNGEVLINSIQQAGFKFGEMNIFHRHLKSGRQRSGVVQSGQHGETGNLQSGQHGGYDDPWGDYLYAGPFLRR

SEQ ID NO: 9139 - protein, 145 aa, Klebsiella pneumoniae
SPRRTNRSQQGAPEMHHPDLALKAVIEACDRAISQEDYDTLMSYYAEDAALVVKPGMVVRGKENIRKAFIAIADYFQHRLVVTQGKMEVIEGGGNALVIMETRLDIPTADGISQVTRRATYVFQKQGERWLCTVDNSYGTDLLDD

SEQ ID NO: 9140 - protein, 350 aa, Klebsiella pneumoniae
DRKLTHPRRACAALFFTWAIPDLSRQYLPPAGRCYCSSIAQSTGRMNMKKPTSTPHDAVFKTYLSHPDTARDFLQLYLPETLLKVCDLRTLHLESGHFVEDDLRPFYADILYSLKTTAGDGYIYALIEHQSTPDRHMAFRLMRYAIAAMQRHLDAGHDRLPLVIPVLFYHGLVSPYPFSLRWLDEFIAPELAGHLYHGAFPLADITVIPDDEIATHQRMATLELLQKHIRQRDLAQLLDKLSELLLTGLATESQVQALMHYLVQAGNTREPIKFIRELALRTPQHKETLMTIAEYLEQQGLERGLAQGRQEGRKEEAQRIAVAMLHSGLPRDLVARLTGLTEQELTPLAD

SEQ ID NO: 9141 - protein, 67 aa, Klebsiella pneumoniae
WNWLCASAIDDPASLPFFLFHLKDGHSHTLYQYHLILAAEKWHAIKHTHAAVEMRSGRQSQSVHPMQ

SEQ ID NO: 9142 - protein, 532 aa, Klebsiella pneumoniae
LISSPADSRTLIEMRGSVPGGNEVAAWVKRQPSCCSRVARCRRTRVTAPKKSQTMPSRTTSAQSRHTATGWPSRSTTIDTTSQVPKSMPSHSGDSLAAGAWLHRAAAFCSLGESQRCSSCAMFIPYTIRNASTSTQRRRRTKVRALVTPSPVGVVMVMVVQPSPPSPSPAMHGPFLTKMLVSMAFAIWFMLSILRECIAAVWWQPPSSCTARAMASSTFATRTTGSTGIISSVTANGWLAGVSTNSRRVCAGTCRPIAAAILPASRPTQSRLTVPLPRSSIFFSSSGWSCSACAAVSFTACWPSIRRISSSATLSTTISTFSSAQIMLLSNEAPLTIACAARGRSAVSSTTTGGLPAPAAIRRLLVCLRAASTTASPPVTTSRPMPGYLNSRWAVSISGFATVTSRLAGPPAATTAWLSRVIALCETFFAAGWGAKTTLLPAAIRLMALLITVAAGLVDGVTEATTPQGAFSISVRPLSPVSTCGVRHSTPGVPRACATFLANLSSTRPMPVSVTASSASSRAYFSPASRMA

SEQ ID NO: 9143 - protein, 415 aa, Klebsiella pneumoniae
QGVRAMGINEIIMYIMMFFMLIAAVDRILSQFGGSARFLGKLGKSIEGSGGQFEEGFMAMGALGLAMVGMTALAPVLAHLLGPVIIPLYEMLGANPSMFAGTLLACDMGGFFLAKELAGGDVAAWMYSGLILGSMMGPTIVFSIPVALGIIEPTDRRWLALGVLAGIVTIPIGCIAGGLVAMYSGVEINGQPVEFTFALILMNMIPVIIVAVLVALGLKFIPEKMINGFQIFAKFLVALITIGLAAAVIKFLLGWELIPGLDPIFMAPGDQPGEVMRAIEVIGSISCVLLGAYPMVLLLTRWFEKPLMRVGNLLKINNMAAGGMVATLANNIPMFGMMKQMDTRGKVINCAFSVSAAFALGDHLGFAAANMNAMIFPMIVGKLVGGVTAIGVAMLLVPKDENVPAPANNEAEAHS

SEQ ID NO: 9144 - protein, 394 aa, Klebsiella pneumoniae
QRMSANFNTVAKPGGNRCNLACRYCFYLENEVPRPGYATMDDLTLEAYIHNTISSTPSQNVEFCWQGGEPTLCGLDFFAKVVELQQRYRGNKIIANSLQTNGILLNDKWARFLRRHGFLVGLSIDGPASLHDTWRTTGCGKPTWEKVVQAIRCLQQHDVPVNAMVVVSRQSASQGKSLYRCLSRELNLHHLQFIPLVDSPAPWLVTPEGWGKFLCSVFDDWLENDVGRVFIQYFDNLLGVWAGQPATLCTMQPVCGQSLLVEQNGDVYSCDHFVSAEYKLGNLKQDAMAAMASSPFQQQFGKQKGQLSARCQGCHWRFACHGGCPKHRFTIHDDEAQNYLCSGYLTFFGHITPYMNVMRRLLLNCQPPALIMSLIPEIRQNILQLTESEDERTK

SEQ ID NO: 9145 - protein, 369 aa, Klebsiella pneumoniae
PRTRPRASATAPMTVSPSATTGAASLSVLVSANRITTLPRMTNGMNGGMAVCCCRWSCWTPSRAVERGVNVSKYDLTHARHDPVHCLAPGLFRSLKRGERKRSKLDVVYDYGNGKRIEFSGPEPLGADDLRILQGLVAMAGPSGLVLSPDPQTEAGRQLRLFLEPKWEAVQQDAMVVKGSYRSLAREVGYADIDNTRPVRDCIERLWKVSIIAQNGRRRQGFRLLSEYSSDEQDGKLYVALNPLIARAIMGGQHIRIDMAEVRKLQTDPARLIHQRLCGWIDLGKSGRVELDTLCGYVWPDEQTNPNTIKKRRQKARKALAELTAVGWKLDEYAKGKWEIGRPKASDFNAAPPCLTAPHPLFNSTQPPV

SEQ ID NO: 9146 - protein, 115 aa, Klebsiella pneumoniae
LSIGGVIMMNDVFFGLMMLGGFFVLGIGMWALGQWLRRKGFGPQLDALDKQYTALLHRVNRLALPAAAHFYGGMGMLNRMPLFGSKNQVVLVERVRMAILQMEEEERQRRRVINR

SEQ ID NO: 9147 - protein, 76 aa, Klebsiella pneumoniae
ATVGVTGCGATGCCTTGCGWCCGCTGGCAGCGCCQPGCGAACGAGCCCGGTGAWRGGCGGWRTGSSGRAGCCIWRS

SEQ ID NO: 9148 - protein, 481 aa, Klebsiella pneumoniae
KRTGACQQRSGGALVNTRQLLSVGIDIGTTTTQVIFSRLELVNRAAVSQVPRYEFIKRDISWQSPVFFTPVDKQGELKEAELEALILAQYRAAGIAPQAVDSGAIIITGESAKTRNARPAVMALSQSLGDFVVASAGPHLESVIAGHGAGAQTLSRQRMCRVLNIDIGGGTSNYALFDAGNVSATACLNVGGRLLETDAQGRVVHAHPPGQRIVDALFGAGTNVLALTAGQLAQVARRMAALIVEVIEGTLSPLAQGLMQTEVLPAGVQPEVITLSGGVGECYRHQPADPFCFSDIGPLLATALHEHPRLREMNVQFPAQTVRATVIGAGAHTLSLSGSTIWLEGVPLPLRNLPVAIPQDAADLPNAWLQALTQLDLAPEADAYVLALPASLPVRYATLLTVIDALLAFVARFPNPRPLLLVAEQDFGKALGMLLRPQLPHLPLAVIDEVSIRAGDYIDIGTPLFGGSVVPVTVKSLAFPS

SEQ ID NO: 9149 - protein, 328 aa, Klebsiella pneumoniae
LSGGERHRLGDPGRLTGAAVFHQYPAESLWSTRGRSLMAEVTQLKSYDAPRINWGKWFLIGVGMLVSAFILVVPMLYIFIQAFSKGLMPVLENLANPDMLHAIWLTVMIALITVPVNLVFGTLLAWLVTRFTFPGRQLLLTLLDIPFAVSPVVAGLVYLLFYGSNGPLGGWLDAHNLQIMFAWPGMVLATIFVTCPFVVRELVPVMMSQGSHEDEAAVLLGASGWQMFRRVTLPNIRWALLYGVVLTNARAIGEFGAVSVVSGSIRGETLSLPLQIELLEQDYNTVGSFTAAALLTLMAILTLFLKSMLQWRLANQKERAQQEGNHEH

SEQ ID NO: 9150 - protein, 1055 aa, Klebsiella pneumoniae
SGTGCAITRKCAYEVFILMANFFIDRPIFAWVLAILLCLTGALAILSLPVEQYPDLAPPNVRITANYPGASAQTLENTVTQVIEQNMTGLDNLMYMSSQSSATGQATITLSFTAGTDPDEAVQQVQNQLQSAMRKLPQAVQNQGVTVRKTGDTNILTLAFVSTDGSMDKQDIADYVASNIQDPLSRVNGVGDIDAYGSQYSMRIWLDPAKLNSYQMTTKDVTDAISSQNAQIAVGQLGGTPSVDKQALNATINSQSLLQTPEQFRNITLRVNQDGSEVTLGDVATVEMGAEKYDYLSRYNRQPASGLGIKLASGANEMATAERVINRLNELAQFFPHGLEYKVAYETTSFVKASITDVVKTLLEAILLVFLVMYLFLQNFRATLIPTIAVPVVLMGTFAVLYACGYSINTLTMFAMVLAIGLLVDDAIVVVENVERIMSEEGLSPREATRKSMGQIQGALVGIAMVLSAVFVPMAFFGGTTGAIYRQFSITIVAAMVLSVLVAMILTPALCATLLKPVKPGESHERTGFFGWFNRTFNRSASRYETFVGKILHRSLRWMLIYVLLLGGMVFLFLHLPTSFLPLEDRGMFTTSVQLPSGSTQQQTLKVVQKAEDYFLNNEKQNVESVFATVGSGPGGNGQNVARMFVRLKDWDQRDPQTGTSFAIIERATKAFNQINEARVIASSPPAISGLGSSAGFDMELEDHAGKGHDALMAARDTLLELAGKNPLLTRVRHNGLDDSPQLQVDIDQRKAQALGVSIDDINDTLQTAWGSSYVNDFMDRGRVKKVYVQAAAKYRMLPDDINLWYVRNSSGTMVPFSAFATSRWETGSPRLERYNGYSAVEIVGEAAPGISTGTAMDMMEKLAAQLPTGFGLEWTAMSYQERLSGAQAPALYAISLLVVFLCLAALYESWSVPFSVMLVVPLGVIGALLATWMRGLENDVYFQVGLLTVIGLSAKNAILIVEFANELNEKGQDLLSATLSACRQRLRPILMTSLAFIFGVLPMATSTGAGSGSQHAVGTGVMGGMISATVLAIFFVPLFFVLVRRRFPLKERPQ

SEQ ID NO: 9151 - protein, 299 aa, Klebsiella pneumoniae
YITGNEVLMRWQGRRESDNVEDRRGQSGSPFGGGGGGGFRLPSGKGGIVLLIIVLVAGYYGVDLTGMLTGEPMPQQQTSTQRSISPKDDEAAKFTSVILATTEDTWGPIFEKIGRQYPQPKLVLYRGATRTGCGTGQSVMGPFYCPADSTVYIDLSFYDEMKNKLGADGDFAQGYVIAHEVGHHVQKLLGIEPKVRQQQQHATQAEANRLSVKMELQADCFAGVWGHNMQQQDILETGDLQEALNAAEAIGDDRLQQQSQGRVVPDSFTHGTSKQRYTWFKRGFDSGDPAQCNTFGSAL

SEQ ID NO: 9152 - protein, 365 aa, Klebsiella pneumoniae
PVGGAGSGLPPALTIMKKRRSANLHHLCCEALPENTRLTPQVEIDNIHQRHTTDVYEHALTITAWQQIYDQLHPGQFRGEFTEILLDEIQVFREYTGLALRQSCLVWPNSFWFGIPATRGEQGFIGSQCLGRAEIATRPGGTEFELSTPDDYTILGVVISQEVIARHASFLHHPERVLHMLRNQSALAVREPHKAALWGFVQQALATFSEHPDTLHQPAVRKVLRDNLLLAMGTMLEEAQPMVSAESVSHQSYRRLLAQAREYVLENSAEPLTVLDLCQQLYVSRRTLQNAFHAILGIGPNAWLKRIRLNAVRRELISPWSERETVKEAAMQWGFWHLGQFATDYQQLFAEKPSMTLHHRLRQWV

SEQ ID NO: 9153 - protein, 688 aa, Klebsiella pneumoniae
AVMGQEKLYIEKELSWLSFNERVLQEAADKSNPLIERMRFLGIYSNNLDEFYKVRFAELKRRIIISEEQGSTAHSRHLLGKIQARVLKADQEFDSLYNELLLEMARNQIFLINERQLSVNQQAWLRNYFKQYLRQHISPILINRETDLVQFLKDDYTYLAVEIIRGENINYALLEIPSDKVPRFVNLPPEAPRRRKPMILLDNILRYCLDDIFKGFFDYDALNAYSMKMTRDAEYDLVHEMESSLMELMSSSLKQRLTAEPVRFVYQRDMPDAMVEMLRDKLSISNYDSMLPGGRYHNFKDFIGFPNVGKANLVNKPMPRLRHLWFDKFRNGFDAIRERDVLLYYPYHTFEHVLELLRQASFDPSVLAIKINIYRVAKDSRIIDAMIHAAHNGKKVTVVVELQARFDEEANIHWAKRLTEAGVHVIFSAPGLKIHAKLFLISRKEGDEVVRYAHIGTGNFNEKTARIYTDYSLLTADARITNEVRRVFNFIENPYRPVSFDYLLVSPQNSRRLLYEMIDREIANAQNGQPSGITLKLNNLVDKGLVDRLYAASSSGVPVNLLIRGMCSLIPGLEGISENIRVISIVDRFLEHDRVYCFENGGDKQVWLSSADWMTRNIDYRIEVAAPLLDPRLKQRVLDIFDILFNDTVKARYLDKELSNRYVPRGNRRKVRAQMAIYDYLKSLEQPD

SEQ ID NO: 9154 - protein, 420 aa, Klebsiella pneumoniae
GFVGLFEHGIFERKPNPTMLTDTKLRNLKPKDKLYKVNDRDGLYVAITPAGSISFRYNYSIHGRQETITFGRYGVGGITLAEARERLGEAKKMIAAGKSPAKEKARDKARVKDAETFGAWAEKWLRGYQMADSTRDMRRGTYERELKPKFSNRKLIEITHEDLRALTDAIVEQGRPSTAVLCREIMMQVFRWAIERGQKVENPADLVRPSTIAKFEPRDRALTPEEIGLMYQYMERIGTTPSIRAAAKLLLLTMVRKSELTNATWNEINFTDALWTIPKERMKRRNPHLVFLSRQALDIFIALKTFAGGSEYILPSRYDSDLPMSSATLNQVLTLTYRLAQKEGQSLGKFGPHDLRRTASTLLHEAGYNTDWIEKCLAHEQKGVRAIYNKAEYRDQRRAMLQDWADMIDEWTIRKTRLKD

SEQ ID NO: 9155 - protein, 352 aa, Klebsiella pneumoniae
INFISQMKKSTIAHLFSGAFMKLFRILDPFTATLITVVLLASFFPARGAFVPFFEHLTTAAIALLFFMHGAKLSREAIIAGGSHWRLHLWVMCSTFILFPLLGVLFAWWAPVNVDPMLYSGFIYLCILPATVQSAIAFTSLAGGNVAAAVCSASASSLLGIFVSPLLVGVLMNLHGAGGSLEQVGKIMLQLLLPFVLGHLSRPWIGDWVAKHKKWIGKTDQTSILLVVYSAFSEAVVNGIWHKVGLGSLLFIVVVSLVLLAIVIAVNVFVARRCGFNKADEITIVFCGSKKSLANGIPMANILFPTSILGIMVLPLMIFHQIQLMVCAVLARRYKQQTDARLAEEKANAAKA

SEQ ID NO: 9156 - protein, 578 aa, Klebsiella pneumoniae
GRVMISGILASPGIAFGKALLLKEDEIVIDRKKISADKVDQEVERFLSGRAKASAQLEVIKTKAGETFGEEKEAIFEGHIMLLEDEELEQEIIALIKDKHMTADAAANEVIDGQATALEELDDEYLKERAADVRDIGKRLLRNILGLAIIDLSAIQDEVILVAADLTPSETAQLNLKKVLGFITDAGGRTSHTSIMARSLELPAIVGTGSITAQVKNGDYLILDAVNNQVLINPSNEQIEALRSLQAQVAEEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAVRIAMDRKEILRDQVRAILRASAFGKLRIMFPMIISVEEVRALKKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 9157 - protein, 480 aa, Klebsiella pneumoniae
GETMSGFKAGFLWGGAVAAHQLEGGWQEGGKGISVADVMTAGAHGVPREITDGVVAGKNYPNHEAIDFYHRYPQDLALFAEMGFKCFRTSIAWTRIFPQGDELEPNEAGLQFYDDLFDECLKHGIEPVITLSHFEMPYHLVTEYGGWRNRKLIDFFVRFARVVFTRYQHKVKYWMTFNEINNQANFHEDFAPFTNSGLKYLPDEDREPVMYQAAHYELVASALAVKAAREINPALQIGCMIAMCPIYPLTCAPDDMMMAMNAMHRRYWFTDVHVRGRYPQHLLNYFARRGFTLDITEADRQALTEGCVDYIGFSYYMSFATKATEDNPLLDYDETTSLVSNPYVKKSDWGWQIDPVGLRYSLNWFWDHYQLPLFIVENGFGAIDVREADGSVNDQYRIDYLSAHIAEMKKAVVEDGVDLMGYTPWGCIDLVSAGTGEMKKRYGFIYVDKDNEGNGTLARSRKKSFAWYQQVIASNGENLS

SEQ ID NO: 9158 - protein, 674 aa, Klebsiella pneumoniae
WCDMEPIEQQLTELRTTLRHHEYLYHVMDAPEVPDAEYDRLMRKLRELESQHPELITPDSPTQRVGAAPLTAFSQIRHEVPMLSLDNVFDEESFLAFNKRVQDRLKSTDHLTYCCELKLDGLAVSILYENGVLVQAATRGDGTTGEDITSNVRTIRAIPLKLHGENIPARLEVRGEVFLPQAGFEKINEEARRTGGKVFANPRNAAAGSLRQLDPRITAKRPLTFFCYGVGVLEGGELPASHSARLLQFKAWGLPVSDRVTLCHTPEEVLTYYRKVEEERPHLGFDIDGVVIKVDSLALQEQLGFVARAPRWAVAFKFPAQEQMTFVRDVEFQVGRTGAITPVARLEPVHVAGVLVSNATLHNADEIERLGLKIGDKVVIRRAGDVIPQVVNVVLSERPADARDVVFPTHCPVCQSDVERVEGEAVARCTGGLICGAQRKESLKHFVSRRALDVDGMGDKIIDQLVEKEYVHTPADLFRLTAGKLTGLDRMGPKSAQNVVNALEKAKETTFARFLYALGIREVGEATAAGLAAHFGTLEALEQASIEELQKVPDVGIVVATHTFNFFAEESNRDVIAQLLAEGVRWPAPVVVKAEEIDSPFAGKTVVLTGSLSQLSRDDAKARLVALGAKVAGSVSKKTDLVIAGEAAGSKLAKAQELGIEVIDEAEMMRLLGE

SEQ ID NO: 9159 - protein, 146 aa, Klebsiella pneumoniae
GQFMKIKTRFAPSPTGYLHVGGARTALYSWLFARNHGGEFVLRIEDTDLERSTPEAIEAIMDGMNWLNLQWDEGPYFQTKRFDRYNNVIDEMLEAGTAYKCYCSKERLEALREEQMAKGEKPRYDGRCRHSHEHHADDEPCVVRFC

SEQ ID NO: 9160 - protein, 222 aa, Klebsiella pneumoniae
GGIMPALDLIRPSVTAMRVIASVNDGFARELKLPSHIRSLGLITADSDDVTYIAADEATKQAMVEVVYGRSLYAGAAHGPSPTAGEVLIMLGGPNPAEVRAGLDAMMAHIEGGAAFQWANDAQDTAFLAHVVSRTGSYLSSAAGIALGDPIAYLVAPPLEATFGIDAAMKSADVQLVTYVPPPSETNYSAAFLTGSQAACKAACNAFTDAVLDIARHPVQRA

SEQ ID NO: 9161 - protein, 128 aa, Klebsiella pneumoniae
ELIIMSGVVAPKNTTARRRGKPIEVWVTDEEKTAITELADQTGLSRSAYLRAVGLNRPVGARADLEAVRELVKLNGDLGRVAGLLKLWLAEKRGQGARPIDIESVMIEFWELQAQIREKMSAIVFARK

SEQ ID NO: 9162 - protein, 172 aa, Klebsiella pneumoniae
EKIMGLFDKLKSLVSDDKKDTGTIEIVAPLSGEIVNIEDVPDVVFAEKIVGDGIAIKPTGNKMVAPVDGTIGKIFETNHAFSIESDSGIELFVHFGIDTVELKGEGFKRIAEEGQRVKVGDPVIEFDLPLLEEKAKSTLTPVVISNMDEIKELIKLSGSVTVGETPVIRIKK

SEQ ID NO: 9163 - protein, 670 aa, Klebsiella pneumoniae
SSPMMDALLNLTAQMAREGIRRLLVLSGDESWTLQQAQALRERLGGDGLWVGPEPVSAPCVAPGALKTLLGREVMHAFFDARRGFDVAAMAALSGTLRAGSWLVLLTPPFADWPTRADEDSLRWSDTPDPIVTPNFVHRCCRQFIADPEVLLWRQSDRPRFPLAAPRPDWHPADGRPQAEQAAILEQLIRLPPGIAAVTAERGRGKSALAGMLLRQLGGEAIVTAPTRSAVEVLASFAGETLRFMAPDALLASKEKAAWLIVDEAAAIPAPLLRQLVSRFPRTLLTTTVQGYEGTGRGFLLKFCASLPHLQSFTLSAPIRWAAGCPLESAISQLLIFNDEAFRDAPMGEIALEAVNQSCWQTQPALPEAMYQLLSGAHYRTSPLDLRRMMDAPGQAFRCARAGGAVAGALWLVAEGGLSRELSRAVWAGFRRPRGNLVAQSLAAHGGSPLAATLRGLRVSRIAVHPSRQREGLGRKMIADIAADAAGYDYLSVSFGYTAELWRFWQRCGFTLVRLGTHREASSGCYTAMALYPLTAAGRQLAQREAQRLQRDEYWLRPWREESAPLPAVADAMLSDEDWLEAASFAFAHRPLAAALGCLNRLLMQADMPLPALRGRLQGKEEAALCAVLQLTGRKALQARWRREAADALRSLDAARAEALRQQVAHLQFF

SEQ ID NO: 9164 - protein, 122 aa, Klebsiella pneumoniae
GDPMTDAVKIYHNPRCSKSRETLSLLQSRGIDPEVVLYLETPPDAGTLRQLLQLLGMESPRELMRQKEELYKSLNLADPALSNAALIQAMVDNPKLIERPIVVSRGQARIGRPPEQVLEIVS

SEQ ID NO: 9165 - protein, 295 aa, Klebsiella pneumoniae
GWPMFTGSIVALVTPMDENGNVCRTSLKKLIDYHVANGTSAIVSVGTTGESATLSHEEHGDVVMMTLELADGRIPVIAGTGANATAEAISLTKRFNDSGVVGCLTVTPYYNRPTQEGLFQHFKAIAEHTDLPQILYNVPSRTGCDMLPETVGRLAEIKNIVGIKEATGNLSRVHQIKELVSDDFILLSGDDATGMDFMQLGGVGVISVTANVAAREMADMCRLALAGQFAEARAINQRLMPLHTKLFVEPNPIPVKWGCKALGLVATDTLRLPMTPITDHGREAVTAALKHAGLL

SEQ ID NO: 9166 - protein, 326 aa, Klebsiella pneumoniae
GRAMSKIFEDNSLTIGHTPLVRLNRIGNGRILAKVESRNPSFSVKCRIGANMIWDAEKRGVLKPGVELVEPTSGNTGIALAYVAGARGYKLTLTMPETMSIERRKLLKTLGANLVLTEGAKGMKGAIQKAEEIVASNPEQFLLLQQFSNPANPEIHEKTTGPEIWEDTDGQVDVFISGVGTGGTLTGVSRYIKNTKGKKDLITVAVEPTDSPVIAQALAGEELKPGPHKIQGIGAGFIPGNLDLKLVDKVIGITNEEAISTARRLMEEEGILAGISSGAAVAAALKLQEDEAFTNKNIVVILPSSGERYLSTALFADLFTEKELQQ

SEQ ID NO: 9167 - protein, 282 aa, Klebsiella pneumoniae
GMNMAHDEQRWLSPRLQKAAALCNQAPAASESPLWLGIDLGTCDVVSMVVDRDGQPVAVCLDWADVVRDGIVWDFFGAVTLVRRHLATLEQQLGCRFTHAATSFPPGTDPRISINVLESAGLEISHVLDEPTAVADLLQLDNAGVVDIGGGTTGIAIVKQGRVTYSADEATGGHHISLTLAGNRGIGLEEAEQYKRSHAGEIWPVVKPVYEKMAEIVARHIAGQGIVDLWLAGGACMQPGVHELFRQRFPALPVHLPQHSLFMTPLAIANSGREKAEGMYAS

SEQ ID NO: 9168 - protein, 511 aa, Klebsiella pneumoniae
PMPINDNTPRPQEFAAVDLGSNSFHMVIARVVDGAMQIIGRLKQRVHLADGLDENSVLSEEAMTRGLNCLSLFAERLQGFSPSSVCIVGTHTLRQATNAAEFLKRAEKVIPYPIEIISGNEEARLIFMGVEHTQPERGRKLVIDIGGGSTELVIGEDFEPRLVESRRMGCVSFSQAYFPGGVINKENFQRARLAAVQKLETLAWQFRIQGWTVALGASGTIKAAQEVLVAMGEKDGFITPERLEMLVNELLKHKNFDALSLPGLSEDRKAVFAPGLAILCGVFDALAIKELRLSDGALREGVLYEMEGRFRHQDIRSRTAQSLANQYNIDREQARRVLETTTQMLEQWQEQNPKLANPHLAALLKWAVMLHEVGLNINHSGMHRHSAYILQNSDLPGFNQEQQMLMATLVRYHRKAIKLDDLPRFTLFRKKQFLPLIQLLRLGVLLNNQRQATTTPPTLRLQTEAHHWTLTFPHNWFSQNALVLLDLEKEQQYWEGVPEWMLKIAEEEPDA

SEQ ID NO: 9169 - protein, 341 aa, Klebsiella pneumoniae
GCAMAVKSLKKGYLALAASMLLVAQAQATELLNSSYDVSRELFAALNPPFEQQWAKDNGGDKLTVKQSHAGSSKQALAILQGLKADVVTYNQVTDVQILHDKGNLIPADWQSRLPNNSSPFYSTMGFLVRKGNPKNIHDWNDLVRSDVKLIFPNPKTSGNARYTYLAAWGAADKADGGDKAKTEQFMTQFLKNVEVFDTGGRGATTTFAERGLGDVLISFESEVNNIRKQYEAQGFEVVIPKTNILAEFPVAWVDKNVKANGTEKAAKAYLNWLYTPQAQTIITDYYYRVNNPKVMDALKDKFPQTELFRVEDKFGSWPEVMKTHFASGGELDKLLAAGRK

SEQ ID NO: 9170 - protein, 347 aa, Klebsiella pneumoniae
GDLMAYSVQKSRLAKVAGVSLVLLLAACSSDSRYKRQVSGDEAYLQASPLSELHAPAGMILPIQVGDYNIPVANSTGAVGKALDIRPPAQPLALVSGARTQFNGDTATLMVENGRSGSLWAQVTSILQSKNYVIAKRDDASQTLNTDWVEWNRLDEDQQYRGRYQISVKPQGYQQAVVVKLVNLEQAGKPVADPASLQRYSTAMLNVISEGLDMNATSAQNAAQRSAGATFDVQSAADDTGLPMLVVRAPFNLVWQRLPGALEKVGMKVTDSTRSQGSMALTYKPLSDSSWQELGARDPQLVSGDYKLQVGDLDNRSSLQFIDPKGHTLTQSQNDALVAVFQAAFNK

SEQ ID NO: 9171 - protein, 68 aa, Klebsiella pneumoniae
GQLMKDRSHDEAMAEHFRADPAYAAELLAEVRRNGDPAELAMLLRLMATASADDARSDDADTGRTLPR

SEQ ID NO: 9172 - protein, 64 aa, Klebsiella pneumoniae
WWVMTGSNRRPPPCKGGALPAELITPAVWSRIIGRVENESTPFLKNSFVRRKIKQSDRETGAIA

SEQ ID NO: 9173 - protein, 289 aa, Klebsiella pneumoniae
IVAIDLRAAFENEPPTLDFIWPGFLAGTVGALVAPGATGKSFWALEAAMAIACSVAGGDLLRLSPAGTGRVVYCAGEDPKVALVRRIHSIGQHLNPQSREAIAQNLTLEPIMGRRLNVMDERHLARVIEFCAGARLIVLDTLSRIHDRDENSNGDMARLVATLEHIATSTGASVLYLHHVSKGSARDGQTDQQQAARGASALIDNARWCGFVAKMTEDEAKSLSDRAYDRQPIGNDRRGFFVRFGVSKQNYDSTPHDQWYERRDGGVLLPVELLDAKQGSGKGRQREQV

SEQ ID NO: 9174 - protein, 311 aa, Klebsiella pneumoniae
IKKMNYSLRQLKVFVTVARARSFSRAGEMIGLSQSAVSHSVKELEHQTGVRLLDRTTREVVLTEAGQQLAGRLERLLDELRITLRDAGRVGQQLSGTVKVAASQTISAHLIPQCIAHSNRRYPDIDFVLHDRPQQWVLESIRQGEVDFGIVIDPGPAADLQCEVVLAEPFLLLCREDHPFASLTEVPWQALQDERLILQDYASGSRPLIDAALSRLAIRANIVQEIGHPATLFPMVESGIGISVLPALALPLPQGSHLTVKRLTPVMERQLMLACRKNRSLSTAAQALWEIVREEGENLTAARVEDPLYQR

SEQ ID NO: 9175 - protein, 306 aa, Klebsiella pneumoniae
VKIVNTLEQTIGNTPLVKLQRLGPDNGSEVWVKLEGNNPAGSVKDRAALSMIVEAEKRGEIQPGDVLIEATSGNTGIALAMIAALKGYRMKLLMPDNMSQERRAAMRAYGAELILVSKEQGMEGARDLALEMAQRGEGKLLDQFNNPDNPYAHYTTTGPEIWQQTAGRITHFVSSMGTTGTITGVSRFLREQSKPVTIVGLQPEEGSSIPGIRRWPAEYMPGIFNASLVDTVLDIHQQDAENTMRQLAVREGIFCGVSSGGAVAGALRIARENPGAVVVAIVCDRGDRYLSTGVFGEEHFSQGAGI

SEQ ID NO: 9176 - protein, 209 aa, Klebsiella pneumoniae
YEGVLLRCGVGMSLNIHVIKDKILSENWFVLRNMTYELTRADGSVVRHKREVYDRGNGATVLLYNRHKQTVVLVRQFRVATWVNGNHDGMLIETCAGLLDNDEPEACIRKEAVEETGYEVGEVRKLFELFMSPGGVTEVVHFFIAEYSDAQRTTSGGGVDDEAIEVLELPFSQALQMVADGEIRDGKAVILLQYLQTSGLMSGNSDKSD

SEQ ID NO: 9177 - protein, 148 aa, Klebsiella pneumoniae
PSMVGNTMEIRVFRQQDFEEVVTLWERCDLLRPWNDPEMDIERKLNHDVSLFLVAEVNGEVVGTVMGGYDGHRGSAYYLGVHPEYRGRGIANALLNRLEKKLIARGCPKINIMVREDNDVVQGMYERLGYEYADVLTLGKRLIEDEEY

SEQ ID NO: 9178 - protein, 343 aa, Klebsiella pneumoniae
PPAVKARRRGIAFISMVFHSVKTVVLSIPGRLLFWQSGYLMRGIRETFMTTLNLGNLATFRLVVQRGSFSAAADALGISQPAVSLQVRQLEQFLQTRLLERTGRGIKATAAGMALLAHSEQIDRAVNSAVQSVSAFSQEVNGSLTLGTGATACIHLLPPLLQHLRQQHPLLTVGVTTGNTLDIVRAVEENRLDLGLVTLPVQGRSLAVTAMLDEEFVTIYASRETEMPAVYTPAELQAQPLIAFEAGSGTRDLIDRWFRSAGLAVTPVMQLGSIEAIKRMVRAGLGYSIVPRMAVERVEDRDGLRVHSLAPRLYRQLAVVMRQDKIVTKGIAEMLRLLHTVRL

SEQ ID NO: 9179 - protein, 82 aa, Klebsiella pneumoniae
QNEVFGVERELRSARKVLISKKQLLEMIPLCERTIYNFEKRGKFPQRIALSSRKVVWDLAEVEAWIDACKHSGSAPRPGMGA

SEQ ID NO: 9180 - protein, 269 aa, Klebsiella pneumoniae
QKEVFGMELESQKMSTYAARKFGRGAALALAMASAGLGVSLYMAPAPAYAIYCSNCSTFYQQMYEYAEAVNTQLNTAQQLQTQIQQYDNMIKQGMSLPSRMFNTITGDLQRVASVYNSAQSLGRNISNLDEQFRQQFKGYDSYLNSIGQGQNNMPQRYRDWAQSGFDNARTAMQAAGVNTSTFEDENAMLDQLVSRSQSAVGRQQAIQAGNEIAAQNVQQLQKLRDLVATQITLQGNYMAQQNERQSVSDASEQQFRSRENTRGPSEGF

SEQ ID NO: 9181 - protein, 675 aa, Klebsiella pneumoniae
ACALRGYSPRRQKEAMNHFILSDSRKCIGCQACEVACVMAHNEEQHVLTPQRFLPRITVIKAEGQRNAITCRHCEDAPCVRSCPNDAIAQSGDSVQVRQEKCIGCKSCMVACPFGVMQVVVTPQAAGLVKASAHKCDLCQGREAGPACVENCPAQALTLADDETLITLAKQRRLRSACQEVQPWQRATPLCSQPNAGAKVRQMAMTPPRGEPDKLAAEVRKSHFEEIYQPFTPQQAQQQAARCLTCGEHSICEWTCPLHNHIPQWIELVKAGNIAAAVALSHQTNCLPEITGRVCPQDRLCEGACTLRDESGAVTIGNIERYISDQALASGWRPDLSQVKPSGKRVAIIGAGPAGLACADMLVRHGVQPVVFDRHPEIGGLLTFGIPAFKLDKSLLARRRAIFSEMGIRFELNCEVGKDISMATLLADYDAVFVGAGTYRSMKAGLPNEEAPGVYDALPFLIANTKQVMGLAASAQEPYVNTAGLNVVVLGGGDTAMDCVRTALRHGARQVTCAYRRDEANMPGSKKEVKNAREEGALFEFNVQPVTLELDENGRVNGVRFLRTELGAPDAGGRRRPTPIPGSEFVMPADAVIMAFGFHPHRMPWLEAAGVALDSQGRIKAGVESRYRYQTSQEKIFAGGDAVRGADLVVTAMAEGRHAAQGILDYLARKTTPLH

SEQ ID NO: 9182 - protein, 589 aa, Klebsiella pneumoniae
WNEFYMIKRIDKIAITNVKGIESSVFDVQLIPNKPTLVVAPNGFGKSSIAAAFGCLRSKKMDLDKDECHKGDEGRHPSLKISYTMQGGDKIEKEANHTKNELAATFGVHVINSQLVSKAKKLKIAGANIVTSAIEVTPIVLIKNIPPKEKFSYSFAAVKVGFGKNGKVLPNISNLLADNRIMAKIWNQVDFTKQDQAGVKKAIKALQDEINAGTGNTDKILADVKDETTQAVLAIDFVSGILAALAESGLNDFSQIEAILVALQIGDIHANDKAAFKKAAERANYAFEKAAYIEDFSALKGTWRNIQPKETADGLVIAFPKANQISNGERDIICFVAQLKKAKLQLKKKKAIILVIDEIFDYLDDANLVACQYYLTQMIAELKSEGRQIFPLIMTHLNPGFFRNFTFSDQKVCYLNKIAVSNKAVENIISKRDDPAISDAISKHFLHFHSEDVDLSNEFQALGLPADLAKASQFSVHCASQMQRYVEGKGFDPLAVCSGVRRKVEQLTFDSLAEESREEFLSVHKTVNKLQFAEAAGTTVPEVYYLLAVIYNDAMHIRPNQDNFSGLGTKLANLTIKHMISTLIQPDAL

SEQ ID NO: 9183 - protein, 115 aa, Klebsiella pneumoniae
RYRSLKKTLYNLLYNDWEGAMENHFGKGLMAGLQASYADTAAHAANFCADYKRGFVLGYSHRMFEKTGDRQLSAWEAGILTRRYGLDRDMVMDFFKEGGSGMAMRYFLAGYRLES

SEQ ID NO: 9184 - protein, 458 aa, Klebsiella pneumoniae
MVMSLFHSVSDLIGHTPLLQLHKLDTGPCSLFLKLENQNPGGSIKDRVALSMINEAERQGKLAPGGTIIEATAGNTGLGLALIAAQKNYRLILVVPDKMSREKIFHLRALGATVLLTRSDVNKGHPAYYQDYARRLADETPGAFYIDQFNNDANPLAHATSTAPELYRQLEGDIDAIVVGVGSGGTLGGLQAWFAEHSPKTEFILADPAGSILADQVDTGRYGETGSWLVEGIGEDFIPPLARLEGVHTAYRVSDREAFQTARQLLQVEGVLAGSSTGTLLSAALRYCRAQSRPKRVVTFACDSGNKYLSKMFNDDWMRQQGLIARPEQGDLSDFIALRHDEGATVTAAPDDTLAAVFTRMRLYDISQLPVLEDGRVVGIVDEWDLIRHVQGDRQRFSLPVSEAMSRHVETLDKHAPESELQAILDRGLVAVIADNARFLGLVTRSDVLTAWRNRVAQ

SEQ ID NO: 9185 - protein, 435 aa, Klebsiella pneumoniae
TNSSSLPDLRIILRKTDTGESGVKSYLVGGAVRDALLGLPVKDRDWVVVGATPQQMLDAGYQQVGRDFPVFLHPQSREEYALARTERKSGAGYTGFTCYAAPDVTLEADLLRRDLTVNALAQDADGAIIDPYGGQNDLRQRLLRHVSPAFSEDPLRVLRVARFAARYAHLGFRIAEETQALMAAMVEAGELAHLTPERVWKETESALTTRNPQVFFQTLRDCQALKVLFPEIDALYGVPAPAKWHPEIDTGLHTLMTVTMAAMLSPDVDVRFATLCHDLGKGLTPKALWPRHHGHGPAGVKLVEQLCARLRVPNDIRDLAKLVAEYHDLIHTLPILQPKTLVKLFDSIDAWRKPQRVQQIALTSEADVRGRTGFEASDYPQGRLLLEAWEVAQSVSTKEVVAAGFKGAEIREELTRRRIAAVAQWKEQRCPQPQG

SEQ ID NO: 9186 - protein, 381 aa, Klebsiella pneumoniae
SLPPQRLLPVGNQIVRIFDPHRQADQLRCDTVRQAFLQRDRGMGHAEGLAHQTLHAAQALRKRKPAQLADDALGVTFIALHHHRNHAAGQGHLLARQLMMRVRSQPGKPDSLHFRLLFQPFGELQRVRAVALHPQRQGTDAAQRQEAAERVKHAAYRILQIAKLFRELGVIANHRQAGDDIGMAVEVLGRGVHHNIKPMLQRAMDRRRSKGVIGDADQVMAARDGGDGAEIRELQQRVGGRFHPDHAGVGADRRFNSRQVVGFHPAHLQTRATAANVFQQAVSAAIHIIDRHQVTVLIQQLQHGGDGGQPGGERVAARAVFQVGDRRLQRVAGGIPAAGIFITGMLPRRWLSKSGGGINRRHHCAVAVGEGSAMYTQGVDR

SEQ ID NO: 9187 - protein, 220 aa, Klebsiella pneumoniae
PVYPRLLLLKNSLSPHQESAMKIIVIGASGTIGRAVSEELSQRHEVIRVGRTRGDYQVDITSQESVEALFAQTGEVDAIVSTTGNLHFGPLSTMTDSQFNLGLQDKLLGQIRLALVGQHFLRDGGAITLVSGIVAQEPIAQGVNATTVNAGLEGFVRAAACELPRGIRINLISPTVLSESLAAYGDFFPGFPSVPAAAVAQAYRRSIEGVQTGRIYPVGY

SEQ ID NO: 9188 - protein, 260 aa, Klebsiella pneumoniae
IQYPSRPACFLAKPDTTSGELCVLSTDAENTTTFSKRNSVMSAIAPGLVLLAYLCGSISSAILVCRLAGLPDPRDSGSGNPGATNVLRIGGKGAAVAVLIFDVLKGMLPVWGAWALGLTPFWLGLVAIAACVGHIWPVFFHFRGGKGVATAFGAIAPIGLDLTGVMAGTWLPDHPAQRLLFPGRYRQRADRPVLRLVVQTAVYLSGVDALLPDPPAPSRQHSASVASPGEQNLDPREEEKNARAEVISPPGSASRGTLLR

SEQ ID NO: 9189 - protein, 80 aa, Klebsiella pneumoniae
WPGPGCLTILLSGYSSLGAIVSALIAPFYVWWFKPQYTFPVSMLSCLILLRHHDNIQRLWRRQESKIWTRVKKKKTPEQK

SEQ ID NO: 9190 - protein, 273 aa, Klebsiella pneumoniae
CASPVRRTGDALNVRQRKDPPLSAPLRFIFHHSSSILSVNTRHTTGSWKTNMKRTKNINHSSFRKSWSARHLTPVALAVTAVFMLAGCEKSDETVSLYQNADDCSAANPGKAAECTTAYTNAVKEAERTAPKYATREDCVAEFGEGQCQQTPAQAGVAPENQAQAQSSGSFWMPLMAGYMMGRLMGGGMAQQQPLFSSKNPASPAYGQYTDASGKSYGAAQPGRTMNVPKTAMAPKPATTTVTRGGFGESVAKQSTMQRSAAGSTSSSRSMGG

SEQ ID NO: 9191 - protein, 206 aa, Klebsiella pneumoniae
GFFTMNQTLLSSFGTAFERVEHALDALREGRGVMVLDDEDRENEGDMIFAAETMTVEQMALTIRHGSGIVCLCLTEDRRKQLDLPMMVENNTSAYGTGFTVTIEAAEGVTTGVSAADRVTTVRAAIADGAKPSDLNRPGHVFPLRAQPGGVLTRGGHTEATIDLVTLAGFKPAGVLCELTNDDGHHGPRAGVHQVRSAAQYGGSHD

SEQ ID NO: 9192 - protein, 63 aa, Klebsiella pneumoniae
YKLTTLRELKASKFPFSNISFLLAIIILRVQHSNKLLLRTCRFIHPLPVLPFPEHSVHSGDKM

SEQ ID NO: 9193 - protein, 98 aa, Klebsiella pneumoniae
CPMTLSCSSTDFENDSDFRPSRARCCLRFRLCRSIRCVYRLLITCSFPFRRDSYSGQPSVIHITTSKGDSRLIRRPSVAIVRSPNTCATTVFRSLSYA

SEQ ID NO: 9194 - protein, 76 aa, Klebsiella pneumoniae
TGGTADRNRSHWSTSKTPSYTKSVSWQHHRTSFVGFSQLQRGAYYLDLHPRLFAFKELDSQSRYDKSALLGSDCYA

SEQ ID NO: 9195 - protein, 252 aa, Klebsiella pneumoniae
PMVASYALCFWLTGKTRIRWCVKRAKRRSRREWSRLSRSPRSCLTACCPQVDLSTPDGRAQLSTLALPLITQVPGETLRIYLRQELGNKLGILDDAQLERLMPKQAENGAPRPAPQLKRTTMRILIGLLVQNPDLAPLVPPLEGLDSRKMPGLSLFSELVKSCLAQPGLTTGQLLEQYRGTKEAATLEKLSMWDDIADKDIAEQTFTDSLNHMFDSLLELRQEELIARDRTHGLSSEERRELWTISQELAKK

SEQ ID NO: 9196 - protein, 161 aa, Klebsiella pneumoniae
FADAGKLSGGGTAHHRRHARDGWRKLRFTVQYLWTTHRMPEAVLNEFLTLREHPELNPARYHEIIDKWWGISFSSPSIASSDWLTVGVLVLVTIPFIAYFGLRHARPLSAQFSQLRIAADEVTDGHFGAQAELTPEAPAELVQFAQNFNAMMSSRRGEDKR

SEQ ID NO: 9197 - protein, 245 aa, Klebsiella pneumoniae
FLRAAHRLHAAGAEVQIAALQQEYLSGDIAERGLVAADHAGEDVIDDHRRDGGEQADGRRQQRFCDARRYHRKIGGLGLGDADKAVHDAPDGTKQTHKRGNGADGRQIAVTAPHMATNRRNAALKAKTGSFLDAFIVFGTGREFEFVLRFIDKLGGEAFRLKGAGDIAGLIERAGFRQLLLFTFEATLAGEDFRPFTEENGPCDDRRQNQANHHHLNDNIGMMIHTPNGEIRLHQIITHALSPRR

SEQ ID NO: 9198 - protein, 155 aa, Klebsiella pneumoniae
TASASAGADDPGARADAQAAAAESTPPAPEPGCRWPAHRPAVPPAASAARPRRSPPGAARSHRCSAKPHRVSSALLPLRPAAATRCGRSRPYGTGRDDRRDPLASRGSRNAPDKPARRRSPSDTAPGSEPPDPPDGSRRYGSPDRTPHPPDRPSG

SEQ ID NO: 9199 - protein, 632 aa, Klebsiella pneumoniae
MSTARLPTPIKRIKCGYRLMEQNPQSQLKLLVQRGKEQGYLTYAEVNDHLPEDIVDSDQIEDIIQMINDMGIQVMEEAPDADDLMLAENTADEDAAEAAAQVLSSVESEIGRTTDPVRMYMREMGTVELLTREGEIDIAKRIEDGINQVQCSVAEYPEAITYLLEQYDRVEAEEARLSDLITGFVDPNAEEDMAPTATHVGSELSQEEMDDDEDEDEDEDADDNSDDDNSIDPELAREKFAELRTQYELTRDTIKAKGRSHAAAQEEILKLSEVFKQFRLVPKQFDYLVNSMRSMMDRVRTQERIIMKLCVEQCKMPKKNFITLFTGNETSETWFNAAVAMNKPWSEKLLEVKEDVQRGLQKLQQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLRSFLDD

SEQ ID NO: 9200 - protein, 336 aa, Klebsiella pneumoniae
RAAAGGVAPVQAGAAAAYRGGGISPGTLPVMKVSDHLTWLAEAILDAVVQQAWGQMVARYGLPTHLHDRQGRGFAVVGYGKLGGWELGYSSDLDLVFLHDCPAEVMTDGEREIDGRQFYLRLAQRIMHLFSTRTSSGILYEVDARLRPSGAAGMLVTTADAFADYQQNEAWTWEHQALVRARVVYGDPALQARFDAIRRDILTTPREGATLQTEVREMREKMRAHLGNKHPNRFDIKADAGGITDIEFITQYLVLRYASDKPKLTRWSDNVRILELLAQNDIMDEEEARALTHAYTTLRDALHHLALQELPGHVAPEAFSREREQVSASWQKWLMA

SEQ ID NO: 9201 - protein, 143 aa, Klebsiella pneumoniae
SAMAMRLNENLDDNGEMHEINVTPFIDVMLVLLIIFMVAAPLATVDVKVNLPASSSQPQPRPEKPIYLSVKADKSMFLGNDPVTEANMINALDSLTAGKKDTTVFFRADKTVDYETMMKVMDTLHQAGYLKIGLVGEETVKAK

SEQ ID NO: 9202 - protein, 523 aa, Klebsiella pneumoniae
TAVAALSASKVKVIRRNFGIRSSFGHKKWNDSRGIARATQSFPPQSESSRRWPGKKRVAWRFTAKYYLLTKNIVVSSPQFVGAAQKRKNSVMAQEIELKFIVAQDGVETLREQLNALEAKHTPAGQLLNIYYETADNWLRRHDMGLRIRGDQGRYEMTLKIAGRVVGGLHQRPEYNIPLDKPELALERLPAEVWPQGELPAALAEHVQPLFSTDFARERWVIQEGKSEIEIALDRGEVEAGEHQEPICELELELLAGETTDLLRLAHRLLESGVLRQGSLSKAARGYHLAQGNNERPVTRLAVLPVAAKASVEQGLEAALESALAHWLYHDEIWLRGNAKAKAEILLAIARVRHALVLFGGIVPRKATTHLRALLNDADAVLLAADTADEALFRTEVVGAKLALTEWLVQRGWRPFLNEAGEKKIAGSFKRFADIHLSRVAAELRSAVQHLAVEDAADQLPKLSRDIDSVQLLAGAYGDAVAPWLENWQELQRAIEHDDRSVFEYFRRQALAAEPFWLHSGKR

SEQ ID NO: 9203 - protein, 121 aa, Klebsiella pneumoniae
LSPAEKLMLKKLSLIIPLLALIALLVWWFTPHYTEEDEAYYRAVFCIIDHDDSRQFLHDMQNIVEGGNSDYALHKTHYLPALGQRMLDTWRQLSPQEQQALRQDKQRCGEILREKQQGKSS

SEQ ID NO: 9204 - protein, 765 aa, Klebsiella pneumoniae
PWPAHGQGLRKSSFISTIIPAYNPRPFGYFFIIFPGSNMSAISLIQPDRDLFSWPQYWAACFGPAPFLPMSREEMDQLGWDSCDIILVTGDAYVDHPSFGMAICGRMLEAQGFRVGIISQPDWNSKDDFMRLGKPNLFFGVTAGNMDSMINRYTADRKLRHDDAYTAGNVAGKRPDRATLVYTQRCKEAWKDVPVILGGIEASLRRTAHYDYWSDTVRRSVLVDSKADMLMFGNGERPLVEVAHRLAMGETIDQIRDVRNTAIMVKEALPGWSGVDSTRLDTPGKIDPIPHPYGEDLPCADNKPVAPKKQEAKSITVQPPRPKPWEKTYVLLPSFEKVKGDKVLYAHASRILHHETNPGCARALMQKHGERYIWINPPAIPLSTEEMDSVFALPYKRVPHPSYGDARIPAYEMIRFSINIMRGCFGGCSFCSITEHEGRIIQSRSEDSIINEIEAIRDTVPGFTGVISDLGGPTANMYMLRCKSPRAEQTCRRLSCVYPDICPHMDTNHEPTINLYRRARELKGIKKILIASGVRYDIAVEDPRYIKELATHHVGGYLKIAPEHTEEGPLSKMMKPGMGSYDRFKELFDTYSKQAGKEQYLIPYFISAHPGTRDEDMVNLALWLKKHRFRLDQVQNFYPSPLANSTTMYYTGKNPLGKIGYKSEEVVVPKGDKQRRLHKALLRYHDPANWPLIRQALEAMGKKHLIGSRRDCLVPAPTLDEMREARRQNRHTRPALTKHTPIAHQRQPPAAAGAKKRVKPKAVSR

SEQ ID NO: 9205 - protein, 278 aa, Klebsiella pneumoniae
GHHLESLLNLPLAGEARVRILQITDTHLFAEKHETLLGINTWDSYQAVLSAIHASQRPCDLIVATGDLAQDHSSAAYQHFAEGIASFAAPCVWLPGNHDFQPAMYSTLQEAGISPAKRVFLGDRWQILLLDSQVFGVPHGELSDFQLEWLEHKLAEAPERYTLLLLHHHPLPAGCSWLDQHSLRNAGALDSALSAWPRVKHLLCGHIHQELDLDWNGRRMMATPSTCVQFKPHCANFTLDTVSPGWRWLELHPDGTLTTEVCRLEGAAFHPDIASEGY

SEQ ID NO: 9206 - protein, 491 aa, Klebsiella pneumoniae
DSFYPASTVNTTSSERDYIVNHDNKLSFAEKLGYGMGDAACGIVYSSVTMFLTWFYTDIYGLSAAAVGVMFLVTRVLDAITDPLTGIVADRVKTRWGHFRPWLIWFAVPYAVLAVMTFTTPEFGASGKLVYAYLTYTLLMLCYTFINIPYCALGGVITRDEKDRLSAQSYRFTISSLAGLMVSVATLFLVDFFGKENKQFGFQATMGIMGAIAIVMLAFCFFSTKERVAPAVEQQGSIREDLRQLLANDQWRIVAIITFFSSMAGVMRSAATLYYATYLMLGGVESAAGTAMKSAFVSTSVVGTIIGSIAAGWLAKRYRAVSLFKNINLLLVLVGVVMFFVPPTWLPVVFPLYFLVGFFHQMYQPFKWNMMANAADYGEWKFGRRITGLSYSGNLFALKMGMAVAGAAVGFSLGLFGYQAGVTAQTPLATMGIVGLLTLGPSLSYLLLWWLARFYKLDDKMMQTIQRELSMRQQQGHSETHLPLNAVPEKA

SEQ ID NO: 9207 - protein, 175 aa, Klebsiella pneumoniae
DWSYKLLRHLLKSWRKASLRRKVERGRLLRFDGLFAHQPDLEIARLMQGIHHFHHRLVIDGFIRAEEDSGIFFAGGQAIQGVNHIRFGNRVVAEEHALIRLHRQVDGFFRSRLRLAGGGWQIDLHVDRRQRRGHHKDNQQNQHDVDKRRHVDLMHFAVIVQIFIKTHRHSRSTYP

SEQ ID NO: 9208 - protein, 499 aa, Klebsiella pneumoniae
WLNYKIGCAIIARKVCVSQERVMKVTLPEFERAGVLVVGDVMLDRYWYGPTSRISPEAPVPVVKVENIEERPGGAANVAMNIASLGATSRLVGLTGIDDAARALSQALANVNVKCDFVSVPTHPTITKLRVLSRNQQLIRLDFEEGFSGVDPQPMHERIQQALGSIGALVLSDYAKGALTSVQTMIRLAREAGVPVLIDPKGTDFERYRGATLLTPNLSEFEAVVGKCQDEAQIVERGMKLIAEFELSALLVTRSEQGMTLLQPGRPPLHMPTQAQEVYDVTGAGDTVIGVLAATLASGNTLEEACYFANAAAGVVVGKLGTSTVSPVELENAVRGRAETGFGVMSEEELKQAVAAARKRGEKVVMTNGVFDILHAGHVSYLANARKLGDRLIVAVNSDASTKRLKGETRPVNPLEQRMIVLGALEAVDWVVSFEEDTPQRLIAGILPDLLVKGGDYKPEQIAGSEEVWANGGEVLVLNFEDGCSTTNIIKKIQKDSDK

SEQ ID NO: 9209 - protein, 82 aa, Klebsiella pneumoniae
LIWYELTLILLHSFQNEIKLMPVIIASSVKEAKALINGGKYREIILNFDIDADDFFSLASHSAGTKISIADRNDRSPVESAK

SEQ ID NO: 9210 - protein, 789 aa, Klebsiella pneumoniae
RNPQPISRPVTQGVRSGIIAGSFAVRTVGTQIEDPRLMSDMAERLALHEFTENAYLNYSMYVIMDRALPFIGDGLKPVQRRIVYAMSELGLNASAKFKKSARTVGDVLGKYHPHGDSACYEAMVLMAQPFSYRYPLVDGQGNWGAPDDPKSFAAMRYTESRLSKYAELLLSELGQGTVDWVPNFDGTLQEPKMLPARLPNILLNGTTGIAVGMATDIPPHNLREVAKAAITLIEQPKTTLDELLDIVQGPDFPTEAEIITSRAEIRKIYQNGRGSVRMRAVWSKEDGAVVISALPHQVSGAKVLEQIAAQMRNKKLPMVDDLRDESDHENPTRLVIVPRSSRVDMEQVMNHLFATTDLEKSYRINLNMIGLDGRPAVKNLLEILSEWLVFRRDTVRRRLNHRLEKVLKRLHILEGLLVAFLNIDEVIEIIRTEDEPKPALMSRFGISETQAEAILELKLRHLAKLEEMKIRGEQSELEKERDQLQAILASERKMNNLLKKELQADADAFGDDRRSPLHEREEAKAMSEHDMLPSEPVTIVLSQMGWVRSAKGHDIDAQGLSYKAGDSWKASAKGKSNQPVVFIDTTGRSYAIDPITLPSARGQGEPLTGKLTLPPGATVEHMLMESDDQKLLMASDAGYGFVCTFNDLVARNRAGKALITLPDNAHVMPPLVIEDESDMLLAITAAGRMLMFPVSDLPQLSKGKGNKIISIPAAEAAAGQDGLAHLFVLPPQSTLTIHVGKRKIKLRPEELQKVTGERGRRGSLMRGLQKIDRVEIDSPRRAAAGDSEE

SEQ ID NO: 9211 - protein, 82 aa, Klebsiella pneumoniae
TRGQSRGRWAQGTPQTSAGRVPRPAVGHSDARVCSLSTPDVALFFCYITDNDITFVSGCRVIFLNGTISETNEWYHRYTSVW

SEQ ID NO: 9212 - protein, 224 aa, Klebsiella pneumoniae
PPPHLHQASPFFFHIRIYAPMNAIIIDDHPLARIAIRNLLDSNGITVAAELDSGAHAVQTAESMQPDLLIVDVDIPELSGIEVLEQLRKRRYQGTIIIISAKNELFYGKRSADCGANGFVSKKEGMNNILAAIDAANNGYSYFPFSLERFCTHGITDQDRLDTLSTQEMKVFRYILSGVDYTTIGSKMNISNKTVSTYKVRLMDKLGCSTLLELYDFAQRNKIG

SEQ ID NO: 9213 - protein, 304 aa, Klebsiella pneumoniae
RALNNGGRVMTRLTAKDFPQQLLEYYDYYAHGKISKREFLQLAGKYTVGGMTALALFNLLKPDYALAEHVPFTDPDIRPEYIHYPSPDGHGEVRAYLVTPTKIADKAPAVVVVHENRGLNPYIEDVARRVAKAGYIALAPDGLSAVGGYPGNDDEGRALQQKVDPVKLMNDFFAAVAFMANYPQATGKVGITGFCYGGGVSNAAAVAIPELACAVPFYGRQPPLKEVDKIKAPLLLHYAGLDSGINEGWPAYEQALKEHHKVYEAYFYQGVNHGFHNDSTPRYDRAAADLAWQRTLAWFEKYLR

SEQ ID NO: 9214 - protein, 388 aa, Klebsiella pneumoniae
AMNNFDLHTPTRILFGKGAIEKLREQIPAEARVLITYGGGSVKKTGVLDQVLTALNGLDVLEFGGIEPNPSYETLMNAVKLAREEKVTFLLAVGGGSVLDGTKFIAAAAHYDADIDPWEILETYGSKIASAIPMGSVLTLPATGSESNKGAVISRKTTGDKRAFMSSHVQPQFAILDPVYTYTLPPRQVANGVVDAFVHTVEQYVTYPVDGKIQDRFAEGILLTLIEDGPKALQEPENYNVRANIMWAATQALNGLIGAGVPQDWATHMLGHELTAMHGLDHAQTLAIVLPALWNEKRDAKREKLLQYAERVWNITEGSDDQRIDAAIAATRQFFEQMGVPTRLSDYGLDGSSIPALLAKLEEHGMTKLGEHQDITLDVSRRIYEAAR

SEQ ID NO: 9215 - protein, 121 aa, Klebsiella pneumoniae
IYRNDICVTRVVYLISTETQEDNTMPAANSMSIKRETLNLRIKPAERDLIDRAAKARGKNRTDFVLEAARAAAEEALIEQRIIMADPQAYQEFLARLDQAPAPNAALRKTMQTPAPWEQEE

SEQ ID NO: 9216 - protein, 625 aa, Klebsiella pneumoniae
TMSNISRQAYADMFGPTVGDKVRLADTELWIEVEDDLTTYGEEVKFGGGKVIRDGMGQGQMLAADCVDLVLTNALIVDHWGIVKADIGVKDGRIFAIGKAGNPDIQPNVTIPIGASTEVIAAEGKIVTAGGIDTHIHWICPQQAEEALVSGVTTMVGGGTGPAAGTHATTCTPGPWYISRMLQAADSLPVNIGLLGKGNVSQPDALREQVAAGVIGLKIHEDWGATPAAIDCALTVADEMDIQVALHSDTLNESGFVEDTLAAIGGRTIHTFHTEGAGGGHAPDIITACAHPNILPSSTNPTLPYTLNTIDEHLDMLMVCHHLDPDIAEDVAFAESRIRRETIAAEDVLHDLGAFSLTSSDSQAMGRVGEVILRTWQVAHRMKVQRGALAEETGDNDNFRVKRYIAKYTINPALTHGIAHEVGSIEVGKLADLVVWSPAFFGVKPATVIKGGMIAIAPMGDINASIPTPQPVHYRPMFGALGSARHHCRLTFLSQAAAANGVAERLNLRSAIAVVKGCRTVQKADMVHNSLQPNITVDAQTYEVRVDGELITSEPADVLPMAQRYLMRWSLPPSRYYAEDRLSFGELSWKTLRSLVSIWVKTLSIFIAKIVAARLFTVKNLHGQS

SEQ ID NO: 9217 - protein, 244 aa, Klebsiella pneumoniae
SVGNNLMQADLSVWGMYHHADIVVKVVMIGLILASVVTWAIFFGKGAEILASKRRLKREQQQLAEARSLDQASDIASAFEAKSLTTQLINEAQNELELSAGAEDNEGIKERTGFRLERRVAAVGRHMGRGNGYLATIGAISPFVGLFGTVWGIMNSFIGIAQTQTTNLAVVAPGIAEALLATAIGLFAAIPAVVIYNIFARMIGSYKASLGDVAAQVLLLQSRDLDLSASGVKPVRSAQKLRVG

SEQ ID NO: 9218 - protein, 238 aa, Klebsiella pneumoniae
HNNKTEKENSMHDRRLAARAGELKPSAVRELLKHSKLPGVISLGGGIPAPELFDTEGLELAVQKVMSERFNDAFQYGLTEGYPPLRQAVSEICHSRGVACSAAQVYITSGSQQSLDIVARTLLDPGDTIVVERPTYLAALQVFQLAQANILSVDTDDDGMLVEQLADLLETTRVKAGYLVPTFGNPGGKTLSEARRRRLVELAKKYDFVILEDDPYGEISFTDAVRRPALSTCCRAGL

SEQ ID NO: 9219 - protein, 194 aa, Klebsiella pneumoniae
KMSNILIINGAKKFAHSNGQLNDTLTEVAESYLRDAGHDVKSVRAESEYDVKEEVQNFLWADVVIWQMPGWWMGAPWTVKKYMDDVFTEGHGSLYASDGRTRSDASKKYGSGGLVQGKKYMLSLTWNAPMEAFTDKDQFFHGVGVDGVYLPFHKANQFLGMEALPTFIANDVIKMPDVPRYIAEYRKHLAEIFG

SEQ ID NO: 9220 - protein, 283 aa, Klebsiella pneumoniae
FAVKGRVPYAHPQAIYSYVIIFTGREAMSSPLILTLFAGSATFIGAIFGVIGQKPSNRLLGFSLGFAAGIMLLISLMEMLPAALAAEGMSPLLGYGMFVVGLLGYFGLDRLLPHAHPQDLMTPAMPRPRNLRRTAILLTLGISLHNFPEGIATYVTASNNLELGMGVALAVALHNIPEGLAVAGPVYAATGSRSKAVLWAGLSGMAEILGGVLAWLILGSLVSPLVMGAIMAAVAGIMVALSVDELMPLAKEIDPQSNPSYGVLCGMSVMGLSLVVLQTMGIG

SEQ ID NO: 9221 - protein, 343 aa, Klebsiella pneumoniae
SEVKQLMRVLGIETSCDETGIAIYDDQQGLLANQLYSQVKLHADYGGVVPELASRDHVRKTVPLIQAALKEAGLTAKDIDAVAYTAGPGLVGALLVGATVGRALAFAWNVPAIPVHHMEGHLLAPMLEDNPPAFPFVALLVSGGHTQLISVTGIGQYELLGESIDDAAGEAFDKTAKLLGLDYPGGPMLSKMASQGTEGRFVFPRPMTDRPGLDFSFSGLKTFAANTIRSNGDDEQTRADIARAFEDAVVDTLMIKCRRALEQTGFKRLVMAGGVSANRTLRAKLAEMMQKRGGEVFYARPEFCTDNGAMIAYAGMVRLQTGAKAELGVTVRPRWPLAELPAA

SEQ ID NO: 9222 - protein, 198 aa, Klebsiella pneumoniae
YNKKTTQHQESTMSTPSHLNAQPLVWGHGPRTFEVFLEPTCPYSVRAFNKLDDLLDEVGADNVTIKIRLQSQPWHLFSGVIVRCILAASTLPHGREQAHKVMQAVADHREEFEFTDHCSGPNMNATPQQIIERIERYSHVLLGAAFARPELQDVIKWHSKYARQNGIHVSPTFMVNGLVQPDLGSGDDVSVWAARIMA

SEQ ID NO: 9223 - protein, 641 aa, Klebsiella pneumoniae
TALNDLRIHTMTQSSYNADAIEVLTGLEPVRRRPGMYTDTTRPNHLGQEVIDNSVDEALAGHAKRVEVILHADQSLEVIDDGRGMPVDIHPEEGVPAVELILCRLHAGGKFSNKNYQFSGGLHGVGISVVNALSKRVEVNVRRDGQVYSIAFENGEKVEDLHVTGTCGKRNTGTSVHFWPDESFFDSPRFSVSRLTHLLKAKAVLCPGVEIVFRDQVNNSEQSWCYADGLNDYLSEAVNGLPLLPEKPFVGAFSGETEAVDWALLWLPEGGELLTESYVNLIPTMQGGTHVNGLRQGLLDAMREFCEYRNILPRGVKLSAEDIWDRCAYVLSVKMQDPQFAGQTKERLSSRQCAAFVSGVVKDAFSLWLNQNVQAAELLAEMAISSAQRRLRAAKKVVRKKLTSGPALPGKLADCTAQDLNRTELFLVEGDSAGGSAKQARDREYQAIMPLKGKILNTWEVSSDEVLASQEVHDISVAIGIDPDSDDLSQLRYGKICILADADSDGLHIATLLCALFVRHFRTLVKEGHVYVALPPLYRIDLGKEVYYALTEEEKTGVLEQLKRKKGKPNVQRFKGLGEMNPMQLRETTLDPNTRRLVQLVISDEDEQQTTAIMDMLLAKKRSEDRRNWLQEKGDMADLEV

SEQ ID NO: 9224 - protein, 73 aa, Klebsiella pneumoniae
TNMNLLFCTSAPPIQAKILPGPRLAAFLLRKRKENKRDLLHSVNTNENHYQFDVVLILLWADFVIIVVEIERG

SEQ ID NO: 9225 - protein, 137 aa, Klebsiella pneumoniae
VLGNIVRRQLAGKIITMAKEKRAFWRKWVWKHLMAGITVLAMSSAAVGKDVVPDEARTRDMMRCQDYLQLDPRTWTPMVIWLMNDPFSLEPPEWTDFHEAELVLTPILTEICRQEPDVWLTSLRERLNSYQQVRSLN

SEQ ID NO: 9226 - protein, 106 aa, Klebsiella pneumoniae
QGVDHRDPHPVQAAGKLIVFIGKLTARMQPAEDQLNRWHALFRVDVDRHPTTIVNDLQGLVGMKDNFHAFGVACQRFIHTVINNFLTKMVRTSGVGIHARTAAHRL

SEQ ID NO: 9227 - protein, 216 aa, Klebsiella pneumoniae
RDADHRSVPPGRRRVSSGYCFRRLLMATLLYLHGFNSSPRSAKATALKTWLAQHYPEITMVVPELPPYPAETAELLESIVLEHGGEPLGVVGSSLGGYYATWLSQCFMLPAVVVNPAVRPFELLNNFLGHNENPYTGQQYVLESRHIYDLKVMQIDPLEAPDLLWLLQQTGDEVLDYRQAVHYYASCRQTVEEGGNHAFVGFDDHFTQIIEFLGLR

SEQ ID NO: 9228 - protein, 174 aa, Klebsiella pneumoniae
YGHEWRWMPGNRPHYGRWPQHDFPPFKKLRPQSVTSRIQPGSDVIVCAEMDEQWGYVGAKSRQRWLFYAYDRLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 9229 - protein, 211 aa, Klebsiella pneumoniae
PNDDLMPKLRLITFTLLALSAATAVHAEEKRYVSDELNTWVRSGPGDNYRLVGTINAGEEVSVLQTNDSTSYAQIRDSNGRTAWIPLKELSNEPSLRTRVPDLENQVKTLTDKLNNIDATWNQRTADMQKKVAGSDSVINALKDENQKLKNELVVAQKKVNAANLQLDDKQRTIIMQWFMYGGGVLGVGLLLGLVLPHLVPSRKRKDRWMN

SEQ ID NO: 9230 - protein, 425 aa, Klebsiella pneumoniae
NFRLYRRCAGTEKQIHVSLDVQTYKNRFVNMADKHLDTALVNAGRSKKYTQGSVNSVIQRASSLVFDTVEAKKHATRNRANGELFYGRRGTLTHFSLQEAMCELEGGAGCALFPCGAAAVANTILAFVEQGDHVLMTNTAYEPSQDFCTKILAKLGVTTSWFDPLIGADIARLVRPETRVVFLESPGSITMEVHDVPAIVAAVRQVAPEAIIMIDNTWAAGILFKALDFGIDISIQAGTKYLIGHSDAMVGTAVANARCWPQLRENAYLMGQMLDADTAYMTSRGLRTLGVRLRQHHESSLRIAEWLAQHPQVARVNHPALPGSKGHEFWKRDFTGSSGLFSFVLSKRLNDAELAEYLDNFSLFSMAYSWGGFESLILANQPEQIAHIRPDAEVDFSGTLIRLHIGLENVDDLQADLAAGFARIV

SEQ ID NO: 9231 - protein, 616 aa, Klebsiella pneumoniae
QAVDDAPRRLIVEEATQHFRTARVAQFTQRLRFDLTDTFAGNVELFTHFFQRVVGVHVDTETHTQHFRFTSGEAGQHVMRCRAQALGGRRIQRQLEGGILDEIPQMRIFIVADRRFHGDRLFGDLQHFTDFVFRHQHTLSQLFRGRFTAHLLQHLTGDTVELVDSLNHMHRNTDGARLIRDRAGDGLTDPPGGVGRELVATTVFELIDRFHQTDVAFLNQVEELQTAVGVFLGDRDNQTQVRFNHLFLRTTGFRFADGHATVDIFNLLDGQAGLFFNLLQLLQAALHIFFHFQQLLRPRLVHCHRGVEPGLAGFVAGEQGDEVFLRHFALLNAQLHDDTFLSTNAIHHAAHAVDQVIELLRHQAELLEDFRQLQDLFLGGGMATTFGFDGVARQLVLGTQLGEFLTGQLWVDAVVVIAVVVGVFIFVFVFVVIHLFLRQLGANVGGGWRHIFFGVRIDETGDQIGQTGFFRFNAVVLLKQVGDRFRIFGNGALHLIDAVFDAFGDVNFAFTGQQLYGTHFTHVHTHRVGRAPDFGFHAGEHLRGGFGSIFIRGVFGKHQIIGIRCFFHHLNTHVVDHLDDVFDLIGIDDIFRQMVIDLGIGQIALLLTTLDKKLQL

SEQ ID NO: 9232 - protein, 173 aa, Klebsiella pneumoniae
NYADPCAVGTGRMISAPEPLHAGHILTPFCCGIDSMDHWLKQRAMKNQVTGASRTFVCCDDAKVMAYYSLASSAVTTNTAPGRFRRNMPDPIPVVVLGRLAVDKSLHGKGVGRALVRDAGLRVIQVAETIGIRGMLVHALSDEARDFYLRVGFEPSPMDPMMLMVTLRDLVNA

SEQ ID NO: 9233 - protein, 269 aa, Klebsiella pneumoniae
HPKDIIMSRTRMPALFLGHGSPMNVLEDNRYTRAWAQLGETLPRPKAIVVVSAHWFTRGTGVTAMEAPKTIHDFGGFPQALYDTHYPAPGSPALAQRLVELLSPVPVTLDTEAWGFDHGSWGVLIKMYPQADIPMVQLSIDSTKPPAWHLEMGRKLASLRDEGVMLVASGNVVHNLRTARWHGENTPYPWAESFNNYVKANLQWQGLDEQHPMVNYLAHEGGSLSNPTAEHFLPLLYVLGTWDGVEAMAIPVDGIEMGSLSMLSVLVGA

SEQ ID NO: 9234 - protein, 218 aa, Klebsiella pneumoniae
NPILSIIPFLGEAMNSYKHPLRVGVGGPVGSGKTALLEALCKAMRDTWQLAVVTNDIYTKEDQRILTEAGALAPERIVGVETGGCPHTAIREDASMNLAAVEALSEKFGNLDLIFVESGGDNLSATFSPELADLTIYVIDVAEGEKIPRKGGPGITKSDFLVINKTDLAPYVGASLEVMASDTQRMRGDRPWTFTNLKQGDGLSTIIAFLEDKGMLGK

SEQ ID NO: 9235 - protein, 77 aa, Klebsiella pneumoniae
CCQLTDLVYDGVFEVLQWLLFLSAVPPVQLLTGWCVTAKAPPDISAISALTAVKHGNCSSLTPLLNPVRTRKSLIWP

SEQ ID NO: 9236 - protein, 291 aa, Klebsiella pneumoniae
TIPCSWFFSFYFFKGFNWMSDIHSLLVAAILGVVEGLTEFLPVSSTGHMIIVGHLLGFEGDTANTFEVVIQLGSILAVVVMFWRRLFGLIGIHFGKPPAHEGQGSGRLSLIHILLGMIPAVVMGLIFHDTIKSLFNPVNVMYALIVGGVLLIAAEVLKPKQPRAVGIDDMTYRQAFVIGCFQCLALWPGFSRSGATISGGMLMGVSRYAASEFSFLLAVPMMMGATVLDVYKSIGFLNMGDVPMFAVGFVMAFIVALIAIKTFLQLIKRISFIPFAIYRFIVAAAVYVVFF

SEQ ID NO: 9237 - protein, 142 aa, Klebsiella pneumoniae
STGCGRRKPAARRTGTPADYLPASAPADALPYGVPGSPARSRRRPAPGQRSPRPAARRPGLDPPYRRRRRYLSPSDRLLSAPPGSAAPFCARGRAMPAPAPRRRNPHAVSPDYTIGWLTDLAGRHKSRCRFHRRMFQCPVHA

SEQ ID NO: 9238 - protein, 341 aa, Klebsiella pneumoniae
AFIRRTIMENIALIGIDLGKNSFHIHCQDRRGKAVYRKKFTRPKLIEFLATCPATTIAMEACGGSHFMARKLEELGHFPKLISPQFVRPFVKSNKNDFVDAEAICEAASRPSMRFVQPRTESQQAMRALHRVRESLVQDKVKTTNQMHAFLLEFGISVPRGAAVISRLSTLLEDNSLPLYLSQLLLKLQQHYHYLVEQIKDLESQLKRKLDEDEIGQRLLSIPCVGTLTASTISTEIGDGKQYASSRDFAAATGLVPRQYSTGGRTTLLGISKRGNKKIRTLLVQCARVFIQKLEHQSGKLADWVRDLLCRKSNFVVTCALANKLARIAWALTARQQTYVA

SEQ ID NO: 9239 - protein, 174 aa, Klebsiella pneumoniae
QTLLVVINRDAGFIAGCFNAQYTHELFYLASIPRSVGPMTGDVKLCSPLVLSSCILLTLIKVPFKKGAGALQSSSSCSKIPHHFEISWHCGQRQTELIKGERHMPVIKVRENEPFDVALRRFKRSCEKAGVLAEVRRREFYEKPTTERKRAKASAVKRHAKKLARENARRTRLY

SEQ ID NO: 9240 - protein, 519 aa, Klebsiella pneumoniae
TPFRKRPEEMRNMTPSEYQNPILCADYSDPDIVRVGDDFFMVSSSFNHVPALPILHSTDLVNWTIINHVMDELPLPGYDRYQPGKGVWAPSIRWHDGKLWVCFSTPDEGIFICHTEDPWGEWSAPHCLREARGWIDPCPFWDDDGQAWLVHAFAHSRSGIKHKLQLFAMAPDASELLGEGQIIYDGCCDLPTLEGPKVYQRAGWYYIFAPAGGVENGWQTVLRARQMTGPWEAKNVLFQGNTSINGPHQGGWVEGEEGECWFVHFQDLHLYGRVVHLQPMSWGNDGWPRIGEQIGNCGVGQPVLRWPRPKGLTPSPAMAPQTSDYFAQGQPGIQWQWQANPSPEWLLPAEGELRLRCVPLSEVDGQRALYWAPQLLLQKFPALTFSAKTSVTLYAAQDGDAGGLIVYGERYAALLVEFGQGGYRLVWRHGWMSDAGVVRETRQVLAELKCGKCQLQVAVGEGGLCQFSWRAEEEWRKVPLCFAAGKGKWVGAKFGLLAASMVGLQSEGYSALQDFEVIL

SEQ ID NO: 9241 - protein, 100 aa, Klebsiella pneumoniae
SIIRPEQETTMIDPKKIEQIARQVHESMPKGLRDLGEDVEKKIRQALQSQLTRLDLVSREEFDVQTQVLLRTREKLALLEQRLNDLENRPAATPGSEEQQ

SEQ ID NO: 9242 - protein, 229 aa, Klebsiella pneumoniae
STIRYHLGKSMVVIQEIVAALWQHDFAALANPHVVGVVYLVMFATLFLENGLLPASFLPGDSLLLLAGALIAKGVMDFVPTIAILTAAASLGCWLSYVQGRWLGNTQTVKGWLAHLPHKYHQRATCMFDRHGLLALLAGRFLAFVRTLLPTMAGISGLPNRRFQFFNWLSALLWVCVVTGLGYALSMIPFVKRHEDQVMTCLMILPIALLLAGLLGTLFVVIKKKYCSA

SEQ ID NO: 9243 - protein, 637 aa, Klebsiella pneumoniae
AAIRICSTSTTSSRTGSKGSKTAACPRSKISRVISPLMPPLNRRWRKRYKSSEKKPRYSVSRAIIYTSFLEKVIPCCVGLLIVMSCESEIRDFQTVWLPFYGPYVRLVQITAGWHVTPTFYGGRIDTISGIFLRIRPALNASQQGMQMKKLLPILIGLSLTGFSAMSQAENLLQVYQQARISNPDLRKSAADRDAAFEKINEARSPLLPQLGLGADYTYNNGYRDSNGINSNVTSGSLQLTQVLFDMSKWRALTLQEKTAGIQDVTYQTDQQTLILNTATAYFKVLAAIDTLSYTEAQKQAIYRQLDQTTQRFNVGLVAITDVQNARSQYDAVLANEVTARNDLDNAVEELRQVTGNYYPELASLNVNGFKTNKPQAVNALLKEAENRNLSLLQARLNQDLAREQIRQAQDGHLPTLSLSASSGISNTSYSGSKTHNNPQQIQDNDAGQNQICLKFSLPLYQGGAVTSQVKQAQYNFVGASEQLESAHRSVVQTVRSSFNNVNASISSINAYKQAVVSAQSSLDAMEAGYSVGTRTIVDVLDATTTLYNAKQQLSNARYNYLINELNIKSALGTLNEQDLVALNNTLGKPISTSADSVAPENPQQDATADGYGNTTAAVKPASARTTQSSGSNPFRQ

SEQ ID NO: 9244 - protein, 193 aa, Klebsiella pneumoniae
IIARETLYRGFFSLDLYRFRHRLFNGGMSGEITREIFERGHAAVLLPFDPVRDEVVLVEQIRIAAYDTSESPWLLEMVAGMIEAGETVEDVARREALEEAGLEVGRTKPILSYLASPGGTSERLSILVGEVDASTAKGIHGLAEENEDIRVHVVSREQAYQWVEEGKIDNAASVIALQWLQLHYHNLRNEWTK

SEQ ID NO: 9245 - protein, 513 aa, Klebsiella pneumoniae
SGQRSGRARSGWKAIRQETPPTRAYCWRETNSLFHLSVCHGVNMSLSRRQFIKASGVALCAGAAPLKAHAAGQQPALPVPPLLESRRGQPLFLTLQRSHWSFTPGTRAPVWGINGRYMGPTIRVWNGDDVKLIYSNRLTENVAMTIRGLQVPGPLIGGAARMMSPNADWAPVLPIRQSAATLWYQANTPNRMAKQVYNGLAGMWLVEDEVSKNLPIPNHYGVDDFPVIIQDKRLDNFGTPEYSEPGSGGFVGDTLLVNGVQSPYVEVSRGWVRLRLLNASNSRRYQLQMSDGRLLHVISGDQGFLPAPVSLKQLSLAPGERREILVDMTNGDEVSITCGEAASIVDRIRGFFEPSSILVSTLVLTLRPTGLLPLVTDSLPVRLLPTELLSGTPIRSRDITLGDDPGINGQLWDPQRIDITAQQGTWERWTVRADRPQSFHIEGVMFQIRNVNGSSPFPEDRGWKDTVWVDGQVELLVYYAQPSWPHFPFQYLSQTLELADRGSIGQMLVNPAP

SEQ ID NO: 9246 - protein, 450 aa, Klebsiella pneumoniae
RMKRLARLSLRLRLTLLFAVLTTAAWGMASVIAWQQTSKKLDKLFDTQQLLFARRLSVMHFDELRAPPALLGEKKKVRHGHIDDDALAFAIFTRDGKMVLNDGENGEDIQWNSQREGFSDGYLRDDDDEWRFLWLTTADGRYRIAVGQEWDYRREMAMDIVTSQLTPWMVALPLMFVLLIVLLSRELAPLKNLARTLRLRAPDSADSLSVEKIPAEVRPLVEALNQLFRRTHDAMLRERRFTSDAAHELRSPLAALKVQTEVAQLSLDDPEGREKALDQLHQGIDRATRLVDQLLTLSRLDSLAQLDDVQQVAIADLLQSAVMEMYHPAQQSGIELRLHLNASHIVRTGQPLLLSLLVRNLLDNAVRYSPRGSQVDITLNAREFRVRDNGPGISPQALSRIGERFYRPPGQEAPGSGLGLSIVRRIASLHGMQVDFANARDGGFEARVYW

SEQ ID NO: 9247 - protein, 69 aa, Klebsiella pneumoniae
RSMRMNHNDMYSMKNFDFLARSFARMHAQGQPVDLQAIVGNMDEEHREWFCQRYELYCRQVSSQAEAAH

SEQ ID NO: 9248 - protein, 178 aa, Klebsiella pneumoniae
SCFSHTAGENMISDILAPGLRVVFCGINPGKSSAHTGFHFAHPGNRFWKVIHQAGFTDRQLRPEEELQLLDTRCGITMLVERPTVQASEVALQELRSGGRELVRKIEEYQPQALAVLGKQAFELAFNQRGAKWGKQAMTIGTTQVWVLPNPSGLNRATLDKLVAAYRELDDALATRGQ

SEQ ID NO: 9249 - protein, 308 aa, Klebsiella pneumoniae
PEVSNMDKLRGMETFIAVVECGSFTGAASRLGLSAVMVGKYIAQLESQLATRLLERNTRRQSLTDAGRVYFDEAKRVMEQVSIAESAVERLRLAPAGTLRVSAPTSFGASVIAPLTANFLQAWPAVRVELDLTNRMVDLVDEGFDLAIRIGEIHQEDLVARYLAPYRMVICAAPAYLARYGTPGTPEDLADHLCLSHTVWTARNEWRLPGVEGEVRWKRDAVLRCNDGYALRQAAIAGAGLLMQPEVLLADALASGSLVRVLEAWTPQPRPVHLLWRQDRRPLPKLTQFIAHLQQGMADALTTTRASE

SEQ ID NO: 9250 - protein, 258 aa, Klebsiella pneumoniae
PLASCRSSRKPALTPARATVIIMLIMTTTLTATSMSTAEQRLRLMQLASSNLPVGGYSWSQGLEWAVEAGWVPDVAAFERWQRRQMTEGFFTVDLPLFARLYRACEQGDIAAAQRWTAYLLACRETRELREEERNRGAAFARLLSDWQPDCPPPWRSLCQQSQLAGMAWLGVRWRIALPEMALSLGYSWIESAVMAGVKLVPFGQQAAQQLILRLCDHYAAEMPRALAAPDGDIGSATPLAAIASARHETQYSRLFRS

SEQ ID NO: 9251 - protein, 134 aa, Klebsiella pneumoniae
LKSRQGVMDIVFIEQLSVITTIGVYDWEQTIEQKLVFDIEIAWDNRKAAASDDVSDCLSYADISERVIAHVEGGKFALVERVAEEVADLLLETFQSPWVRIKVSKPGAVARAANVGVIIERGLNLKQNFSGHTC

SEQ ID NO: 9252 - protein, 402 aa, Klebsiella pneumoniae
RRRLNVLFSLNGRLSNMERVSITERPDWREKATEYGFNFHTMYGEPYWSEEAYYKLTLAQVEKLEAVTAELHQMCLQVVEKVIASDELMTKFRIPKHTWGFVRQSWKTNQPSLYSRLDLAWDGVGEPKLLENNADTPTSLYEAAFFQWIWLEDQLNAGKLPAGSDQFNSLQEKLIDRFGELREQFGFQLLHMACCRDTVEDRGTVQYLQDCAAEAGLATEFLYVEDIGLGEKGQFTDLQDQVIGNLFKLYPWEFMLREMFSTKLEDAGVRWLEPAWKSIISNKALLPMLWEMFPNHPNLLAAYFSEDTHPEMEKYVIKPIFSREGANVSIVENGKVVEAVEGPYGEEGTIVQAFYPLPKFGDSYTLIGSWLINDQPAGIGIREDRALITQDLSRFYPHIFVE

SEQ ID NO: 9253 - protein, 362 aa, Klebsiella pneumoniae
VLQRVKPSTGTIPLPDEGYCGPGAVDPQCTFLPMSCLFLHMAGEFVAACAQCTGEETSGETVAMQHAEICRTLTEKINLLKDKHEMLSSLLPDVRLLYGTQPGPRTPVMYQPGIVFLFSGHKIGYINERTFRYDTNEYLLLTVPLPFECETFATPEVPLAGMRLNVDILQLQELLMDIGEDPLFQPAVASSGINSAVLSEDILCAAERLLDVMERPLDARILGKQIVREILYYVLTGPCGGALLALVSRQTHFSLISRVLKHIESQYTENLSVDRLAAEANMSVSAFHHNFKAVTSTSPLQYLKNYRLHKARMLMIHDGMKASAAAMRVGYESPSQFSREFKRYFGLTPGEDAARIRTMQGM

SEQ ID NO: 9254 - protein, 247 aa, Klebsiella pneumoniae
AEKRNFNAVHHPLQRGLLRKETGSSEGNMRILLVEDDKLIGDGIKAGLSKMGFSIDWFTAGLEGKNALYSAPYDAAILDLTLPGIDGLDILREWRDKGRHEPVLILTARDALNQRVEGLRLGADDYLCKPFALIEVAARLEALIRRAHGQSSSELRHGKVILDPNRLTASLDGESLALKPKEFALLELLMRNAGRVLPRKLIEEKLYTWDDEVSSNAVEVHVHHLRRKLGSDFIRTVHGIGYTLGDA

SEQ ID NO: 9255 - protein, 448 aa, Klebsiella pneumoniae
TRRSRIRRGVALSLDEIAKNGSKNTSPRRLFNVRRGESGGERLACSLVNTAADVQGDILMFAKFSHAVLFQFRQQRRDGATVETVIGKAGRHAHLLEELTRCGDGGIDTLVVRAFGNIPHALGILQQLLALGIAFLIPQRRQHDSQRLGVIQAVHRRQLVAEHMRRPVLWHACADQAVQRLRRRPHNIGAHVIVLRFLQGFRAILDQGQENAFGETVLDFAVYRVGHVLLDGMDEGVNHAVRDLARRQGIGINRIEDRELRLDVRRHKRAFVAGGFPRYDRAFVGFRTGRRQSQYRAHWNGAGNFAAIGFQNFPRIDIRVVVGCCSDKLGAIQHRTAADRQQEGHFLFPGEFHRIHQGFVRRVRLDAAKFKDIQSIQSGEDLIQDACFFDAAAAVGDQYAGFRRDLFTQLFNRAFAKQNAGWGMQVEIIHCLSPPKSKTVDRDDTAAR

SEQ ID NO: 9256 - protein, 621 aa, Klebsiella pneumoniae
MSKGSTSSDAPFGTLLGYAPGGVAIYSSNYSSLNPQDYPDDATFRSYIGNEYMGHKWQCVEFARRFLFLTYGFVFTDVGMAYEIFSLRFLREVVNDNILPLQAFANGSRRPPIAGSLLIWQKGGEFKHTGHVAVITQLVGNKVRIAEQNVIHSPLPQGQQWTRELTLEVNDGRYTIKDTFADTEILGWMIQTADTEHSLPQPVLPGEAMAIKGARLPNNGQFRGKWLNEKDPLQKAYVAANGHFINQDPYQYFTISESAEQELIKATNELHLMYLHATDKVMKDDNLLALFDIPKILWPRLRLSWQRRRHHMITGRMDFCMDERGLKVYEYNADSASCHTEGGLILEQWLKQGYYGTGHNPAEGLLDELAGAWKHSRARPFVHIMQDKDLEENYHAQFIQRSLTQAGFESKILFGLDELRWDAAGQLIDADGRLVNCVWKTWAWETAIEQVREVSAEEYAAVPIRTGHPQNEVRLIDVLLRPEVLVFEPLWTVIPGNKAILPVLWSLFPHHRYLLDTDFEVNDELAKTGYAVKPISGRCGNNIDLIGPQDELLDKTSGQFVDRKNIYQQLWCLPKVDGKYIQVCTFTVGGNYGGTCLRGDSSLVVKKESDIEPLIVLKDKA

SEQ ID NO: 9257 - protein, 279 aa, Klebsiella pneumoniae
QEEGMTHPTVIKLHDGNLMPQLGLGVWKAGNEEVVSAIHKALEVGYRSFDTAAAYQNETGVGNALHSAGVNRDELFITTKLWNDDQKRPHEALKESLSKLKLDYVDLYLIHWPVPAIGHYVEAWQALIELQQQGLTKSIGVCNFQVPHLQKLIDETGVAPVINQIELHPLMQQRQLHAWNATHKIQTESWSPLAQGGEGVFDQKVIHQLADKYGKTPAQIVIRWHLDSGLVVIPKSVTPSRIAENFDVWDFRLDKDELGAIAKLDQGKRLGPDPDQFGG

SEQ ID NO: 9258 - protein, 148 aa, Klebsiella pneumoniae
VLSGVIGAIPTQKGEYKMKKIAAMTAIIALVSMPVLAAGQGGFTGPSTTTTTQAGGFTGPSGAVTTVANAKSLRDDTWVTLRGKIVERISDDLYKFQDASGVINVDIDHKRWNGVTVGPQDTVEIQGEVDKDWNSVEIDVKQIRKIAP

SEQ ID NO: 9259 - protein, 280 aa, Klebsiella pneumoniae
FCRGATLHGTVLPPLKKGWQATLNLRFQQAGGKTVLASAQHVGPLTVQRPFYPEEETCHLYLLHPPGGIVGGDELTISAHLAPGCHTLITMPGASKFYRSSGAQALVRQQLTLAPQATLEWLPQDAIFFPGANARLFTTFHLCASSRLLAWDLLCLGRPVIGETFSHGTLSNRLEVWVDDEPLLVERLQLQEGELSSVAERPWVGTLLCYPATDALLDGVRDALAPLGLYAGASLTDRLLTVRFLSDDNLICQRVMRDVWQFLRPHLTGKSPVLPRIWLT

SEQ ID NO: 9260 - protein, 167 aa, Klebsiella pneumoniae
QDLMERFLENAMYASRWLLAPVYFGLSLGLIALTIKFFQEIFHILPHIFSVSESDMILTLLSLVDMTLVGGLLVMVMFSGYENFVSQLDINEGKEKLSWLGKMDATSLKNKVAASIVAISSIHLLRVFMDAKNVPDNKLMWYVIIHLTFVLSAFVMGYLDRLTKVKH

SEQ ID NO: 9261 - protein, 103 aa, Klebsiella pneumoniae
ENVMELTPREKDKLLLFTAALVAERRLARGLKLNYPESVALISAFIMEGARDGKSVASLMEEGRHVLTREQVMEGVPEMIPDIQVEATFPDGSKLVTVHNPII

SEQ ID NO: 9262 - protein, 538 aa, Klebsiella pneumoniae
GMTMSSLDLNPELPATTRTSGSRETLEDYTLRYAPLSFRRWGPGVVAVTALGGIAYLADFSIGASIGMAWGTSNAIYSILVAALVIFLTGIPLAITAARYNIDLDLITRSAGFGYFGSVITSIIFAGFTFIFFALEGSIMAQGLLVGLGNPLWMGYLIATLMVLPLVVYGMKALTRLQVWTTPLWLVLMVVPVVWLIVKDPQLVDGFLHFAGKNSASTVDITAIMLGAGVCLSLIMQIGEQIDYLRFMPPKTAENRKSWWLAVFSAGPGWVVLGAIKQIIGAFLGFYLLTRFPAVHNTEPVQQFVSVFDNLVPGWLALTLAVVLVVISQIKINVTNAYSGSLAWTSAWTRTTKRYPGRIIFVVVNLAIALALMEGDMFSALSWILGFYSNFAIAWVVVVATDITFNKGLLKLAPAQPEYRRGMIYNVNPVGVVSFGLAAGLSICAFFGLLGATLAPFSPLIALVVAFVMTPLMGLLTRGRYYIKQVDDGIAEPRYDAAGNASTTVYQCVSCEEEYERPDVMHSHKHQGAICSLCKSME

SEQ ID NO: 9263 - protein, 427 aa, Klebsiella pneumoniae
RLDIALFFHHQRRIAAQAGTAVVTADGKCAHLNVLTVHFRQAPQLLVDILAIDKLAAGLIQKFILRADQVDIVPAAPGNRLHRIAGFRQLVVNLKIGIQQIAMMREQRPQHRQNGFVAGDHRPQRFEYQYFRTQQDVNQPHLILRMSGTNRYRRVLLGADFAHLLNGGFPCPGFPDAVDQPSVGVDQLAGSVPAQLIKAKENFALKTGLGQRTLNKLRVVVLFQILVLHDVDEGPRPAVFPRPRQLIEQTFRRIVAGAVVALLQPLFEDQPAFGMAGSGIGIVLVHLQPALVHAKIHAPGDHMMTAALPREAQTRPENFRNIEQRQQVVILHHLIGGVQIHQVQLVGGFDQLLFGTFADGEILIGILVDEMTVGCHIGFLQRVFLVQPFTAKLAVVWQPRAFDGHRLARQHRLRQAVFGISGLDHPA

SEQ ID NO: 9264 - protein, 69 aa, Klebsiella pneumoniae
VGVITRMFYMDSQDVLYIVRCYGVVKRSFTAPGHQLAYGSLKVADGELDKVACKIHRTGENSPVSHDKP

SEQ ID NO: 9265 - protein, 319 aa, Klebsiella pneumoniae
NRAISLRRISARSVRNRDPRSVRVCREEETMNDIKASPAYVGRFQRVCRYIARHLDEPLSLETLSAIAHSSPYHFHRQFSAYTGIPLYRYIQWLRLRRACWRLAFNPRDKVIDIALDAGFQNAESFSRAFRTAFDQSPTQFRQQPDWAEWHRRVPKHTLQEQTSMDVNIISCPSTRIAVLQHRGSPDLVNATAARFIAWRKTSGLSPVATSDTWGIAWDDPQTTPQEAFRFDICGTVDRPVGENAFGVINGEIPGGRCAVVRHHGSLDTLANSVWFLYRDWLPASGETLRDFPVYFRYLNFVHEVAEHELQTDIYLPLA

SEQ ID NO: 9266 - protein, 109 aa, Klebsiella pneumoniae
GSAMIPGEYHVKPGQIALNTGRATCRVVVENHGDRPIQVGSHYHFAEVNPALKFDRQQAAGYRLNIPAGTAVRFEPGQKREVELVAFAGHRAIFGFRGEVMGPLEVNDE

SEQ ID NO: 9267 - protein, 1095 aa, Klebsiella pneumoniae
GDGMAVRLILSVVVGLALSLSPAAYAMKQLELKSHSHIAAIDIPLSGKEKAWLAAQPTLTVGTWLPERTPIVYDGDEKSYQGINADYLALMAHSLGLKVIIRQYDTEQQALTALADRQVDTLLTQVAHRDALAPGLDQSAPLLKTWPTLVTSLKSPLPPLTTDRRVTLACTRDCAFFDIIQQAFPNAKITLYDSDYQALASVVSGENQYFIGNNITTGHCISKYFSQSLVIAHYFRQQEQHNRFVTRDDRPELHQLFDRFIHAVDSDTAMRIMQNWLNRGDLSFLNTPLTFSPEEQRWLQKHRRVRLLVNPYFPPFTLVDNEDELRGIMADMLNIVSLQTGLQFDTILVRNRQALAKRMEKEDWAIMPAATLTPQPQAYVTLSDPLINVAFVLVARGSAPDQHLLTRSARIALPVGPIAAHDLKARFPLINWVETDNVGVAMKMVEEGEVDAAVASELSARYMIDHYYPQGLHYTRIDGLPVAAIRLAIPRDEPVLAAILNKALQVIPPRDILQMTEKWSKISSQQIENWSQYSRQFYQLIAFALVLIAISLGWGLSLCREVCKRKDSQQRLEEELAQKEALSCALEREKDKAIQATKAKSRFLASMSHELRTPVSAIVGFLELLAKPELNVGQRKEAIELAGSTAQTLLGLIGNILDIDKIESGKYQVTPQWSDVAQLVSQQCHTFDALAQQKGIDLHYHNALQEGTMLWVDPQALRQILNNLIGNALKFTVEGAIQVSCRLTPANETQGELALMVSDSGCGISEAEQATLFHRYAQARQGRQQTGSGLGLVICKELVALMQGRLEMVSRPGVGTTFTITLPVKASRCAIHAPQASPARPQALPGLAILIADDHPTNRLLLKRQLSTIGYSVDEACDGEEAENKLASKHYDLLITDLNMPKKDGLELAASLRRRYPGLVIWGVTASALPQSREACLASGMNMCLFKPVSVQTLSHELSRLAVGRASPHATRHLKLSVLSENTGGDQALMNEMLETFRDASAADLQAAGQAIARHEPQIFLRALHRLHGSAQILGITALQQLCAPFEAKRPDSLTPASCLEVVQRITGVMREMDGESCDLLCSIFGPRTVCRKRY

SEQ ID NO: 9268 - protein, 197 aa, Klebsiella pneumoniae
MPSILARLSVCIILSLFMVSCSGSFDKTIDYQDAKQMPGYGYIVMDFRLANEMAYGNGYIPGKTNYTISYKNKGDIFFVDIQHADFRNRILKAYIPYMKGYTLIGIGRSYWYPFFRCDKCDNEPQLKFLYINIVKSVDEAWCSETTYKNLRSFNAMDGCSQMVGVEESRKVTGDVLITPELKSDFQGMFTPYLKPGR

SEQ ID NO: 9269 - protein, 143 aa, Klebsiella pneumoniae
VDKMKRYTPDFPEMMRLCETNFAQLRRLLPRTDAAGEKVSYQVGSAQYRLTIVESTRYTTLVAIEQTLPAVSYWSLPSMTVRLYHDAMVAEVCSSQQIFRFKARYDYPNKKLHQRDEKHQINQFLADWLRYCLAHGAMAIPVC

SEQ ID NO: 9270 - protein, 424 aa, Klebsiella pneumoniae
SSEITGLMAGRIPRVFISDLLARTDIVDLIDARVKLKKQGKNFHACCPFHNEKTPSFTVNGEKQFYHCFGCGAHGNAIDFLMNYDKLEFVETVEELAAMHNLEVPYEAGNGPSQIERHQRQNLYQLLDGLNAFYQQSLMQPAADPARQYLAKRGLSSEVITRFAIGYAPPGWDNVLKRFGGNQENRQSLIDAGMLVTNDQGRSYDRFRERVMFPIRDKRGRVIGFGGRVLGDALPKYLNSPETDIFHKGRQLYGLYEAQQDNPEPPRLLVVEGYMDVVALAQYDINYAVASLGTSTTADHIQLLFRVTNNVICCYDGDRAARDAAWRALETALAYMTDGRQLRFMFLADGEDPDTLVRKEGKAAFEARMEQAQPLSTFLFNSLLPAGRSEYSGRARAAEHAGAAADNPGPGRNAAHLFASGVGQ

SEQ ID NO: 9271 - protein, 650 aa, Klebsiella pneumoniae
WKTIITGQGALMMPLSPQLQQHWQTVADRLPADFPVAELSPQARSVMAFSDFVEQSVIAQPGWLNELADSAPAAEEWRHYEAWLQERLQAVTDEAGLMRELRLFRRQMMVRIAWAQALSLVREEETLQQLSVLAETLIVAARDWLYAACCKEWGTPCNAEGQPQPLLILGMGKLGGGELNFSSDIDLIFAWPEHGATRGGRRELDNAQFFTRLGQRLIKALDQPTQDGFVYRVDMRLRPFGDSGPLVLSFAALEDYYQEQGRDWERYAMVKARIMGDNDGAYASELRAMLRPFVFRRYIDFSVIQSLRNMKGMIAREVRRRGLKDNIKLGAGGIREIEFIVQVFQLIRGGREPALQQRALLPTLAAIDELHLLPEGDATLLRAAYLFLRRLENLLQSINDEQTQTLPQDELNRARLAWGMHTDDWETLSAQLANHMANVRRVFNELIGDDEAQSPDEQLAEYWRELWQDALEEDDASPALAHLNDADRRSVLALIADFRKELDRRTIGPRGRQVLDQLMPHLLSEICSRADAPLPLARITPLLTGIVTRTTYLELLSEFPGALKHLITLCAASPMVASQLARHPLLLDELLDPNTLYQPTATDAYRDELRQYLLRVPEEDEEQQLEALRQFKQAQQLHIAAAGYRRAPCR

SEQ ID NO: 9272 - protein, 280 aa, Klebsiella pneumoniae
MLAIFCDIPWDIRHFNHVVGDKGWQCLHAEELIGFMERQVNAVNADAVEELVFVGEGFHRRVPGQRKHIFFPLHQAAGAIFFAGVGAGTAIAGVQRAVAFGKDVIHIFFHRPRSAHPPARHLPDHHIGPQEILYFFFYVVLAFGANAFNIVPGVAQITLRDLGQGVVQLTIRVRELFRPIDNQDVAHFLPSYMKICRRSYPAKRGSKMSKMCKVFCQMSNNLATSTRGPRSRRRARWQNQPACRAARRCAGRSTSPGRCPAPPAPADDKNARQCARAPAG

SEQ ID NO: 9273 - protein, 161 aa, Klebsiella pneumoniae
GERMLYLTQRLEIPAAATASVTLPIDVRVKSRVKVTLNDGREAGLLLPRGLLLRGGDVLSNEEGTEFVQVIAADEGVSVVRCDDPFMLAKACYHLGNRHVPLQIMPGELRYHHDHVLDDMLRQFGLTVTFGQLPFEPEAGAYASESHGHHHAHHDHHAHSH

SEQ ID NO: 9274 - protein, 315 aa, Klebsiella pneumoniae
CQRVGRADYGLRSPATLFVHPRKRQTSMSEQNYQPPKVWEWKQNSGGAFANINRPVSGATHERVLPVGTHPLQLYSLGTPNGQKVTIMLEELLALGVSGAEYDAWLIRIGEGDQFSSGFVEINPNSKIPALSDHSTTPPTRVFESGNILLYLAEKFGFFLPKDPAGRTETLNWLFWLQGAAPFLGGGFGHFYNYAPVKIEYAIDRFTMEAKRQLDVLDKQLARGRYVAGEEYTIADMAVWPWYGNVVLGNVYNAAEFLDAGSYKNVLRWAQDVGNRPAVKRGRIVNRTNGPLNEQLHERHDARDFDTQTEDKRQA

SEQ ID NO: 9275 - protein, 212 aa, Klebsiella pneumoniae
ARRVVAGWLSWRKNMISSFWKTIPTAKLALLTPFGAPLYQHAVELGCEDQGVYTSTFSKILAPGMRIGWIVMPDWLAQQTVIVKQAADLHTNMLSQVITAEYLSLNRLDNQIALIREDYRKKCVSLADALESRLGEHLEFSRPQGGMFLWARFRYPFDTMEWMKKTLENGVVYVPGEAFYHDKPDTRTLRLSYSTVSEAGLLTAVERLAASL

SEQ ID NO: 9276 - protein, 395 aa, Klebsiella pneumoniae
PPGVTESHNKEFFMSSIHTLSVHSGTFTDSHGAVMPPIYATSTFAQPAPGQHTGYEYSRSGNPTRHALETAIADLENGTRGYAFASGLAAISTVLELLDKDSHLVAVDDVYGGTYRLLENVRRRSAGLQVSWVKPDDLAGIEAAIRPDTRMIWVETPTNPLLKLADLSAIAAIARRHNLISVADNTFASPAIHRPLEHGFDIVVHSATKYLNGHSDVVAGLAVVGDNSELAEKLGYLQNAVGGVLDPFSSFLTLRGIRTLALRMERHSANALQLAEWLEQQPEVERVWFPWLASHPHHQLARQQMALPGGMISVVVKGDEGYAERIISKLRWFTLAESLGGVESLVSQPFSMTHASIPLEKRLANGITPQLIRLSVGIEDPHDLIADWQQALRRE

SEQ ID NO: 9277 - protein, 94 aa, Klebsiella pneumoniae
GAPVASVSISCPSCSATDGVVRNGKSTAGHQRYLCSHCRKTWQLQFTYTASQPGTHQKIIDMAMNGVGCRATARIMGVGLNTIFRHLKNSGRSR

SEQ ID NO: 9278 - protein, 440 aa, Klebsiella pneumoniae
YHPVDRFQRPQHDHPLFQRVHRAGFAFQTFGGGIAVDRHDQTVAQLARIRQIGDMTGMQNVEDAVGHHHFLAALARRRNRLFELLFAHHAKAGLSPAADRVFQLDRGNGGCTQLTDHHARRGVSEIAGLFQGVAGRQGRRQYANHRVAGAGHVVHFLGLGRHMQRRTSRLQQRHPLLRARHQQRRQFEFGDELHAALNDLRFILALAHHRFKLREVRGEQRRAAIAFEIGAFRIDQHRHARFTCESDHGLDAGQRPFGIVRKDQRANRAQRLLNALVHRLRIDAGEALFKVEADQLLIARQHPQLGDSRVSRDGDEVALHIDVGQRLAQRAGGVINPGQSHQARGCPQRGNVHRYVCRAARTFFDIFHLHHRHRGFRGNTTGGAVPVAVQHHITHHQHSCTFKLRQRYFHDSLLRDANFARDNSTPDFIVKPSAISASWR

SEQ ID NO: 9279 - protein, 149 aa, Klebsiella pneumoniae
CPTVYRRISQASSGNFWLTRGLALHISSYSNLEYDEIHTEGVELTMLTVIAEIRTRPGQHHRQAVLDQFAKIIPTVLQEAGCHGYAPLVDHAAGVSFQTTAPDSIVMVEQWESVAHLEAHLQTPHMKAWSEAVKGDVLETSIRILQAGV

SEQ ID NO: 9280 - protein, 253 aa, Klebsiella pneumoniae
AVWVLEVAMLFIFRVIFVVIYCIVVCVLGCLYCLFSPRNPKHVATFGHLFGRLSPVFGLKVELRKPADAESYGNAIYIANHQNNYDMVTASNIVQAPTVTVGKKSLLWIPFFGQLYWLTGNLLIDRNNRTKAHGTIAEVVNAFKKRKISFWMFPEGTRSRGRGLLPFKTGAFHAAIAAGVPIIPVCVSNTSNKIKLNRWNNGLVIVEMLPPVDTTQFGKDNVRALATHCRELMAAKIADLDNEVAEREAAGKQ

SEQ ID NO: 9281 - protein, 280 aa, Klebsiella pneumoniae
  UNSURE (264): Identity of amino acid at the above locations are unknown.
SHCSGTLRSGRASLAGADNARAHHVYMRTYLRVKGMLKVIQSPAKYLQGPDAAVLFGQYAKNLAESFFVIADDFVMKLAGEKVVNGLQSHDIRCHAERFNGECSHAEINRLMAILQKQGCRGVVGIGGGKTLDTAKAIGYYQKLPVVVIPTIASTDAPTSALSVIYTEAGEFEEYLIYPKNPDMVVMDTAIIAKAPVRLLVSGMGDALSTWFEAKACYDARATSMAGRQSTEAALNLARLCYDTLLAEGEKARLGGASRGNDRXAGTHHLGEHLPQRHWL

SEQ ID NO: 9282 - protein, 211 aa, Klebsiella pneumoniae
KTPLANSVIPEVRDPVLDRIKACFTESIQTQIAAAEALPDAISRAAMTLVQSLLNGNKILCCGNGTSAANAQHFAASMINRFETERPGLPAIALNTDNVVLTAIANDRLHDEIYAKQVRALGHAGDVLLAISTRGNSRDIVKAVEAAVTRDMTIVALTGYDGGELAGLLGQQDVEIRIPSHRSARIQEMHMLTVNCLCDLIDNTLFPHQDD

SEQ ID NO: 9283 - protein, 297 aa, Klebsiella pneumoniae
TPASHSDRYAPWRDPQRADCRGGRRGASRPGGAHSAHVRRLLYGLGCGQPERLGDRHRYPVEGDHGHPSARSAAAQQPGAVLPGAAADAGDLPADWQKRCALCAQRVTFAGAGGERSDGAAEIYGQSRAISYQRDQACGAGRRARHPAHRLSKGVTMSEKTMRVQDYPLATRCPEHILTPTGKPLTDITLEKVLSGEVGPQDVRISRQTLEYQAQIAEQMQRHAVARNFRRAAELIAIPDERILAIYNALRPFRSSQAELLAIADELEHTWHATVNAAFVRESAEVYQQRHKLRKGS

SEQ ID NO: 9284 - protein, 268 aa, Klebsiella pneumoniae
AARSAGVNKSAEATLYAWSDSCQTRPAILLPGSDSQCPRYFLSWLRLVMLTDFNQESTMKKVILASLLATMMSTSPVWATDSATAAPAAAATTQVQKEAADVLQVAVQGANAMRDIQFARLALFHGQPDSAKKLTDDAAALLAADDASWAKFVKTDAKAKMIADRYVIINASIALSEDYVATPEKESAIQSANEKLAKGDQKGAIDTLRLAGIGVIENQYLMPLNQTRKAVAQAQELLKAGKYYEANLVLKGAEEGIVVDSEMLVAGN

SEQ ID NO: 9285 - protein, 335 aa, Klebsiella pneumoniae
RSSSTFMIRFAVVGTNWITKQFVDAAHETGKYKLTAIYSRSLEQAQAFAKDYPVEHLFTSLDELAQSPDVDAVYIASPNSLHFPQTRLFLSHKKHVICEKPLASNLQEVEAAIALAKENNVVLFEAFKTASLPNFLLLKETLAKVGKLRKAFINYCQYSSRYQRYLDGENPNTFNPAFSNGSIMDIGFYCLASAVALWGEPRAVLATASLLDSGVDAQGTVVLSYGDFDVTLHHSKVSDSAIPSEIQGEDGALVIEKISECQKLAFVPRGGKAQDLTQPQHINTMLYEAETFARLVETQDVDHPGLAVSRITAKLSSEIRRQTGVIFPADTQPLA

SEQ ID NO: 9286 - protein, 501 aa, Klebsiella pneumoniae
GQRSVDMQYIKIHSQDNVAVALTDIAAGSVVTIDNDSVTLGQDIVRGHKFALRAIAKGENVVKYGLPIGHALADIAPGEHVHAHNTRTNLSDLDAYRYQPDLVAQPPQPADREVQIYRRANGDVGVRNELWILPTVGCVNAMARQMQNRFLKETYGAEDIDGVHLFSHTYGCSQLGDDHINTRTMLQNMVRHPNAGAVLVVGLGCENNQVEAFRETLGEFDPQRVHFMVCQHQDDEVEAGVEHLHQLYEVMRQDKRQPGKLSELKFGLECGGSDGLSGITANPMLGRFSDYVIANGGTTVLTEVPEMFGAEQLLMSHCRDEATFDKLVTMVNDFKQYFIAHDQPIYENPSPGNKAGGITTLEDKSLGCTQKAGSSQVVDVLRYGERLKVHGLNLLSAPGNDAVATSALAGAGCHMVLFSTGRGTPYGGFVPTVKIATNSELAAKKKHWIDFDAGQLLHGKTMPQLLEEFVDAIVAFANGKPTCNEQNDFRELAIFKSGVTL

SEQ ID NO: 9287 - protein, 198 aa, Klebsiella pneumoniae
GGIPVQQTTQIQPSFTLKTREGGVASADERADEVVIGVGPAFDKHQHHTLIDMPHGAILKELIAGVEEEGLHARVVRILRTSDVSFMAWDAANLSGSGIGIGIQSKGTTVIHQRDLLPLSNLELFSQAPLLTLETYRQIGKNAARYARKESPSPVPVVNDQMVRPKFMAKAALFHIKETKHVVQDAEPVTLHIDLVRE

SEQ ID NO: 9288 - protein, 160 aa, Klebsiella pneumoniae
PISLSTNSIAISMPFPRTSFTRSGYSCASRRKPSSSISPFCAACAGRFCVSSTLIVASAAAQANGLPPKVVVCRNGLSKSTEKTSSVATVAPIGITPPPSAFARHRMSGWTFSCSQANILPVRPMPVCTSSRISNAPNSSHSLRTAGKYPVGGRITPPSP

SEQ ID NO: 9289 - protein, 113 aa, Klebsiella pneumoniae
RAAPQDGRHCPNGLRRRPGRSGRQTHRPRPRSRQSPRRCPLRSGSQSAPEWKCSCWTGRSSPARCQTYCRGGKRRPRGSLPADNGSKPPPAPPVQPSRQTAPGSYRSRCPACA

SEQ ID NO: 9290 - protein, 687 aa, Klebsiella pneumoniae
LIRPHNNNFTLEATMSRYPSLFAPLELGFTTLKNRVLMGSMHTGLEELPDGAQRLAAFYAERARHGVALIVTGGIAPAPSGVTMAGGAVLNDASHLAHHRHITDAVHQEGGKIALQILHTGRYSYQPALVAPSALQAPINRFTPHELSHDEILTLIDDFAHCAQLAREAGYDGVEVMGSEGYLINEFLAARTNQRDDQWGGDYARRMRFAVEVVKAVRQRAGHDFIIIYRLSMLDLVNDGSTLAEVTELAKAIEAAGATIINTGIGWHEARIPTIATPVPRGAFSWVTRKLKGAVSIPLITTNRINDPQVAEDILARGDADMVSMARPFLADAEFISKAQADRADQINTCIGCNQACLDRIFVGKVTSCLVNPRACHETLMPVLPANAPKRLAVVGAGPAGLAFAVNAAARGHHVTLFDALPEIGGQFNIAKQIPGKEEFHETLRYYRTMLDLHGVDLRLNTRVTTDDLLAFDETILATGIAPRLPAIDGIDHPKVLSYLDVLRDKAPVGAKVAIIGCGGIGFDTAMFLSQSGVATSQDIGEFCREWGIDTSLQTAGGLSAEGPQLSKSPRQIVMLQRKASKPGEGLGKTTGWIHRATLLARGVKMIPAVSYEKIDDEGLHVTIGGERQLLAVDQVVICAGQEPRRELADPLRAAGKTVHLIGGCDVAAELDARRAIAQGTKLALAI

SEQ ID NO: 9291 - protein, 383 aa, Klebsiella pneumoniae
VHRPGRPGAGDASGPLQRRAGAAGGDRRSHDDPGLRRAGMKTLLKNRELSAFFAIVALFVVLVVLNPAYFSLQTLAMIFASSQILCLLALGATLVMLTRNIDVSVGSTVGLCAIAVGVALNNGYGLATAIAFALAIGALAGAFNGLLVVGLRIPAIVATLGTLGLYRGVMLLWTGGKWIEGLPDSLKSLSEPAFIGVSPLGWLVLALLLAGGWLLSRTAFGRDFYAVGDNLAAARQLGVAVNRTRMLAFTLNGMLAACAGIVFAAQIGFVPNQTGSGLEMKAIAACVLGGISLLGGTGTLLGAFLGAFFLTQIDTVLVLFRLPAWWNDFIAGLVLLGVLVLDGRLRQALARHQRALKYSRFQPGNKGGKQVARFPERKSKEVA

SEQ ID NO: 9292 - protein, 294 aa, Klebsiella pneumoniae
IGNTDETMKQHESADNSQGQLYIVPTPIGNLSDITQRALEVLQAVDLIAAEDTRHTGLLLQHFAINARLFALHDHNEQQKAETLLAKLKEGQNIALVSDAGTPLINDPGYHLVRTCREANIRVVPLPGPCAAIAALSAAGLPSDRFCYEGFLPAKSKGRRDTLKALEEEPRTLIFYESTHRLVESLEDICAVLGESRYVVLARELTKTWESIHGAPIGELVAWVKEDENRRKGEMVLIVEGFKAQEEALPAAALRTLALLQAELPLKKAAALAAEIHGVKKNALYKYALEQQGE

SEQ ID NO: 9293 - protein, 111 aa, Klebsiella pneumoniae
EVDTVAYADFAKLEMRVGKIVEVKRHDNADKLYIARIDVGDRTLQTVTSLVPYYSEEDLLGKTVVVLCNLAKAKMRGETSECMLLCAETEDGSESVLLTPERVMPAGVRVV

SEQ ID NO: 9294 - protein, 307 aa, Klebsiella pneumoniae
KIITRMKRENIMTIKVGFIGLGIMGKPMSKNLLKAGYSLVVSDRNPEAIADVIAAGAETATTPKAIAEQCEVIITMLPNSPHVQEVALGENGIIEGAKPGTVVIDMSSIAPLASREISEALKAKGIDMLDAPVSGGEPKAIDGTLSVMVGGDKAIFDKYYDLMKAMAGSVVHTGDIGAGNVTKLANQVIVALNIAAMSEALTLATKAGVNPDLVYQAIRGGLAGSTVLDAKAPMVMDRNFKPGFRIDLHIKDLANALDTSHGVGAQLPLTAAVMEMMQALRADGLGTADHSALACYYEKLAKVEVTR

SEQ ID NO: 9295 - protein, 116 aa, Klebsiella pneumoniae
SPLTFATRTTLQENDMAKENVTDDLRAELKTLADTLEEVLNSSADKSKEEMGKLRSKAESALKESRARLGETSEAILRQTRETAARADDYVRENPWTGVGIGAAVGLVLGVLLSRR

SEQ ID NO: 9296 - protein, 416 aa, Klebsiella pneumoniae
IMTTRTPSSGWLSRLAQGSLVKQILIGLVLGVLLALVSKPAAIAVGLLGTLFVGALKAVAPVLVLMLVMASIANHQHGQKTSIRPILFLYLLGTFSAALTAVLFSFLFPSTLHLTTAADSITPPSGIVEVLRGLLMSMVSNPIDALLNANYIGILVWAVGLGFALRHGNDTTKNLINDVSHAVTFIVKVVIRFAPLGIFGLVSSTLATTGFETLWGYAQLLLVLVGCMLLVALVINPLLVFWKIRRNPYPLVLTCLRESGVYAFFTRSSAANIPVNMALCEKLNLDRDTYSVSIPLGATINMAGAAITITVLTLAAVHTLNIPVDLPTALLLSVVASLCACGASGVAGGSLLLIPLACNMFGIPNDVAMQVVAVGFIIGVLQDSCETALNSSTDALFTAAACMAEDDQLAKNALRG

SEQ ID NO: 9297 - protein, 388 aa, Klebsiella pneumoniae
TRGFYYSGGGEAMSQAELNGELFTLERFPPNAEEEALQAWEAADEYLLQQVNDVDGLTLIFNDGFGALACALADRNPVSINDSFISELATRHNLRMNGIDEESVRFQDSLSPLPAAPALVLIKVPKQLALLEQQLRALREVVTPETRIIAAAKARDVHNSTLALFEKILGTTTTSLAWKKARLIHCVFTAPELADAPQTYSWKLDGTPWTIHNHANVFARSGLDIGARFFLQHLPSDLEGEIADLGCGNGVIGLQALAQNPNARVMFTDESHMAVASSRLNVERNLPDDIARCEFMVNNSLSGIEPDRFTAILCNPPFHQQHAITDHIAWQMFNDARRSLKYGGELYVVGNRHLDYFRKLKRAFGNCTTIATNNKFVILKATKVRKQR

SEQ ID NO: 9298 - protein, 218 aa, Klebsiella pneumoniae
TGETKEHDMSLNRTQIVDWLYRCGDIFTKESDFLTGLDKEIGDADHGLNMHRGFSKVVEKLPSIADKDIGFILKNTGMTLLSNVGGASGPLFGTFFIRAAQVTQAHQSLTLDELYLMIREGADGVVNRGKAEPGDKTMCDVWLPVVDSLRQSSEQHLSIAAALDAACEVAERAAHATITMQARKGRASYLGERSIGHQDPGATSVLFMVQMLAAAAKE

SEQ ID NO: 9299 - protein, 337 aa, Klebsiella pneumoniae
AFMTDKSVPFSVLDLAPIPQGSSAKEAFTHSLDLARLAESRGYHRYWLAEHHNMVGIASAATSVLIGYLAANTTTLHLGSGGVMLPNHSPLVIAEQFGTLNTLYPGRIDLGLGRAPGSDQPTMRALRRHMSGDVDNFPRDVAELVDWFDARDPNPHVRPVPGYGERIPVWLLGSSLYSAQLAAQLGLPFAFASHFAPDMLFQALHLYRSNFKPSARLEKPYAMVCINIIAADSNRDAEFLFTSMQQAFVKLRRGETGQLPPPVENMHQLWSASEQYGVQQALSMSLVGDKTKVRHGLESILRETEADEIMVNGQIFDHQARLHSFDLAMQVKEELLG

SEQ ID NO: 9300 - protein, 73 aa, Klebsiella pneumoniae
DVFALKFPHILTLSALWQQKGYHWRTLRRVQKGPILGLNPEGLAQFFNYFYGQRLKFTVKRRIRVFLPPTPGE

SEQ ID NO: 9301 - protein, 145 aa, Klebsiella pneumoniae
KAFAHHSSSSRETHQVTTCCLLSQRPMAASVSIFLLHYAMVHTPYHSDFVTVCWFLYLIRTADNRLYTGITTDVPRRFRQHQAGKGAKALRGKGDLQLAFSHEVGEHSLALRLEYRVKQLTKREKERLVAGEDAFETLLARLKDD

SEQ ID NO: 9302 - protein, 355 aa, Klebsiella pneumoniae
TPFATTVLSMALFAFSTWISTNGAKMLGPITSVTSSLMLLLTLSYILLAGTALVGGVQPADPITVEAMIPNFNWAFLGITTWIFMAAGGAESVAVYVNDVKGGSKSFVKVIILAGIFIGVLYSISSVLINVFVSSKELKFTGGSVQVFHGLAAYFGLPEILMNRFVGLVSFTAMFGSLLMWTATPVKIFFSEIPSGIFGKKTVELNENGVPARAAWIQYLIVIPLMIIPTLGSNTVQDLMNTIINMTAAASMLPPLFIMLAYLNLRRKLDHLPRDFRMGSRTTGIVVVSMLIVIFAIGFVASTFPTGGNILTIIFYNVGGIVIFLGFAWWKYSRYVKGLTQEQQQIEAAPASHTS

SEQ ID NO: 9303 - protein, 67 aa, Klebsiella pneumoniae
SATAPSALAGGAVISYSRRSRNENTCSCHNYVATQLKNKIHIKITVFYASRQSFFPYTRLCKHLLTS

SEQ ID NO: 9304 - protein, 670 aa, Klebsiella pneumoniae
TAGASWRFFFLPSGSRCRRGSLWYNAEKDMTVQTQDTGKAVSSVIAQSWHRCSKFMQRETWQTPHQAQGLTFDSICRRKTALLTIGQAALEDAWEFMDGRPCALFILDESACILSRCGEPQTLAQLAALGFRDGSYCAESIIGTCALSLAAMQGQPINTAGDRHFKQALQPWSFCSTPVFDNHGRLFGSISLCCLVEHQSSADLSLTLAIAREVGNSLLTDSLLAESNRHLNQMYGLLESMDDGVMAWNEQGVLQFLNVQAARLLHLDAQASQGKNIADLVTLPALLRRAIKHARGLNHVEVTFESQHQFVDAVITLKPIVEAQGNSFILLLHPVEQMRQLMTSQLGKVSHTFEQMSADDPETRRLIHFGRQAARGGFPVLLCGEEGVGKELLSQAIHNESERAGGPYIAVNCQLYADSVLGQDFMGSAPTDDENGRLSRLELANGGTLFLEKIEYLAPELQSALLQVIKQGVLTRLDARRLIPVDVKVIATTTVDLANLVEQNRFSRQLYYALHSFEIVIPPLRARRNSIPSLVHNRLKSLEKRFSSRLKVDDDALAQLVAYSWPGNDFELNSVIENIAISSDNGHIRLSNLPEYLFSERPGGDSASSLLPASLTFSAIEKEAIIHAARVTSGRVQEMSQLLNIGRTTLWRKMKQYDIDASQFKRKHQA

SEQ ID NO: 9305 - protein, 122 aa, Klebsiella pneumoniae
FTLAGGVDYASPPKRRRPAESSRRGADASSRRGARPSRRSPLKRRPSPRPPSRRSPPKPRPPSRRSPPKPRPSSRRSPPSRRSVRGCASPSSCMFIGLFRIRVLVKCCSTLPGIPFGSSMVE

SEQ ID NO: 9306 - protein, 328 aa, Klebsiella pneumoniae
DPAAYHGSLVALWRGRRAGQYSGNRRAAQCGRHRAATGRSGELNGRSRQPLSLTCYFRMPIMNQTSTLTGQCVAEFLGTGLLIFFGAGCVAALRVAGASFGQWEISIIWGLGVAMAIYLTAGVSGAHLNPAVTIALWLFACFERRKVLPFIVAQTAGAFCAAALVYGLYRQLFLDLEQSQHIVRGTAASLNLAGVFSTYPHPHITFIQAFAVETTITAILMAMIMALTDDGNGIPRGPLAPLLIGLLIAVIGASMGPLTGFALNPARDFGPKLFTSLAGWGSIAFTGGLAIPYFLVPLLAPVVGAIIGAFLYRKLIGRHLPCECGIDE

SEQ ID NO: 9307 - protein, 139 aa, Klebsiella pneumoniae
RQRAGDCRDFPPGILSVNEGAVMSLSPPGVRLFYDPRGHHAGAINELCWGLEEQGVPCQTITYDGGGDAAALGALAARSSPLRVGIGLSASGEIALTHAQLPADAPLATGHVTDSDDHLRTLGANAGQLVKVLPLSERN

SEQ ID NO: 9308 - protein, 205 aa, Klebsiella pneumoniae
PLPAVRRRWRSSISAPARRMRRSSTRRGRLTAVHLAGAGNMVSLLIKTELGLEDLSLAEAIKKYPLAKVESLFSIRHENGAVEFFREALSPAVFAKVVYIKEGELVPIDNASPLEKIRLVRRQAKEKVFVTNCLRALRQVSPGGSIRDIAFVVLVGGSSLDFEIPQLITEALSHYGVVAGQGNIRGTEGPRNAVATGLLLAGQAN

SEQ ID NO: 9309 - protein, 83 aa, Klebsiella pneumoniae
TKPAPFFPVMPRGPGPPPAGFGLGLVICKSWVALMQGRLEMFSRPGVGTTFTITLPVKASRCAIHAPPGVARQTAGSTRAGRY

SEQ ID NO: 9310 - protein, 130 aa, Klebsiella pneumoniae
ANTYLSGIGFESSGLAAAHAIHNGFTILEECHHLYHGEKVAFGTLAQLVLQNSPMDEIETVLGFCQRVGLPVTLAQMGVKEGIDEKIAAVAKATCAEGETIHNMPFAVTPESVHAAILTADLLGQQWLAR

SEQ ID NO: 9311 - protein, 558 aa, Klebsiella pneumoniae
VFAYSSGTTMSQFFFNQRASLVNDVIEGTIIASPWNNLARLESDPAIRVVVRRDLNKNNVAVISGGGAGHEPAHVGFIGKGMLTAAVCGDLFASPSVDAVLTAIQAVTGEAGCLLIVKNYTGDRLNFGLAAEKARRLGYNVEMLIVGDDISLPDNKQPRGIAGTILVHKVAGYFAERGFNLATVLREAQYAASHTASIGVALASCHLPQEADSAPRHQAGHAELGMGIHGEPGASTIATQNSAEIVNLMVEKLTAALPETGRLAVMLNNLGGVSVAEMAILTRELANTPLQARIDWLIGPASLVTALDMKGFSLTAIVLEESIEKALLSDVETASWQKPVQPRTINVVPSTLDSARVDFTPSANPQVGDYVAQVTGALIDLEEHLNALDAKVGDGDTGSTFAAGAREIAERLERQQLPLNDLPTLFALIGERLTVVMGGSSGVLMSIFFTAAGQKLGQGASVAEALNAGLEQMKFYGGADEGDRTMIDALQPALAALLAEPENLQAAFAAAQAGADRTCQSSKAGAGRASYLNSDSLLGNMDPGAQAVAMVLKALAER

SEQ ID NO: 9312 - protein, 477 aa, Klebsiella pneumoniae
SLQYLIQYRVIRPPQEHILNRLPSSASALACSAHALNLIEKRTLDHEEMKALNQEVREYFKEHVNPGFLEYRKSVTAGGDYGAVEWQAGGLNTLVDTHGQEFIDCLGGFGIFNVGHRNPVVVSAVENQLAKQPLHSQELLDPLRAMLAKTLAALTPGKLKYSFFCNSGTESVEAAIKLAKAYQSPRGKFTFIATSGAFHGKSLGALSATAKSTFRKPFMPLLPGFRHVPFGDINAMRTMLSECKKTGDDVAAVILEPIQGEGGVILPPTGYLPAVRKLCDEFGALLILDEVQTGMGRTGKMFACEHENVQPDILCLAKALGGGVMPIGATVATEEVFSVLFDNPFLHTTTFGGNPLACAAALATINVLLTQNLPAQAAQKGDMLLDGFRLLAQEYPDLVNEVRGKGMLMAIEFVDNEIGYDFASEMFRQRVLVAGTLNNAKTIRIEPPLTLTLEQCEQVLKAARKALAALRVSVEET

SEQ ID NO: 9313 - protein, 270 aa, Klebsiella pneumoniae
QIEYCRHLPGANMEIIEPRRLYQQLAAELKTRIEQGVYLVGDKLPAERFIADEKNVSRTVVREAIIMLEVEGYVEVRKGSGIHVISNHPKYQQVADESLEFANYGPFELLQARQLIESNIAEFAATQVTKQDIMKLMEIQEKARNEKCFRDSEWDLQFHVQVALATQNSALAAIVEKMWTQRVHNPYWKKLHEHIDLRTVDNWCDDHDQILKALLRKDPNAAKLAMWQHLENTKQMLFNETSDDFEFNADRYLFAENPVVHLDTAVNGAK

SEQ ID NO: 9314 - protein, 148 aa, Klebsiella pneumoniae
GRDHGVKVRHIVGAIANKGDISSRYIGNIKLFASHSTIELPKGMPGKVLQHFTSTRILNKPMNMQLLGDAQPRTERRDGGERREDGRGFGGERREGGRGFGGERREGGRGEGRRFSGERREGRAPRRDDASAPRRDDSAGRRRFGGDA

SEQ ID NO: 9315 - protein, 99 aa, Klebsiella pneumoniae
AVGQATLGIDTNVGLHAKVPLIAFLGLMHLRIALLLFVLGRAGCLNDGGIHQSALGHHDACFGQPAIDGLEQLTGQLMLLEQVAEIHDGGAIRQGAIQG

SEQ ID NO: 9316 - protein, 447 aa, Klebsiella pneumoniae
EAAQHRISGNARQAVRSPALEAKLQLAELARLAFILTHHFIQLMQMLNPRLHFIVLMLANHKVHALRVKLAQRLAKGLHLVVFTAKANHQHRPGVRVTNHILQHGASVDVIVPKLRAAIGVAEEMYPIDILSAIRLFQETVLHLSGHRVDAADGRQDPQLIAHADVTVGATINLYFAIRRLWRLGNQVRLIAIRVKVAEIGARIVRMNMLARRDIRQRMANRQPVLNDVFPFRDSAQCKLVAANDILAEGDRVIINRHHATGSDIRQRDRDVILRMDFDVLHINRPLALVQFNGEIVTRIVKANVFHHLAQQRDIRRRFAGSHPTADHLAQNAAEVFVARVGEEAATVGQHPDEAAQQPELRQLGHLPLHTVFLIVEPPAGAELHLAWHAFTLEVTDHGAQHFVITRVQAVENRFRQQVFFVLLAQQLRQLFRHRTIVDRVEADVWP

SEQ ID NO: 9317 - protein, 713 aa, Klebsiella pneumoniae
ALSQKKYHWTLMVPSTFLRSKPARCLPVLLATLIFAGCGTHTQDQSAAFMQGTSQANSSFYLQQMQQSTNDSKTNWQLLAIRALLQEGKKQQAIDLFNQLPANLNSTQAREQSLLAVEVKLAQNDYQAARNLLAKIDPTNLEQPQQARYWQAQIDASQGKPSLTLLRALIAQQPLLSDAKQRQKNIDATWQALTSMPQDQANALVINADENILQGWLDLQRMWFDNRNDPTLLKAGVKDWQTRYPQNPGAKMLPTALVNMQNYKPASINKIALFLPLNGQASIFGRTIQQGFEAAKNGAPSVTGSAVPAQVAQAANVSGNDDVVSPSQAEISDLTAAGSRADPVQAPTQDQAAPAAEPAAQAPATSATPQTTASPATQPVTAPAAQPQPVVATAANPSAELKIYDTTSQPISQLLAQAQQDGATLVVGPLLKENVEEVIKSNTPLNVLALNQPEKVESRANLCYFALSPEDEARDAARHIHQQGKQTPLLLVPRGALGDRVVSAFADEWLKLGGASVLQQRFGSTAELRAGVNGGGGIALSGTPVSTLPSAQNSILGSADEMPVSSGGSVDAAYILATPEQIAYIKPMIAMRNGSQSNVTLYASSRSAQGTAGPDFRLEMEGLQYSEIPMLAGSNPSLMQQALSAVRNDYSLARLYAMGADAWSLANHFTQMRQTPGFELNGNTGDLTANQDCVINRKLSWLKYQQGKIVPAS

SEQ ID NO: 9318 - protein, 115 aa, Klebsiella pneumoniae
SGKQAHGGDFVQGIFHGTVAQVVPMLHAVNTQHGLQRIGPSAIARLGIKRLDDFHHVLPWQNLLHAGEENLFSGLTALSAEFTIGEGELMAHDVPLGCAPDEYDDLISGTCSHLP

SEQ ID NO: 9319 - protein, 559 aa, Klebsiella pneumoniae
RKRQQHARCLPWPPDGLAPRDNSEAHVMSYLLALDAGTGSIRAVIFDLNGRQLAVGQAEWKHLSVDNVPGSMEFDLTTNWQLACQCIRQALDAARLSAADIQSVACCSMREGIVLYDRNGEAIWACANVDARASREVAELKEIHDYRFESEVYEVSGQTLALSAMPRLLWLAHHRPDIYRKAATITMISDWLAAKLSGELAVDPSNAGTTGMLDLFSRDWRPALLDMAGLRADMLSPVKETGTLLGAVTEAAAQQSGLRAGTPVVMGGGDVQLGCLGLGVVRAGQTAVLGGTFWQQVVNLPQVRTDPQMNIRVNPHVIPGMAQAESISFFTGLTMRWFRDAFCAEEKLIAERLGVDAYSLLEEMASRVPAGSHGVMPIFSDAMHFKQWYHAAPSFINLSIDPEKCNKATLFRALEENAAIVSACNLAQISQFSGVTFESLVFAGGGSKGALWSQILSDVTGLPVRVPVVREATALGCAIAAGTGAGLYDDMASTGERLVSWHREFTPNPQHRELYQEMMSKWQTVYADQLGLVDSGLTTSMWQAPGLERRQRVVSSPSP

SEQ ID NO: 9320 - protein, 491 aa, Klebsiella pneumoniae
LCQHCSQSSERLPHWSEEDTRMTSFMTEDFLLDTEFARRLYHDYAKDQPIFDYHCHLPPQQVAENYRFKNLYDIWLKGDHYKWRAMRTNGVPERLCTGDASDREKFDAWAATVPHTIGNPLYHWTHLELRRPFGITGKLLSPSTADEIWDQCNDLLAQDAFSARGIMKQMNVKMVGTTDDPIDSLEHHAAVAKDNSFDIKVLPSWRPDKAFNIELATFNDYMAKLGEVSDTDIRRFADLQSALTKRLDHFAAHGCKVSDHALDVVLFAEATDAELDDILARRLAGETLSEHEVAQFKTAVLVFLGAEYARRGWVQQYHIGALRNNNLRQFKLLGPDVGFDSINDRPMAEELSKLLSKQNEENLLPKTILYCLNPRDNEVLGTMIGNFQGEGMPGKMQFGSGWWFNDQKDGMERQMTQLAQLGLLSRFVGMLTDSRSFLSYTRHEYFRRILCQMIGRWVAAGEAPADIALLGEMVKNICFNNARDYFAIELN

SEQ ID NO: 9321 - protein, 78 aa, Klebsiella pneumoniae
RREHRSAAGAFPGVLAQQVKSHRGKTRIAARRALSGLPAVPFFVGWRLTPYPTCYSAVLHRPGKRSATGEGLTFRQRL

SEQ ID NO: 9322 - protein, 238 aa, Klebsiella pneumoniae
REVKNMITTRTAKQCGQADFGWLQARYTFSFGHYFDPKLLGFASLRVLNQEVLAPGASFQARTYPKVDILNLILEGEAEYRDSDGNHVQAKAGEALLIATQPGVSYSEHNLSKEQSLTRMQLWLDACPQRENPLQQKINVADATLQLLASPEGGDNNLQLRQQAWVYHIAMEKGEQINVQLHGPRAYLQSIHGSVHAVAQEQQKQALTCGDGAFIRDEANITLVADTPLRALLIDLPV

SEQ ID NO: 9323 - protein, 261 aa, Klebsiella pneumoniae
RKVKIMDNAIFPNKFKAALAAHQVQIGCWCALANPISTEVLGLAGFDWLVLDAEHAPNDVTTLIPQLMALKGSSSAQVVRVPTNEPIIIKRMLDIGFYNFLVPFVETAEQAAQAVASTRYPPEGIRGVSVSHRGNMFGTVPDYFAQSNKNISILVQIESQTGVDNVEAIAATEGVDGVFVGPSDLAAALGHLGNAAHPEVQRAIQHIFASAKKHGKPSGILAPVEADARRYLEWGATFVAVGSDLGVFRSATQKLADAFKK

SEQ ID NO: 9324 - protein, 290 aa, Klebsiella pneumoniae
LYQKKTCILFSWQSLSFASSLDISIYRSRRQSMMTKTKADKYPQRVRNELRFRELTVLRVERAGAAFQRIVLGGEALEGFASHGFDDHTKLFFPEPGAAFTPPQVTEEGIDWGEGVRPATRDYTPLYDAERHELAYDFYIHDGGIASRWALEAKVGDKLVIGGPRGSLVVPEDYAWQLYVCDESGMPALRRRLLGLRQLPARPQVTAIVTIADASYKDYLADLDGFNIEWVVGHNPAFVAERLAQVKVPAEDYFIWLTGEGAVVKSLLARFEDESIDQQLVRSQAYWHSK

SEQ ID NO: 9325 - protein, 193 aa, Klebsiella pneumoniae
IYQKQQEVTMRHHHEEGRGPRGRHGDPSEHGDHGRRGGGRRQRFFGHGELRLIILDILSRSASHGYELIKEIETLTQGNYSPSPGVIYPTLDLLQDQGLISVEDDNGRKKILISEEGKQLHAENQEHLAHIQERLQARMVGCELRRDPQMKRALENFKAVLDLKVNQQASSAAQLKQIIGIIDRAAMEISQLD

SEQ ID NO: 9326 - protein, 358 aa, Klebsiella pneumoniae
IMKKLINRVEDVLNEQLQGLAKAHPQLTLHQDPLYVTRTDAPVAGKVALLSGGGSGHEPMHCGYIGQGMLSGACPGEIFTSPTPDKMFECAMQIDGGEGVLLIIKNYTGDILNFETATELLHESGIKVTTVVVDDDVAVKDSLYTAGRRGVANTVLIEKLVGAAAERGDFDGSLALKWAAALNNLGHSIGIALGACTVPAAGQPSFTLKDDEMEFGVGIHGEPGIDRRRFSSLDQTVDEMFDTLLENGAYSRTLRQWDTVKGTWQEVQQSKTALQNGDRVIALVNNLGATPLSELYGVYNRLAQRCEASGIIIERNLIGSYCTSLDMAGFSITLLKVDDETLTLWDAPVHTPALNWGN

SEQ ID NO: 9327 - protein, 131 aa, Klebsiella pneumoniae
KMKKLEDVGVLVARILMPILFITAGWGKITGYAGTQQYMEAMGVPGALLPLTILLEFGGGLAILFGFLTRTTALFTAGFTLLTAFLFHSNFAEGVNSLMFMKNLTIAGGYLLLAITGPGAFSIDRVLNKKW

SEQ ID NO: 9328 - protein, 334 aa, Klebsiella pneumoniae
DQEKLPFMLTATGCGSVNKTGPLLPRYAQGARTATSRFRIGAGHLQKLGCVNAGSPGNVQPPGRGDHFHHHAAGQGEPLRDPRAARRRPPDRRLYPGWPILIADDHPTNRLLLKRQLSTIGYSVDEACDGEEAENKLASKHYDLLITDLNMPKKDGLELAASLRRRYPGLVIWGVTASALPQSREACLASGMNMCLFKPVSVQTLSHELSRLAVGRASPHATRHLKLSVLSENTGGDQALMNEMLETFRDASAADLQAAGQAIARHEPQIFLRALHRLHGSAQILGITALQQLCAPFEAKRPDSLTPASCLEVVQRITGVMREMDGEIDALIGR

SEQ ID NO: 9329 - protein, 151 aa, Klebsiella pneumoniae
WRRKMDTLAAIGRWLSKQHVVTWCVSREDELWCANAFYVYDPDTVAFYLLSEEHTRHGQMTGQRAKVAGTVNGQPKTVALIRGVQFKGEIRRLSGDEEARMRQRYVKRFPVARMLSAPVWEIRPDEIKFTDNTLGFGKKLHWRRDAGAEQA

SEQ ID NO: 9330 - protein, 332 aa, Klebsiella pneumoniae
MKLKLNWESALLALLIVEILLFGALNPRMLDLNMLLFSTSDFICIGIVALPLTLVIISGGIDISLGSTIGLCAIALGVMTQAGWPLWLAVSLTLLLGLLCGLFNAALIHYTGISPLVITLGTLYLYGGGALLLSGMAGATGYEGIGGFPDSFTAFANLTLAGLPLPLVLFAIITFFFWLLTHRGRFGRHLFLLGQNPRAARYAALSVNGIPYVLYGLVGVASAVAALVMVSYFGSARSDLGRDLLMPALTAAVLGGANIYGGSGSILGTALAALLVGYLQQGLQMVGIPNQVSSALSGALLVVVVMGRSLSLHREWVRATWRRLFSHKTIGA

SEQ ID NO: 9331 - protein, 180 aa, Klebsiella pneumoniae
PWLNCPPDRHNDKTMTKLIYLQGYPESLLAQVTTLIEQGRLGEVLQKRYPQGHDVNSDKALYQYTQDLKNRFLRGAAPINKVMYDSKIHVLNNALGLHTAISRVQGGKLKAKAEIRVATVFRDAPEAFLRMIVVHELAHLKEKDHNKAFYQLCCHMEPQYHQLEFDTRLWLTHLSLNRSA

SEQ ID NO: 9332 - protein, 154 aa, Klebsiella pneumoniae
IAGKTFNSLMKTGCRRGRISFLTTHWPRRGPSPARSAAASCPSAGSGTSASSPTRCWYRRALPHAIRTSGGRLPYRVCGRWKATASCSTPTKVSPSPSTCPMSRPITRPAPTSACLPSATAGRANKPSSNSMASKPISKSTLTASTSALAKAAA

SEQ ID NO: 9333 - protein, 605 aa, Klebsiella pneumoniae
  UNSURE (234): Identity of amino acid at the above locations are unknown.
AWNLSLKVQGGEFCKGEPMSQVLLTGATGLVGGHLLRLLQNEPRISTIAAPTRRPLAPAEGVFNPHDPQLTDALAQVVDPVDIVFCCLGTTRREAGSKEAFVHADYTLVVDTALTGKRLGAQHMLVVSAMGANAHSPFFYNRVKGEMEAALIEQDWPRLTIARPSMLSGEREKKRANETFLAPLFRLLPGNWKSIAARDVAIALLAEALSPTHERVRILSSSELRERAARQAEXRFANACFRRIIHGFNSYPHFLLGNAMAGQSSSQAASPFQWWKPALFFLVVIVGLWYVKWQPYYGKAFTAAETHSIGKSILAQADANPLMAAWDYAMVYFLAVWKAAVLGVLLGSLIQVLIPRDWLLRTLGQSRFQGTLLGAIFSLPGMMCTCCAAPVTAGMRKQQVSMGGALAFWMGNPLLNPATLVFMGFVLGWQFALVRLVAGLATVLTVATLVQKWVKEAATQPVAVPAAPSEATQGGFFSRWLQALWTLFWNTIPVYILAVLVLGAARVWLFPHADGVVDNTLFWVIAMAIAGCLFVIPTAAEIPIVQTMMLAGMGTAPALALLITLPAVSVPSLIMLRKAFPAKALWLTGGLVALCGAIVGALALV

SEQ ID NO: 9334 - protein, 164 aa, Klebsiella pneumoniae
RSADVLPDAPAGCPVGLRTDRLAGGTVEEKIQKPGLMMVMKRPSLRQFSWLLGGSLLLGALFWLWLAVQQQEATLAIRPVGQGIGMPDGFSVWHHLDANGIRFKSITPQKDGLLIKFDSTAQGAAAKEVLGRALPHGYIIALLEDDNSPTAWLSRLRDAPHRLG

SEQ ID NO: 9335 - protein, 443 aa, Klebsiella pneumoniae
MILDSTLDEKKGIPTRYLILLMIFVVTAVNYGDRATLSIAGTEVAKELGLSAVSMGYIFSAFGWAYLLMQIPGGWLLDKFGSKKVYSYSLFFWSLFTFLQGFIDVFPLAWAGVSMFFMRFMLGFSEAPSFPANARIVAAWFPAKERGTASAIFNAAQYFSLALFSPLLGWLTFALGWEHVFTVMGIIGFVLTIIWVKFVHNPTDHPRMSAAELKYISEGGAVVDMDHKKEATPAAGPKMDYIRQLLTNRMMLGVFFGQYFLNTITWFFLTWFPIYLVQDKGMSILKVGFVASIPALFGFAGGVLGGLFSDYLIGRGCTLTFARKLPIVLGMLLASSIILCNYTASTPLVITLMALAFFGKGFGALGWPVISDVAPKEIVGLCGGVFNVFGNVASIATPLVIGYIVSELHSFNGALIFVGGSALMMMVCYLFVVGDIKRMELQK

SEQ ID NO: 9336 - protein, 175 aa, Klebsiella pneumoniae
MATLTTTATRPSLFGGVVIIGGTIIGAGMFSLPVVMSGAWFFWSLAALVFTWFCMLHSGLMILEANLNYRIGSSFDTITKDLLGKGWNLVNGVSIAFVLYILTYAYISASGSILHHTFSELSLKVPARAAGFGFALLVAFIVWMSTKAVSRMTAIVLGAKVITFFLTFGSLLGHV

SEQ ID NO: 9337 - protein, 89 aa, Klebsiella pneumoniae
KVKLTDKPGSVVDSHSSRPAIAHWLKQPTRVQYGPYLMNPYLALLRVEFTVPRTVTSRAVRSYRTLSPLPDPACAGHRRFALCCTGRGL

SEQ ID NO: 9338 - protein, 227 aa, Klebsiella pneumoniae
RRICVGAQRLGLCIGLIALRHRARNSGVSASEAPFVFFSQGAYMTAYWLAQGVGVIAFLIGITTFINRDERRFRLQLAVYSAIIGVHFFLMGAGPAGMSAGLNALRTVISLRTRSLWVMTVFILLTLILGLGKLQHAMELLPIIGTVASTWALFRCKGLTVRCVMWCSTACWVTHNLWLGSIGGTLIEGSFLIVNGLNIIRFRRMQKRGIDPFKVENAVQEESPSAR

SEQ ID NO: 9339 - protein, 184 aa, Klebsiella pneumoniae
RNYCIHGVKLVLDKLRSRLVHFGPSLMSVPVKLAPFALKRQVLEQVLSWQFRQALAEGELEFLEGRWLSIHVRDIGLLWYTSVVDGRLVVSQQADADVSFSADASDLLMIAARKQDPDTLFFQRRLVIEGDTELGLYVKNLMDAIELEQMPKALRVMLLQLADFVEAGLKSPQKPEQTSVGEAC

SEQ ID NO: 9340 - protein, 434 aa, Klebsiella pneumoniae
CRRCARTVSALQTIARWRAITKNWRKWKSLANKKGALRALLCLPCAALSGYKIMKIVIAPDSYKESLSASEVAQAIEKGFREIFPDAQYVSLPVADGGEGTVEAMIAATQGKAHFAWVTGPLGERVKACWGMSGDGVTAFIEMAAASGLGLVPPDKRNPLITTSRGTGELILQALEHGAERIIIGIGGSATNDGGAGMMQALGARLCDAEGQEIGHGGGSLSRLSRIDLSAIDPRLRDRMIHVACDVTNPLVGERGASRIFGPQKGATEAMIVELDRNLAHYADVIKASLQVDVKSIPGAGAAGGMGAALMAFLNAELRSGIEIVTEALKLEEQIHDCSLVVTGEGRLDSQSVHGKVPVGVARVAKKYRKPVIGIAGSLTHDVGVVHQHGIDAVFSVLTSVSTLEEAFRGAFDNIYRASRNIAATLQVGMTTEG

SEQ ID NO: 9341 - protein, 93 aa, Klebsiella pneumoniae
TCSCWAMRSRAPNVVTAVSVAKTAVASAASVVKAAVASVANVVKAVVVKDVVSAANVVKAVRRVVTMHPRRAAMTQPVAVASVAMRNQRRPLA

SEQ ID NO: 9342 - protein, 366 aa, Klebsiella pneumoniae
KRLRLPIPLKYLKKMKTNSYLYGALVALAVCAPAAAAETVHPAEHDDTKTPELTTTSYRFYGELGVGGYMDLEGEDKHKYSDGTYIEGGLEVKNGHWFGLIYGEAWTVQADSQGNAWTPGHSWGGVEGGLNRLYGGYKTDNNTEIMLSLRQDSSLDDLQWWGDFTPDLGYVIPNTRDIMYALKVQNRSGDFRYSVTATPAGHHDESKAWLHFGKYDRYDDKYTYPAMVNGYVQYDIVKDVTWMNGLEVTDGTGQLFLTGVLSPNLAFRAWHHTGRAKGLDVPGSETGFMASAMYEALSGLYFSTAYSYAKHRPDHAADETTAFMQFGIWYEYGGGRFATAADSRFYTSNASGDPSDKIFLMQYFYW

SEQ ID NO: 9343 - protein, 190 aa, Klebsiella pneumoniae
LAHRLAIPPARRAASPRVSCRQTAFLTQSGGFPHLLLCLNLRESTHSRSPTGTGISSGYPLRQWKVLSMKHRIALLLVLTSLSASALAASPCQEKEQDIQREISYAEKHHNQSRIDGLNTALRQVRENCSDSKLKADHQQKIAKQREEIAERQRDLQEARKKGDADKINKRQHKLNEAQQELKTLESRDY

SEQ ID NO: 9344 - protein, 338 aa, Klebsiella pneumoniae
KSNRTACRAISMSRRATVSCCCPEARGVQQREHQQLRLLTEDEMADLDDIKEGKEFGIDRPQQNTLYTLKGCGSLDWGMQSRLARIFNPHSNRTVMLAFDHGYFQGPTTGLERIDLSIAPLFADTDVLMCTRGVLRSQVPAATNKPVVLRASGGNSILSELSNECVAVAMEDALRLNVCAVAAQVYIGSEYEHQSINNIIKLVDAGNRYGMPVLAVTGVGKEMTRDARYFSLASRIAAEMGAQFVKTYFVEEGFEKVTASCPVPIVIAGGKKLPEHEALEMCWRAIDQGASGVDMGRNIFQSSAPRAMLKAVKKVVHENLNAREAYQFWQEEKQGELK

SEQ ID NO: 9345 - protein, 277 aa, Klebsiella pneumoniae
AFSRVATARLTWSTSDPESVVILTFTFIGHYDETNWSLQDYRMRSVTPSIESAVSRLAPGFRALSIVVESAPVADPAVAEQALAEACLAVQQDDVPWAQAHLAAWDEAFSAFGAKAKRTPCSAQALRKRVLKEGSLPAIDPVVDIYNAISIRYAVPVGGENLAAYRGEPRLAIARGDEPFDTLKSAEPVVEYPEPGEVIWRDDIGVTCRRWNWRQGVRTRLDSGAQTMWFILESLPAMPLSALHEAGERLVGYLQQLMPGARASITLLRADDEGDLR

SEQ ID NO: 9346 - protein, 174 aa, Klebsiella pneumoniae
RILRYPAHQGYHLKIDKEIEMLLRFRVLPLVFVISLLSGCGLASKAFYSAGDKLFQPGDDAVASMQTYSVAQFLQPFTLNPAKASSDYLGKWVKVRGVIVDIRRKSGIAGSYYFIVTMRDEQNKTDKRLTFNFGSHNSADVEALSNGSVATIVGQVHQVQDSTIPTLQNPKVVK

SEQ ID NO: 9347 - protein, 117 aa, Klebsiella pneumoniae
NEARSGLSPILTLEKKMNLPKALVLTVAATTFCLMTSPAFAVEETTPQNMTCQEFMDMNPKSMTPVAFWVVNRNTDFSGGDYVDWHEVETVSVPKMLQECHKNPAAKLGDLSAVIKK

SEQ ID NO: 9348 - protein, 118 aa, Klebsiella pneumoniae
ESERARSVSVLAGRETGRAEMNVTLVEINIKPERVDEFLEVFRANHEGALREPGNLRFDVLQDPEVKTRFFIYEAYKDDEAVLAHKKTPHYLACVEKLEEMMSQPRQKRSFIGLLPQV

SEQ ID NO: 9349 - protein, 321 aa, Klebsiella pneumoniae
RYGRCIVSQIFCPVCSNFLNEKAMAKERALTLEALRVMDAIDRRGSFAAAADELGRVPSALSYTMQKLEEELDVVLFDRSGHRTKFTNVGRMLLERGRVLLEAADKLTTDAEALSRGWETHLTIVTEALVPTPDLFPLIEKLATKSNTQLSIITEVLAGAWERLEQGRADIVVAPDMHFRSSSEINSRKLYSVLSVYVAAPDHPIHQEPEPLSEVTRVKYRGVAVADTARERPVLTVQLLDKQPRLTVSTIEDKRQALLAGLGVATMPYPLVEKDIAEGRLRVVSPEYTNEIDIIMAWRRDSMGEAKSWCLREIPKLFAGR

SEQ ID NO: 9350 - protein, 238 aa, Klebsiella pneumoniae
PTTLFNVAEKNAYYAPYLLMTLPFCLASFGYHGNVPSLMKYYGKDPRTIIRCLTYGTLLALGLYVVWLLVTMGNIPRPQFIDIAQKGGNIDVLVQALSGVLNSRSLDLLLVVFSNFAVASSFLGVTLGLFDYLADLFGFDDSAMGRFKTALLTFIPPMIGGLVKPDGFLYAIGYAGLAATIWAAIVPALLARASRKRFGSPQFRVWGGTPMIVLILLFGLGNAVVHILSSVNLLPVYQ

SEQ ID NO: 9351 - protein, 72 aa, Klebsiella pneumoniae
ISMRNCSVSAPTPGAAKFWIAGASGSTPSTMALRCCRWRADAAPRRYWRTIASAPVSFPPLHTARLNNENSR

SEQ ID NO: 9352 - protein, 90 aa, Klebsiella pneumoniae
SSVRFSMRFSACALQARADALEGNLFKMCSWGGRITRYWIKYCRDYASSAEAVKIGINAKQKTNCVKFNLIAPLLARFIPELTRFSAWRQ

SEQ ID NO: 9353 - protein, 161 aa, Klebsiella pneumoniae
LCSRKSVDWGRNWRRRRAGAGCPAVASLIMANTQHTQGPGQRVFSIGQRIVTLLVEMVETRLRLVVVELEEEKANLFQLLIMTGLTLLFAAFGLMSLLVLVIWAVDAQYRLHVMIATTVVLLLAAAIVGILTLRKARRSTLLRLTRKELENDRALLEEDKS

SEQ ID NO: 9354 - protein, 69 aa, Klebsiella pneumoniae
SHIRNLFAPSLDIPRAQNTFYNCFKWFLIYLKDDIEIVYSHIDHLKNMTQYNQHAPARHYAYPQYKVII

SEQ ID NO: 9355 - protein, 452 aa, Klebsiella pneumoniae
AEVSMPLIAGIDIGNATTEVALASDDPQARAFVASGIVATTGMKGTRDNIAGTLAALEQALAKTPWSMSDVSRIYLNEAAPVIGDVAMETITETIITESTMIGHNPQTPGGVGVGVGTTIALGRLATLPAAQYAEGWIVLIDDAVDFLDAVWWLNEALDRGINVVAAILKKDDGVLVNNRLRKTLPVVDEVTLLEQVPEGVMAAVEVAAPGQVVRILSNPYGIATFFGLSPEETQAIVPIARALIGNRSAVVLKTPQGDVQSRVIPAGNLYISGEKRRGEADVAEGAEAIMQAMSACAPVRDIRGEPGTHAGGMLERVRKVMASLTGHEMSAIYIQDLLAVDTFIPRKVQGGMAGECAMENAVGMAAMVKADRLQMQVIARELSARLQTEVVVGGVEANMAIAGALTTPGCAAPLAILDLGAGSTDAAIVNAEGQINGGPSRRGGEYGQPVD

SEQ ID NO: 9356 - protein, 62 aa, Klebsiella pneumoniae
TACSPARLSCSICATSALSVTKIHVDRYRSGGLPPEGEFSLTLQEPLCLNSFLTSAPASSTM

SEQ ID NO: 9357 - protein, 330 aa, Klebsiella pneumoniae
IFIRVQFMSEKRITEENRYAGLALAEEELVARVAWCYYHDGLTQNDIGERLGLPRLKISRLLEKGRQSGVIRVQINSRYEGCLALESELQQRFGLKIARVLPALNTPPMNTRLGIGAAQSLMGILQPGQLLAVGFGEATMSCLQHLSGFIGSQQVRLVTLSGGVGPYMTGIGQLDAACSVSIIPAPLRVSSAEVAEILRRESSVRDVILAATAADAAVVGIGAIDQRRDATILRSGYISEGEQLMYARKGAVGDILGYFLQADGRPVEGLEIHRELLGVTLDELAQLPTIVGVAGGEEKAQAIYAALIGKRINGLVTEETTARAVLTLAS

SEQ ID NO: 9358 - protein, 556 aa, Klebsiella pneumoniae
TMKRSKRFAVLAQRPVNQDGLIGEWPEEGLIAMDSPFDPVSSVKVDNGLIVELDGKRRDQFDMIDRFIADYAINVERTEQAMRLEAVEIARMLVDIHVSREEIIAITTAITPAKAVEVMAQMNVVEMMMALQKMRARRTPSNQCHVTNLKDNPVQIAADAAEAGIRGFSEQETTVGIARYAPFNALALLVGSQCGRPGVLTQCSVEEATELELGMRGLTSYAETVSVYGTEAVFTDGDDTPWSKAFLASAYASRGLKMRYTSGTGSEALMGYSESKSMLYLESRCIFITKGAGVQGLQNGAVSCIGMTGAVPSGIRAVLAENLIASMLDLEVASANDQTFSHSDIRRTARTLMQMLPGTDFIFSGYSAVPNYDNMFAGSNFDAEDFDDYNILQRDLMVDGGLRPVTEAETIAIRQKAARAIQAVFRELGLPPISDEEVEAATYAHGSNEMPPRNVVEDLSAVEEMMKRNITGLDIVGALSRSGFEDIASNILNMLRQRVTGDYLQTSAILDRQFEVVSAVNDINDYQGPGTGYRISAERWAEIKNIPGVVQPDTIE

SEQ ID NO: 9359 - protein, 297 aa, Klebsiella pneumoniae
MAVRNMKYSLGPVLYYWPKETLEDFYQQAANCSADTIYLGEAVCSKRRATKVGDWIEMAKTLAASGKQVVLSTLALVQASSELGELKRYVDNGEFLIEASDLGVVNLCAERKLPFVAGHALNCYNAVTLRLLRKQGMVRWCMPVELSRDWLANLLTQCEELGIRNQFEVEVLSYGHLPLAYSARCFTARSEDRPKDECETCCIKYPTGRSMLSQENQQVFVLNGIQTMSGYVYNLGNELTSMHGLVDMVRLSPMGNETFAMLEAFRANENGAAPLDLTSNSDCNGYWKRLPGLVLQA

SEQ ID NO: 9360 - protein, 394 aa, Klebsiella pneumoniae
PEARRYIMSYRMFDYLVPNVNFFGPNAISVVGERCQLLGGKKALLVTDKGLRAIKDGAVDKTLHYLREAGIEVAIFDGVEPNPKDTNVRDGLAVFRREQCDIIVTVGGGSPHDCGKGIGIAATHEGDLYQYAGIETLTNPLPPIVAVNTTAGTASEVTRHCVLTNTETKVKFVIVSWRNLPSVSINDPLLMIGKPAALTAATGMDALTHAVEAYISKDANPVTDAAAMQAIRLIARNLRQAVALGSNLQARENMAYASLLAGMAFNNANLGYVHAMAHQLGGLYDMPHGVANAVLLPHVARYNLIANPEKFADIAELMGENITGLSTLDAAEKAIAAITRLSMDIGIPQHLRDLGVKEADFPYMAEMALKDGNAFSNPRKGNEQEIAAIFRQAF

SEQ ID NO: 9361 - protein, 531 aa, Klebsiella pneumoniae
HLFGDDWTMADIAIRQQSPTAFYIKVDPTDNVAIIVNDRGLTAGTRFPDGLTLVEHIPQGHKVALVDIPAHGEIIRYGEVIGYAVRDIPQGSWIDESLVELPTAPPLNTLPLATKVPEPLPPLEGYTFEGYRNADGSVGTKNLLGITTSVHCVAGVVDYVVKIIERDLLPNYPNVDGVVGLNHLYGCGVAINAPAAVVPIRTIHNIALNPNFGGEVMVIGLGCEKLQPERLLQGTEDVKSIPVDSASIVSLQDEKHVGFKSMVDDILQVAERHLAKLNQRQRETCPASELVVGMQCGGSDAFSGVTANPAVGYASDLLVRCGATVMFSEVTEVRDAIHLLTPRAINEEVGKRLLEEMAWYDNYLDMGKTDRSANPSPGNKKGGLANVVEKALGSIAKSGKSAIVEVLSPGQRPTKRGLIYAATPASDFVCGTQQVASGITVQVFTTGRGTPYGLMAVPVIKMATRTELANRWYDLMDINAGTIATGEETIEDVGRKLFEFILDVASGRKKTFSDQWGLHNQLAVFNPAPVT

SEQ ID NO: 9362 - protein, 184 aa, Klebsiella pneumoniae
LNHGGRQNNADKNKASQPNGNSFLLSPLLTIRASVTLVRERMMNKSQQVQTITLAAAQQMAAAVEKKATEINVAVVFSVVDRGGNTLLIQRMDEAFVSSCDISLNKAWSACSLKQGTHEITPAVQPGQSLYGLQLTNQQRIIIFGGGLPVIFNEQVIGAVGVSGGTVEQDQLLAQCALDCFSAL

SEQ ID NO: 9363 - protein, 99 aa, Klebsiella pneumoniae
IVNGRQERERQKTQLLRQIQQQRLELSACRRHWHEATAPLDRGWHTLLSLRSWLMVGSGLMAVWSVRHPHFLMRWTKRGLGLWSTWRLVRGILRQSAVR

SEQ ID NO: 9364 - protein, 157 aa, Klebsiella pneumoniae
PADGGVGLCDGLLPCRLESGGARRAARVIDSGTHSARLAATHPGTIAVSGHAAGSDFLAARHDVHLLRRAGHGRDAQTAGVDGRGVGVLDGEPAAQSGDAGVYGFCSGLAVCAGSPGGGSGDSINCGDAGAEMGERGGDAAGSGACCTVGSDSGRLL

SEQ ID NO: 9365 - protein, 237 aa, Klebsiella pneumoniae
SGLGALIYACRSRGLLFSSDLSFGPLNKPSRFLFSVRPPTGICGAIMFMFSHYTLNAFSPRVFIRYKRHACLMAVLLFICGACCLAWPLVAGWYLATVTGMLLMICGFYSLYSLIVFRQQHWKSRLVALIFAIAWIVLGLSFVVNPLNGMSSLAILFGFLFVLGGISRIVNGCQTRKQSGAGWNIFIGLLDLLIACLWLAMNPQQSWLFITAFIGIEMIFSAIGLLVLRNKMKHAQA

SEQ ID NO: 9366 - protein, 177 aa, Klebsiella pneumoniae
PPPGIQSRYAYVYGKLHQRQRTDNRPAQRHQSARQPQRFGREGFTQHNQRRHAHCRQCDEQRQRGRRPHTRQHHCLHNRNFRRGRDHKQAAGDRHRDNPEQRIIHHAIGVREQPDARRSQHQHREDINRDRVPEQRPQRLKPAAKEAALSRFRRCSRHRYRLRRRLFHPFLHQRRHS

SEQ ID NO: 9367 - protein, 524 aa, Klebsiella pneumoniae
SSHGCKYSSPSTLLNIIKFKNHLFKRGATMKPLLEARQIRKQFSGVAVLKGIDFTLCAGQVHALMGGNGAGKSTLMKIIAGVETPDNGELTIGDRAFARLSPALAHQLGIYLVPQEPMLFPNLSVRENILFRLPKRADTTARLQEKLQQLNCQINLDASASTLEVADQQMVEILRGLMREARILILDEPTASLTPGETERLFSQIRALQALDVGIVFISHKLPEIRQLASHISVMRDGAVVLSGETATYRDEQLISAMTPASRDHTLSDTQKLWLALPGNRRTQAQDFPVLRVEDLTGEGFIDLNLEIRAGEIVGLAGLVGSGRTEFAETLYGLRPPRAGRIWLENREISNDSTRARLASRLVYLPEDRQVSGLFLDAPVRWNTVMFNQPSWWQQGKREAAVVERYHRALGIKLADGDQPVRTLSGGNQQKVLLARCLEANPLLLIVDEPTRGVDVSARADIYQLLKSVAAQNVAVLMISSDLDEFIGLADRVLVMHQGRYSGELARQAVTVDRMMTLAFGGQA

SEQ ID NO: 9368 - protein, 343 aa, Klebsiella pneumoniae
KRSGCRLPTSAVLFLCKEYQMNTVGTPLLWGGFAVVVAIMLAIDLLLQGRRGSHSMTMKQAAGWSILWVTLSLLFNAAFWWYLVQTQGRAVADPQALAFLTGYLIEKALAVDNVFVWLMLFSYFAVPPALQRRVLVYGVLGAIVLRTIMIFAGSWLISQFDWLLYVFGAFLLFTGVKMALAKEDESGIGDKPLVRWIRSHLRMTDKIESERFFTRKNGVLFATPLLLVLILVELSDVIFAVDSIPAIFAVTTDPFIVLTSNLFAILGLRAMYFLLAGVAERFSMLKYGLSVILVFIGVKMLIVDFYHIPVAISLGVVGGILAVTLLINAWVNRQHDKQRKLPE

SEQ ID NO: 9369 - protein, 482 aa, Klebsiella pneumoniae
MIGGRMSESVRAKIGKFALLSMAFAAVFNVRNIVNNNIELGLSSAPIFLFATIVYFIPFVFIIAEFVSANKHSESGMYAWLKQPMGTRAAYLGSFLYWFVNLFFFLSLLPNVVAYASYAITGYAIPFSPMVTSLISIVLFAMATHISTKGATWLGKISECVAYGVFALFAIYVVGALTALGSGHVPAQPITLAAMEPTINWATLGIMCWIFQAAGGAETVAAYLNDTKGGQKSFIKVIITAGVLIGGMYALGSLLVNVFVARENLTYAGGMVEIFTGLGAYFHISEALMGRFVGIILFIAIFGSMMMWTAAPVKIHFSEIPKSIYGQKTTELNAHGVPVRAAWWQFLFVFLMLIVNGFGSASVQQMMNTAINLTAGTAMLPPLFIMAAYFVFRWKHDDTPRDFRMGSRKVGMSVVSMLIVIFVVSMTASAFPPGVDLVNAFFINVFMTAVFSGLAWWWITRFEKKQQRLRAAAPVNAAAAGK

SEQ ID NO: 9370 - protein, 334 aa, Klebsiella pneumoniae
SEGGAKMGQLVDGVWQDTWYDTKSTGGRFKRSVSAFRNWLTADGAAGPSGEGGFAAEKDRYHLYVSLACPWAHRTLIMRKLKGLEPFLPVSVVNPLMLENGWTFDDSFPEATGDTLYQHDFLYQLYLHADPHYTGRVTVPVLWDKKQQTIVSNESAEIIRMFNTAFDGLGARAGDYYPPALREQIDELNGWIYDNVNNGVYKAGFATSQQAYDEAVDAVFTSLERLEQILGQHRYLTGNQLTEADIRLWTTLVRFDPVYVTHFKCDKRRISDYLNLYGFLRDIYQMPGIAETVSFPHIRHHYYRSHKTINPTGIISIGPQQDLNEPHGRDQRFR

SEQ ID NO: 9371 - protein, 1036 aa, Klebsiella pneumoniae
AVQGGDMNRWENLQLTHENRLPPRAYFFSYDSLAQARTFAREISSRFLSLSGQWNFRFFTNPLLVPESFTSCYQNEWGPITVPGMWQMEGHGQLQYTDEGFPFPIDVPYVPTDNPTGAYQRLFTLGDGWQGKQTIIKFDGVETYFEVYVNGQYIGFSKGSRLTAEFDISAAVKTGDNLLCVRVMQWADSTYIEDQDMWWSAGIFRDVYLVGKNPLHVQDFTVRTDFNDDYIDATLSCQLTLENLAPQTAAATLEYTLFDGEKALYSGNVGQLQVSQQLNTGFTIDVSAPQQWSAESPYLYHLVLTLKNAAGEVLEIIPQRVGFRDIKVRDGLFYINNRYVMLHGVNRHDNDHLKGRAVGMDRVEKDLLLMKQHNINSVRTAHYPNDPRFYEMCDIYGLFVMAETDVESHGFANVGNLSAITDDPAWEHIYVERIVRHVHAQKNHPSIVIWSLGNESGYGCNIRAMYHATKALDDTRLVHYEEDRDAEVVDIISTMYTRVPLMNEFGEHPHEKPRIICEYAHAMGNGPGGLTEYQNVFYQHDCIQGHYVWEWCDHGIQASDENGAVWYKFGGDYGDYPNNYNFCLDGLIFSDQTPGPGLREYKQVIAPVKVQARDICRGELRVENKLWFSTLDDYTLRVEVRAEGETLSSQLLKVKDLAPNSGRDLQIALPQLDEREAFVNIMVTKDSRTPYSEANHDIAVYQFPLKARTAARTPLLNASATPLQIVDERLSYTICGHNFRVVFSKVSGKLSEWQVNSVDQITREPKINFFKPMIDNHKQEYEGLWQPAHLQIMQEHLREFSAEIEGETVVITTRSVIAPPVFDFGMRCTYRWQITPQGHIKVELAGERYGDYPHIVPCIGFMLGINGEFDQVNYYGRGPGENYADSQQSNIIDIWHTTVDDMFVNYPFPQNNGNRQHVRWASFSDRHGSGLLVVPRNPLNVSAWHFTAENLHAAQHCNELQRSDDITLNIDAQLLGLGSNSWGSEVLDSWRVWLNTFNYGFTLLPLEGGCGTSQVLANHSFGAGFFSPVAHSEAEQ

SEQ ID NO: 9372 - protein, 162 aa, Klebsiella pneumoniae
FHFMLRLFYARKDAARSRAPIHGAGSANAPSPPQPTAPLTARSTPGWGCRPSVNPVADTPPAMPPARYPVSIPSRRKYWPRRAPPRSAPASAGRGLNPNVPSRNRRPSPAPRPPRRRQPGHTARTGCRSPTARHSARRAGFARVKRGGGQSARDGSAARRKR

SEQ ID NO: 9373 - protein, 176 aa, Klebsiella pneumoniae
MYRIYTRTGDKGTTALYGGSRIKKDHIRVEAYGTVDELISQLGVCYATTRDAGLRESLHHIQQTLFVLGAELASDARGLTRLSQTVGEEEITALERLIDRNMAESGPLKQFLIPGRNLASAQLHVARTQSRRLERLLTAMDRAHPLRDVLKRYSNRLSDALFSMARIEETKPDACA

SEQ ID NO: 9374 - protein, 341 aa, Klebsiella pneumoniae
YEIIIFIRSASQRDIMSHQLTFADSEFSTKRRQTRKEIFLSRMEQILPWQNMVEVIEPFYPKAGNGRRPYPLETMLRIHCMQHWYNLSDGAMEDALYEIASMRLFARLSLDSALPDRTTIMNFRHLLEQHQLARQLFKTINRWLAEAGVMMTQGTLVDATIIEAPSSTKNKEQQRDPEMHQTKKGNQWHFGMKAHIGVDAKSGLTHSLVTTAANEHDLNQLGNLLHGEEQFVSADAGYQGAPQREELAEVDVDWLIAERPGKVKTLKQHPRKNKTAINIEYMKASIRARVEHPFRIIKRQFGFVKARYKGLLKNDNQLAMLFTLANLFRVDQMIRQWERSQ

SEQ ID NO: 9375 - protein, 120 aa, Klebsiella pneumoniae
IDTMKIEHGAVVTQRLVKLLFAGDLFGDIKLTADLRERIKQRDVMTAGGSVYGEGQTGRPGADHRQPFRRVGRQDRHQGFMTRARVDQTGGDFADEDPIETRLIAADAGVDLIGAIGLRF

SEQ ID NO: 9376 - protein, 194 aa, Klebsiella pneumoniae
GEHMKALSPLAILLSALLLQGCVAAAVVGTAAVGTKAATDPRTVGTQVDDSTLELRVNSALSKDEQIKKQARINVTAYQGKVLLTGQSPTPDLSARAKQIAMGVEGTTEVFNEVRQGQPIGLGTASSDTWITTKVRSQLLSTDQVKSSNVKVTTENSEVFLMGLVTDREGRAAADIASRVSGVSRVTTAFTYIK

SEQ ID NO: 9377 - protein, 125 aa, Klebsiella pneumoniae
GVEMDWYLKVLKNYIGFGGRARRKEYWMFILVNLILTGVLSIIDKMLGWQRAGGEGILTTIYGVLVFLPWWAVQFRRLHDTDRSAWWLLLLLIPVIGWLVILIFNCQRGTEGNNRFGPDPKPFSY

SEQ ID NO: 9378 - protein, 150 aa, Klebsiella pneumoniae
TMRILDNLEQFKQVYHSGRKWQRCVEAINNIDNIRPGVAHSIGDSLSYRVETDSTTDALFVGNRRYFEVHYYLQGQQKIEFAAKENLQTVACYRDETDREYLKGIGETVKVHEGQMVICDIDEAYRFICDAPVKKVVLRVTVEDGYFLNK

SEQ ID NO: 9379 - protein, 149 aa, Klebsiella pneumoniae
GMLIRVEIGIDAPGIDALLRRTFGRDAEAQLVHDLREDGLITLGVVATDDEGQVIGYVAFSPVAVEGEELQWVGLAPLAVDERYRGQGIGRQLVYEGLDSLNEFGYAAVVTLGDPDLYRRFGFEPAAAFRSPLPLAGQRRGVPGSPSGG

SEQ ID NO: 9380 - protein, 330 aa, Klebsiella pneumoniae
RKKMATLKDIATEAGVSLATVSRVLNDDPTLNVKEETKHRILEIAEKLEYKSSSARKTQVLPVGHHHILALYSYQQELEINDPYYLAIRHGIETQCEKLAIELTNCYLNNTLPELKKVTGVLIIGQPTRELRETASALTDNICFIDFHEAGSPYDAVDIDLVRIAKEVVDFFIQQGASRIGFIGGQDQPGKADIREVAFVEYGQLKGVVSADDIWRGGFSSSSGYELAKQMLAQAEFPRALFVASDSIAIGVLRAIHERGLAIPEDISLISVNDIPTARFTFPPLSTVRIHSEMMGSQGVNLLLEKARDGRALPLNVFVPSVLKLRGTTR

SEQ ID NO: 9381 - protein, 443 aa, Klebsiella pneumoniae
CGKITDDEVYMRKIKGLRWYMIALVTLGTVLGYLTRNTVAAAAPTLMEELHISTQQYSYIIAAYSAAYTVMQPVAGYVLDILGTKIGYAFFAIAWAVFCGSTALAGSWGGLALARGAVGAAEAAMIPAGLKASSEWFPAKERSIAVGYFNVGSSIGAMIAPPLVVWAIVMHSWQMAFIISGVLSFAWAIAWLIFYKHPRDQKKLSDEERDYIIGGQESQHQTNNAKKMSPWQILRNRQFWGIALPRFLAEPAWGTFNAWIPLFMFKVYGFNLKEIAMFAWMPMLFADLGCIVGGYLPPLFQRWFGVNLIVSRKMVVTMGALLMIGPGMIGLFTSPYVAIALLCIGGFAHQALSGALITFSSDVFGRNEVATANGLTGMAAWLASTMFALVVGALADTIGFSPLFAVLAVFDLLGALVIWTVLKNKPADDDSTPLSSRKPVTQS

SEQ ID NO: 9382 - protein, 132 aa, Klebsiella pneumoniae
QETVMAQVPAGKNRSGQLSKQTGDAWENQARRWLEGQGLRFIAANARERGGEIDLIMRDGTVTVFIEVRYRRSARYGDAAASVTPQKQQRLLKAARLWLCRQNGSFETVDCRFDVVAFTGNDIQWLKNAFGE

SEQ ID NO: 9383 - protein, 360 aa, Klebsiella pneumoniae
ACTVNGCARPGGVFSRIKQSEHKMKLKLIVLALAMSVVTAQAADRIAFIPKLVGVGFFTSGGNGAKEAGKALGVDVTYDGPTEPSVSGQVQLINNFVNQGYNAIIVSAVSPDGLCPALKRAMQRGVKVLTWDSDTRPECRSIYINQGTPQQLGGLLVEMAEKQVTKPTAKVAFFYSSPTVTDQNQWVKEAKAKIEKEHPQWQIVTTQFGYNDATKSLQTAEGILKAYPDLDAIIAPDANALPAAAQAAENLKRQGVAIVGFSTPNVMRPYVERGTVKAFGLWDVVQQGKIAVNVADRLLKKGDLNVGDSVEVKDIGSLKVEPNSVQGYQYEPKGNGIVLLPGGAWCSAKRTSTTTTSDGG

SEQ ID NO: 9384 - protein, 201 aa, Klebsiella pneumoniae
PMNVKVNITTDSGSDVDQVSRAVATRLKAYRKAKKMSLDELSRRASISKGMLVEMEKEAANPSIAILCKLAAALGVSVADIVNVASEPALHIIPAEQIPTLWQGPLGGSARLLAGTAGPNMIELWRWEMQPGEAFTSPGHPATTFELLHVEAGALTLTLGETCRTVAAGESVVARTEIEHGYRNEGTAPLVFTMTVAELPS

SEQ ID NO: 9385 - protein, 837 aa, Klebsiella pneumoniae
NHRVYAIWHLVRIRRRAFRHRRRQPFLYQQRQRRPERQNFPDAILLLVTRSRDTMNFTTTLTPLACALMLSFSAHAVTAQAFKNVIDRSGAPQYIQDFDADDHQRFNPFFDLGAWHGHLLPDGPATMGGFPGPALLTEEYINFMATNFDRLTVYQNGKKVDFTLQAWSLPGALKQTLTAPGVKVEMTLRFASAHTSLLETKITSNTPLKLVWDGELLEKLAAKEGKALSDKTIDEAFPDYQRRVSATPDGLTVSFGKVRAASDLMTSGESQYQIHRSLVTETRIDGHRFTSSAEIRGSTTLYTTYSHLLTAEQARREKAQIRDILARPAYYLTASEQRWDGYLQKGLSNPDATAEQTRVAVKAIETLNGNWRAPGGAVHYHTVTPSVTGRWFSGNQTWPWDTWKQAYAMAHFNPDIAKENIRAVFSWQIKANDKVRPQDAGFVPDLIAWNLSPERGGDGGNWNERNTKPSLAAWSVMEVYNVTKDKAWLEEMYPKLVAYHDWWLRNRDHNGNGVPEYGATRDKAHNTADGAMLFTVKKGQTEQTLSGLSAYEQVTAKGDYDSLEIPAQVAASWESGRDDAAVFGFIDKEQLDKYVANGGKRSDWTVKFAENRDRDGNLLGYSLLQESVDQASYMYSDNHYLAQMATILGKAEEAKRYQALAAKLADYINTCMFDPQTRFYYDIRIEEQPLANGCAGKPIVERGKGPEGWSPLFNGAATQQHADDVVSVMLDPKEFNTFVPLGTAALTNPAFGADIYWRGRVWVDQFWFGLKGMERYGHRDEALKLADAFFQHAKGLTADGPIQENYNPLTGAQQGAPNFSWSAAHLYMLYNEFFRKP

SEQ ID NO: 9386 - protein, 345 aa, Klebsiella pneumoniae
PFSVPDGPHFSGKIMELLCPAGNLPALKAAIENGADAVYIGLKDDTNARHFAGLNFTEKKLQEAVSFVHQHRRKLHIAINTFAHPDGYARWQRAVDMAAQLGADALILADIAMLEYAAERYPHIERHVSVQASATNEEAIRFYHRNFDVARVVLPRVLSIHQVKQLARATPVPLEVFAFGSLCIMAEGRCYLSSYLTGESPNTVGACSPARFVRWQQTPQGLESRLNEVLIDRYQDGENAGYPTLCKGRYLVDGERYHALEEPTSLNTLELLPELMAANIASVKIEGRQRSPAYVTQVAKVWRQAIDRCKADPQNFVPQSAWMETLGAMSEGTQTTLGAYHRKWQ

SEQ ID NO: 9387 - protein, 487 aa, Klebsiella pneumoniae
AFGVLEEGVRQLQRLIAMTVALHSLQAEPELIHPHPSAPVNIGAKGRVGQRGGAQRHKGVELFRVEHHRNHIVSMLLRRRAVKQRRPAFRPFAALDDRFTGAAVGQRLFFDTNVVIETSLRVEHASIDIIRQLRRQRLIALCLFRFAKNCRHLRQIVVIAVHIAGLIDRFLEQRIPQQVAVAVAVFGEFHRPVAAFAAVGDVFIQLFFIDKTKYRRIVAPGLPRRRYLRRDFEAVVIAFGRHLFVGAKARKRLLGLPFFHREQHGAVGGVVRLIAGRAIFRHAVTVMVAIAQPPVVIGHQLRIHLFQPRFIFGDVIHLHHRPGREAWLGVAFVPVAAVAAALGAQVPGNQIGHKSGVLRAHLIIGFNLPGEDGADILFGDIRVEVGHGVGLFPGIPRPGLVAGEPAAGHGWGDGMVMHRAARRAPVAVERLNSFHRHAGLFGGSVGVAEPFLQITVPALFRGGEIVSRARQNIADLRFFPPRLFRGE

SEQ ID NO: 9388 - protein, 578 aa, Klebsiella pneumoniae
SAKVRTESSTAAKRSQGIKPCATSGCRWWTPCASPASSTCRSPPRWMPPAKWPSVRPTPPSLCRRVKAAPAISASAASDIRIPARPRCCLWFRCWPPPPKSKEIAMVNLVIVSHSARLGEGVGELARQMLINDGCKLAIAAGIDDPDSPIGTDPLKVMEAIESVADTDHVLVMMDIGSALLSAETALDLLDPAIAAKVRLCAAPLVEGTLAATVSAASGAGIDKVIADAMSALEAKRVQLGLPSPTSDAAPAPMLADDGDTKSVSVIINNHNGLHVRPASKLVAALAGFNADLLLEKNGKCVKPDSLNQIALLQVRRNDKLRLLARGPDADAALAAFQALAADNFGESPAAQPAAAPATPERVEGAALRYPLALIQPLRPAAADAAREQQRLRQAIDQTLADLIALTELAENKFNADIAAIFAGHHTLLDDDDLFDAANDRLLTEQCTAEWAWHQVLMELSQQYRQLDDPYLQARYIDIEDILQRTLRHLQGVQERVPTPGEPTIIIADNIYPSTVLQLDASFVKGLCLRDGSEQAHGAIIARAAGIAWLSQQGEALNSVQPGETIVLDMRHQRLIRD

SEQ ID NO: 9389 - protein, 220 aa, Klebsiella pneumoniae
MELFTQLLNALWAQDYETLANPSMIGMLYFVLFMILFLENGLLPAAFLPGDSLLVLVGVLIAKGAMGFPETLLLLTAAASLGCWLSYIQGRWLGNTRIVQNWLSHLPSHYHQRAHHLFHKHGLSALLIGRFIAFVRTLLPTIAGLSGLNNARFQFFNWMSGLLWVLILTSLGYLLGKTPVFLKYEDQLMSCLMLLPVALLVFGLIGSLVVLWKKKYRSRG

SEQ ID NO: 9390 - protein, 148 aa, Klebsiella pneumoniae
SAISATFTSGKKMKLITRIAFATLLTTGFSITAQAADVKAAPAPAQDPIVQHLKLTNDQVAKIKSLHQQLESNVQQISQQEIKDGALINVIDSGKWDEKAVNDQLAAFSKIDQQVRYYRVKYYFEVNKVLTPEQRTQVKKDLADALNE

SEQ ID NO: 9391 - protein, 229 aa, Klebsiella pneumoniae
PRSSPAWRGGGSPALKKSSNVYAPQRRLTLPLPVNNVPFVPSAPRRLAGFFYPSPDYVLLNLFRDRVKAIRFLYFYLLKVLLKSTLILNYLYPTNNTTPFSDPLKDNVWRCVMSDTKRNTIGKFGLLSLTFAAVYSFNNVINNNIELGLASAPMFFLATLFYFIPFCLIIAEFVSLNKNSEAGVYAWVKSSLGGRWAFITAYTYWFVNLFFFTSLLPRVIAYASYAFLG

SEQ ID NO: 9392 - protein, 108 aa, Klebsiella pneumoniae
CCASSSLPPHSDPPPRYAAASRCCRARRWRPPPPRRRLAAAPARGKPPGSPAPLSGEWQWFPPRSPDAGRRQPSGHAAGCCNHQNLPHRSSSRRTCCRSSAPRCSRRK

SEQ ID NO: 9393 - protein, 195 aa, Klebsiella pneumoniae
QWGSMHYLQRDARREGIMQAAMRLALRGGFAAMTVRQIAREAQVAAGQLHHHFTSIGELKAQVFIRLIREMLDMPLVAEDASWRERLFSMIGSEDGRLEPYIRLWREGQVLADSDPDIKAAYLLTMNMWHAETVAIIEQGLASGEFRSAEPAADIAWRFIALVCGLDGIYALDAQALDEAAFSRYVNKMITLELF

SEQ ID NO: 9394 - protein, 125 aa, Klebsiella pneumoniae
TKISKISINNTLQEQVNKMRKIFLCCAAGMSTSMVMNKMKQAAAAQGIAVDIIAVSMDDFDRTLPNYDCCLLGPQIKYKFEEFNKKAAAVGKRVAVIDSMDYGMMRGDKILAAALALLDEPSLNK

SEQ ID NO: 9395 - protein, 280 aa, Klebsiella pneumoniae
RAVSPAPGANATGDRSELGRDGNHPSGYRMLITDTLSPQAFEEALRAKGAFYHIHHPYHIAMHNGDATREQIQGWVANRFYYQTTIPLKDAAIMANCPDAQTRRKWVQRILDHDGSHGEDGGIEAWLRLGEAVGLSRDDLLSERHVLPGVRFAVDAYLNFARRACWQEAACSSLTELFAPQIHQSRLDSWPQHYPWIKEEGYFYFRSRLSQANRDVEHGLALAKAYCDSAEKQNRMLEILQFKLDILWSMLDAMTMAYALQRPPYHTVTDKAAWHTTRLV

SEQ ID NO: 9396 - protein, 214 aa, Klebsiella pneumoniae
KSHSGGRPMKEYLPETASQTAGPYVHIGLAPDAAGFHIFEKNFGPVLTTADTVGERITIEGRVIDGSGTPVRDVLLEIWQANAAGRYNHPDDRQQQKAVDPAFRGWGRTCSDFTSGIWRFETIKPGPVVGRDGRLMAPHVNLWVVARGINIGLNTRMYFADEHAANASDPVLNLIEWEVRRKTLIAEREVRGTEVVYRFDIHLQGENETVFFDI

SEQ ID NO: 9397 - protein, 448 aa, Klebsiella pneumoniae
EDSSMSTLITDKVDNAAVQKEKLDTSAYLPHTPWLQFLLVCCLFALWGMAGNLNDILIAQFKKGFDLTDTQTALVQSIFFLGYFFVALPAAALIKRFSYKAAIIIGLCLYALGCFLFVPAAQIMTYGAFLACLGVIACGLSFLETSANTYSSLLGPIQSSTQRINFSQIFNSLGVISGVLIGQLMVFGENDPSHEQLLAMPAAAADVARHQMVGQVVGPYLIIGSVLVVLALVFVFIKFPSCKGAPAQQQQLPTESMGPTLKRLFAIPRFRLGILSQFLYVGAQVGVWSFTIRFVQLVQQGTSEHSATYWLLASLVIYAVGKTVATWLMNRLNPAMLLGTFALAATALLLIAVFSGSMLAVYALILVSFCMAPCWPTNFGLVIKGMGKDTQTAGSIVVMSIIGGAVIPLVMGIISDMNGGNMQIAFIAPLLCFVYVAFYGFWCVRKGV

SEQ ID NO: 9398 - protein, 320 aa, Klebsiella pneumoniae
RWRFQLANAGIQGVPGQHRESVRSDSMAMETQDIIKRSATNPITPAPRARDYKAEVAKLIDVSSCVGCKACQVACSEWNDIRDDVGHCVGVYDNPADLSAKSWTVMRFSETEQNGKLEWLIRKDGCMHCAEPGCLKACPSAGAIIQYANGIVDFQQENCIGCGYCIAGCPFNVPRLNKEDNRVYKCTLCVDRVSVGQEPACVKTCPTGAIHFGTKKEMLEVAEERVAKLKKRGYANAGIYNPPGVGGTHVMYVLHHADQPELYHKLPKEPQIDTSISLWKGALKPLAAAGFIATFAGLIYHYIGIGPNKEVDDDEEKHDE

SEQ ID NO: 9399 - protein, 165 aa, Klebsiella pneumoniae
KRSSPMYTITDIAPSDAEFIALIAALDAWQETLYPAESNHLLDLSQLPPQTVIALAIRSPQGEAVGCGAIVLSEEGFGEMKRVYIDPQHRGQQLGEKLLAALEAKARQRDCHTLRLETGIHQHAAIALYTRNGYQTRCAFAPYKPDPLSVFMEKPLFADLRSAAL

SEQ ID NO: 9400 - protein, 205 aa, Klebsiella pneumoniae
SMPSIIIKTADELARQRHAGQLLASVFDMLDTFIVPGVTTMAINDRVEDFIVNQLHARPASKGQYDFPYVLNTSINDVVCHGIPKATEHLRSGMIVNVDITLEKAGMIADSSKMYLIGDVSPLARRLVKTTYEAMWKGIEVVKPGATLGDIGHAIQRWVEEHGYSVVREYCGHGVGQEMHEEPQVLHYGRPGRRRRAAGRHGVHH

SEQ ID NO: 9401 - protein, 397 aa, Klebsiella pneumoniae
TLLSMAQTPVMDVGTKSYISHQEQKMTATVEQIESWIVDVPTIRPHKLSMTTMGCQSLVIVRLTRSDGICGIGEATTIGGLSYGVESPEAISSAITHYLTPLLKGQPADNLNALTARMNGAIKGNTFAKSAIETALLDAQGKALGLPISALLGGALQTALPVLWTLASGDTAKDIAEGEKLLAEGRHRAFKLKIGARELATDLRHTRAIVEALGDRASIRVDVNQAWDAATGAKGCRELAAMGVDLIEQPVSAHDNAALVRLSQQIETAILADEAVATAYDGYQLAQQGFTGAYALKIAKAGGPNSVLALARVAQAAGIGLYGGTMLEGTVGTVASLHAWSTLPLQWGTEMFGPLLLKDDIVSVPLTFADGQVALPQTPGLGVELDEDKLHFYTRQP

SEQ ID NO: 9402 - protein, 329 aa, Klebsiella pneumoniae
RPSSTSAILAHRILMVGKEPRVATVINNAMLEAILAEIRPLIGRGKVADYIPALASVSGDKLGIAISTVNGQHFAAGDAHERFSIQSISKVLSLVVAMNHYQEEEIWQRVGKDPSGQPFNSLLQLEIEQGKPRNPFINAGALVVCDMLQSRLSAPRQRMLEIVRRLSGVADIAYDPVVARSEFEHSARNAAIAWLMKSFGNFHNDVATVLQNYFHYCSLEMSCVELARTFLFLADRGIAPHLDAPVIAPIQSRQVNALMMTSGMYQNAGEFAWRVGLPAKSGVGGGIVAIVPQEMAIAVWSPELDDAGNSLAGVAMLEKLTQRMGRSVF

SEQ ID NO: 9403 - protein, 106 aa, Klebsiella pneumoniae
FLPSSQDQCRSRCGRLCRPRRPAPARGGQRRHRSRRPSPSCRRRPLSRRRPIPARRASIAGTPPAPRQWPEHRRRRWWTTPSRRCPASDGRRGRSRRTGSPAPGRH

SEQ ID NO: 9404 - protein, 86 aa, Klebsiella pneumoniae
ISQSLFASQAGSTAAESGWINGCMSEVFISSFSYQVAVGRTISEKRQVLDMRKSSVTSRSSLPSIAAVCHSTSSGFTSSLAPSSSP

SEQ ID NO: 9405 - protein, 67 aa, Klebsiella pneumoniae
TIWSANSSASRRSWVTYRAVMPSCRSRRLISPHSDSRSSLSRLESGSSNSSTRGAATIARASATRCC

SEQ ID NO: 9406 - protein, 208 aa, Klebsiella pneumoniae
TNRSTTVCSMNRHSDCDTREHILATGEQLCMHRGFTGMGLSELLKTAEVPKGSFYHYFRSKEAFGVALLEHHYTGYLQRLVDHFDHGDGNYRDRLLAYYQHTLNQFCQQGIISGCLTVKLSAEVCDLSEDMRAAMDRGASQIIALLGDALEKGRQEGSLAFDGEAMTLSQVLYSLWLGANLQAKITRSATPLESALAHAKQIIAAPAV

SEQ ID NO: 9407 - protein, 85 aa, Klebsiella pneumoniae
RAFPLRKGVPGLHLTGRQPSGGVMQRCILAILSLAFCAGAQAVSEDVQLNLVTTQGVGQTIGSVKITETRPRTRVRPHSAGATAG

SEQ ID NO: 9408 - protein, 322 aa, Klebsiella pneumoniae
WISPCSRSRSVWPWYCSLPGDLPVMKRLKYLSTLLVAAVALIAAWLLWNFYTQSPWTRDGKVRAEQVGITPQVSGSILQLNVTDNQRVKAGEVLFTIDDTPYRIAVLNAQAQLAKAQAEVAKAQAEQSKAASEARRRRSLSQNAISAEDLENVNTALNTATTTLAAARAGVGVTEAALKHARWQLSQTVVKAPVDGWVTNLSTRVGDYATTGHPVFALVDSHSFYVLGYFEETKLRHIRIGDPAQIILYSNQQTLKGHVASIGRAIVDQSVEQGTGLVANIKPNIPWVRLAQRVPVRIAFDTLPADVTLVSGTTCTVSIGGQ

SEQ ID NO: 9409 - protein, 276 aa, Klebsiella pneumoniae
GSTPGGSSFDMIMAGAKSEMPGSIDKAPRHDEATGWSSTAISYQRGEADPPHHHVEGQLLFATRGVMLVQTESDRWVIPPQRALWLPPLHIHSYHLLSQTDLRAIYFSSSLIAECTSFTKSQQVHVITATPLVKELIAGLFSEDYARPSQRKIALLLLEILSEAPPLTMALPMPNDERLFSAARSLLVNQRWEASLSELAFMSAMSERTFSRLFMKDTGFSFRTWKQRARICASLDLLANGVPIKQVAYQLGFSCPAAFTAAFRCILGATPRDFVP

SEQ ID NO: 9410 - protein, 352 aa, Klebsiella pneumoniae
PVRPTLTPAIIDKELIMVKVGINGFGRIGRNVLRAALNNPDIQIVAINDLTDSKTLAHLLKYDSLLGKLDAEVTAGEGGLVVDGKPITVFSERNPASIPWRQCEVDIVIEATGLFTDREKAAVHIHSGGAKRVIISAPGKNDDLTIVMGVNESLYSPDKHYVISNGSCTTNGLAPAAQVLHQHFGIKHGLMNTTHAYTNSQALHDQPEKDLRGARAAALSIVPYSSGAAKALGKVIPELDGRLTGYSLRVPVPVVSIVDLTVTLERDVTVEEVNNAFREAAAAGPLKGILGYSDEPLVSSDYQGDPRSSIIDGLSTLVIGGNMVKILAWYDNEWGFSNRLVDLALMMAKRES

SEQ ID NO: 9411 - protein, 405 aa, Klebsiella pneumoniae
ITSPELMTTNTVSRKVAWLRVVTLAIAAFIFNTTEFAPVGLLSDIADSFGMETAQVGMMLTIYAWVVALMSLPFMLLTSKVERRRLLIGLFILFIASHVLSFFAWNFDVLVISRIGIAFAHAVFWSITSALAIRMAPPGKRAQALSLIATGTALAMVFGIPIGRIIGQYFGWRMTFLAIGLGALATLACLVKLLPTLPSEHSGSLKSLPVLFRRPALVSVYILTVVVVTAHYTAYSYIEPFVQTVAGLSGNFATVLLLILGGAGIIGSILFGKLGNQHASGLISLAIALLLACLLLLLPASHNPQHLMLLSIFWGVAIMIIGLGMQVKVLASAPDATDVAMSLFSGIFNIGIGAGALVGSQVSLHLSMASVGYVGAIPALVALVWSLMIFRRWPVSLEDHQPHHS

SEQ ID NO: 9412 - protein, 224 aa, Klebsiella pneumoniae
LTMFDLFKAIGLGLAVLLPLANPLTTVALFLGLAGNMNNAERNKQALMASVYVFAILMVSWYAGQVVMNTFGISIPGLRIAGGLIVAFIGFRMLFPQQKAHDSMEAKIKSEELQDEPTANIAFVPLAMPSTAGPGTIAMIISSASTVKHGVDFPEWVVLAAPPIIFLLLGVILWACLRSSGAIMRLVGKGGIEAISRLMGFLLVCMGVQFIINGVLEIISTWHP

SEQ ID NO: 9413 - protein, 249 aa, Klebsiella pneumoniae
AIMFDLHTISFLLIFIAAGLVKGVTGMGLPTVAMGLLGLLMPPQAAAALLVLPSLLTNLWQLLAGPALAQIVRRLWLMMTGIIIGTLAGSSLLIGLNPRWSALALGAALIVYAGYALCSPVFQVSGRVEKWLSPLMGGLTGVITGATGVFVIPAVPWLQALGFRRDELVQALGLSFTLSTLALAAGLALHDGWHDDAWLLSALALLPALLGMWLGQRIRSRLSPQRFRQGFLLFLLALGIELIARGWLV

SEQ ID NO: 9414 - protein, 399 aa, Klebsiella pneumoniae
PLIPMSTSVSTTQLNLRIISIVVFTCICYLSIGLPLAVLPGYIHYQLGYSTFVAGIVISLQYISTLVSRPHAGRYTDIWGPKKVVSLGIVCCLLSGAFTLLAVVLQATPMLAIAALLAGRVFLGVGESFTATGATLWGIKTVGAIHTSRVISWNGVATYVAMAVGAPLGVTLNHYFGISGFATVVVLVAAIGLLFARTRQDVKVTAGARAPFHAVVRKIWPYGLGLAFGTVGFGVIATFITLYFAAHSWQGAAFTLSLFSVGFICVRLVLGNTITRFGGVPVSLACFIIESLGLLLIWLAPSAWMAGVGAFLTGSGFSLVFPALGVEAVKQVEEQNQGTALGTYSAFLDLALGLTGPLAGWVAGFYDLATLYLLAAIVVALAFLLIFRVHRQQRLVARE

SEQ ID NO: 9415 - protein, 351 aa, Klebsiella pneumoniae
LITPFSENTMNATTLPILDLARYADPADKAAFLADLRHAARDIGFFYLINHGVDDALQYEVQRQSQRFFALDEAQKQQVAMIHSPHFRGYNRAASELTRGQPDWREQFDIGAERPALTLSDDAPRWQRLQGPNLWPAALPSLKPVLLHWQQQMTQVGIRLLRAFAEALQLPENAFDRLYGEKPNEHIKLIRYPGQQETQSSQGVGAHKDSGFLSFLLQDEQKGLQVEVAPGEWIDAVPLAGSFVVNIGELLELATNGYLRDTVHRVVSPPAQQQRLSIAFFLGAQLDAVVPVYTLPPELAREARGPDSDPHNPLLRDVGWNYLKGRLRSHPDVAERYYQDVFRERAEQLIV

SEQ ID NO: 9416 - protein, 401 aa, Klebsiella pneumoniae
RMNPRIIISGVISCFLPATLCHAANLSDDGSFQLNGYGMVAGDFQSELNRPKNMSLHTDPTGPNQDPRGKMGDLGNSFWHDYWTSLAITKKWQGLASPEQWADYTYEMVGYGDKTVETAQNYGRFGGLSFLPEGANIWAGRRYLDQRINIFAYNTKEVHIDSGLGYNSKNFDLNVGTDQIDWSSDTAPQAIEGSRRIVDMAYRIDQTELGMTYVKEIDDPLGTGKQKAISFSAKYSMPSFWGVAKGQSTVKLQYGKGVIAPYLNTSRITVLSEEGDCSMRFSTDGNLTLFDDFAVSPAFIYEYTKREKTADRTTFIPDTGYSGGDMTYGSANETGIFTGVNVKQNIHHQNLSMLYEVMVNNTINKNGVEGSSGVGYQIAAGPGPATGCFTVCRADSHFDGY

SEQ ID NO: 9417 - protein, 326 aa, Klebsiella pneumoniae
SLRPPFARAPSFITRSVFMFIKVLGSAAGGGFPQWNCNCANCQGLRDGIIQAAPRTQSSIIVSDNGKEWVLCNASPDISQQIAHTPELNKAGVLRGTHIGGIILTDSQIDHTTGLLSLREGCPHQVWCTPEVHEDLSTGFPVFTMLRHWNGGLVHHPIAPQQPFTVDACPDLQFTAVPIASNAPPYSPYRDRPLPGHNVALFIENRRNGQTLFYAPGLGEPDETLLPWLQKADCLLIDGTVWQDDELQAAGVGRNTGRDMGHLALGDEHGMMALLASLPAKRKILIHINNTNPILNEQSPQRQALTQQGIEVSWDGMAITLQDTAC

SEQ ID NO: 9418 - protein, 142 aa, Klebsiella pneumoniae
PAIPIRRRRCSTVSVPFARWWRLAHGGSVPSGPAAPAALNLASICCVLYSVSASPFRSLTLLMQTLVLLSLFIFVVKFGLMVQVTDLWQFLLFPVPGSWTPCSYSNCSGPNTPGLWEQLIVFMGSLIAVTNPPVYDYAAFFQ

SEQ ID NO: 9419 - protein, 338 aa, Klebsiella pneumoniae
KLIPALTGRLQVKSPSVLLPGINHMNGLNHNALTCSAVPIPPWERSLQTVEAQPYFSVSQASLVLEGIVFDRNNNLLFVDVATGRVFKLTPERQLSIVLKENTFGASGLAVHKDGRIFIASVGDMQRGSVRAIEPDGTREQMIVAPDTGFLVNDLVFDNQGGFYFTDSRGNSADPQGGVFYVSPNVGSIHAILPGLAVGNGIAIDPAGSQIWATEHAKNRLHRVRLSDATTVAPFGSVVTYQFTGPAPDGARVDSEGNVYVAISGQGRVMVFNRNGLPIGQIVLPDRDKGRNLKSTSLAIRPGHRELFIVANSGTEPGGAMIFRSGAFAPAPFPFSHQ

SEQ ID NO: 9420 - protein, 198 aa, Klebsiella pneumoniae
SPSPTRRCTIMRPFFNDNLSKIVGVGFAWLAFAVLSPGSDARKGRRHIRALRRHFVDQLSRHPQHSEHEFESLVYHHVSQLSQSKDALARRWLLRWGVVLLNCSHVVWQLREWETRSDPLAQVRDLCINLLRDVMSERGVQQRPLASTLQELQRICDALNHHHQPAARELAAAIWRLYCALSQLEQAPVAGTIGEGTT

SEQ ID NO: 9421 - protein, 570 aa, Klebsiella pneumoniae
LIPFLRRWPPEDPQLQEPVVKQTFLSGATLAALVMLVALPLVFILLQAIFPHFSAGSLGDAFGGIPALLADPQLPAMLGGTLWIAAGVALVSVMIGLPLGILRGMFSLPLPRLWDLLFLIPFLTPPYISALSWMLALQSQGYLQQLTGWQLNDLLFSRSGIVLVMTFNIFPVVYFAVSRSLLASGTRLAVVARVHGASAWRAFWHVTLPMLSPALAAGTLLAFTLAIEEFGVPAALGSRAGVVMLTVGIEKKLADWPVDLPGAALLSLLLMAVALFAWWLQRRLVGEKEVTSVTGKPGENHGASLGWMMLPAVLAMAAVGGLAVGVPAVSMMLTSVMGTLSGGVSVENVTLRHFAALFDQQGDALSALGTSLSLALGSALIVGALGLLAAWLVMVQKIKGRGMVDALSLMPAALPGVVVGVGLILLWNQPFWPRSPYNTLWMLLLSYCCLLLPWPVRYVGSALRQLGPNLEPAARVHGASPLQALRLIVLPLVFPALLAAMLMVFAVASRELVTSLLLSPAGTQTVAVFIWRQFEQGSVGQGMAMASLTLLTGLVLMLTALALMQRRTCG

SEQ ID NO: 9422 - protein, 385 aa, Klebsiella pneumoniae
RRKPADVLRVRPARLQAAGMDAVGGALRSGGGVICPAGGDHQPQRNVADQLHRGRHLGSARRARYPDWPGAWRRIGQRCEKHFHRGDARVLAAVSRPHLHHCDPVFTPRGDGPAASRRPLMQPDEGLFTRQLPGDRFREQTDPVLQLENINVSFDGFRALTDLSLAIGVGELRCVIGPNGAGKTTLMDVITGKTRPQSGKALYDQSVDLTTLDPVAIARQGIGRKFQKPTVFEALTVAENLALAMKGDKSVWASLRARMSSEQDDRLNEVLRLLRLDGERYRQAGLLSHGQKQFLEIGMLLVQEPHLLLLDEPAAGMTDAETEYTAELFRTLAGQHSLMVVEHDMGFVETIADRVTVLHQGQVLAEGSLREVQANEQVIEVYLGR

SEQ ID NO: 9423 - protein, 335 aa, Klebsiella pneumoniae
SSEPNLKACISVFIAAKLITSKEVKSVGHYRMIPDKSVEILLGELSRDIAQRTPGTGDFPTAVEGLELFRRNEPAPPVNCLVPPSIVLVADGAKIMWVGGEPYEYNAEKFLITSLDLPASSEILQASTSQPCVGVAYKLDQRVLMELIAQGSLPPVKKRDAGTSVGIGTITDALLEPFCRLLSLLDEPEAIPVLGPLIQREIHYRLLMSDQSDHLRQIAAVDGHGYRIGKAIDWLKTNIASPLRVEELASRVQMSTPSFHHHFRQLAGMSPLRYQKWLRLNEARRLMLNEHYDVTTAAYAVGYESLSHFSREYTRMFGESPKRDITELRKSAGKL

SEQ ID NO: 9424 - protein, 304 aa, Klebsiella pneumoniae
RSAFIKTRIRTDKMSTLPKVAVLGLGAMGHAFASNLLKNGFTVAGWNRSPARGEDLQAHGLSLHATPQQAVADAEVIISMLADGEATLEVLAQIAPACQPQAIYCQMGTIGLPETRQAIALLRELQPAMTYIDAPVSGTKAPAEKAQILVLASGDREKGAAAEPVFAAISRGTQWFGEAGNSQKMKLVLNAWLISMMQGIAESAQLAKTLGFTPDQLWSALEGGPLAAPYVKVKLDAIASEQFTPQMQLAHALKDARLALSLAEPHTMPGLENIAELWQQAADAGYAGEDLSAVYQWLSPSSKA

SEQ ID NO: 9425 - protein, 564 aa, Klebsiella pneumoniae
CVLPRPSHRERCTMSNDHLTDIAYRHFIESVKDYAIYMLSADGTVISWNEGARRAKGYLSDEIIGRYFGLFYSEAEQLSGVPAKNLEIALRSGQFEGEGWRYRKDGSRFWAHVMIDTIRDEQNTLLGFAKITRDISEQKAINDRIAWMARYDALTGLPNRVEFFERVEKLITGNDARRFAIFTIDLDKFKEINDLQGHLIGDQLLQRVAGAVLKTLQKEEMVARFGGDEFVAVKPFSDEGEVDAFAARLWHCFSGKQTFAATEVVLSASIGISVYPEDGTDINTILSNSDLAMYRAKSSLDHKICWYEREMDDKTRQRNMMAADIRRGIHAGEFSLHYQAIRNIKDRSITGYEALLRWQHPQLGTIPPDVFIPIAEESGAIVPLGYWVLEQVCNESLENGLNRKVSVNISPVQLRHRSFIEKVREILMRTAYPVSLLEFEVTETAFVINKQLAFSVLHHLQKMGISIALDDFGTGYSSLSMLRDFHFDVIKLDRSFMTDVESNPQVRSFVRAIISLGNSINTPLIAEGVETAGQLQILEEEGCDEMQGFLFGEPVDIKHLPDRR

SEQ ID NO: 9426 - protein, 352 aa, Klebsiella pneumoniae
KTMPISRCSGGNPHPARATSLSPKRISPLAGTLSPASRRSSVLLPQPEGPSSATMRPGSICNVKRSRMGVSAKAKETSCRVIGVSVRIIALPFGTARPARRSTSDGARSPGIASGEPTYCDPLWDLVLATIVRRDDVLITFSLRLNVLPANRPIIQGTPMSRFRHVELQYASRLLNHGPTILITSYDAPSDRRNVMAAAWSMPVEFAPPRVAIVVDKSTWTREIIERNGTFGIVVPGVAAASWTYAVGSVSGRDEDKFNAWGIPVVTGPELGLPLIEEKCLAWMECRLLPATAAQTQYDTLFGEVVSAAADERAFVTGRWQFDDDKLNTLHHLGTGNFVASGRHVRANSLDE

SEQ ID NO: 9427 - protein, 383 aa, Klebsiella pneumoniae
EGVPGAAVLLWQPSISRAGRIMIQYIRIQNFRSVKDIALELGPLNIVFGPNGCGKSNIYNAIHLLTAAAEGRLSGFISEEGGLENMMWSGERSPLDRHPRRLQIACRTDSFDYELQIGFPEKLPYPTQFMLDPIVKEENIWLAGYSRRPSSRVLQRKNQAAFLVDVTGEKSTFTESIYENESVFGQLGEPHRFPEVSRVRETLRRWRFYHEFAIGRHSPLRQPAVGYRSPVLDSDGQNLAAAFQTIVEIGAEEILHEILADAFPGCQFYCENEHSRFALKMRREGIRRPLLAAEMSDGTLRFLCLAVALLSPRPPAFLAINEPENSLHRDMLPALARLIIEASRYSQIWLTSHSAELAELIAAGAPCQRYALENRGGETRIVE

SEQ ID NO: 9428 - protein, 299 aa, Klebsiella pneumoniae
ILPPGCRLSVPPRIMALRLILPGQVKRSLRAWQPPLSSPCTSRRNNMKGYNRLEQIMDFLKSHNLVTVDQLVAATNASPATIRRDLIKLDQEGVISRTHGGVTLNRFIPSQPTTLEKAQRSPLEKQAIASAAAALVKAGDAIVLDAGTTMIELARQITHLPLRVITSDLHIALFLSEFKQIEVTIIGGRIDDSSQSCIGDHGRRLLQTIWPDLAFVSCNGWDLEKGITAPTEEKAALKRDLMANARRRILLADSSKYGAWSLFNIAPLASLTDIVTDAHLPDKTREALETLSPQLIIAD

SEQ ID NO: 9429 - protein, 377 aa, Klebsiella pneumoniae
RGPPDGRDPASGTVAAGSDPGGAYSGGPQLYRLPARAEEDGFWRFLSGMSGGHMRDILPVVVDGLWRQGAKNLAVRLVSAEGQPLPAWTPGAHIDLHLPCGLIRQYSLTGSPAERDRYLLCIARESQSRGGSRYIHDTLRPGQPLMISAPRNHFPLHEGGHVVLLAAGIGITPLLAMAHARAASGASFTLHYYVSRAQEAAFATEIARQLSGGNCQIHCSDEGQSPRQRLAQDLGAPDADTRVYFCGPPGFMARVRDTARAAGWEEAQLHSEAFQPPAPTAASAADGTFTITLASTGERWPVPGDKTIAQVLQEHGVAVPLSCEMGICGACLTPVREGTVDHRDTVQSEAEKQAAEQHIALCCSRSLSANLVIDLAG

SEQ ID NO: 9430 - protein, 453 aa, Klebsiella pneumoniae
SCTPACSKGCRRYSRAGWRLALRLPPAAAQIVNRLPGLRLIEVVFAEQDGALDLRQSLIEIELLFQLRHAAIHRPVRLVFGRFTHLVQRHADIQPGMRRFNHLGPPVGQHIIARGIAGKRPVDLRRDVVEQSLLHPAAGIGIGFIIGGRAPGIGPRRIVGAVAPHPGRAHAKLDVRIELFDGGGNLGYELLGVMPPPVALRGIALPVTAESLVVVKRGRGGFGIEIVIELHAVNRVVLHHFSDDAGDPVTRFGNARVENKAIAGGADPVTVQDEHAGRYLSKGVVQLGNRRRFGVDRDAVGIKPRVNLHAALVRFIQHKLQRIVARVFADFAGQHIGPRQNIRPPERRTVRFHLEKDGVDPQALQVIEFSDQRQLLLRDAALRRAGDNRPDRRPVKARNGGEPHAAHRLPVRLPGFDGGSVRRRDKGFRGFTGAAEQHASGDERRACQRHFAG

SEQ ID NO: 9431 - protein, 292 aa, Klebsiella pneumoniae
LSTPLTRRGFPPGVVNYLTCAPEDAPALVESLIAHPAVRRVNFTGSTPVGRIIARTCGQYLKPAVLELGGKAPLLVLDDADIEQAAAGAVFGAFANAGQICMSTERIIVDNAVAEAFIPLLARRAAALPAALTGPVVDMNTIARCNALIEDALAKGARLLTGGKANDTHMSPTLLDGVTREMRLWREESFGPVKAIIRVHSEEEALAVANDSEYGLSAAVYSRDSARAWNVAQRLHTGICHINGPTVHDEAQMPFGGCKASGYGRFGGRAGIAEFTELRWITIQTQPRELPF

SEQ ID NO: 9432 - protein, 350 aa, Klebsiella pneumoniae
RYALPRSNRGLHHTILHTISSASPHSVSLVTEHRQQGAAMALPIMIDCDPGHDDAIALVLALASPELEVKAVTASAGNQTPEKTLRNVLRMLTLLNRPDIPVAGGAWKPLMRDLIIADNVHGESGLDGPSLPEPAFAPQNCTAVELMASVLRESQEPVTLVATGPQTNVALLLASHPELHAKIARIVIMGGAMGLGNWQPAAEFNIYVDPQAAEMVFQSGIPVVMAGLDVTHRAQILPADIERFRQIGNPVSTIVAELLDFFMAYHKDEKWGFDGAPLHDPCTIAWLLKPEIFTTIERWVGVETEGKYTQGMTVVDYYHLTGNRPNTTLMLDVDREAFVDLLAQRLAFYA

SEQ ID NO: 9433 - protein, 538 aa, Klebsiella pneumoniae
RPAPGTVGDRHRERKEPSMSTVQALSAPQGLSMPTAKKIFAFASMCVGMFIALIDIQIVSASLRDIGGGLSAGDDETVWVQTSYLIAEIIIIPLSGWLARVMSTRWLFAASAAGFTLMSLLCGWAWNIQSMIAFRALQGLAGGSMIPLVFTTAFAFFQGKQRVIAAATIGGLASLAPTLGPTVGGWITENYNWHWLFFINVVPGIYIAVAVPLLVKVDSADPTLLRGADYLSILLLALSLGCLEYTLEEGPRWGWFDDATLTTTAWVALLCGVAFVIRTLRHPQPVMDLRALQDRTFSLGCYFSFMAGVGIFATIYLTPLYLGSVRGFSALEIGLAVFSTGLFQVMSIPFYSWLANRVDLRWLLMAGLIGFAVSMYSFVPITHDWGADQLLLPQAFRGLAQQFAVAPTVTLTLGSLPPARLKLASGLFNLMRNLGGAIGIALCGTVLNDRTNLHYSRLADHLNNANLAMSDFVQRSAANFTVQGISPDAAQTAALKNLSALALREARTQAFSDAFYLIMMGFLLAALLVPLMKKPPAH

SEQ ID NO: 9434 - protein, 116 aa, Klebsiella pneumoniae
AIAPGSRGAPRRQRARGVSPLSGRQRRRAGGRSRCAAGRLRRFSPHPLRRPANAALAAGAAVAGGARRAGGPFRRRTCRRRGAAAGAAAAPGRVHCTAASGLQPARAVALPADRFK

SEQ ID NO: 9435 - protein, 529 aa, Klebsiella pneumoniae
SDKPIHQVMTAVCKDERTTMIGVKKLQDFSKAMIGPVLYLPAIGLLIALFSMTTNRLWVDESSGLYLVGKFVSSMLWALMNHLGFLFCLGLASGLAKTRKAEAAFVAAMTWLMYLAANNSWLTLTHRLATGTTNAQLYGSGQTFIFGFQVIDMGVFLGIILGCAVAFVHNRVVGIEFRGALSIYGNSKLVLIVMLPLVGMFAIATVYLWPVVELGISALTGFMKSFGAIGVFLYGFLNRFLIPTGLHHLIWSPFVFTSIGGQLLIDGQTVIGAKPIFLAEIARHPVDALSDSARFLTYGMVKIFGTAGMALAFYRTAKPENKQRLKVTLIPLIVTSVLVGITEPFEFLFIFTAPLLWLIYSLLDGFFQMLAWLLHVRVCATNGLIDFVVYNLPAGVSATRWPVFVALGLLETATMYLVGTFCITRLRLLTPGRETAAEDEHSQQANSEHPDKGALVIAGLGGKENVCAVGNCFTRLRVDVRDPALIQQTLLKESGGSSVLIKGNHVQVIYGLGVNKIRTAVNASLGVIE

SEQ ID NO: 9436 - protein, 137 aa, Klebsiella pneumoniae
APRPTGRERRARRPLTRGERHERIASRECVGAIADLAAMAGAGRGGGRLRCRQSQPAGAAVDPVGGSAAGGSSAAAAGVDHREPGDGRRKTCFPHPTGRITAIGRCRRAAGRNPAGPSDQPAAQSGCRRAGQPPYFK

SEQ ID NO: 9437 - protein, 104 aa, Klebsiella pneumoniae
DTGPLGIRMHMPIPIGMPTLGASLATQSGLLFFAGTQDFYLRAFDTANGKEIWKSRLPVGSQSGPMTYVSPKTGKQYIIINAGGARQSPDRGDYIIAYALPDHH

SEQ ID NO: 9438 - protein, 180 aa, Klebsiella pneumoniae
QGAFMTTSFSLRTLSRDDILHHLPALSEILASCVNGGASVSFMLPFAPQTAITFWQRTADSVAAGERIVLAAFDAEERPVGTVQLITSQPENQPHRADVAKLLVHQNVRRQGIAQALMSELERIARRERKTVLVLDTATGSGAEQFYARCGWEKVGEIPRYALMPDGEMTATSLFYKFLP

SEQ ID NO: 9439 - protein, 237 aa, Klebsiella pneumoniae
FLAFCFLEEGAMVFPYMTHLLAAMLLGALIGAERQWRQRMAGLRTNALVATGAAVFILSAMSASPDSPGRIAAQIVSGIGFLGAGVIMRDGMNVRGLNTAATLWCSAGIGVLCGLGQFWNATAATLIILCANILLREAAQRIHALPGAGDEEKRYVLRVTCLREHENAVRQLLLNIAQQQRFTLQGLQSAAADTADHLEICAQLISHKQHQKTLAQIMAQMGVQQNVTSVHWRVGEA

SEQ ID NO: 9440 - protein, 379 aa, Klebsiella pneumoniae
HYFTDAHHPDLPITMTENANILTTPSVTLSRHQVVALAYDGLCTFEFGVAVEIFGLPRPEMGDNWYQFAVAAVDEGPLCATGGIRLMTDGGPELLAQADTIVVPGWRGVDAPVPEALCAALASAHARGCRIISICSGVFVLAAAGLLNGRQATTHWRYTAALQSRFPQIQVVEDVLYVGDTLLMTSAGSAAGIDLCLHLVREDFGSEAANVVARRLVVSPHRDGGQAQQVLRPVARSRESLRLGQLFDYLHQHLAASHTVASLAQRAGMGTRTFLRRFEEATGKTPARWLLEERLLRARQHLTESTMGIDQIAERCGFASAGTLRHHFRQHFALSPLQYRKQFTPSPIAKSSQPRTIDGHSKPVARRVDDEERVSGSDL

SEQ ID NO: 9441 - protein, 311 aa, Klebsiella pneumoniae
HHLTMEKNGLFSQRIRLRHLHTFVAVAQQGTLGRAAETLNLSQPALSKTLNELEQLTGTRLFERGRLGAQLTLVGEQFLTHAVKVLDALNSAGQALNRKEGLNNDIVRIGALPTAALGILPTVIGQFHKQQKDITLQVATMNNTMLLAGLKSGEIDIGIGRMSDPELMSGLHYELLFLESLKLVVRPGHPLLQETVTLSRVMEWPVVVSPKGTVPRQNAEALLQSQGCKMPAGCIETLSASLSRQLTVDFDYVWFVPSGAVKDDLRRGVLTALPIATQGAGEPIGILTRVDATLTPGTQTLLSAIRKSMPA

SEQ ID NO: 9442 - protein, 223 aa, Klebsiella pneumoniae
SITTRARAYMATVERAMMLKTMRKHGVTLALFAAGSTGLTAAINELTKSTIDQQAAMQQKALFDQVLPADRYNNDLLKSCYLVSAPALGKGQHKVWIAKNNDRPIGAVMEATAPDGYSGAIQLLVAADFSGTVLGTRVTEHHETPGLGDKIELRLSDWITHFAGKVIHGQGDSHWAVKKDGGDFDQFTGATITPRAVVNAVKRAGLYAQTLPAQLPEFTACGE

SEQ ID NO: 9443 - protein, 185 aa, Klebsiella pneumoniae
YCTTIVYEKLRFAMSIRPAIKDDCAAIAEIYNHAVVHTAAIWNDKTVDTDNRIAWFEARQLAGFPVLVSEEDGVITGYSSFGDWRAFDGFRHTVEHSVYVHPEHQGKGLGRKLLVALIAEARRLNKHVMVAGIESQNHASLHLHETLGFITTGQMPQVGTKFGRWLDLTFMQLQLDARQDPDGKA

SEQ ID NO: 9444 - protein, 238 aa, Klebsiella pneumoniae
FTTTSVSGRTRKLTTTRRSMMSKSKMIVRTTFIDRACHWTVVICFFLVALSGISFFFPTLQWLTETFGTPQMGRILHPFFGVLIFVALMFMFVRFVHHNIPDKQDIPWLKGIVEVLKGNEHKVARVGKYNAGQKMMFWTIMSMIFVLLVTGVIIWRPYFAEYFPMQVIRYSLLIHATSAIILIHAILIHMYMAFWVKGSIKGMIEGKVSRRWAKKHHPRWYRDVERLEAMKESREGMK

SEQ ID NO: 9445 - protein, 425 aa, Klebsiella pneumoniae
FVEFNMLHFLIYDVLGTPAILVGLFSLIGLLLQKKGISDVISGTLKTIMGFVILTAGAGIIAYTLTIFSQLFEHSFHIQGVVPNTDAMAALAQKNYGTETATIMVLGMLINIALARLTPLKYIFLTGHHTLYMAAMLAVILSVGGLSGGWVVAIGAVILGAMMVISPAILQPFTCKITNTDDLALGHFGSIGYLLSALVGKIIGKGSPSIEEIKVPKSLNFLRDSSVAISLTMMILFLVLVLVAGKSFVEETLSAGQNFIIFAIIQSLTFAAGVYIILAGVRMVIAEIVPAFKGIADKLVKDAKPALDCPTVFPFAPNAVIVGFLASFVAGLVSMFLCPLFGLSVIVPGLVPHFFCGATAGVYGNITGGRRGAVVGAFAHGLLISFLPAILLPMMGDMGLGSTTFGDADFGVVGIVLGHIIAMFN

SEQ ID NO: 9446 - protein, 350 aa, Klebsiella pneumoniae
QEEFAMTDQPQRHRRWVLASRPHGEPTAENFRLEESEVPTPGPGQVLLRTVYLSLDPYMRGRMSDAPSYSPPVAIGAVMVGGTVSRVVSSNHADYQPGDWVLGYSGWQDYELSDGSGLVKLGDNPQHPSWSLGVLGMPGFTAYMGLLDIGQPKAGETLVVAAATGPVGATVGQIGKIKGCRTVGIAGGAEKCRYAVETLGFDLCLDHRADDFAEQLAQACPQGIDVYYENVGGKVFDAVLPLLNTAARVPVCGLVSGYNATGLPDGPDRLPLLMATILKKRIRMQGFIIGQDYGHRIAEFQQQMGRWVQEGKIKYREQLIDGLDQAPQALIGLLKGENFGKVVIRVAADD

SEQ ID NO: 9447 - protein, 272 aa, Klebsiella pneumoniae
INNTFTHTASGDITTICPSTVYTEYPMNDKWSPREVVHRDYSSHPPAYAPGYKTSVLRSPKNALISLQNSLSEITGPVFSRDDLGPLDNDLILNYAKEGLPIGERIIVHGYVRDGFGRPMKNTLVEVWQANAGGRYRHKKDQYLAPIDPNFGGCGRVLTDENGYYCFRTIKPGPYPWRNQASDWRPAHIHFSLSGDAWAQRLITQMYFEGDPLIKQCPIVRTINNDDAVRTLIAELDMHAAVPLDCLAYRFDLVLRGHRATLFENRTQGAAR

SEQ ID NO: 9448 - protein, 485 aa, Klebsiella pneumoniae
ALFTIPLYSAVDLIYLLLSGQVEGNMSAQNDKDNHYLLNNWRPENKAFWENKGQAIARRNLWISVACLLLAFCVWMLFSAVAVNLNKVGFHFTTDQLFLLTALPSLSGAILRVPYSFMVPLFGGRYWTVLSTVILIVPCIWLGVAIQNITTPFWVFIIIALLCGFAGANFASSMGNISFFFPKAKQGSALGVNGGLGNLGVSVMQMVAPAVIFLPLFTFLGVHGVTQPDGSTITLSNAALVWVPLLLLATVAAWFGMNDIAGSKASIRDQLPVLKRPHMWLLSLLYLATFGSFIGFSAGFAMLAKTQFPAVDILKLAFFGPFIGALARSFGGIISDRLGGVRVTLVNFVLMALFTGLLFLTLPGSGSGSFLAFYVVFMGLFLTAGLGSGSTFQMIAVIFRQLTIDSVKQRGGSDEEAQHEAVTDTAAALGFISAIGAIGGFFIPKAFGTSLAMTGSPVGAMKVFFVFYVVCVLVTWLVYGRRKPA

SEQ ID NO: 9449 - protein, 410 aa, Klebsiella pneumoniae
PSFTSASPTSPRRGKWHGSATAPGLSPWCWCKVTIRPIRRWDRSAISASPAPPRPRSMRKWPSHGGKVFYAGSRSSWAIRWAISLSLPTRTVTPWSCRGGSGWDWKSSWRENPANNFPPPRRGRITLQRDTSATRSMAMGNKKSGNPVDTAAKIAPLDNKAYEKALRKLHVELVKLQRWVVHKGLKVCIVFEGRDGAGKGGTIKAITERVSPRIFRVVALPSPTEREKSQLYFQRYIKHLPAAGEIVIFDRSWYNRAGVERVMGFCTPEEVQKFLDGAPMVERGMVESGIILLKYWLEVSPQEQERRLRDRIDDGRKIWKLSPMDIKSFNRWDEYTAARDAMFAATDTAWAPWFVARSEDKKRVRLNIITHLLSQIPYEALPVEPVTLPKRKIGKMKQTNFPFRFIPEKF

SEQ ID NO: 9450 - protein, 77 aa, Klebsiella pneumoniae
CINTTRSPTSRAKFISWVTRISVIPSAASCSSTFSTSPTSSGSSAEVISSQSKTFGDMASARAIATRCCWPPERLAG

SEQ ID NO: 9451 - protein, 380 aa, Klebsiella pneumoniae
DARTFIAVERLLMRKAFWLLFALALPALAQDPVLPAVTAIHTAPTLGELPPPESLRPCCAFGYDLHVRAAGIPIPMYQIGNVLTLGTLGKHHYNDSAFGAVKNLLGLSEEQNGLIYTRRGGFIDIAHVRDTADNTFYLFNRIAPTLGQAGRIFYSEELGVRRVQLNAFTPPAGVRQRYQLAAWLAGHLAFEIAQWHEIAQWYGFQSVPGFSEEISAFSPEDLYSNLLGARLAINVILSGHGGSLEDYNQAMDAALKQVLTRLLVATRGETEAMFQQIDGDWWNSHRRVPDKFLVLKRNYDLQENRLPTPVPFETMPPYRLTMPEQVGGFRLRDLGELQIYPGHDMQALPVPAQYYGAGAFQGLADRAHEADKTQLARTEK

SEQ ID NO: 9452 - protein, 65 aa, Klebsiella pneumoniae
GWRFTRLVAKKRYCPDYFLLYELGIYCMDSRRETFFLVESLATTHGKPYRPILSSCRGTGPDFEH

SEQ ID NO: 9453 - protein, 80 aa, Klebsiella pneumoniae
MCGTRAVQMNYRGALCLLTGVGDIVYPGLALDGLQCKAARAGRGYEITAWGGWQDKREMRLAVYPLSSEKTLLSRLFFAL

SEQ ID NO: 9454 - protein, 68 aa, Klebsiella pneumoniae
SRLTSSKVKMPVHDPSSESFDWETIFESSDRCGKTVARTCLFGQRRTSQFSYYNMCQGSIEMSVIQLN

SEQ ID NO: 9455 - protein, 362 aa, Klebsiella pneumoniae
RLLTRRGQRGHVIAGRLGVASRVSNGSLVLNHYYITTGYYPMNKHVAAMLTMLIIPSAFAQTPLTDSKTIVIKPSALAVEMVPDIAYSFTQNIMGRPLQLTMDLLKPYADKPLPAVVFITGGGFLDAPKSKFIGQRVDIARAGYVVASITYRVVPNVTFPGMVEDAKTAVRFLRANAEKLGIDPNHIAVMGESAGGYLAAMVGTTSGHKEFDQGEYSNQSSDVQAVVDLYGLSDLTKVGADFSADIQKAHQSPAIPEAMLVNGIPWQGGGAISAYPEKAKRANPITWISNKTPPFLLMNGDADNVVSPSQSTLLHEALVAKKIPSTHYVVKGADHAGLMWYQPEVSKIIINFLDQNLKDKHQ

SEQ ID NO: 9456 - protein, 399 aa, Klebsiella pneumoniae
RSPTVCWRLPPARWANRRKRKAAFAAAPALTPARPICCRSSCTGSAKVSSTIKPLPIIWRTASSAVPARGYVQVIFRWCSTSVRKMPRSRRFVRKSSALRKTKPDSRPDRRAWDREKAARAERHKKAAVQPAAKDQEAISAALARVRDKQRDAAQPIVIQAGAKPDNSEAIAAREARKAEARARKAQQQAAPVDAPAAEPVDPRKAAVEAAIARAKARKAEQQAAPMEAPAAEPVDPRKAAVEAAIARAKARKAEQQAAPVDAPAAEPVDPRKAAVEAAIARAKARKAEQQAAPVEAPAVEPVDPRKAAVEAAIARAKARKAEQQAAPVEAPAVEPVDPRKAAVEAAIARAKARKAEQQATQQDLASAAANDDPRKAAVAAAIARVQARKATQQAVNEE

SEQ ID NO: 9457 - protein, 819 aa, Klebsiella pneumoniae
HGPTVASLAPTFGRGAMTNHWVDIKNANVVVVMGGNAAEAHPVGFRWAMEAKNNNDATLIVVDPRFTRTASVADIYAPIRSGTDITFLSGVLLYLIENNKINAEYVKHYTNASLLVRDDFAFEEGLFSGYDAEKRQYDKSSWNYQFDENGYAKRDETLTHPRCVWNLLKQHVSRYTPEVVENICGTPKADFLKVCDVLASTSAADRTTTFLYALGWTQHTVGAQNIRTMAMIQLLLGNMGMAGGGVNALRGHSNIQGLTDLGLLSTSLPGYLTLPSDKQTDLQSYLSANTPKATLPEQVNYWSNYPKFFVSLMKSFYGEAAQKENDWGFEWLPKWDQAYDVIKYFNMMDNGNVTGYICQGFNPVASFPDKNKVVRSLSKLKYMVVIDPLVTETSTFWQNHGESNDVDPSAIQTEVFRLPSTCFAEEDGSIANSGRWLQWHWKGQDAPGEARNDGEILAGIYHRLRELYRTEGGKGAEPLLKMSWRYKQPDHPESEEVAKENNGYALADLYDQNGTLLAKKGQLLNSFALLRDDGSTASSCWIYTGSWTEQGNQMANRDNADPSGLGNTLGWAWAWPLNRRVLYNRASADINGKPWDAKRMLIQWNGSKWVGNDIPDFNTAPPGSNTGPFIMQQEGLGRLFALDKLAEGPFPEHYEPMETPLGTNPLHPKVVSSPVVRLYEEDAIRLGKKDKFPYVGTTYRLTEHFHTWTKHALLNSIAQPEQFVEISEGLAKSKGIANGDWVKVSSKRGFIRAVAVVTRRLRTLNVNGQQVETVGIPLHWGFEGVARKGYIANTLTPNVGDSNSQTPEYKAFLVNIEKA

SEQ ID NO: 9458 - protein, 179 aa, Klebsiella pneumoniae
TGTTALRPVHYPARGGGLMLNLEQVRQFLYYEARLLDDRQWDEWLSCYSPQVVYWMPAWGDDDQLTRDPQKEISLIYYPNREGLEDRVYRIKTERSGASTPEPRTTHIISNVELMGESDEGLEVRYSWVTWSHRYQHTDAYYGSTCCTLIEQDGRPQIVRKTVRLNNDYIRQVIDVYHI

SEQ ID NO: 9459 - protein, 85 aa, Klebsiella pneumoniae
QAATGCHLPHHRLQVGRSGGIQPLVQFAEEVMKMDPPPGGERQAGEKVVEDKAFPSPGTSPDVHPLRPACRGHQLLTEGVKAGDE

SEQ ID NO: 9460 - protein, 192 aa, Klebsiella pneumoniae
ISKTPGYSYLSLLYSPLSALTQGCIVVMRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPRRIDWPFCARSATTSPALTAGKRN

SEQ ID NO: 9461 - protein, 674 aa, Klebsiella pneumoniae
TGRTEMTDRSMLQRLRQISISSSLRGAFLTGALLTLIVSSVSLYSWHEQSSQIRYSLDEYFPRIHAAFLIEGNLNLVVDQLNEFLLAPNTTVRLQLRNQIIQHLDKIERLSQGLSPAERQQLGVILQDSRALLAELDRVLYNMFLVREKVGELAARIDWLHDDFTTELNSLVQDFTWQQGTLLDQIEARQGDARQYLKRAREVQNEQQQVYTLARIENQIVDDLRDRLNELKSGNDDGMLVETHIRYLENLKKTADENIRALDDWPSTITLRQTIDELLEIGMVKNNMPDTMRDYVSAQKALVEASRSREATLGRFRTLLEAQLGSSHQQMQMFNQRMAQIVRVSGGLILVATLLALLLAWGLNHYFIRSRLVKRFTALNQAVVQIGLGRTEATIPVYGRDELGRIAGLLRHTLGQLNAQKQQLEQEIGERKAIEADLRATQDELIQTAKLAVVGQTMTTLAHEINQPLNALSMYLFTAGRAIEQGQAEQARTTLSKAEGLINRIDAIIRSLRQFTRRAELETPLHPVDLRQTFTVAWELLAMRHKPQQGTLVIPDDTVWIQGDEVRVHQVLVNVLSNALDACPHAAQITVSWQIQGGRLCVLIADNGPGWPAALLPSLLKPFTTSKTVGLGIGLSICVSLMTQMEGALRLASTFTRSACVVLEFNLTDVKDVE

SEQ ID NO: 9462 - protein, 328 aa, Klebsiella pneumoniae
FWRTAAGMGWWPDRRRAPSWTIFLSRSRHLRRQPMCRSVTAPMPSKRQDLFRRRIVHSNWLFVPSSSRRHSVLREHDPERGGKVTRNRLLLVQTGTPPTAIRQAHGDLPRWFRTLLAPWQTQLTTVRVFEDEPLPTPDNQTIAVLTGSWAMVTDRLAWSERTADWIRQAVAIDMPLFGVCYGHQLMAHALGGEVAYHPGGRESGSQTITLSPWGVDDPLLSGLPATFPAHLSHLQTVTRLPEGATVLAASAHDPHQIVRYGPHAVSTQFHPEFTAPIARSLIRHREAVLQAEGIDAQRLHDEVQESPQGAAILTRFVSAFLTPDAPGH

SEQ ID NO: 9463 - protein, 245 aa, Klebsiella pneumoniae
LPLTGATPSRHLKVIYKKIATELRTRINSDDYAVGDMLPSEKALAAELKVSVMTLRKALALLEEEKLIARRHGSGTCIVRKSNYHGGELEGFNYQMQVVGVTNYRNKVIEFTLLDAPPAIAQQLKIQPGEKVYYVRRLRLIDEVPILVENSYIPFATFPWLSVGNLEQSKFNYFKKECHITIIESHRSYTPVLATREQAELLQVAPNSLLLRVQSISYAQNRAIVDFSEIYQNTSKYNVKHITRR

SEQ ID NO: 9464 - protein, 423 aa, Klebsiella pneumoniae
MHVTNISVSQATMHSLHSAASYLYTNYENVMSQPGKGFLVWLAGLSVLGFLATDMYLPAFAAMQQDLNTSAASISASLSLFLAGFALGQLFWGPLSDRYGRKPVLLSGLAIFAAGCLGMLWVHNATLMLALRFLQAIGVCAAAVTWQAMVADYYPAQRTNRIFATIMPLVGLSPALAPLLGSWLLVHFEWQAIFATLFAITLLLMLPALRLKAAAKSVVVTQQKITFLALLRSREYSGNVLIYAACSASFFAWLTGSPFILHEMGYGPTAIGLSYIPQTIAFLVGGYGCRALLQKWSGQQMLPWLLVIFAVSVAATWLVGLQTHASLVALMIPFCMMAVVNGGIYPIVVAQALKPFPQATGRAAALQNTLQLGLCFLTSLLVSALIATPLLTTTSVMLVSIGLAGIGYRLQQTPELTPHSSHA

SEQ ID NO: 9465 - protein, 344 aa, Klebsiella pneumoniae
SLPTAAISLNGKAMAFILLSINSVCQFILPAHKGREIMTQHNFENDNKYHERSVQARKSTLVSVVVNIFLSALQVVVGIFSGSQGLIADGMHSFSDLVADGVVLMANKKSRRPSDHDHQYGHWRYENGASLIIGAMLLLVGGGMLWSAAGHLAQPQTIPPVHSAALWMALVALAAKEGLFRYMLAAARRLNSSLLIANAWHARSDAASSLVVALGIIGNLAGFAWFDPLAALAVGLLIARMGYRFAASALHDLMDRAVDEEMQQAIADTLRATPGVAGLHDLKTRKAGDLVLVDVHLEVAGEMSVAEGHQIARHARERVLAQHPVLNVMVHLDPCEAQGLKKAV

SEQ ID NO: 9466 - protein, 532 aa, Klebsiella pneumoniae
TIPTGGGAQQTTLRSAVKSVPCWHQPYREQVMQHPSKPLAKTRQGTLAGSAEQGIHIWRGIPYAAPPVGPLRWRAPQPAARWQGVRPAETFSAASWQDIDYCRELGGGDPGAFSEDCLYLNVWAPASAAQPLPVMVWLHGGGFTIGAGSLPPYDGKALASRDVVVVTVNYRLGHLGFFAHPALEEEAGERLYNFALLDQIAALQWVQENIHAFGGDAANVTLFGESAGARSVLSLMASPKAKGLFHKAIIQSGYTLPDLPREKALEKGRLLAEHFALPQASAEELRAIPAEAFWSLTAPLNTGPAPIVGDAVLPQPMLETFFAGRQHPIPVMIGSNSDEASVMAVFGVDIAGQIQKLRRERRLGLGLIKLLYPGVKGDEALGREVCRDMAFTTLGYVVMQAQQRVGQPCWRYWFDYVAEAEHDAYPHGAWHGNEVPYVFDNLRLTDPVRQYASEADLAFAAQVADYWTQFARLASGEQTLSGAVRWPACLRGRDRLLRIGLHKRAGFKVENRFMRARLALFRRVMKHHVTLE

SEQ ID NO: 9467 - protein, 119 aa, Klebsiella pneumoniae
GSTTMSSTLEKIQRQIAENPILLYMKGSPKLPSCGFSAQAVQALSACGERFAYVDILQNPDIRAELPKYANWPTFPQLWVDGELVGGCDIVIEMYQRGELQQLIKETAAKYHTDEPKAE

SEQ ID NO: 9468 - protein, 206 aa, Klebsiella pneumoniae
KNQTNGGILCAVKTGGRMNIAQHLAATLKTLRQQRGWSLSRLAEETGVSKAMLGQIERNESSPTVATLWKIATGLNVPFSAFIVPDASAAPSAFDPQQQAMVVTPVFPWDPELRFDHFSITLAPGALSESTPHEKGVIEHVVVISGTLDLCLQGEWHSLQAGEGRRFAGDATHAYRNRGAQAAHFHSLIHYPKEKTASEPAARQDD

SEQ ID NO: 9469 - protein, 101 aa, Klebsiella pneumoniae
TKFASARGNVFNERRRGDRRRVVAEQLEFFPVQSPCRGICQTDERGYCRGCFRSREERFNWQTMSDAQKQEVLRLCRQRLLRKIRANRPEPAEEPQQPSLF

SEQ ID NO: 9470 - protein, 596 aa, Klebsiella pneumoniae
RPSALYSARCFPPALRLSPRRDCGHDQGVSAMQFTHKKNRSLYIPYAGPVLLEFPLLNKGSAFSMEERSNFNLLGLLPEVVETIEEQAERAWIQYQGFKTEIDKHIYLRNIQDTNETLFYRLIGNHLEEMMPVIYTPTVGAACERFSEIYRRARGVFISYQNRHNLDDILQNVPNHNVKVIVVTDGERILGLGDQGIGGMGIPIGKLSLYTTCGGISPAYTLPIVLDVGTNNQQLLDDPLYMGWRHPRITDDEYYQFVDDVIQAIKARWPDVLLQFEDFAQKNAMPLLNRYRNEICSFNDDIQGTAAVTVGTLIAASRGAGSQLSEQKIVFLGAGSAGCGIAEQIIAQIVREGLSEEEARQRVFMVDRFGLLTDGMHNLLPFQNKLVQKREQLQSWDTTSEALSLLDVVRNVKPNILIGVSGQPGLFTEEIIREMHKHCRRPIVMPLSNPTSRVEATPQNILSWTDGEALVATGSPFSPVTVKGKQYPIAQCNNSYIFPGIGLGVIASGASRVTDEMLMAASETLAQHSPLVNNGEGPVLPELKDIQTVSRAIAFAVGKVAQEQGVAVKTSAEALLQAISDNFWLPEYRNYRRTSI

SEQ ID NO: 9471 - protein, 345 aa, Klebsiella pneumoniae
RLSAEGVPLMGIELSVIWFVIIVFATLMYIVMDGFDLGIGLLFSTVRGGGDRDVMVNSVAPVWDGNETWLVLGGAGLFGAFPLAYAVIIDALSIPLTLMLIGLIFRGVAFEFRFQATPSHRPFWDRAFFGGSLLATFSQGVVVGAVINGFTVSGRAFSGGMFDWLTPFSLFCGLGLCVAYALLGATWLVMKSEGALQQRMRSASRQLLGALLAVFAVISLWTPLAHPAIAARWFSLPNLYFLLPVPLLVILVSGWLWRTLHQRDRHVSPFTLTLGLVFLGFSGLGISIWPHIIPPAITLWQAAAPPQSQGFMLVGALLIIPVILGYTCWSYYVFRGKVQPGEGYH

SEQ ID NO: 9472 - protein, 184 aa, Klebsiella pneumoniae
RRPASPTTRKPGEREGQRLQKDAASASRTILFVRHHYRRNQMAIHKKGLAHWEGDLKHGKGTVSTESGALSQQPYGFNTRFEGVKGTNPEELIGAAHAACFSMALSLMLSEEGYTATSIDTTAVVTLNKTDGGFAITDIALQSQIVLPDVSPAAFDEIIQKAKAGCPVSQVLKANITLDYQLNP

SEQ ID NO: 9473 - protein, 362 aa, Klebsiella pneumoniae
PTAARCSVPTVPIRWDFARQDKELTTEQWIEVFRQARAMGSVQLGFSGGEPLTRKDLPELIRAARDLGFYTNLITSGIGLTESKLDAFSEAGLDHIQISFQASDEVLNAALAGNKKAFQQKLTMAKAVKARDYPMVLNFVLHRHNIDQLDKIIELCIELEADDVELATCQFYGWAFLNREGLLPTREQIARAEQVVADYRQKMAASGNLTNLLFVTPDYYEERPKGCMGGWGSIFLSVTPEGTALPCHSARQLPVAFPSVLEQSLESIWYDSFGFNRYRGYDWMPEPCRSCDEKEKDFGGCRCQAFMLTGSADNADPVCSKSPHHHKILEARREAACSDIKVSQLQFRNRTRSQLIFQTRDL

SEQ ID NO: 9474 - protein, 463 aa, Klebsiella pneumoniae
LHAAGAGDSARSGRLRRPSLADARSPLCAGADGQRRDWQRNGPRRVAAGRRPTAPSLVYRIAERLSAISEYWGGEQACYKQQLSVPCTTTFNIYEVFMSHLFSATRIGQLTLDNRIVIAPMCQYSADEGKATSWHRIHLGQLAFSGAGLLILEATAVEPAGRISPGDLGLWDDETENALRGVVEDIRAWSPIRLGIQLGHAGRKASCAAPWLGGHQLALNDGGWQTVAPSAVAFHDGDRAPAELSHADMARIKAAFVASALRAQRLGFELIELHAAHGYLLHQFLSPLSNQRRDEYGGSLENRMRYPLEVFKAIREAVGNTMAVGVRLSATDWVEGGWDCEQSIKFSQQLETLGSDYIHVSSGGLSPQQAITVGPGYQLPFARDIRQQVAIPVIGVGLITDPQQAEAALENGDADLIALARAVLYDPHWPWHAAASLGAQVRVPSQYLRSEPHGLKGTLLPNR

SEQ ID NO: 9475 - protein, 65 aa, Klebsiella pneumoniae
RRAAGIVDPEQRSLPPRVEHKQSAVGVAPDSALVGIYFQVSFRLGNHRFGQQLAKNIIAAGFTRR

SEQ ID NO: 9476 - protein, 66 aa, Klebsiella pneumoniae
GKDADVESVIHNNIEGFLLLLLSMWPILLVVFIGVAISFYTMLLRKTALACLLFALAIGAAGWSLA

SEQ ID NO: 9477 - protein, 516 aa, Klebsiella pneumoniae
ATCAPAAICASPPARPSAFHSFRWPPPRRPGNGICIRSRCEIFLWNNMFKLFSAFRKDKVWDFNGGIHPPEMKTQSNGTPLRQVSLPQRFVIPLKQHIGAEGELCVKVGDRVLRGQPLTRGWGRMLPVHAPTSGTIAAIAPHTTAHPSALAEMSVIIDADGEDRWIERDGWSDYQTRTREALIERIHQFGVAGLGGAGFPTGSKLRGGGDKIKTLIINAAECEPYITADDRLMQDCAAQIVEGIRILAHILQPEEVLIGIEDNKPQAISMLRAVLCDAHGISLRVIPTKYPSGGAKQLTQILTGKQVPHGGRSSDIGVLMQNVGTAYAVKRAVIDGEPLTERVVTLTGEAVTRPGNVWARLGTPVRHLLNDAGFCPSAEPMVIMGGPLMGFTLPWLDVPVVKITNCLLAPSASEMGEPQEEKGCIRCSACADACPADLLPQQLYWFSKGQQHDKATAHNLADCIECGACAWVCPSNIPLVQYFRQENAEIAAIRQEEQRAAEDKARFEARQARLGS

SEQ ID NO: 9478 - protein, 186 aa, Klebsiella pneumoniae
ARSAGENGGAGCRRWQTRSAQRSDRCPSCSPSGAGGRAAVVPPAASGRAFYRWPPQSGAKRCASPCRRAGRGKRRYGWRQDAGADSQTADRGAGSPGCGLPGAGPAAPDRRRDGERRPGGGRRRWRLRCRNLHAPDADKGRSPPRCRRKSSAKYRPRKGRPPPPGSAENGTAAPRCNASGLSPGGH

SEQ ID NO: 9479 - protein, 338 aa, Klebsiella pneumoniae
KKSATMIDSSLPLTDIHRHLDGNIRAQTILDLGREFNIALPATTLDTLRPHVQVTSLEPDLVSFLAKLDWGVKVLASLEACRRVAYENVEDAARNGLHYVELRFSPRYMAMTHRLPVDGVVEAVIAGVQEGCRDFQVDARLIGILSRTFGEAACQEELAALLAHREGITALDLAGDELGFPGTLFRNHFNQARDAGWHITVHAGEAAGPESIWQAIRELGAERIGHGVKAVEDPALMDYLAEHRIGIESCLTSNVQTSTVASLAQHPLKQFLEHGVLASLNTDDPAVQGVDIIHEYTVAAPAAGLSREQIRQAQINGLTLAFLGEQEKAALIQRVAKG

SEQ ID NO: 9480 - protein, 396 aa, Klebsiella pneumoniae
AAGADHVDIHLCFSPVTRLCLAILLDHLSGCRTPGHAAPANVGSPGAGVFWAYYNTCPAQRNKSSAITILLHCVRPSGWHNPQAGHTLCVPVSSIHQSGKIMLKENVNDLLSFMVVARERSFTRAAAQLGVSQSALSHAMRHLETRLDVRLLTRTTRSVVPTEAGERLIQRLGPHLEEIEQALAALRDTRERPAGNLRITAGEHAASAVLWPALKPFMLQYPDINIEITVDNGLTDIVGDRFDAGVRLGEQVAKDMIAVRIAPDMRMAVVGSPAYLQRAGTPQTPWDLAQHRCINLRLPTRGGLYAWEFARDGREIQVRVEGQLILNSLPQRIDAAEAGLGLAYVPDDCVAEALASGRLVRVLAEWTPAFPGYHLYYPSRRQHTSAFTLLLETLRR

SEQ ID NO: 9481 - protein, 410 aa, Klebsiella pneumoniae
ARFAQISIAPGANFSPITAIFLHVSGQQGRAVRAVPPRSPGNSFRSHAMQVKAAVTLGYQQPFVIKDVEVALPGKDEILVKIVATGVCHTDAVMRDNPGVVPMPAILGHEGAGIVASVGEAVSGIRVGDHVVLSYAACHHCENCLSNHPSACEDFNTLNFGGRREDGTTPYRLGDQDLSLFFGQSSFSQYVVTRASHAVVVDPDVDLTLLGPLGCGIQTGSGTVLNRLKPVVGESLVVFGCGAVGLSAIMAAKLTGCSQIIAVDIHASRLALAGELGATHQINGKEQDAVAVIKQITGKGAHYAVETTGVSAIVLQAVHAVKPLGTVAIVGFTGDITLNVQNDLMAEGKSLVGVIEGDAVPALFIPLLVQLYKQGKFPIDKLIARYPLADINQAFADSASGKVIKPVVVM

SEQ ID NO: 9482 - protein, 214 aa, Klebsiella pneumoniae
PVVAGIVLFDNKRLFFVSGRMMADYLLLFIGTVLVNNFVLVKFLGLCPFMGVSKKLETAMGMGLATTFVMTLASICAWLIDTWILIPLNLVYLRTLAFILVIAVVVQFTEMVVRKTSPALYRLLGIFLPLITTNCAVLGVALLNINLGHNFLQSALYGFAAAVGFSLVMVLFAAIRERLVVADVPAPFRGNAIALITAGLMSLAFMGFSGLVKL

SEQ ID NO: 9483 - protein, 404 aa, Klebsiella pneumoniae
RNAAGKRPCPRQTDYCSACGITGVFISSVTRRPVYSGVTMSEAKLFSPLKVGAVTVPNRVFMAPLTRLRSIEPGDIPTPLMGEYYRQRASSGLIITEATQISAQAKGYAGAPGLHSPEQIAAWQKITAGVHAENGHIAVQLWHTGRISHSSLQPGGAAPVAPSALSAGTRTSLRDENGHAIRVDTSMPRALETAEIPGIVNDFRQAVGNARDAGFDLVELHSAHGYLLHQFLSPSANQRTDQYGGSVENRARLVLEVVDAVSQEWSAERIGIRVSPIGSFQNVDNGPNEEEDALYLISELAKRGIAYLHMSEPDWAGGKPYSEAFRQKVRDRFPGVIIGAGAYTVEKANDLINKGLIDAVAFGRDYIANPDLVARLQKKAPLNPQRPESFYGGGAEGYTDYPTL

SEQ ID NO: 9484 - protein, 273 aa, Klebsiella pneumoniae
ASAATRVTSCKKERGRMFAEERQEKLLGILREKRKVAVSEMCDVFNVSGATIRADLRQLEEEGLLTRTHGGAVLRTRASFEQASDAREIVNLSAKERIGHRAAALVEDGDIIVLDTGTTTLHIARNIRDRQNVTVVTNDYQIARELEASPSIQTILLGGIVKKGYHCVVAINGRSILDTLNVDKAFMGTNSLSLKHGACVADIMLAETKRGMVEHASQVIIVCDYSKLNNTSLAQFTAADRIDTVVVDRLPDDVQAYRNAGIQVISLDEEEYL

SEQ ID NO: 9485 - protein, 347 aa, Klebsiella pneumoniae
WAAAKDRRQTMTYAVEFQNVSRLYGDVRAVDGVSIGIRDGEFFSMLGPSGSGKTTCLRLIAGFEQLSGGTIHIFGQPASELPPWQRDVNTVFQDYALFPHMSILDNVAYGLMVKGMAKKARHARAQEALEKVALGFAHHRKPSQLSGGQRQRVAIARALVNQPRVLLLDEPLGALDLKLREQMQVELKKLQQSLGITFIFVTHDQSEALSMSDRVAVFNNGRIEQVDAPQDLYLHPRTAFVAGFVGTANVFAAEAARRLCGMAGSWSLRPEHVRLQGGGEVQVQGVVQAVQYQGAATRIELRLADGDKLLVSQANIDGAAAASVPRTGQIVQASWSRSAMTPLESGG

SEQ ID NO: 9486 - protein, 78 aa, Klebsiella pneumoniae
RQAAFLFMKMVLGNPCAVEAQTLRVADLFGRQPVARLRGALIEQTGKKTEAFWHYAFSVWACAKREETWGMAAISSRV

SEQ ID NO: 9487 - protein, 240 aa, Klebsiella pneumoniae
LRYAAKMRVFVAAKVGEAHRHHAVANIQQRQLKLDIFAVCPLFEIPFAFFAPAKADGAVRRHQFAVAVIGHGFPFRVISFSETVKQVGSTQHTARRIAAVVARLEYHQHRHVGVGPAVVEKVIARVIEVEGFEDHMAHGHRQRAVGALLRRQPLVAELSDFRIVRRDGDSFGALVAHFGKEVGVRGSGLRHVGAPGNNVAGVVPVGGFRHVGLFAPGHRRGGGQIAVPVIKAQAGAANQR

SEQ ID NO: 9488 - protein, 87 aa, Klebsiella pneumoniae
YVHAIVPSRKGMLKRSISALLLLCALFSGHLLAHRQGHEYFPVQSLEQQLLHEADSDELRSQHEEAAADLREHHRWQDDRKPRASCQ

SEQ ID NO: 9489 - protein, 347 aa, Klebsiella pneumoniae
KSCALAGRPGRNTHLTEPFMNYTHLGRTGLKVSRLCLGTMNFGDVTDEKTSARILDEALEAGINFIDTADVYGTEQSPDIQQGSGLSEEIIGRWLQQGGRRERIVLATKVYQPMGPGPNDRRLSAYHIRKACEDSLRRLNTDHIDVYQMHHIDRHTPWEEIWQAMELLVQQGKVLYIGSSNFAGWDIATAQSVATARHFLGLVAEQSLYNLTARTIELEVIPACRHFGLGLIPWSPLAGGLLGGVLKKMASGRRARPAFARLIEQYRPQLEAYEGLCEDLGETPSDVALAWLLQNPVVTAPLIGPRTVEQLQQALHATTITLSDDTMSCLDEIWPGPGGEAPQAYAW

SEQ ID NO: 9490 - protein, 178 aa, Klebsiella pneumoniae
AARAGPAGGQCPLRSPLWPGVFNPRQRAQRRRDVAGADAPAAAYRRRRSGRGACPAARDYDVKTGRSDWRMSTLSTHILDISTGTPAEGVTVSLSREGETLANLVTNAQGRIATFSAAPLPAGRYCLTAETGAWFARAGRESVFTRAQIDFVIGEAAEDHFHLPFLIAPGGWSTYRGS

SEQ ID NO: 9491 - protein, 129 aa, Klebsiella pneumoniae
DLSATKPENGGRAPHAAGPGPATHPLLQTPIGLTNQMVIHLTLSRHVRAVVISGDKMKKPFMVICAGAMLALLAGCSSNYVMTTKSGQTIVTHGKPQLDKETGMTSYIDESGNKREINSSDVSQLVEDN

SEQ ID NO: 9492 - protein, 358 aa, Klebsiella pneumoniae
RGGACRPAVSLTCNKPIMSLSAFFISFRNANALFAGPVDPCLSRCHSTIPKITTFRINVLKMGIMMEKRLPGLDLDALRSFVTGMECGSFAQAALRLSRSTSAVSAQLKKLESQCGAALVTKQGRHLVLTAEGEKLMSYARRLLALNDETLRALQGERLTGEIHLGMQEDFGESLMPGILGQFKRHHPQVQIVARVDRNGPLHQALAEEALDLALLWQNEDQGSGLGLCPLAWIAHPDLDIRALLVSGEPLPLVMFDSPCLMRSRAIACLDAAGIPWQVVFVSHSLSGIWAAVQAGLGLTIRTRIGMPGNLRPAGGLLPAPGSLAVSLRQTPREEHHSAAVALLGELMTEALQGWLDR

SEQ ID NO: 9493 - protein, 308 aa, Klebsiella pneumoniae
GGGAGDHKSAHRARAEGRNRLSCSCAIGCSGFAVMMTLTVEYYFTHPQDKLGMYASDPEDNSQEHGHEFAELVIVEEGHGLHVINGRPLYIQQGDVFYVQPGDVHYYDELGTLKLINVLINPAVAFGYLQQMEGLLQQLSAQRAACYGWLAPETRSYCRELVEKIFSPALRAADNTPLRESLFFQLVTTILTAESEAEYSSTRYKLHKLLTWLQEHCFEEHNWQQLAEQFHLTTRTAFRHIKEATGLTPDNYLKRLRLVSARVKLRETEMTITEVAYLCGFANSNHFTTLYKKVFGLTPSADRRRPPG

SEQ ID NO: 9494 - protein, 147 aa, Klebsiella pneumoniae
AFTAIFLSAPAGFYPPHGRDPPAPGTLRRHSIAREPAAPAYRALDRSAVRRGRVSGIPRPAPAWSGDTAAWFRMGPASAAGFPVDRSYASVPETYPAPAGDCSTSRRRSAETSLPSLRASPPAAGSALVSAPHPWPGYNPPANRRGR

SEQ ID NO: 9495 - protein, 208 aa, Klebsiella pneumoniae
PVTAGQWLLCIRLFSAKSFRTAGELWPKRLNKYLRRKIMTSTHISCQYSQANAFICKETLMVIDIREVRPHDKAEWLQLWQGYTRFYGSPQPEEVTECTWQRMLDVNSSVLGKVAVVDDAVVGFAICVLHEGTWVTTPICYLEDLFVDPAFRGQGIARTMIKSLQSEGADKGWSRLYWHTRRDNPARHLYDEFTLADDYVRYRITLES

SEQ ID NO: 9496 - protein, 295 aa, Klebsiella pneumoniae
SRAAEKRQRQRSDFVFTEGKDQQQRHGNDPVGHGRNAQRAVAPGNFAAEQIADHHSQPRQHHNQHHLAFSKAGDVEHKGLDIAEPCKHAGVTEHGGGENQPRRRGGQKTELLAQPRAGPVIKRGHPAEDRQKYRHVKYRDKRKGIAPAEVMPKPGATRDAHQVSDRHAANHPRHRGGHLPRRRDFRQDNRADAKERPVGKPGNQPAKRQHGVATGEGKQGIAENTQASQEQHHRFQGKPAGEQRHDRRADHHAEGIPGNHIAGGGYGYSDIVRHIRQHAHNAKLRHAKSKGAQRQ

SEQ ID NO: 9497 - protein, 211 aa, Klebsiella pneumoniae
RGKAYLSAKNAKHNLSMQALIYRQSYGGFFCPFHPVPTASIRLSIWHILPRHARSPFRETTGDKVMMVIEGKEAIARVDWQRVRTIIAEAGLNERDVQQLEQAFRQSTFCWFGYENGQLIAVARAISDCTWSSYLADVAIVPARQGQGYGQQLMLAIREQLLPFGKIFIYAVADKITFYQRFGFAMLTTGMVCASEEGMQKMQEQGYIRQP

SEQ ID NO: 9498 - protein, 294 aa, Klebsiella pneumoniae
MRKAISGVLTAIVTPFTAEGALNLPALRQQVQRQLAAGNGIFCGGTNGEFFVLNEEEKIAVARTCVEEAAGRAPVVAHIGEVSTRETRRLGQQIARLGVDAVSAITPWFVPLKQEELINHYTAIADALSVPLFLYNIPARTGNTIAPETARQLARHENIVGIKDSAGSYDSLKGFLDAVRDIDGFDVLNGPDSLIHQGFVDGCSACISGLANVAPAEINAIWSRFHAGDIAGSRQAQEQVTGLRTDLYKVAFSPAAVKKALQLMGHEVGDSRYAVQFSDHQLQQIKNIINTYLH

SEQ ID NO: 9499 - protein, 121 aa, Klebsiella pneumoniae
RQEAAGCRAQKRCCAAQCHPLSRKIAMSPFRLALICLCLAPLASSAALSGQVHFSGRVINPACVIAPRHDRIDVSCQHHSPEQVALTNNRPRYAMPDNRGEVSIHWRNAQHSEADVIIRYR

SEQ ID NO: 9500 - protein, 317 aa, Klebsiella pneumoniae
QLLATVRHFADQHKVGIDPGAAVLQPGAKTMGATDIFRPYRGGQTILRVIRPAQGLRFIAERRHADYRTKHFALDNSVFLPGAGEQRRLEVIARAVSPTAAGDHLNVRQRPCGFHRRANALKMGQRAQRTQFGGSVLRRPHFQAGHRRPKFLHQLVIDTLLGVDPAGGRAVLAGVVKTEGPHPIHHRIDVRIVKNDHWRLTAQLHVGAFNRRGGMANDMGSGGNRSGQGDHSHFNVGGQGVAHRFTAAKQHVDNPLREDIFCQLRQLQRRQRGDLRGFYHYAVARRQRRGQLPGRHHQRIVPRRDGGHHAHRIAADH

SEQ ID NO: 9501 - protein, 203 aa, Klebsiella pneumoniae
RQLACGCQVAVGPLSGRCRGGWRPGSPYSITGLHPQNVMEHTNMNSNNQVKQLRLQRAWSQEQLAEMAGLSVRTIQRIENGERPGLETLSALAAVFEVTVAEIGGEARREDAPGQEASLDLRIEEAKARVHQESRFFRSLSVALVVCVLLAVLNRFTNPQYYWSGWVALIWGALLVVRGLRLFVFGEWIKNWRQARLQRLLRK

SEQ ID NO: 9502 - protein, 449 aa, Klebsiella pneumoniae
HIMANTITADEIREHFSQAMSAMYQQEVPQYGTLLELVADVNLAVLENNPQLHEQLANADELARLNVERHGAIRVGTAEELATLRRMFAIMGMYPVSYYDLSQAGVPVHSTAFRPIDDAALARNPFRIFTSLLRLELIENRALRERAEAILARRKIFTPRCLALIAQYEAEGEFTSADAREFVQEALETFRWHRQATVDEETYHALHREHRLIADVVCFPGCHINHLTPRTLDIDRVQSLMPECGIEPKALIEGPPRREVPILLRQTSFKALEEPVMFAGEHRGTHSARFGEIEQRGVALTPKGRALYDRLLQAAGTGKDNLSHQQHLQEVFSEFPDSEFLLRQQGLAWFRYRLTPTGEAHRQAFRPGDDPQPLIERGWVVAQPIIYEDFLPVSAAGIFQSNLGNETQARSHGNASREAFEAALGCLVQDEFELYRQAEERSKRRCGLL

SEQ ID NO: 9503 - protein, 343 aa, Klebsiella pneumoniae
DVMATIKDVAKRANVSTTTVSHVINKTRFVAEETRNAVWAAIKELHYSPSAVARSLKVNHTKSIGLLATSSEAAYFAEIIESVEKSCFQKGYTLILGNAWNDLEKQRAYLSMMAQKRVDGLLVMCSEYPDSVLSMLEEYRHIPMVVMDWGEAKADFTDAVIDNAFQGGYIAGRYLIERGHREIGVIPGPLERNTGAGRLAGFMQAMKEAHISVPENWIVQGDFEPESGYRAMQQILNQQHRPTAVFCGGDIMAMGAICAADEMGLRVPQDISLIGYDNVRNARYFSPALTTIHQPKDSLGEAAFNMLLDRIVNKREESQSIEVHPRLVERRSVADGPFVDYRR

SEQ ID NO: 9504 - protein, 442 aa, Klebsiella pneumoniae
LVMATLTTWMNNVRVGTLTRQANGAHSFRYDEEWLRSPRARPLSLSLPLQYGNITADAVYHYFDNLLPDSPQVRDRIVRRYQARSKQPFDLLAEVGRDSVGAVTLLPPGEEAHLEGLRWQTLDEAQLTALLTAYQSDIPLGMITGQDDFRISVAGAQEKTALLRMGEQWCIPQGATPTTHIIKLPIGEIKQPNATLDLRESVDNEYLCLALARELGLAVPEAEIIATPRIRALAVTRFDRRWAQEGRVLLRLPQEDLCQAFGLPSAMKYESDGGPGIAAIMTFLLGSSEALKDRYDFMKFMVFQWLTGATDGHAKNFSIYLLPGGSYRLTPFYDIISAFPVLGGTGLHLRDLKLSMGLNATKGRKTEINAIYPRHFLATAKAVNFPREQMLAILQEFAGHVPQAIESARRTLPADFSSHVWQAITENMLKLHARLQQGLQAL

SEQ ID NO: 9505 - protein, 82 aa, Klebsiella pneumoniae
ISPAVSEIKSALIIKDQIVDKKSSIRGNNHLLTGAVGFDSPNRTSLHIAHRGDKDPSIFVYRQAGSTERILLKDNGKLPLRG

SEQ ID NO: 9506 - protein, 293 aa, Klebsiella pneumoniae
SKPAPNLTTARRLPPAKRVRLRPGRAKRSSRPRRWTPRPPNRSIRARRRWKPLSPAPKRVKPNSRPRRWKPRPPNRSTRARRRWKPLSPAPKRVKPNSRPRRWTPRPPNRSIRARRRWKPLSPALKRVKPNSRPRRWKLRPSNRSTRARRRWKPLSPAPKRVKPNSRPRRWKPRPSNRSTRARRRWKPPSPAPKRVKPNSRPHNRISRQPQPMTTRAKRPSPRLSPAFRRVKQHSRQLTRNKWFSESQAPPIPITSGRPRVLCCWCCSPLCLALWSRPGFSAGAPYCRLSSPP

SEQ ID NO: 9507 - protein, 395 aa, Klebsiella pneumoniae
CRPALNTPIRCMKKTIFSLALGTFGLGMAEFGIMGVLPDMAHDVGISIPAAGNMIAWYAFGVVIGAPIMALLSSRFSLKSVMLFLAGLCILGNTLFTFSSSYAMLALGRLVSGFPHGAFFGVGAIILSKIAPPGKVTAAVAGMIGGMTIANLVGVPGGTWLGHHFSWRYTFALIAVFNVAVFLAIFCWVPTLYDRASTRLREQFRFLASPAPWLIFAATMFGNAGVFAWFSYIKPFMLNVSGFAESKMMLIMMLAGLGMVVGNLFSGKISGRYSPLRIAAMTDGVIAVTLLLIFAFGEHKVASLALAFLCCAGLFALSAPLQILLLQNAKGGEMLGAAGGQIAFNLGSAIGAFCGGMMIAQGFGWNSVALPAAALSFLAMSALLIYGCHQRRQAY

SEQ ID NO: 9508 - protein, 462 aa, Klebsiella pneumoniae
HQAARIMLSRRRGVNTTMTTINHTPAGEQRGKKRLIHRFSWVSLLVCWLIWVLNAYDREMILRLGPVISKEFSLSPEQWGNIVALIMVALAVLDIPGSIWSDRYGSGWKRARFQVPLVLGYTALSFISGIKAISHGLTAFVLLRVGVNLGAGWGEPVGVSNTAEWWPKEKRGFALGVHHTGYPIGALLSGVVASLVLATFGEGSWRYCFLLALLVAIPLMIFWAKYSTADRINTLYQHIDSQGLTRPATQESSHVAKGEGMKTFLRTLRNRNISLTAGNTLLTQIVYMGINVVLPPYLYHVSGLSLAASAGLSIIFTLTGTLGQVIWPWLSDSFGRKRTLIVCGLWMSIGIALFYFATNMPRLIAIQLFFGLVANAVWPIYYAMASDSAEERATSTANGIITTAMFIGGGISPLLMGWLIQFGGGWENPAGYIYAFFTMAGCALLGMLLQLMTTDKTPRKAH

SEQ ID NO: 9509 - protein, 102 aa, Klebsiella pneumoniae
IFQAVTSLWKLSRKINIKLTAGIYFLVGKVNNHRTNRKEPMMKSNTLRKRPTDVPVQKASEQPGKDLREADKQRQHKEFIAAMNEFIAKGGTLTDDEFFRVL

SEQ ID NO: 9510 - protein, 551 aa, Klebsiella pneumoniae
QGRAEREVRVMQREEWFHRAVIYQVDSSLFYDANGDGFGDLAGIRQKLHYIRSLGATVLWLTPFYLTPLQDDGYDISDHLQPDPRFGTIADVIELIARARELGLRVIVELVIQHTSAQHPWFQAARRDPRSPWRPYYLWADRPPENDDPPMFPGVEESVWRWDEQAGQYYRHMFYHHEPDLNLAHPPVIAEIENIITFWLQAGVSGFRLDAASHLVKQAGKGDETRGYPLLTHLRQVVQRLNPDAILLGEVDVAVEDYRHYFGQGDRLQMVLNFWLNKYLYLSLAQQRAAPVVKALQAMVTPPDGCCFVNWLRNHDELDLEGIGERNKRQVIRTFAPDKSMSVYQRGVRRRLAPMLDGDTRRIALAHAILLALPGVPVMRYGDEIGMGDDLSLPERYAVRTPMQWSAAANAGFSRAARDDLPVKPVASGRFRYQRINVETALRHPRSLLHRVRNMVLARTEYTEPGSLPFTLLTLKPDAVLGLLYRSESREVLMLANCSQQAVEVLLPPLAEGYWSPILEDKLYQDGLHGGKDARLALSGYGYRWFSRSLS

SEQ ID NO: 9511 - protein, 144 aa, Klebsiella pneumoniae
PPRASVRPSAASKSPKPDRGLEFAPTLRALPPGKHGFHIHAEGSCQPAMKEGKAVAAGAAGGHYDPQHTGKHEGPLGAGHLGDLPLLVVNDAGVADQPIIAPRLKTLAEVKGKALMVHVGGDNMADSPQPLGGGGERFACGVIK

SEQ ID NO: 9512 - protein, 326 aa, Klebsiella pneumoniae
SARAGQRPAQSAAARCRLELSQGPSAFPSGRGGTLLSGRVSRTRRAIDRLTITKKEHIMKYAAFKLAGVALSLSLAWTSAQAAALRVAADPVPHAEILNYIKKIDPSLDLKVVELTSGVNANELLASGDVDANYFQHVPYLKDQEKALGKTFTVAATVHIEPLGIYSHKHKDFSSLPENATVAVPNNTTNLSRALFLLQAQKLIKLDPKFTDPATTLATPKDIVENPKHLKILEIESPQIPRSLDDVDLAVINGNYALEAGLVPAKDALGLESAEHNPYANILVTTPALANDPRIKALAKDLTSPQVAEFIRKTYNGSVIPVAPQS

SEQ ID NO: 9513 - protein, 61 aa, Klebsiella pneumoniae
FLHFTFHCEGVRNNYFAQQRACGKCYLFSIFTMNVYRRKKRFCGGRYYSDVINNRADMSTR

SEQ ID NO: 9514 - protein, 62 aa, Klebsiella pneumoniae
LGNLLVSAQAGHKISAKLIAQNLTHARCVKNNPSLHYFESILTHFVDLNFLAAYFTLRGNYS

SEQ ID NO: 9515 - protein, 234 aa, Klebsiella pneumoniae
LTIYRRWFMSAKFSPSLMCMDLTQFKEQIAAMNKKADFYHVDIMDGNYVRNITLSPFFIENLKKITTVPIDVHLMVNHPEDIIPMCLEAGADIISFHPETANNKIFRLLNQIKDAGKKCGVVLNPATPAESIAEYAHLLDKVTVMSVDPGYAGQKFIPESLNKIRKLINMRKNNGYHYLTEIDGSCNEKTFGQIAESGVDVFIVGTSGLFSLHEDVSQAWDRMIEIFQRETVAA

SEQ ID NO: 9516 - protein, 103 aa, Klebsiella pneumoniae
FNIYRNCSAQTNKTLPYYMIVQNDYYADLATRVIIPLMRPQQLPRWHQHVVPRINIEFDSFLLCTPMISNLNNKRIPPQDFVCNLSHARQGVIDSIDTLITNC

SEQ ID NO: 9517 - protein, 150 aa, Klebsiella pneumoniae
DQHYYRIEKKNMNHSTLEIFIQVADTQSVTQAAKRLGRAQSNITTRIQQLEEELAVELFVRGNKKMVLSPAGVQFLSYARRILSLAEEAKAGSASDNPRRQSASGRDGGDRRQPAAAAAYPLPTAVPTGGYHPHHPTDPPVNGGGVNRRP

SEQ ID NO: 9518 - protein, 152 aa, Klebsiella pneumoniae
QANYKEMKLESPLGSDLARLVRVWRALIDHRLKPLELTQTHWVTLHNIHQLPPEQSQIQLAKAIGIEQPSLVRTLDQLEEKGLISRQTCASDRRAKRIKLTEKAEPLINEMEEVIGKTRDEILSGVSKQEVETLLHLIRKLEQNILDLQAKD

SEQ ID NO: 9519 - protein, 418 aa, Klebsiella pneumoniae
PQNYLSFTTSLFNNTQTGVDRRSNFVNSQAIDNLDMVSFNQHAAPAALFQQRLLDKGGVPHINPQTGKTVAHRTDILFPSQPGNHQRAFIRMLAISLLRMLIFGCGFAARGEQPQTGNTEGADQVHGRGFQQTEGDKHRPARRADSRREVIDDEIDETVSGADPDVKQPGQHLEKTVQQGVDKPQQWGGEDKEKLKRFGDPHQDGGNNQGDQRDFQPLLILRFRRTVEGERHAGGAKNLHHPIGEETGGITERVNGVAGDFGQENRLSANDGLTIDQQLTADRGKNERRPDQMMQPGGDQEPVEKAVQEDPDGAKGFHKAGQRRDAQLHYRPEIDGGDGEHANQRQHHDQHQLTVAVDRQRAAKLNPNHAIMDKGDSAAKDNPKEYAHIDNLKTEDKGLSAAVQLRVGGSGRQAMGEG

SEQ ID NO: 9520 - protein, 314 aa, Klebsiella pneumoniae
AKNYVYSEHFFIEEAVMVQRIAMAPQGPEFSRFVMGYWRLMDWKMSPGELVSFIEQHLDLGVTTVDHADIYGDYQCEAAFGEALKRAPHLRSRMEIVSKCGIATRARAENTIGHYITDRDHIVLSAEQSLRNLATDHLDLLLIHRPDPLMDADEVSEAFLALHHSGKVRHFGVSNFTPAQFTLLQSRLPFTLATNQVEISPVHQPLLLDGTLDQLQQLRIRPMAWSCLGGGRLFNEEGFQALRDELAQVAHELNADSIEQVVYAWVLRLPSQPLPIIGSGKIERVRSAIVAEKLSMTRQQWFRIRKAALGYDVP

SEQ ID NO: 9521 - protein, 286 aa, Klebsiella pneumoniae
NESYRGAMQQLDERLKGQYASLSPQEQRVADFIFDHFDDLISYNSAELAQLSGVSKATVSRLFKRLGYDKYKDMRDELRTLRQSGMPLTDQRDAVQGNTLLARHYKQEMANLTQWVNALDARQFAEALTAMVAARRIVVIGMRNAYPAALHLRQQLLQARGQVLVLPQPGQSLSEELVDLTADDLVVMMAFRRRPRIVRPLLQQLQRDGVPVLLMCEPQAHSLFPLSRWQLCAPLDSVSAYDSYASVNSLINLLANAFLHETLDSGRPRIHDIATLYQQLDELEQR

SEQ ID NO: 9522 - protein, 184 aa, Klebsiella pneumoniae
FIVYFLICMTNIAASSNFPRMTTMAKTDEVVSAKMIPVVQGIVDWIEAHIFDTLSVSAIAKKSGYSHWYFQRQFAMVTGCTLASYVSRRKMTIATIYLTQTQASIQSISQCLGYEGQAAFCRTFHRHFGMSPTRYRRDTPGKESNMQYPLRVGMEIEQERRSAAAAADRDQRMVFGVMTRRAPT

SEQ ID NO: 9523 - protein, 84 aa, Klebsiella pneumoniae
KGAYKMAYSQQENALWVATSQSRSLDKGRVVYRLEPTTLDVTHIIPNDLKPFGATIHHAHRHPGGLAITSTALVTAIEPQKRAR

SEQ ID NO: 9524 - protein, 258 aa, Klebsiella pneumoniae
GAVLADGPQRRGGDPGVTAPGIEVRGLSLHVGDRRLFDNLSFTVPGGQWVSLLGASGTGKTSLLRVMAGLAPATRGEVVASDGQPIQGRLAWMGQKDLLYPWLSVRDNVALGARLRGEKVDRARVAALLEQVELSSCADARPATLSGGMRQRAALARTLYEDRPIVLMDEPFSALDTLTRTRIQTLAATLLAGRTVVLITHDPQEACRLSHRLLVLSAADGDIDDSHHLAGTPPRAPDAPDLLIGQAALLQQLMRAQP

SEQ ID NO: 9525 - protein, 62 aa, Klebsiella pneumoniae
HQLYRIVVYVIIQLTNAVPTLSHRTILEKQHSFQVTPCDSRFVAGVVVRLFRLATARTEQQE

SEQ ID NO: 9526 - protein, 369 aa, Klebsiella pneumoniae
FMSLKQIWQAANPKGHLLTAISFLIPIVCGSGFIIAIGMGLGGTVQDTLTPGQFDVWQAMATLGAKALGLLPVVIAVGISGSIAGKPGIAPGFVVGLAANTISAGFIGGMIGGYIAGYIALAIIKNVKVPDWARGLMPTLIVPFFASIISCLIMVYIIGTPIGIFTEALTSFLRSMGTSSNLVLGAVIGALCIVDFGGPLNKTCFAFVLTLQAQGINEPITALQLVNTATPIGFGLAFFIAKLLRKNIYNREEVETLKSAVPMGIVNIVEGSIPIVMNDIVRGIAAAAIGGACGGAVTMVYGADATVPFGGVLMIPTMSHPMAGIMALLVNIVVTATVYAVIKKDIPRDVIVDNDYEEEDIDLDDIKVS

SEQ ID NO: 9527 - protein, 370 aa, Klebsiella pneumoniae
VPQYPMKGFNIMTLISSTRFFNGALLAGAMALISTEVAVAQPAPGTADSSGRLVQTWDKTFPRSEKVDHQKVTFKNRYGITLAADVYLPKDRGNKKLAALVISGPFGAVKEQASGLYAQTLAERGFVTLAFDPSYTGESSGEPRNIASPDINTEDFMAAVDFMGLQPYVDRERIGVIGICGMGGIALNAVAVDKRVKAVVASTMYDMSRVMSKGYNDSVTPEQREQALEKMSLQRWEDAANGKPAYQPAYNKLKGGEAQFLVDYADYYMTKRGYHPRAVNSGNSWSVTTPMAFMNFPLMTYIKEISPRPILFIHGEKAHSLYFSKTAYEAANQPKELLIVKNATHVDLYDRMDKIPFDNIIAFFNKNLNK

SEQ ID NO: 9528 - protein, 482 aa, Klebsiella pneumoniae
LLEYKKLFYMARLMLFACIPQCGQERMPYGHNRSPVCGRNLPLSVRHPGWMRFTEACLLKTENNMTTLSEPLVTPKYGKWRQLVLGLICMAAISSPQYVWTLLTKPLAAKLGVGLPELQVTFSLLIILQTFFSPFQGRLVEKFGPRRLIAIGTVMAGMSWVLSAQVNGLATLWLVYGCMGGLGTGIVYIGVVGLMVKWFPQQRGFAAGAVAAGYGMGAIITTFPISLSLTTNGLEHTMTTFGILFALVGFLASQGLKLPPPAVSQPVSQTVVQSSRSFTSREMLRQPLFWLMFAMMAMMSTSGLMVTSQMAVFAEDFGISQAVVFGMAALPLALTIDRFTNGLTRPLFGFISDRFGREQTMFIAFALEGVAMMLWLACREDPLLFVLLSGVVFFGWGEIFSLFPSTLTDTFGSEHAASNYGWLYISQGIGSIFGGPLAALLYQHTHGWHVVFSCAIGLDFVTAALALWVLKPWRARFIRQHS

SEQ ID NO: 9529 - protein, 70 aa, Klebsiella pneumoniae
RPEYSSQQSFNKIHHSYRIILVMMSVIPSFDACPAVTVSDFRNNAYQKVHHSQLMCIKVRIIRQFRNIRT

SEQ ID NO: 9530 - protein, 466 aa, Klebsiella pneumoniae
SMTLQHFTIAEIQRALHDGELSAREIARQTLDDIARVNPQINAWTEVTAQRMLAEADSIDALRREKRPLPPLAGIPYAVKNLFDVAGHTTLAGAELLSDRPPAASDSWAVRQLHSAGALLSGMLNMDAYAYGFTTENSHYGATRNPHDLSRIAGGSSGGSAAAVAAGLVHFSLGSDTNGSIRVPASLCGIFGLKPTFGRLSRSGSHPFVASLDHIGPFARRVADLAAVYDALQGRDPADDFQADKASERTGNLLDRGLEGLRCARLGGYFTTWCDDDARAAVDRVAHALGADSELQFADAALARSAAFIISASEGGNQYLTDLRHSPERFEPHSRERLLAGAMIPSAWYLQAQRFRRHARQAMKSLFSQADVLIAPATPCSATPIGAEEMVINGQPLPVRASMGMLTQPISFLGLPVVTVPLRTASGKPIGLQLIAAPFNEQACLRAARALEAMGITDARVAESAA

SEQ ID NO: 9531 - protein, 172 aa, Klebsiella pneumoniae
SEVYMTDIENYHNWLRDAHAMEKQAESLLVATIRRLDNEPQLRTRLEQHLYETRRQLSALQDIIARNHISRSALKDAMSRVAALGQTIGIMLPGDEVIKVIITAYVFAHFEVACYTALLTAAKRVGDHSAMHTLEGILAEERGMADWLLHYLPALTGQYLMDTDMPGVEAGH

SEQ ID NO: 9532 - protein, 484 aa, Klebsiella pneumoniae
MPIQFLTPIIQPAFNRNAGCGSDMMTDKVRIDTLRADLLDANNETFLARQAEFESNVRSYPRKLPLAITKAEGVWLTDADNKQYLDCLAGAGTLALGHNHPDVLQSIQSVITSGLPLHTLDLTTPLKDRFSEYLLSCLPGEGKEYCLQFTGPSGADAVEAALKLAKKYTGRTAVISFSGGYHGMTHGALSVTGNLSPKAAVNGMMPEVQFMPYPHLYRCPLGIGGEAGVKALTYYFENLINDVESGVRKPAAVILEAVQGEGGVNPAPVEWLQRIRKVTEEHGILLIVDEVQAGFARTGKFFAFEHAGIQPDIIVMSKAVGGGLPLAVLGIKKQFDAWEPGHHTGTFRGNQLAMATGLTTLRHLRDNKIADKVAAQGEWLKGKLAELQKRYPVIGHVRGLGLMIGIEIVKPNEAQDHMGCYPADGELSALLQKKCFEAGLILERGGRHGCVLRLLPSLLISDAELDVFLDKFEQALLAAGVKPV

SEQ ID NO: 9533 - protein, 128 aa, Klebsiella pneumoniae
RSVHDGSTLDKNCRVRGCCGWLSTSSLLPCSTILPSTINTTWSATSRAKPISWVTTTRVVPDRASFLMTSSTSPTSSGSSAEVGSSNRITRGFSASARAMAIRCCWPPERCRDQASALLRSPTTSSSS

SEQ ID NO: 9534 - protein, 436 aa, Klebsiella pneumoniae
VLSQRGFYGISIFMNGITNIFLRGVRIVSKMLALLLLTAWLRPCAAQGNELVMATTFSPSATVWIIDRWQQEPGSVMIRTLNRTSASLEQLLDTANAENVDLILTSSPMLLQHLQEHQKLAPFSGAPAGSQHLVPESIRSTSVAVAISGFGLLMNRSALMTRHLPAPADWDDLTDPRYQGALLMSSPSRSDTNHLMVESLLQQKGWIKGWETLLTTAGNLVTISSRSFGVADKIKSGLGVAGPVIDNYANLLLNDPHLAFTYFPQSAVSPTYVAVLKNSQHASEARRFIRYLLSPEGQTILADANTGKYPVTPLAPGNPRAAQQAMLMNQPPLNYRLILKRQRLVQRMFDTAISFRLAQLKDAWRALHSAEVRLKRPLPEIRALLTRVPVDPASSEDEAWLAQFDNKSFAEQQMMEWQLWFLNNQRQAITKLEELK

SEQ ID NO: 9535 - protein, 140 aa, Klebsiella pneumoniae
ATAQEGPAVKIRRGKMMSRRNNDAITIHSILSWIEDNLESPLSLEKVSERSGYSKWHLQRMFKKETGHSLGQYIRSRKLTEIAQKLKQSNEPILYLAERYGFESQQTLTRTFKNYFDVPPHKYRITNVPGESRYLHPLNN

SEQ ID NO: 9536 - protein, 97 aa, Klebsiella pneumoniae
TQYQRDVGERRAGVVSGLTPQPVPLPEKNEKTHHTLFATLTQANPLQAGLIQAAPSLLRRRSEQSKGMRVTRLRPSFFAAYSALSTRENSCSTVSPS

SEQ ID NO: 9537 - protein, 243 aa, Klebsiella pneumoniae
RKDLIMYYRNFIITSIEAERILAMKFDEAFAGVKKNVIDTLNQMGNGITRASYYTSCLMDNYQDVCSKLKQEDTRFIAGLAQLVNSRDIIFQMIKIYIETYFQNKKEEKAQYILKKLVGAGVYISSSGLTNRILIMAVATMICQTSRFNTVVYGRINRARSLVLKGSVTATAVVLNVYGLIQDAANSADNLKMHNSFYYNALYANHLEMMYFLIEPVITGVPYLNPMIISDDELAELLIKLMR

SEQ ID NO: 9538 - protein, 216 aa, Klebsiella pneumoniae
RPDHEITLSHPTPAGSPCGPEESAMTADIPAVPESIPVTDALTLIAIDERYVSDLHQLVVKNQRWLQQSLSWPAEVRNEDETRRHVQGNVMLHQRDYAKMFLLFLDKQLIGVLSFNQIEPQNKTAYIGYWIDEEHQGQGLLSRSLQAFIRHYAASGLVRRFVIKCRVANTRSNQVALRNGFVLEGCLRQAEYLNGSYDDQNIYARIIDRDEALKRA

SEQ ID NO: 9539 - protein, 97 aa, Klebsiella pneumoniae
TNRHRRRFRALPIITPGYNVPTFIQESYVGQSPLLRFSGKLTRSFRCLPSRRAAISQFRIASLNNLCAIERERQRYVYVFQTLISSTIIHRLTARRG

SEQ ID NO: 9540 - protein, 477 aa, Klebsiella pneumoniae
DVGHRAGLAADRQTRFPDLFAVRGIKGAQVEILGAGEEQQSGLRCQRCAKGRHADWNWHVHTDPQRPGVLYGANRHLPHQFPGFQIYRGHGAERRLLARNAQRRQETFAHRAKRRAFHRHDAHLDPAGVFRHLRARHHIVGQAQTHIVDKHQAVVWIQRNTAPVHAAERARELQGTVFTWRGKDALMAHLFELNAAQQQVDRCRSPHIGLGQRLVADHRHPYRVRLRRRVAFTFDVARRHRTLFHFGHRLAGLAVEHKDHALLAGLHQHRGGAALAVRQIVQQRLRRQVKVPQIVVCGLEVPAHLAGGGIHSHDRGAVFIVQRGTFAAKEIWRGVAGGQIDQIQLRVVGHRRPDVWRTARVGLTFRRNTGQRWIARIPRPCQFAGVDIKRADHARRFASGVVIRDAAAHHHHIARHQRGGGLLIVTRFHFTHADAEVDNTAIAEVFAQFAGIGINGDQAGVDGRQEQTTGTGGRLRA

SEQ ID NO: 9541 - protein, 398 aa, Klebsiella pneumoniae
REFQFMSKMMHDQPSAAVPASRDRRNFLIAGAGLALAATTLGRSGAVMAKPAGQDTPNAPSEAVPVQKETLTTRKLGSLEVSGMGLGCLPMVGYYGGGPRDRKAMVSLIRAAFEQGITFFDTAEVYGPHLSEEFVGEALAPVRDRVVIATKFGFGVEEGKPTSLNSHPDHIRRAVEGSLKRLKTDHIDLLYQHRPDPNVPIEDVAETVKALIQEGKVKHWGLSEASARTIRRAHAVLPVTAVQSEYAMWWREPETRIFPTLEELGIGFVPYCPTARSFLAGAVNPSQRFDSTDRRHNLPRFQPDALAKNMVLLEFAQSWARRKNTTPVQFALAWVMAQRPWIVPIPGTTQYPHLIENSGAPQVRLTDSELREIDAALAKIPLQGGRADPFTESQFDKS

SEQ ID NO: 9542 - protein, 110 aa, Klebsiella pneumoniae
SSIQFSAGEASFCCHVRQQAASGNGFSSASAVHSPRSIHGRAKWLGTMPTQSPADKQVADDSQSGTTTLFWLSSNHVVRLGNEREVSSRTSDGQLRRTSSLRGPSIFASG

SEQ ID NO: 9543 - protein, 83 aa, Klebsiella pneumoniae
TTTHVFFVIFHSVTSGFSIISKQHALQTPCGFLQLSILNKRRGDKADNASFSMEALFHNPSGLASCMNSIRRRSPVGNCRRLE

SEQ ID NO: 9544 - protein, 380 aa, Klebsiella pneumoniae
RRCQQRDGGAPESGDHDFLACHVVIILCLRSQITRPLRLVQVIAVDGRTSGPAKNNDLSRRPLFRYFDFVHKNSNNDRGRGMTRKDGLLALLVVVVWGLNFVVIKLGLHNMPPLMLAGLRFMLVAFPALLFVARPAIPLRLLLGYGLTISFGQFAFLFCAIGLGMPAGLASLVLQAQAFFTIILGAFVFGERLQGKQLAGIALAIFGVLVLVEGSLGGEHVPLVGFMLTLAAALSWACGNIFNKKIMSQASRPPIMSLVVWSALIPVLPFMLASLLIDGPQTMLASLQHIDLLTILSLLYLAFIATIVGYGIWGSLLGRYETWRVAPLSLLVPVVGMASAALLLGETLSGLQLTGAVLIMAGLYINVFGLRLVRPGMARG

SEQ ID NO: 9545 - protein, 263 aa, Klebsiella pneumoniae
RPRQTAEHRRQRPYQQLEAARVVPAEHQPVFGVTYRGEDPAKLTLRQRRAQPQGQQQQQNRGHKQGGAGAGGGDRKTQQRGKTGEAVIPAKPGLVAKEQQHTGIGQGLGHDREIDPFDLRAKGKPAEHQGQQTGNQHHQRHRPGEMLRAPPEPGQLAPGEKRHKRRQTVARRLAHQVHSHGVPAEGKEDPVPQRQHARIAPDQIQRHRHNGVAEDFAAQRQQPARHRQRMGGRQQRQEWHTQQPQHQQDPQPAQRPRRALRQR

SEQ ID NO: 9546 - protein, 441 aa, Klebsiella pneumoniae
CNIQKLLIHKKATNTSHCTDAVRHEPSLCLRQAVFLPPANWYANCCSQSQHREKEKKMKAIVIGAGIGGLSAAVALKQSGIDCDVYEAVKEIKPVGAAISVWPNGVKCMAHLGMGDIMETFGGPLRRMAYRDFRSGENMTQFSLAPLIERTGSRPCPVSRAELQREMLDYWGRDSVQFGKRVTRCEEDADGVTVWFTDGSSASGDLLIAADGSHSALRPWVLGFTPQRRYAGYVNWNGLVEIDEALAPGDQWTTFVGEGKRVSLMPVSAGRFYFFFDVPLPAGLAEDRDTLRADLSRYFAGWAPPVQKLIAALDPQTTNRIEIHDIEPFSRLVRGRVALLGDAGHSTTPDIGQGGCAAMEDAVVLGAVFRQTRDIAAALREYEAQRCDRVRDLVLKARKRCDITHGKDMQLTEAWYQELREETGERIINGMCDTILSGPLG

SEQ ID NO: 9547 - protein, 735 aa, Klebsiella pneumoniae
RHSQKQTEPDMSTSNDPSNNASAGKCPFHAETPKQSAGSGTANRDWWPNQLRVDLLNQHSNRSNPLGENFNYREEFKKLDYSALKADLRALLTDSQEWWPADWGSYIGLFIRMAWHGAGTYRTVDGRGGAGRGQQRFAPLNSWPDNVSLDKARRLLWPVKQKYGQKISWADLYMLAGNVALENAGFRTFGFGAGREDVWEPDLDVDWGDEKEWLAHRHPESLAKQAIGATEMGLIYVNPEGPNASGEPLSAAAAIRATFGNMAMDDEEIVALIAGGHTLGKTHGAAETSHVGAEPEAAPLEAQGLGWHSSYGSGAGADAITSGLEVVWTQTPTQWSNYFFENLFKYEWVQTRSPAGAIQFEAKDAPEIIPDPFNPEKKRKPTMLVTDLTLRFDPEFEKISRRFLNDPQAFNEAFARAWFKLTHRDMGPKSRYLGPEVPKEDLIWQDPLPAATHQPSAEDIASLKTAIAGAGLSVSELVSVAWASASTFRGGDKRGGANGARLALAPQKDWPVNAIASRVLPTLQAIQRASGKASLADIIVLAGVVGVEQAAAAAGVSVNVPFTPGRVDALPEQTDVESFDLLQPLADGFRNYRRIEGGVSTETLLIDKAQQLTLTAPEMTVLVGGLRVLGANYDGSKHGVFTDRVGVLSNDFFVNLLDMATVWKAADDNAELFTGSDRKTGEAKYSATRVDLVFGSNSVLRALAEVYACADGQQKLVHDFVAAWTKVMNLDRFDL

SEQ ID NO: 9548 - protein, 110 aa, Klebsiella pneumoniae
PLPQDTIMQSWSSKDFTADRAWGALDIANFSGTTVRLHWTDQPYIWHINDGQEVFAVMDGQVAMHVKVDGEEQIIMLNAGDIFYAGVGCEHVAHPQGAARILVIEKEGSV

SEQ ID NO: 9549 - protein, 521 aa, Klebsiella pneumoniae
AITQRRKSFNSVRYDNTGVINPDWGDVFLSCVVQQNKGTTMSFITNLNQQQRKRLHQITLVATFGGLLFGYDTGVINGAFSSLKQYMALTPTTEGLVMSVLLVGAALGSVFGGKFADYFGRRKYLLFLSFVFLIGALLSAAAPDITTLLIARALLGYAVGGASVTAPTFISEVAPTEMRGKLTGLNEVAIVIGQLAAFAINAIIGIIWGHLPDVWRYMLLVQAIPAICLFVGMWRAPESPRWLISKNRHDEALHILKQIRPAERAQKEYDDISTLIKIEAGNKYSAQSTFATIVKTPWILKILLVGITWAALQQTTGVNVIMYYGTEILSAAGFSERTSLICNVLNGVFSVGGMLIGVLFLVDRFKRKTIIIYGFAIMATLHLIIAAVDYTLVGDLKATAIWLLGALFVGVMQGSMGFITWVVLAELFPLKFRGLSMGISVFFMWIMNAVVSYLFPLLQAKLGLGPVFFIFAAINYLAILFVVFALPETSNKSLEQLEAELSANHEDKKSTRLTREVGYDR

SEQ ID NO: 9550 - protein, 311 aa, Klebsiella pneumoniae
QTTQGIIMPYLLLTLAALFWGGNYVVGHVLVQGVDPILMTEARWALTALLLGLLYRRQIAGSRHLLRANAPAVVVLTLCGQVSFPLTLYIGLQTTSALNAAIYMSATPSMVLLINRLFFRDPVSGRNWLGVAFSTLGVMILLFQGNPLHAASLHTFAIGDLWAMGSALSWALYCSLLRLKDRRIPANGFVAVSSLLGALILVPIVIFWLMRHPAQDWAAWREPFFLSGLAYLVIFPSWLAYLFWNKGIATIGATRGEIYTHIIPLSGGVLSILFLHTQPQAWHLFSALFIMVGIGICSLEKRQAASICLRD

SEQ ID NO: 9551 - protein, 339 aa, Klebsiella pneumoniae
KPKHNEVTMSVMVITGGTAGAGKATALRFARAGYHVALIARDETGLQETRQACERFGIKTLAISADVVDAGALQRAAAEVETTLGAIDVWINNAMTTVLAPFRQMSEEEFRRVTEVTYLGYVNGTRAALEVMIPRDRGVIIQAGSALAWRSIPLQSAYCGAKAAIRGFTDAVRTELMHEKSHIQLTMVQLPGMNTAQFGWARNKMDQAMQPVPPVYQPEVAAEAIYSVIQRPVNELWVGKSTIQSILGQVFFPRLLDRLMVKKAWEGQFTGQPKSSDQQDDLFTPVRGNHPGHGPFNDGARRKAVTISADLPGKVAAGVGVAVATMALRALFRRSGKRR

SEQ ID NO: 9552 - protein, 350 aa, Klebsiella pneumoniae
KKEHRMKYVNLGRSGLKVSRLCLGCMSYGEPERLPQPWSLDEKASRPLIRQALEAGINFFDTANIYSGGSSEEITGKALREMARRDEIVVATKTFFPWRNSPNTGFLSRKAIFQSIDDSLMRLGMDYVDLFQIHRFDYSTPVEETMEALHDVVKAGKARYIGASSMEAWRFAKMQHTAERNGWTRFITMQPQYNLLYREEEREMLPLCEDQGVGVIPWSPMARGRLTRDWSVTSRRTQNDAFALKMYENAALLDKPVIDVVASIAEKHAVPRAHVAIAWLLSKSVITAPIIGATKPEHLSTAISALDFSLSDAEITELEARYLPHPVDGIIPPLPDTPPSLTPPSAIQNY

SEQ ID NO: 9553 - protein, 355 aa, Klebsiella pneumoniae
YQLHKRGGKMSDAIRVGLVGFGYASKTFHAPLIGGTPGMALKAVASSDADKVHADWPGVKVMSAPGDLLDDPDIDLVVIATPNDTHFPLAKAALEAGKHVVVDKPFTVTLSQARELESLAKHCGRILSVFHNRRWDSDFLTVSALINEGQLGEVCYFESHFDRFRPQVRRRWREQAGPGSGIWYDLAPHLLDQVVVLFGLPVSITVDLAQLRPGAQSTDYFHAVLAYPQRRVVLHGTLLAAAESARFIVHGSRASYIKYGLDPQEERLKNGERLPQEDWGYDMRDGTLTRAEGDERSQEKWLTLPGNYPAYYAAIRDALNGVGENPVPASEAIQIMTLIELGIESARHRATLSLV

SEQ ID NO: 9554 - protein, 85 aa, Klebsiella pneumoniae
NRLHSCEAGHCFNAELLRVHHIRWRWGLIVIYMVCDNQKQCRNTKNNPANKFYNTGKNSCHNTSISFEHSVKCYSMVSRSQGVSV

SEQ ID NO: 9555 - protein, 253 aa, Klebsiella pneumoniae
LPLFQGQRPPALILFLVTGSSIMQCYKAAFILSLLFCPFLASAAGVAIAGTRVIYNEQSHEADITVKNTNPHDPVLIQSWVDDLADNNKSPFIVTPPLFRLDAGDSNDLRVLLTSAQLPNDRESLFTLNIKVIPANTAPAGENILQFAIKNQLKLIYRPAGLPGSALDAAQHLRWRVSGNHLQAENASPYYVTITTLSCAGQNQKTPLERSVIAPHSREEYSLPGEACAREVSWRILDDFGAVQTFSAPVSAH

SEQ ID NO: 9556 - protein, 368 aa, Klebsiella pneumoniae
CDSQIYFRYILFFKRLVILVKSFDADGSPKEKRRKGTGKITLTEVAEFVGVSAMTVSRALRMPEKVNPELRDRIDAAVSQLGYVPNLQARNLASVHSDLILAVVPTFSSPGFLPVSEALQKVLTERGYTMMFMESGHDGQSEQKTFEKMLAYNPAAIIQFNIDTIESCTQLLANVDVPILEIGALNTHPVGMCIGVDYGKAVKQLVTHLADASLKNIALLCTPANNTMFRQLLSGWNTAMLALNRSPHRVVTTHLPSTIATGVNIFKDMMITWGDLDALICTSDEMACGCMMACHSAGIKVPNTVAIASLGGGVLSTVCSPALTTVEFPWHDIGVKAGKALLELLNDKPGEKFIEIPSVLKVRASTAA

SEQ ID NO: 9557 - protein, 488 aa, Klebsiella pneumoniae
PASQLCNRFQKPVAHMFALLLHSLYHQTGSFFMAAFPHNFLWGAATAAYQVEGGHDADGKGPSIWDIYSHLPGTTFEGTTGDIAVDHYHRFREDVALMAEMGLQSYRFSISWPRLLPAGRGKVNEAGVQFYSDLIDELLAHNIEPMITLYHWDLPQALQDEGGWEARTTAEAFAEYARLCYARFGSRVKLWATFNETIVFIGHGYINGLHPPAVRDPARAIQACHHVFIAHALAVKAFREMAVAGEIGFVNVLQPHTPLTDSEADIKATELADAIHTHWLYDPVLKGTYPADLLAQTQALWGVPRFAPGDDALLRDNRCDFIGLNYYRRETVSAQPPEIATGGEPGVEGLFYFVRNPQSTYTEWGWEIWPQGLTDGIMMIKARYGDIPIYITENGLGAKDPIIDGEVVDDPRIDYLSSHIGALEKALALGADVRGYYPWSFIDLLSWLNGYQKQYGFVYVDHQQNLARKRKKSFYWYKSVIASHSEQR

SEQ ID NO: 9558 - protein, 272 aa, Klebsiella pneumoniae
INPHVKRSRRRPFMPSSHNGHISITGVSKYYGRHKALDDVSLEIPPGTVTVILGPSGSGKSTLLRTINHLERVDEGFIQIDGDYIGYRRKGDKLYEMKEKEILRQRINVGYVFQNFNLFPHLTVLENLIEAPIAHQQVTRKEAIARAYELLDVVGLRNKADAWSRHLSGGQQQRIAIARALALNPRVILFDEPTSALDPELVGEVLDVIKKLARSGTTLVVVTHEIGFAREVADQVVFMVDGRIVEQGSSDEVLNHPQHPRTRQFLSRVLPS

SEQ ID NO: 9559 - protein, 115 aa, Klebsiella pneumoniae
ASPHHDAPDSFFAKKQSVEFFELFTRQSRTEISITRLDQFQSLICEPGWQLAVTTHATSSAGHTKRSAFTVTGKKSAALPVADTEVLGRTARCDATFNDVLYNLDPVDLFQSKHS

SEQ ID NO: 9560 - protein, 216 aa, Klebsiella pneumoniae
QGKHNMNKAKRLAILTRLRENDPHPTTELHFSSPFELLIAVLLSAQATDVSVNKATAKLYPVANTPAAMLALGVDGVKSYIKTIGLFNSKAENVIKTCRILLEQHNGEVPEDRAALEALPGVGRKTANVVLNTAFGWPTIAVDTHIFRVCNRTQFAPGKNVEQVEEKLLKVVPAEFKVDCHHWLILHGRYTCIARKPRCGSCLIEDLCEYKDKVYA

SEQ ID NO: 9561 - protein, 241 aa, Klebsiella pneumoniae
LQKQQNRGTDEVKLSSGSITTGRTSGLLTLAIGALFYSSGSIARPDLQPLGPNIADKGSAFYHFTQRQYDSADGERHYRVWTAVPDKAPPAAGYPVLYMLDGNAVMDKLDDAFLQQLFAGSPPVIVAIGYQTALPFDTAARAWDYTPPLKTHEPRAGKPALPPRKTGGNDVFRQLLTETMVPQTEANLKIDPHQRAIWGHSYGGLFVLDAWRKASLFGIYYSGSPSLGQAPAIAFAGKPKS

SEQ ID NO: 9562 - protein, 126 aa, Klebsiella pneumoniae
CAEQPDLLAGEAQGMSKGDPLRGDKYPQPHPGIQQRRPVMMPHMFQQPQRTCNQRYRAQRAGDGAQRNNGPRRAHPGQQRQAGDGQPGGDNAQSGGGPRLHPRQQQRADQIASVIGRRSEIAFVQG

SEQ ID NO: 9563 - protein, 73 aa, Klebsiella pneumoniae
REWQTRIKYIESRIGNLYQSGMSHLTGDETADKEPPATGSDRPFFLNHQNTRRPLRVSDMLASHPGVEDIAGV

SEQ ID NO: 9564 - protein, 542 aa, Klebsiella pneumoniae
AIRQFPLLNFPRLLLLNTRYQERHMNSTSADFQNLYQALSHSAARSPDALALAFEDRRYLYRDFHLRVQRAMAQLDRGWSLRKGDRILLAWGNHPAFCEVLFAALGLGIEVVPFSTKLKQAESEALVGHIAPRVVLFDATVQDWLKNTPDARAVSLSEWQALCLPEPLTRPPVPVNRDDTAVMMFTSGTTGEPKGAIITHNNLLCAIDAYTQKLNLTAADSTILAVPIYHITGLSALLALFISLGASIWLQHRFNAPQVITTLREQNITFLHGSPTIFILLCQAAREQSANHPSDFPALRTIACGAGHLSDGLIKELKTLFPHTAIQPIYGLTETTSPATIFPGDVWGSDKCGSSGQAIPGLAITIRNDRQQPLPAGQIGHIWLKGDVVIREYWQHSERRPSCDAQGWFCTGDLGYLDDEGWLYIKDRSKDMINRGGEKIYSLELENILSTYRGVREVAVIPTPSPVYGEEPVAFIVPDGQHHLTSEEILDWLKVKIARFKLPARIIFTRALPRTHNGKVSKQQLKTRLAESIITLSTEDKK

SEQ ID NO: 9565 - protein, 64 aa, Klebsiella pneumoniae
IRRHLLVSFGRSYILRRRRSIICRIPDNQRGGKMLMLNVVNGEKEEDDATRAPESGDKQPERDK

SEQ ID NO: 9566 - protein, 211 aa, Klebsiella pneumoniae
LYIKLTRKCDGWVEAAQVKMAPPLPVSLRRREEMKLPLTTPRLLLRRFRTEDLPSFSHYRNLPEVARFQSWTHYGMTEATAFYEQQRSQAFAEDESWFQLAVEIQANGALAGDVGIHFLDHGRQAELGMTFSPAYQHQGYAREAMRAVMALLFEQLAYHRLTAVVDTRNTGAIKLLEGLGFRREAHYRQNIFFKGEWGDEYLYALLRSEYQ

SEQ ID NO: 9567 - protein, 223 aa, Klebsiella pneumoniae
QSINISRQTILPEEHNTMSTTQVLGETPYASPGQPHASLTGRIDALPASFGLWSFITLLSLGGFFELYDLFQTGYISAGLLAEGIFHTGQAGIFGIADQAAFASATFMGLFIGASLLAPLADKLGRRLTFMVALAWYGLFSLLMATQSSAEGVIFFRFLVGIGLGIELVTIDTYLSEWVPTHLRNKAFAFAFFIQFLSVPAVALMSWMLVPTTLFGPHPLALG

SEQ ID NO: 9568 - protein, 121 aa, Klebsiella pneumoniae
ESTKYRTLSGVAVCRSPRPPVPAVRQRYMPSREELVHPIIKVMLVGGKADGLLVSVADDATEVSVTPAQYGALSGQPLSYRIVSQTIDDERYFFGVFSDAHQDSDKLTRVALTRGMKKMFC

SEQ ID NO: 9569 - protein, 67 aa, Klebsiella pneumoniae
CAHKPHKGLSFTFLHQLTLHCLYPTLAIANNDIRFTMLRISPVNTDLTAIVRHGVARTVVCQGDLFR

SEQ ID NO: 9570 - protein, 62 aa, Klebsiella pneumoniae
GWNNPNLTSAIITQRYPPKYAKDQSVKAYRYAYDWPLTAMLRVIQGLSPGEADLFLELARSV

SEQ ID NO: 9571 - protein, 660 aa, Klebsiella pneumoniae
RCDKAMLPGRYAVGFSSDSGDVPLMPLLRDEIRDHSAEEMLFIRRAAIAFLLVVVCFGVLIVNLYHLQVEQHDFYQTRSNQNDIKMLPIAPSRGLIFDRNGIPLVQNITLYRLQVIPSKIPDMAALLQQLTPIVDLTPDDIASFRDDMHHTSRYKAVTLKSDLSDVEVARFAVNEFRFPGVTVESYQQREYPYGAELAHVVGYVSKINDSDLQRLAKNGEEENYAADRNIGKQGIEGYYEKALHGTTGYQEVEVDNHGRVVRLLKEVPPVAGKNIYLTLDLHLQQYIESVLKGQRAAVVVVDPRDGGVLAMVSSPSYDPNPFVKGIGYQAYKSLLENPDRPLINRVTQGLYPPASTVKPYMALSALSAGVITPNTTFFGAPTWTLPGTQRRYRDWLKTGHGMLNVTKAIEESADTFFYQVAFEMGIDRIHAWLSKFGYGQSTGIDLNEEYAGVLPSREWKQRVHKKPWYQGDTISVGIGQGYWIATPIQMVKALTTLLNNGKVQDPHLLYSMKQGNHVERYQQPANLPQVGDPKSPYWGIVRNGMYGMANQPNGTGYKLFHTAPYQIAAKSGTSQVFSLKQNQTYNAKMIPVRLRDHIFYTLFAPYQHPKVAMALILENGGGDGVVAGPTARAILDHIFVPQQASSAAADVPQRDSADAQ

SEQ ID NO: 9572 - protein, 442 aa, Klebsiella pneumoniae
MKDNFVVTIAGGGSTYTPGIVMMLLENMSRFPLREIRLYDNHHQRQKTIGDACAILVAERFPQVKFSYTTDPQAAFTDVDFVMAHIRVGLYEMREKDEKIPLKYGVPGQETCGPGGIAYGMRSIAGVLELVDYMQQYAPGAWMLNYSNPAAIVAEATRRLRPDARIINICDMPVAIEGLFADILGLPSRKALNVRYYGLNHFGWWTSITDKAGNDLMPALKRHVAEQGYSSPKEDFQHKAPSWIETFKKVKDVFALDPTTLPNTYLKYYLYPDYEVAHSDPEFTRANEVMAGREKEVFDMAREITRRGTAEGAHFHAGAHATFIVDLACAIAFNTQERMLLIVENNGAIANFDETAMVEVPCLVGVNGPEPLAMGKIPSFQKGLMEQQVAVEKLVVDAWIEGSYQKLWQAIALSKTVPSASVAKAILDELIVANEGYWPALH

SEQ ID NO: 9573 - protein, 546 aa, Klebsiella pneumoniae
PLDKLRIFMRISVISAAVCCALFPLISVSAAGLSVEQRLAQLEARLNLAEQQASEASRRAQRAEQQTAAAEQRAAAAEQQVQALSQQTTAREQKQQATNQQLSEQLAKRAPDDGFTFNAYARSGMLVNSHGKGARGGPGVSPASSLNGDAHVGRLGNEKDNYAELSFGKKLTFNDGSWARFKTMLADGATNPDPWVQDNDSHHLNIRQLYVEMGNFAEFTGPLKRASIWAGKRFDRDNFDIHFTDSDIMFLGGTGGGINDVDWGSGLRGDYSVYARNFGDLGSDNYADNDIQNLLFTANHFYGNWQLMTTVMTAQGNDDLKDNTSTTGSYALRSDNTAKNGYYAMLALHDKQQFYGLAPGVSESALQYGVGLGAEARQPGSDGDLTENAASLRFASYGILPLGKNWQLAPSVIAQHSEDRYRDGDRYDWATFNLRVSQGISAHFALLYEASWQYMDLNPNGRSYRYNDNVYQYQAVRGDFYKLTFAPTFKVGDVLDIKARPEIRFFATWMNWDKALDRYAINDDFGSKGFTAGGTWNFGVQTEIWF

SEQ ID NO: 9574 - protein, 367 aa, Klebsiella pneumoniae
IMRNTDNGVIGSDQTAVMARLALDELIDQLLHSNALSLKLTANPLVADRAWHLTENTCIRAFSADDPQAKKRAHHALFILYQSWLADPLSPAAANQFHPLLSGIRNYIESEWLRAESKRFHHQRPMLNAGNIVNELRALCQQHPASHHPLFDFLASEASAAQIDYFFKSDSALNLLFFDLVAMGLVGSLPETRAEIAQNLWDEIGQGSTEITHVNLYKDLLKRRNIALPDNHFAHLYEWQGLAGYNAFMLGGVNRQHYYKSLGVMAMTELLDPPQYEKLVAGCRRIGLSERDVHYYAEHITVDIGHADGWLNNVIVPIGKKHPAAMEEVFFGAALRLQTCNDYYDGLLAALQSLGGSLSSHSVPPSE

SEQ ID NO: 9575 - protein, 577 aa, Klebsiella pneumoniae
LLSKLTMSTLLIAHALHVETAFGPLFNSLSFTLKKGDRIGLIGHNGCGKSTLLQVLDGTLAPTSGSVSLAGQCLMARVEQHLPEALHTQSLLQAVLAPLPADAREAQRWLAERLLAQMGFTPAVMEQQTATLSGGQHTRLLLARALIRQPDLLLLDEPGNHLDLPTLLWLESFLQTWQGSFVLVSHDNTLLDAVTNASWILRNQTLHCFALPCSAARQALQEQDESAALRHKAEQKEIDRVSASARRLATWGRVYDNEDLARKAKQMEKQVARLKDEQTELSVGPPWRLVLQGDALPADRLLEMDTLPVSPAPGLPSLFTTGVARLRSGDRVAIMGRNGGGKSSLLRLLWQQMNDASPLPGLRLHPRLHPGYYDQTLAQLPDEASLLEALTPFAPSADSRKRALIAAGFGWARHSQKVSTLSGGERSRLLFVGLSLARYSLLLLDEPTNHLDMEGKAALAQTLRDYPGGVLLVSHDRQLISESCNRFWLIDSAGLTEWRSLEEVYARLQAVAPAPDSRLALQSTPAGADDDEEALLARLIDLEQWLADDMARKPKHQKPSLQAQWQEEIARLLNQLT

SEQ ID NO: 9576 - protein, 313 aa, Klebsiella pneumoniae
HSGNLCAAPGVNGGVQTGKRMDIKQLKYLIALDQTRHFGQAAAACHITQPTLSMRIRNLEEELNLTLIQRGQRFEGFTPEGERILAWARAVLAAHDGLAAEAAICRGQMVGQLRVGMVPLASLNPMQLIKPLAEKYPALQFSLLSMTSEQIIDGVSRNQLDLGICYLQHLDEGQFKIARLPQTRMGLLHDKRHFDFSAGTPGWETLATLPLGFLTKGMYYRESIEISFKAKGLTPRYVFESDSTFQIIQAVQAGICCAIMPLNNGLEALSDNLEILPIAETHVDSQLALIMRQQEPVSTLAEKCFAEAQGIFG

SEQ ID NO: 9577 - protein, 260 aa, Klebsiella pneumoniae
KNGKGRAVIPIERHQRILALVEQRGAVSINELTEILGVSHMTIRRDVSKLEEQGLLVSVSGGVRAVSRLAAEPSHLVKSTLQSEEKQAIGALAASHIAKNSCIYLDAGTTTLALARAILDRNDLQVVTNDFEITQLLIDASQCGVIHTGGTLCRENRSCVGESAARTLRHLAIDTAFISASGWDSRGIFTPDENKVTVKETVSQVSARSILLCDSSKYNQVATFMALPLTRFTTIITDRHLSDAAASHIARHACEVLRAG

SEQ ID NO: 9578 - protein, 291 aa, Klebsiella pneumoniae
GCGKKMKNILAIQSHVVFGHAGNSAAEFPMRRLGANVWPLNTVQFSNHTQYGKWTGCVMPPSHLTEIVQGIADIDKLQTCDAVLSGYLGSAEQGEHILGIVRQVKAANPAAKYFCDPVMGHPEKGCIVAPGVAEFHVRYALPASDIIAPNLVELEILCGHPVASVSEAVAAARELIAQGPEVVLVKHLARAGLSMDRFEMLLVTAEEAWHISRPLVDFGLRQPVGVGDVTSGLLLVKLLQGASLRDALEHVTAAVYEIMLATKNMQEYELQVVAAQDRIAVPEHCFSATRL

SEQ ID NO: 9579 - protein, 321 aa, Klebsiella pneumoniae
REILLCGLLFGFTRFGAGDGGFHRRLARVDRFDGRGFHRRGLLFGFTRFGAGDSGFHRRLARVDRFDGRSFHRRGLLFGFTRFSAGDSGFHRRLARIDRFGGRGVHRRGLLFGFTRFGAGDSGFHRRLARVDRFGGRGFHRRGLLFGFTRFGAGDSGFHRRLARIDRFGGRGVHRRGLLLRFARPGLSLTRFAGGNRLAVVRFGAGLDHDRLRGIALFIPYPGQGGANRLLIFGGRLNGGFFMPFGARGFLTIPGAPVGPRIGLCLPQRAALPDESPRSRHFPDGSTAPAEYYLDIPTRRHRTRCSPPDYGQWLYRAADLC

SEQ ID NO: 9580 - protein, 388 aa, Klebsiella pneumoniae
MKINFPLLALAIGAFGIGTTEFSPMGLLPVIAKGVDVSIPVAGMLISAYAIGVMVGAPLMTLLLSHRARRNALIFLMGIFTVGNLLSSIAPDYTTLLLSRIITSLNHGAFFGLGSVVAASVVPKHKQASAVATMFMGLTIANIGGVPAATWLGETIGWRMSFLATAGLGLLAMVSLWFSLPKGSAGERPDVKKELSVLLRPQVLSALLTTVLGAGAMFTLYTYISPVLNTLTHASSLFITAMLVLIGVGFSLGNYLGGKFADRSVSGTLKGFLLLLMAIMLAIPLLAQSQAGAAISMIVWGAATFAVVPPLQMRVMRVAHEAPGLSSSVNIGAFNLGNALGAAAGGAVISGGLGYAFVPVMGAIIAGLALLLVWFSGRAQPEEAFASQ

SEQ ID NO: 9581 - protein, 87 aa, Klebsiella pneumoniae
GSVLKSGFTASKFNPFRFKPFFNCHDGIAALEKWFEEIGTPTRLEQLNIKEADLPAIVENVQINVKAFGIASDYRPKVVTEILMHVV

SEQ ID NO: 9582 - protein, 326 aa, Klebsiella pneumoniae
CIPKRSLQLGTFMLHHDIHEKLLAYTDRELELLRANYQLCHKFKSHMERRFFKDNYIHIEKQTRFTKIPLHSHGFIELIYIYQGKMHQKINEESLTLGKGEILLINQFARHEIEAAGQNDIIINFIIKTEFFGRLMSLFDENNIISRFILSAINGRKKHGEHIHFKVGEIDAIQNIMHVIISEIYSNNHLKEIRVNFLVGLLMTELLSNVQASDYHINGSYNESLAMAVLRYIDTDYKTASLKEISCRLNQPNYKVSKLIKDFTGKNFSDLLVEKRLDVLIHLLKHTNHSIIDVINMTGYENASHCYKVFKEKYNMSIKEYRDLNS

SEQ ID NO: 9583 - protein, 408 aa, Klebsiella pneumoniae
NYNNMTGKEIMITTLRRSTIALLASSLLLTIGRGATLPFMTIYLTRRFQLEVDVIGYALSLALVVGVLFSMGFGILADRFDKKRYMVCSVLVFILGFSAIPLVNNAPLVVIFFALINCAYSVFSTVLKAWFADRLTAEKKARIFSLNYTILNIGWTVGPPIGTLLVMHSINLPFWLAAACAAFPLVFIQLFLQRDGAAAAQPGAAPWSPSVLLRDRALLWFTCSGLLASFVGGAFASCLSQYVLVVASSDFAEKVVAVVLPVNAAVVVALQYAVGRRLSARNIRPLMTFGTVCFVIGLVGFMFSGASLWAWGISAAIFTLGEVIYAPGEYMLIDHIAPPGMKASYFSAQSLGWLGAAFNPMLTGLILTHLPHWSLFVILIVAIVAAWLMIFRGINARPWQPDSPLANA

SEQ ID NO: 9584 - protein, 425 aa, Klebsiella pneumoniae
PLNKSATRAMPQAACRRSRKVCAICATSDSDRRHDMINGLKPLDRTLRWGMVGGGGSSQIGYIHRSAALRDNTFTLLAGAFDIDAERGRQFGQQLGVDPDRCYADYQSLFRSEAARPDGIQAVSVATPNNTHYAICRAALEAGLHVVCEKPLCFSSEEADELVALSQRRRKIIGVTYGYAGHQLILQARQMIADGLLGDIRIVNMQFAHGFHAQPVEQENASTRWRVDPRFVGPSYVLGDLATHPLFLVETMAPQLKITRLMCARQSFVKSRAPLEDNAHVLMEYDNGAIGSLWSSAVNCGSMHGQKVRIIGEKASLEWWDEQPNQLRYEIQGEPVRILERGMDYLDPLARQDDRIGGGHPEGLFEAWSNLYRRFAIAMDAADRRDEALLADFWYPDARAGAFGVRWVENCVRSADNGACWVDFR

SEQ ID NO: 9585 - protein, 287 aa, Klebsiella pneumoniae
ALRKWEAVRDRYKLLAHFQVGDTLLNEIVIIALAGFTTGITTVLFGFGGGFVVVPFVYQLMLRQPAIAGNAMHVAVATSTAVMIFNAGWVSYRNWRAGRLAAQTLFPLLWFIAIGAVVGSCLAGILSENIVRALFILYMLATISDCLLRKGFFTGSARRRLSLPVVTGGGVIIGTIAALLGVGGSVMTVPLLRRHGYAMQECVSASNPLSLPVALCGAVTYAVIGWHSIPLSGFLGFISLKILGLLVLTGWAGIVFSRRAIPAVPDVWYARIYVLLLCLVLLAMLIQ

SEQ ID NO: 9586 - protein, 477 aa, Klebsiella pneumoniae
TARKVTLRGLYWAHNRLYLARSRVIAVSRCLFCFHFKPALGLHSVKCRSAPAVGRFGACMLLKELAVFEVLSTPIWVVHPFNERVVYANQASRTLSGEMSLNEMRNGIYSTCPETQLQHYLRYLDTMSEIFEVWTLPTANGLQSVYCKTTLIDTEDCGCLLLFEAVKLLAQNQSIHTGSRRYQRRNNGFFARFFMTNTAPMLLIDPHKDGRIVDANIAALRFYHYSDEEMRTKHTWQINTLGRDVIPIMNNIASLPGGHKPLNFTHILADGSLRHVQTYAGPVVLYNIRLMLCIIHDITEEVHLKKELEFSAAHDPLTGLLNRREFHRLVEAPTFIPRGYCLLLIDIDHFKSINDIHGHQKGDEVLLVLSRILETSVDREDKIYRWGGEEFLLFLPHSPIGRALILAEGIRQAVSEYQTLSVTVSIGVAEHHDGETVEQLFSRVDKALYAAKNDGRNRVTRMPFDCSERRRSRDGAA

SEQ ID NO: 9587 - protein, 446 aa, Klebsiella pneumoniae
QKSNFLYKQFTQAVTPARSAGRRAHSRQCRRDRDDKMHGWTSRQRNAAIASFLSWTLDAFDFFLLVFLLSDIAHSFHVDLEEVTLAILLTLAVRPVGALIFGRAAEKFGRKPILMLNIVFFSAFELLSAAAPSLMLFFLLRVLYGVAMGGIWGVASSLAMETIPDRSRGLMSGLFQAGYPFGYLLAAVAYGLLFEQLGWRGMFVIGAAPVLLLPFIYFCVEESPVWQAARQNKESTALLPVLRSHWKLCLYLVVLMAAFNFFSHGTQDLYPVFLKVQHGFEPKTVSIIAVCYNIASIIGGVFFGSLSEKIGRRKAIMIAALLALPVIPLWAFASGSLALGAGAFLMQFMVQGAWGVIPTWLNELVPANTRAVLPGFVYQLGNLLASVNATLQASIAQHHGHNYGLAMALVAGTVAIVITVLTFFGREGRVIQSAGAGHHQPLSTSR

SEQ ID NO: 9588 - protein, 406 aa, Klebsiella pneumoniae
PPIKRRAKRINAGERMKIVIALDSFKGSCSAQAACAAVAQGLRRVDQTLELVEMPVSDGGEGLLSTLADSPLLKGAVWQQQRCTSPYGLSVQADFLILPGERAIIEMAQSCGLELTPPAQRDVRQASSYGLGEQVKAALDAGCRHLIIGLGGSATNDGGIGFAQALGARFWRKDGTLLPAPAAGQDLAHIQRIDLSGLDPRLQQSEIQASCDVTNPLLGEHGATWVYGAQKGADEAALSELEAGMAHYSQLLTQTLGFDVSERPGAGAAGGMGAALIAYTGATLRPGIDLVLELLNADGHLRDAALTIVGEGWLDRQSAFGKAPVGVAGKAARHGVPVVALCGGRDESSRQLYQHHIDAMWSICQRPMALAESMNTCEPLLADAAENVLRTFLSGWRGEAHKRITV

SEQ ID NO: 9589 - protein, 82 aa, Klebsiella pneumoniae
SGSKPLPAGRPPAPRWKKSASSPTSLKARIDIKGAGGIRDLSTVRALYQLGVRRFGMSHGAVTKVLAELEQHPERFPELNAN

SEQ ID NO: 9590 - protein, 321 aa, Klebsiella pneumoniae
SIPKIIKENHAMQKTTLLLAVALAFSASSWGQDVKINGTGVSLEANKTPIHTAKNPQAIALLPQALHLAVPGKFSVAVAALNSPPLTVFADDNKTLLGSEADIARLVAESLGLEVNVVPTSWEDWPLGVTSGKYDAAISNITVTKERKEKFDFATYRKDSLGFYVKSTSPLSKIDKAEDIAGLKIIVGSGTNHDAILLAWNADNVKKGLKPFIPVYTKDDAAQTLPWQTGRSDAFFGPNVIGAWKAALTGKTKLVGSVDGGWPKAAHIAVTLKKDSGLVNAVQAALNGAIASGEYAKVLNRWGEGVESIPQSEINPPGLGD

SEQ ID NO: 9591 - protein, 223 aa, Klebsiella pneumoniae
ARKKGLIRASSCRCPTFIAYFSAPTVFFVRLTLTARAALHQRQRRQHQDQTGQQRQAGHRHALTDGTLFELAPDKHRHGLRTGRREQQRGHQLPGGHREHHQHRRQQRRKDQRQDNQPQRLQWRRPVHPGGGLKVRAQLAQRAADIAHRPGQQQAAIGEQQHPQRVIGRARPEGLIPQQDQTDPHHHARQRRRHQRQRVHHPAPFNLLHHHQPGGQQAQRADD

SEQ ID NO: 9592 - protein, 404 aa, Klebsiella pneumoniae
VVKNACHGNGFISRGKHKFTCPQQLPTSALYHTVSRGAALTLRDKNGPGRAHGGYKFPLYWSRTLLMTIKGEKTMNRLSLIRYTSAVALGLSTLWSAAVCAAEDAGAFDKIQQIRAGDLNIGYVDIGPRDGQPVILLHGWPYDIQSYAQVAPALAQKGYRVIVPYLRGYGTTRFLSASTPRNGQPSAMAADIVHLMDALNIRQADLAGFDWGARTADIVAALWPQRVKSLVSVSGYLISSQQIGEKPLPPQAELSWWYQFYFATLRGEAGYRQNTHDFAKFIWHQASPQWQFSDATFAKTARALDNPDHVAITISNYRWRLGLEKGEAKYAGYEQRLAALPPITVPTITLEGANNGAPHPAPASYRAKFTGKYEHRDLPGAVGHNPPQEDPTAFVQAVVDADRL

SEQ ID NO: 9593 - protein, 212 aa, Klebsiella pneumoniae
HTENCSHEESRMKLFYKPGACSLASHIALRESGLDFTLQSVDLAQKRLENGEDYLLINPKGQVPALLLDDDILLTEGVAIMQYIADQVPDRHLLAPVGSIARYQTLEWLNYVATELHKSFTPLFRPDTPEDYKPVARGLLEKKLQYVDAALADKQWLTGHRFTIADGYLFTVLRWAYAIKLDMAAYGHIGSWMTQVAARPAVAAALAAEGLK

SEQ ID NO: 9594 - protein, 305 aa, Klebsiella pneumoniae
TTEKPKGKEGLMRLDLADLRLFIAIVDTGSITGGAANAHLALASASERLRKMEAEIGVPLLHRHARGVTMTEAGEVLARHARPLLAQQQRLRQAMHAFACGQRGTLRLFANTSAMSAFLPGKLAAWMAAHPAVQIETEERTSADIVSCILAGVAQAGVVSDAVDPGPLRLDPVADDPLVLIVPPARPLAEKEEVAFAAVLNEPLVALYQTSALQQHIEQHAAELGQALNVRVRMSHFAGLCEMVAHGAGGAILPRVIAERYRQRYSFAVIGLQDRWAQRRLCLCYQDDASLSPAMRRLLEWLRQP

SEQ ID NO: 9595 - protein, 93 aa, Klebsiella pneumoniae
LKENRMKKVLIVCGNGLGSSFIVEMNVKKILAEMNKEAEVAHTDLTSAKSETADLILSAKDIAEHLSSHSAKVVGLSNLLDNNKIKEILAENI

SEQ ID NO: 9596 - protein, 84 aa, Klebsiella pneumoniae
IKRKENRMAHLDEVIVKVDDALAEGVIAHMNELLIALSDDAQLSREERYIQQQRLRTAIAHHGRQHQEEQDARREQLTKGGAIL

SEQ ID NO: 9597 - protein, 95 aa, Klebsiella pneumoniae
VRPLQSPLQASQSLDAVRFRGKSLYLLEGDGKVRGEPSGHEASLEVLRQTQQQLASKGLTVAFWRYPGLTHGQMFEVSLRSALLHLSGQAALAHQ

SEQ ID NO: 9598 - protein, 63 aa, Klebsiella pneumoniae
QMMKEKRGIVNQQNAGLFLFVASLLAFIGPHSRMYCGYALYSPVYYLPVSHPAAGGTRQPAAA

SEQ ID NO: 9599 - protein, 235 aa, Klebsiella pneumoniae
RLPKKNCIYRDLSMRTRVLLKVAALAGILALTGCAAKVAQPNQYSGFLKDYSSLKETTSASGKPELRWIDPNFNPANYDNIVYHPVTYYPVPKPTTQVGEKALQDILNYTNKELKQAISERKPLATTAGKRSLIFRGAITGVDSSKEGLQFYEVIPVAMIVAGTQAATGHRTMDTDLYFEAEVIDASTNKPVIKVVRKGEGKTLANENTPLTVDTLKQVIDDMAVDAVKFDPSQR

SEQ ID NO: 9600 - protein, 512 aa, Klebsiella pneumoniae
APTKSSAGSACAPKSKRHYRPRARYCPGQILHSKTKNSPCFFHPESCRRDRLMQKTLSTLKDKINNALVVDRENHIYRCHRSIFTDPQLFEFEMKHIFEGNWVFLAHESQIPQPGDYYTLTLGRQPVIITRDKKNELHALINSCAHRGAMLCRRKTGNKNSFTCPFHGWTFSNNGKLLKAKDESTGGYPPSFKQDGSHDLQKLPRFQSYRGFLFGSLKADVQPLEAYLGETCKIIDLIVDQAPEGLEVLKGSSSYVYEGNWKLGAENGADGYHVSVVHWNYASTMSRRNYEAEGTHAVDANGWSKSLGGGYGFDNGHMLLWTRALNPEVRPVYAHRERLQAEFGERRADQMVNETRNLCLYPNVYLMDQFSTQIRVIRPIAVDKTEVTIWCFAPKGESDQARALRIRQYEDFFNVSGMGTPDDLEEFSACQRGFLGENLPWSDLSRGALRWVDGADEHAQHAGFSPRLSGVKSEDEALYIAHHHHWQTLMLAAIEQEQQRYDQSITQRVEVA

SEQ ID NO: 9601 - protein, 529 aa, Klebsiella pneumoniae
PEENDMNALRLVSVLALLLTLLPWRAQAAEADDFVAASRSQQAQLLTQWAAAPQADRLPLLRALTTESLVMDDGKHAFRTRQGGLQPLGAVAAPQGETRPVRLTNRLRNLAAGALASHLILSDNVTERASAARTLQREATPAMAALLQQRLQAETDDNVRGLLEVALARLQLTQPEASARLAAVTLLGHSADPETQALLIPFTDAQHEPDAAVREAASDSLQKIKHRLLLGDLLGQAFMGLSLGSVLLLAALGLAITYGLLGVINMAHGEMLMIGAYSCWLVQQALAQLAPQWLAFYPLVALPVAFLVTAGIGMALERTIIRHLYGRPLETLLATWGISLMLIQLVRMLFGAQNVEVANPAWLSGGVQVLPNLILPWNRLAVLAFVLLVLCFTWLILNRTRLGMNVRAVTQNRAMAACCGVPTGRVDMLAFGLGSGIAGLGGVALSQLGNVGPELGQGYIIDSFLVVVLGGVGQLAGSVAAAFGLGIFNKILEPQMGAVLGKILILVMIILFIQKRPQGLFALKGRVID

SEQ ID NO: 9602 - protein, 317 aa, Klebsiella pneumoniae
PRWKAEAEMTMAIIPAQTGRISGIFWRRPALGLFLLLLGPLMWFGIVYLGSLLTLLWQSIYTFDDFTMSVTSDFTLANLRALFNPANYDIIVRTLVMALCVTLASALLALPMAWYMARYTSGKMKAFFYIAVMLPMWASYIVKAYAWVLLLAKDGVAQWFLGHLGLEGALNALLSVPAVGGNTLSTSGLGRFLVFVYIWLPFMILPVQAALERIPGSLLQASADLGAAPRQTFRYVVLPLAIPGIAAGSIFTFSLTLGDFIVPQLVGPPGYFIGNMVYSQQGAIGNMPMAAAFTLVPIVFIALYLAFVKRLGAFDAL

SEQ ID NO: 9603 - protein, 95 aa, Klebsiella pneumoniae
AWRKRPKQALHPTTPGGSLRLGAMEATAASRLPPLLTRFQQQCPQVDITLITQPTRQLTEGVLTAALDAALFCFPPGADGQPACPAEVAFNPGVL

SEQ ID NO: 9604 - protein, 250 aa, Klebsiella pneumoniae
LIRNVAMKLASKTAIVTGAARGIGFGIAQVLAREGARVIIADRDAHGEAAAASLRESGAQALFISCNIAEKTQVEALFSQAEEAFGPVDILVNNAGINRDAMLHKLTEADWDTVIDVNLKGTFLCMQQAAIRMRERGAGRIINIASASWLGNVGQTNYSASKAGVVGMTKTACRELAKKGVTVNAICPGFIDTDMTRGVPENVWQIMISKIPAGYAGEAKDVGECVAFLASDGARYINGEVINVGGGMVL

SEQ ID NO: 9605 - protein, 331 aa, Klebsiella pneumoniae
HTRKNSMQPNRVARILGIEKPVVQGPLSWLTDARLVAAVGNAGGLGVLGPNAGLTAATAVSTPEATAEKMREEIRKTKQLTEKPFGVNLIPTAENDIWTPAILPVIKEEGVKVVVYTGYGDGSLKPALFDELKAAGITIIYRDINPTPENSRRAEQAGADIIVATGFDEGGTLPGTALGTFTIVPLIVDAVQRVPVMAAGGITDARGARAVHALGAEGVFAGSVFISTIESRVPDSVKAKIVAANGLDLRLFRTLPDYYRALPGKLSDTLVAMDRAGASKAELAQAMGGLRGMRLGMLEGNTDEGYISVGAGIGNIHAITSVAEVVNQLAV

SEQ ID NO: 9606 - protein, 373 aa, Klebsiella pneumoniae
MSFEQQLISWRRELHQNPELSLQEVATTARIRDWLQSGGLTLLPYDLKTGLVAEVGSGDKVIALRADIDALPIEEATGLPYRSQNQGVMHACGHDIHTSVMLGAALLLKEREAELPGRVRILFQPAEENFGGAKTLIRAGALEEVSAIFGMHNEPGLPVGEFATRGGAFYANVDRFVFKVTGKGAHAARPHEGRDAILLASQLVTVLQSVASREVNTLDSVVLSVTRIQGGNTWNVLPESVELEGTLRTHSSEVQQRVKARVSEIAAGFASAFGAQIDVFWYAGPTALVNDARWADFASEVAAQAGYRTHHADLHLGGEDFAVYLQHIPGAFVSIGSASEYGLHHPAFNPDERLIAPAAHYFARLAEEALQHI

SEQ ID NO: 9607 - protein, 94 aa, Klebsiella pneumoniae
VLSDAKANDICCHLALFLALIRDDGDEEVMLQRLAIAIYLLTMTARAIYCACGEGGDPFPLADGEIFSLLAKLTPLNRKYFTARDKLLIFTVIA

SEQ ID NO: 9608 - protein, 211 aa, Klebsiella pneumoniae
VMPEFASLMAFAAVALGLVLTPGPNMMYLTSRSICQGKRAGFISLAGVAVGFFFYMLCAAFGITALVFAVPYAYDALRLCGVAYLLYLAWQAIKPGGRPIFAVRDLPADSGRKLFLMGFLTSLANPKVAILYLSLLPQFITPGLGSVLSQSLILGCTQVIISVAVNGMIILLAGQVALFLGRRPGWQQFQRWLMATVLAGMAVKIAFEARK

SEQ ID NO: 9609 - protein, 405 aa, Klebsiella pneumoniae
RFTDFNVEMVFAYLQNFTYRQADKFRRIKGADIAFAGINKVVSAAAVEGFIRGRDKEMLSASSRGARQVAAIFDNGIQHLTVVRSDVFHITHVFVTTFNFEGAYASVDQRRQVGGLIVILHRQEMFLIGHHPPLIVLQGIRQAASLRAVAAVGAASGLGVRNVTLPGIGHAQRAMDKEFDGGVSVVVNGFDLTEVQFARQHDLTEAGVGEKLRFFHTANIALGAGVQLNRRQIQLHDPHILHDQRIDACVVEIGNQPLRRLQFIVMQNGVQRHKYLCAKAMSERHQPGDIAQTVAGVVAGTKARSTDVNGIGAVKDRFASDTGVAGRTKKFKTMIVQAHTRVVIQYKGVEMAAIVVRTGRRRKPFPPSRDDEFSLFNKVLTEKIFPSNHGEEYCHHVFRIFLVTL

SEQ ID NO: 9610 - protein, 490 aa, Klebsiella pneumoniae
QETDTSMNTKHENAAEHHAAKRHWLNSHEAGYHKAMGNRQVQMIAIGGAIGTGLFLGAGARLQMAGPALALVYLVCGIFSFFILRALGELVLHRPSSGSFVSYAREFLGEKAAYVAGWMYFVNWAMTGIVDITAVALYMHYWGAFGDVPQWVFALGALAIVGTMNMIGVKWFAEMEFWFALVKVLAIVAFLVVGTIFLGSGKPLDGNATGFHLITDNGGFFPHGLLPALVLVQGVVFAFASIELVGTAAGECKDPETMVPKAINSVIWRIGLFYVGSVVLLVLLLPWNAYQAGQSPFVTFFSKLGVPYIGSVMNIVVLTAALSSLNSGLYSTGRILRSMSMGGSAPKFMSKMSRHHVPYAGILATLGVYVVGVFLNYLVPSQVFEIVLNVASLGIIASWGFIVVCQMRLRKAIKEGKAAKVSFRMPGAPFTSWLTLLFLFSVLVLMAFDYPNGTYTIGSIPLLAVLLVAGWFGVRKRVHEIHSTAPTLRK

SEQ ID NO: 9611 - protein, 231 aa, Klebsiella pneumoniae
TAADLLFARLAARSGIMHRCRRTAVSPAIVTANHSTGKRMKPKQADILRHASTLFNREGYQSPSIERIAEHAGISKMTFYRYYADKEALILAILKQKESEFMQDLAQITADKASAREKLFAVFDYYHRWFTCETFHGCMFTRALFEYGASSPAIREQCSRFKSLLWQFFRDILLQVLKPEPAERVAMMMVMLIDGAIAAQQAESAECREIPPGMTAWSAAKALIYSEGGTL

SEQ ID NO: 9612 - protein, 221 aa, Klebsiella pneumoniae
YRHDFQQEPNMFTGIVQGTAKVVSIDDKPNFRTHVVELPAHMLEGLETGASVANNGCCLTVTEINGARISFDLMKETLRITNLGDIQVGDEVNVERAAKFSDEIGGHLMSGHIMTTAEIVKILTSENNRQIWFKVQDPTLMKYILYKGFIGIDGISLTVGEVTATRFCVHLIPETLQRTTLGAKKLGDRVNIEIDPQTQAVVDTVERVLAAKEMAAKVNEA

SEQ ID NO: 9613 - protein, 459 aa, Klebsiella pneumoniae
RLRDADAQRAGSGPELPQVHHHSGRGDAGGLGSLPHRGHPMSDTVRQQAEREAAASRVMARADRLAAFSETADALTRVYLSPEHLQANQLVGQWMQAAGMMVWQDSVGNICGRYEGQQEGAPAVLLGSHLDTVRNAGRYDGMLGVLAAIEVVQRLHQHGRRLAKAIEIVGFGDEEGTRFGITLLGSRGVTGTWPESWLSQCDTDGVSVAQALVNAGLDPARIAHAARHPRDIAAYLELHIEQGPCLEQAGLALGVVEAINGARRLNCRFTGEAGHAGTVPMLHRKDALAAAAEWMVQVENLTRQRGGNLVATVGTLRCAPGAVNVIPGEVQLTLDIRGPQDAPLTALLEELLGQAQAIAGRRQLSFAAEEYYRIAATACDSHLQAVLSEAVVAVQGRSLTLPSGAGHDAIAIAERWPSAMLFVRCLGGVSHHPAESVTAADVGLAIDAFSRAVEKVADA

SEQ ID NO: 9614 - protein, 205 aa, Klebsiella pneumoniae
QQSDTTMHLVKTILTAGLLLSAAAQAHNVLEFPQPENNPEEFYAVTEIPTGGIIKYETDAKTGFIVADRFQSMPVAYPANYGSLTQSLAGDGDPLDVVFYTRAPMAPGTLIKLRAIGVLKMIDGGEKDDKIIAVPASKIDPTYDDIKTISDLPKIEQQRLEAFFRVYKELPEGRKKVELAGFNDAAAAKQEIKSAWEAWKAKNPQ

SEQ ID NO: 9615 - protein, 198 aa, Klebsiella pneumoniae
WFGEVVMSAVWIAVIAISLLGLIFGLILGYASRRFAVQDDPVVEKIDELLPQSQCGQCGYPGCRPYAEAVGVQGEKINRCAPGGEAVMLKIAALLNVDPQPVDGDAQEAEPARMLAVIDEPNCIGCTKCIQACPVDAIVGATRAMHTVMSDLCTGCNLCVAPCPTQCISLVPVATTPETWKWDLHTIPVRNIPVEQHV

SEQ ID NO: 9616 - protein, 240 aa, Klebsiella pneumoniae
IHRLWRITMSEVKDVIVQGLWKNNSALVQLLGMCPLLAVTSTATNALGLGLATTLVLTLTNLTISSLRRWTPAEIRIPIYVMIIASVVSVVQMLINAYAFGLYQSLGIFIPLIVTNCIVVGRAEAFAAKKGPALSALDGFSIGMGATCAMFVLGSLREILGNGTLFDGADSLLGSWAKVLRIEVFHTDTPFLLAMLPPGAFIGLGMMLAIKYLIDERSKQRKAQAARAVSVAPSDVTGKA

SEQ ID NO: 9617 - protein, 380 aa, Klebsiella pneumoniae
HHDEEETVMKSRAAVAFGPGQPLKIVEIDVAPPKKGEVLVKITHTGVCHTDAFTLSGDDPEGVFPAVLGHEGGGIVVEVGEGVTSLKPGDHVIPLYTAECGECKFCKSGKTNLCQAVRATQGKGLMPDGTTRFSYNGEPIYHYMGTSTFSEYTVCAEISLAKVNPQAPLDKVCLLGCGVTTGIGAVHNTAKVKAGDSVAVFGLGGIGLAVIQGAVQAQAGRILAVDTNPDKFTLAKEMGATDFINPNDYDKPIQDVIVELTDGGVDFSFECIGNVNVMRAALECCHKGWGESVIIGVAGAGQEIKTRPFQLVTGRVWRGSAFGGVKGRSQLPGMVEDAMAGKIRLDPFITHRLPLEQINEAFDLMHEGKSIRTVIHFGDQ

SEQ ID NO: 9618 - protein, 402 aa, Klebsiella pneumoniae
RQDEECARAQYHTDSKFVRHRQAVAHLVVDGGQNRATNHDPERVQRLILFRFKGETEDRVLHVTDGEEVQRGRHLAVQHEEDNRFYHQQESDDHFTTRSAFQAYGFFGENHDDTQCDDAQHHTCDTLVVQQPGGDSDQHHHASDGRQQFTHVYRGKVRFRAVLFNPFLTEGEVNNGDHHPHHAEGKRYAPAKTCGQPRGCQHREERTDVDGHVVHGKCTVQTWVVFVIAGRKQGGRVGFKQAVTDGDGRHTHIDDSGVMAGPGHQRIANRQHDSAQHDDTLGTQHFITQPAANGDEAINQRAKGGEQSNGIRFRHTQLFYQVNGHDPLQAVVTKTLPQLDRENEIERAWLFESVQTHAFCWFIVCSRHIYLFFYIPYLLGGVRGAISLDRRLYSYSWRENGK

SEQ ID NO: 9619 - protein, 99 aa, Klebsiella pneumoniae
PGGDGRHPALCAGRGKRDTGRGAVDAGYSRPAGCAADGAAGGTAGAGAGDCRAPPAEFRRRGVLSHRRHRLRQSPAGGAERGGGGGAGAFPDAAERRRA

SEQ ID NO: 9620 - protein, 154 aa, Klebsiella pneumoniae
RTSLSSRRAGAGSDGHYRCPSGGECSMINLDNVDRPAILAEVTAAFYQYEEALVSNNIEALDALFWHDPRTVRLGAGENLYGIEAIRAFRAARPAAGLARDLRHTTITTFGADMAVCSTEFTREGSARLGRQQQTWVRFPYGWRIVAAQVSLMD

SEQ ID NO: 9621 - protein, 464 aa, Klebsiella pneumoniae
QQLEGVHVQKYFVEARQLLALAIPVILAQVAQTAMGFVDTVMAGGYSATDMAAVAIGTSIWLPAILFGHGLLLALTPVVAQLNGSGRRERIAPQVRQGFWLAGFVSVLIMVVLWNAGYIISSMHNIDPLLAEKAVGYLRALLWGAPGYLFFQVARNQCEGLAKTKPGMVMGFIGLLVNIPVNYIFIYGHFGMPELGGVGCGVATASVYWVMFASMLWWVRRARTMRDIRCAERFSGPDFAVLLRLVQLGLPIALALFFEVTLFAVVALLVSPLGIIDVAGHQIALNFSSLMFVLPLSLAAAVTIRVGFRLGQGSTIDAQVSARTGVGVGVCLAVFTAIFTVLMRKQIALLYNDNPEVVTLASHLMLLAAIYQISDSIQVIGSGILRGYKDTRSIFFITFTAYWVLGLPSGYLLALTDMIVPRMGPAGFWCGFIIGLTSAAIMMMLRMRFLQRQPSSIILQRAAR

SEQ ID NO: 9622 - protein, 777 aa, Klebsiella pneumoniae
RQPEQSSRSKEMTNKRRAVPGVHPYDGPAGGWGALKATAIAVRTQMDAFEAPATLLRTNQPDGFDCPGCAWPDKEHKSTFQFCENGAKAVTWEATTKRVTPAFLAANTVSSLLAKSDFELEGYGRLTHPLVYDRDSDTLRPVAWEQAFARIGEILRGLQPDEVEFYTSGRASNEAAWLFQLFAREYGTNNFPDCSNMCHESTSVGLPQSIGIGKGTVSLDDFDQTELVISIGHNPGTNHPRMMGTLHELSRRGVPIIVFNPLRERALERFADPQNVMEMATRRSTPIASTYYQVRAGGDAAALKGIAKALLQLEEEQGNVLDHAFIAQHTQGFTAFADDLHATRWQDIEQESGLTRESLTQVAAAYAKSRATIVTYGMGITQHNKGTSNVRLIADLLLMRGNIGKPGAGICPLRGHSNVQGNRTVGISEKPSAAFLDSLQRVMGITPPRHHGHDAVKALEAMIAGEAKALICLGGNFAVAMPDHERAFPAMRGLELSVHVGTKLNRSHLLTAKETFILPCLGRTELDLQASGRQSITVEDSMSMVHASSGKLKPASPMLRSEPAIVAGLAKATLPASKVDWQYLVEDYDRIRDLIEQTIPGFEDYNQRIRHPGGFRMPLPPTERIWPTATGKAMFSVFKGVHENVVVEGEDVMRLVTLRSHDQYNTTIYAMDDRYRGVFGRRDVLFMNEQDMAAQGLEHGDRVDIHTALPGSALTLEDITVVAYGIAPGTVGAYYPEANVLVPLNYLDEESGTPSYKSVPVRLTLRSKEIRPLAGGR

SEQ ID NO: 9623 - protein, 461 aa, Klebsiella pneumoniae
FMAETTFTLWRQRLGYGIADLSCNLVWQMISLYLMFFYTDVMGLPAYYVGLMFLVTRLVDGVADVLMGLVIDNTTTRWGRCRPWLLIGALPFGLLCILAFYVPDFGTTGKLLYAFVTYLCLSFLYTLVNIPFCAMLPFLTSDSAERTTLSAVRILLGSLGATIVAVATLPLVGMLGKGNQQQGFLYTAVIFGVLAAFFLLVSFRNVEEKITLTGERMTLKRAWISLRANRPWWVFASNIFLMWGAFFFQTGALVYFFHYYVGNTELTAVIAGISTFVPLLGTLTVPLLARRMKKRHVYLVASAVNLLGMGIMMVSGAHVLGLIVGAVILSLGAGQRTAIYFSMQADPVDYGVWKTGINTAGILTSINGFLGKVAMAGAGAITGVLLSSSGYIANHTQSDSALLAIKACYLYIPALLILASMLWMGRFYRLDDQYEQIRADLDAGRGASPAPAPTAGESPAM

SEQ ID NO: 9624 - protein, 101 aa, Klebsiella pneumoniae
TPADRRPPPGASGTFPWRTRRGQRRSRAPATACPHSPRPDPAPPPQWRSRGFCRSASAASSAPPADGRPAAAPGMAYSAAPAPAGSPASAEAAARAAPALR

SEQ ID NO: 9625 - protein, 187 aa, Klebsiella pneumoniae
WIREWKWAAWAPRLRYACVASPAKRLPSPACSECHSPCKHKSSVPLITTTCSITPFSCGVDSLSAPGARVIEKWSKRSSGSHGNTGVTTIACCCGSNAEGAALASGTMNAENGTFSPVAIFHSVATVGLDSFRSICPSMAFDTPVSSASRDRLQPRCWRRVLSVAARCCAIFILPPVFTAQSIPPFV

SEQ ID NO: 9626 - protein, 350 aa, Klebsiella pneumoniae
AGREIMKTTTPTPPAHCTFDPEDWLRLARCWHPVARACDIAGAPVKATLLDEQLVIYRIKGQVVVARDVCPHRGVPLTLGFHEEEGIVCPYHGLRFGEDGRCNRIPSSPGQPIPAKLHLTSFAVEERYGLIWTCLACDPDNPPPLPTMPHWDDAGFQQINCPAFEVKGFAGRQVEGFLDVAHFAWIHTDTFADPDNQQVPDYTPQETPFGFVADYWSSVGNYPASSDFRAPEGFQWLRHFEMHLPFTATLTIHFPADARLVIMNAASPVSSRVTRMFAPIARNFDLHVPVEDVHAFNLRVFEEDRLMVETQRPERLPLDLTLEAHIPADRSSIAYRRGLKKMGFGDFFLV

SEQ ID NO: 9627 - protein, 546 aa, Klebsiella pneumoniae
PPVEWSTPMTVLSVEDLRISYRSRGEWREVVHNISFSIQRGEMLAFVGESGSGKTTTAQAIIGLLADNARRDAGRIVLNGEVISDWSDKRLNRLRGVSISLVPQDPGNSLNPVKTIGQQVEEILRLHQSLSAAERRQQVLNLLAKVGLSHPEQRFDQYPHQLSGGMKQRVLIAIAIALQPDLIIADEPTSALDVTVQKRILDLLDILRRESGTAVLFVTHDLALAAERADRIMVFRQGEIQEQGATETIVQRPQHPYTRQLLHDLQDAPLRLTAARHRPLATPAIRVEGISKRFSLGKQALQALDSVSFEVRRGSTHALVGESGSGKTTLARILLGFERADAGQVIIDGIDAGHLSREAQRQLRRKIQFVYQNPFASLDPRQTLFAIIEEPLKNFERLSAATRRQRVESVAARVALAPELLSRTPRELSGGQRQRVAIARALILEPAILVLDEATSALDVTVQAQILALLQQLQQQLGLSYLFITHDLATVRRIADSVTVLRAGQVVEHGDVNRLFAAPQQAYTRELIAAIPQVSSRLAQAHTENA

SEQ ID NO: 9628 - protein, 424 aa, Klebsiella pneumoniae
DDQDVNKPGELYMSSCIAADASLSPAKPAWRAVYALALGVFGLIVAEFLPASLLTPMASSLGVSEGMAGQAVTATALVALVTGLLIATATRNIDRRWVLMFFSVLQIVSSLMVAFADSLAFLLLGRLLLGIAIGGFWAMSTATAMRLVPAAHVPKALAIIFSAVSVATVVAAPLGSYLGELIGWRNVFILCAIPSLLALLWQLWVLPSMRPESVGTFSTLFRVLRRPGMLGGMLATILIFSGHFAFFTYLRPFLETVAQASVEGGSLILLGFGIANFIGTSVASYLLSRSLRLTLALVPLMMSVLALLMVTFGHLTVLAGLLVALWGFAFGLVPVAWSTWLATTVPDEAESAGGLLVASIQLAISAGAAGGGAVFDLHGASGVFTGSGLLLLGAMVIVFAAVRVKPVARADQPVTGRLSREIDN

SEQ ID NO: 9629 - protein, 234 aa, Klebsiella pneumoniae
PPQESAMSHNKPSRLRFAINLGNAVLAHLGETGKPAGITVELSHRLATRWGVSAEFVPYPAAGKVVADAGGEHWDIAFLAIDPAREATLRFTSPYITIQGTALVSVDSPCQSVADMDRPATTINVGQNAAYDLWLTRHLQHASLHRLPSSQEAIDAFLAGEGDMVAGIRQPLEATARQHAGVRVLADNFTEIQQAICVARADVDRFHAVNDALSEWRADGSLQALIAGHLGQAN

SEQ ID NO: 9630 - protein, 314 aa, Klebsiella pneumoniae
KGQEMGENQEHYPRDLRGYAGEPPHARWPGGARIAVQFVLNYEEGAENHVLHGDAGSEQFLSDIIGAASYPARHMSMDSLYEYGSRAGFWRIHREFSQRGLPLTVFGVAMALARHPEIVAAIKAADYDVVSHGWRWIHYQHMDIAEEREHLQKAVQVLTDLFGKPPTGWYTGRDSPNTRQLVVEHGGFDYDSDYYGDDLPFWSEVACSDGSQRPHLIVPYTLDANDMRFATAQGFNTAEQFYTYLKDSFDVLYAEGETAPKMMSVGMHCRLLGRPGRFRALQRFLDYIQQHDKVWVCTRQQIADHWRETHPYRG

SEQ ID NO: 9631 - protein, 546 aa, Klebsiella pneumoniae
ITKEFTMHRHFRLPALAALFLTGAFSVWAADTPVKGGTLIYLEQQPHTNLYPPAGGFYPNGGILNQITDKLTWQNPKTLEIEPWIAESWTSNADKTEYTFHLRKGVTFSDGTPLDAAAVAKNFDTYGLGDKAHRLPVSEVINNYQRSEVIDPLTVKFYFNKPSPGFLQGTATIGSGLVSLSTLQRNFEELGDARHIIGSGPFVVQDEKPGRELTLVARKDYQWGPKNIAQQGPANLDGITYIVTPEDSVRIGALLAGQAGFIRQVQAYDEKQATDQGFKIYAAPTRGVNDSLSFRPDNPLVADLRVRQALLHATNARQVVETLFSANYPQATSVLASSAAGYVNLSDKLTFDQAKARQLLDDAGWKPAADGIRSKDGQRLALTVYESLPQPQNKEVLQLIAQQWRQVGVALTVKAGDAGSRTLDNLDPQKTPLTVSEVGRADPDVVKSMFFPNNRDALLQKGGSSDKVQRFRDDKLNDLLTGISAAVEPQQRLQLTGDAQRYLIDNAYVIPIFEEPQVFAGAPWVKGVSFEAVGRPSFYGAWLDKH

SEQ ID NO: 9632 - protein, 274 aa, Klebsiella pneumoniae
NVWEPSMHSERAPWYLRLATWGGVIFLHFPLLIIAIYAFNTEDAAFSFPPQGLTLRWFSEAAGRSDILQAVTLSLKIAALSTAIALVLGTLAAGALWRSAFFGKNAVSLLLLLPIALPGIITGLALLTAFKAVGLEPGLLTIVVGHATFCVVVVFNNVIARFRRTSWSMVEASMDLGATGWQTFRYVVLPNLGSALLAGGMLAFALSFDEIIVTTFTAGHERTLPLWLLNQLGRPRDVPVTNVVALLVMLVTTIPILGAWWLTRDGDNDAGNGK

SEQ ID NO: 9633 - protein, 227 aa, Klebsiella pneumoniae
HARDATASGGQNTIQVKTSSCQCEIKQKVIRRVAMSFELPALPYAKDALAPHISAETLEYHYGKHHQAYVTNLNNLIKGTAFEGKSLEEIVRTSEGGVFNNAAQVWNHTFYWNCLAPNAGGEPEGELAAAIAKSFGSFADFKAKFTDAAAKNFGAGWTWLVKNADGSLAIVSTSNAGTPLTTDAKPLLTVDVWEHAYYIDYRNARPSYLDHFWALVNWKFVAANLAA

SEQ ID NO: 9634 - protein, 147 aa, Klebsiella pneumoniae
RRRELAGRRGDAGKTDSADGEVGVLMVDQDRLFARLARSTFRSRFRLGGKERQYCLDKGPEVIDRHAADFIRQRLAPAAPNNDGKQTPMRGHPVFIAQHATATCCRGCLEKWHAIPHGRALSEPEQDYIVQVIHRWLVLQMNAPSVR

SEQ ID NO: 9635 - protein, 410 aa, Klebsiella pneumoniae
TTRESASPADRERHRRGRGALFEAPGEVHADAVVTSRGRLVVTSVRLVNDDRPDVLPVEQVVDATEQIHIHPAVAPFIAGRQANHRPGGRFGGVFVIGHDIAHIANIAPGVPTLLRLIAKGGVAHIARDPRNAIAIAAGVVADVSAIGRVQPGPGRLQTPALAKLLIQPQLHPLTAGLAGVFITGAPAAAAVDHNLIIGIGLEQGGGEQPIADPRLAADLHRVVGGGFQAEVEATLVIGAVGEFVNGWRLEAAAGGKIDVPRVGQGIFQRARGQPFVIAGITAVIAIAWGDVVVVRVEPYRAVANPGIEREFVSELPLGLQVGVDVPHQVAFVTAQRALFAILWRAVDHHKVFIPFAPLAHVFVVETGGERDGHQQLSAMGQPGIDPLVVTGKVDHPAGMARLQLRRARD

SEQ ID NO: 9636 - protein, 474 aa, Klebsiella pneumoniae
MSSLSIRSFTLFREEQPVRDALVLFTLTLLLHFLGAMLRLVQELSFFWPLNAVMAGIFARYVWLNRSYFYAVCFAAMLVYDGLTSRWGMGFASLLINFSNIVFIVTLAQLVLWDKRRADSMPGPINALNLFCFCLLAALLCAAVGALGSVDVERATFVPQLADWFSEQFSTAVLILPFILTLTLPSALSGFRFRQLLPVLALVLSIALGVAVGGAGSITFPLPALIWCAVRYPLPLTCLLTFLTGIGEILLVANSLIHFSPDARMQPWQLFSTRLGIAAMLISPVIVASSVEAINTLVKQLALRADFDFQTRVYSRSGLSEALKRQTLPADKLLTVMVLDIDGFKRVNDALGHEGGDCVLTQFAQQVRQLVGEQGMVARIGGEEFAVAAVVDSAQQGYLLAEKIRHGVESQPFGLGQNPIHLTISLGLETREVGHARITELFNQLLLAADDEMVKAKQSGRNQICMPTLTESAP

SEQ ID NO: 9637 - protein, 281 aa, Klebsiella pneumoniae
PTSLISRLKCLPLWRWAISFCAIRCPATAAFWRTNSMPLITINQMQKYYGDNHVLKGVDLDIDMGEVISIIGRSGSGKSTLLRCINGLEGYQEGSIKLGGMTITNRDSQAREISRSIGMVFQNFNLFPHMTALENVMLAPRRVLKKSQAECRELAQRMLEKVGLGDRLDYYPANLSGGQQQRVAIARALAMSPKVLLCDEITSALDPELVGEVLKVLEQLAAEGMTLILVTHEMNFAREVGDRVVFMHQGRVWEQGDSKTLFASPQTSELKQFISSVRGLN

SEQ ID NO: 9638 - protein, 344 aa, Klebsiella pneumoniae
DWLCPRGGRPGGVYGRRQDRRAGQQRRGAQPSAASAYPAVFIQGAAVMNRALMTLVLSAFAMSAYAALDLRANEQPLPVTRDPQAIAKIPPGYRFVEPGTLTVAISALNSPPLALLASDNRTRIGSDPDIARLLAGSLGLKLRLVPTAWEDWPLGIASGRYDVALINIAVTEKRKEKFDFATYRVDSLAFSVKSTSDIAAVNGPADLAGRKVIVGSGTNQERILLGWNEDNRAAGRPQAQPVYLTDDASGNLYIQSGRADIFFGPQSVAAYKAALNGQTRVVGLGPKKAWVATTTKKGNGLVYALQAALDGAIARGEYQQVLARWGEQGEAVAQSVVNPPGITY

SEQ ID NO: 9639 - protein, 331 aa, Klebsiella pneumoniae
WLYCTTISFSGPAAMPDTPLIQQIRTASRLMVRELGFMSTTLAATHYSPSAVHTLLEVSMRGEMTAAQLVTLLGLEKSSVSRMVSRLLAAGELEERPCAEDARAKSLALTAKGHDTVAKINAWGTRQVVAALDHLDETQQQTVATGLAAYARALAQCRDSALADTAPQISLMTGYQPGMIGRIAQMHGEYYARHHDFGAFFEGKVASGVAEFATRLSSPANQIWLAIREGKIVGSLAIDGEDLGQQEAHLRWFILDDSCRGSGIGRRLLSEAMAFCDSRQFSAVQLWTFKGLDAARKLYESFGFTLIREWQGEQWGKVMTEQQFTRSVNTG

SEQ ID NO: 9640 - protein, 187 aa, Klebsiella pneumoniae
PAHWPAPPAAIPPPAPGPDAGPSPGRRWSRQIPCRAPPPSGSAVRPACETAPPYTPFPHRSCRPPAHQAAADAAPAPAACRSQETVSDHGTADRPGGSARRQDAAGAAPHSADRPVRCSSGRAGWPTPIYPPSSPGRDFPPPSALRRPSASETCARCPGGRWPPGQEWSDPPTGHRALCRFAAGSCR

SEQ ID NO: 9641 - protein, 295 aa, Klebsiella pneumoniae
SGDCSVARLNKIAISLCALLFTSISFTPLAQASGHTHASASPKALPAKSGSERKKKATSQKTKTTAKTTSKKSSRTRLPTRTTAASQTALHRQAAGATKKCVLRKGYKKQCAKTVAASAEPTLALNSVKSKCVVRKGYKKRCKPEASEANLTIADAHKVRVQKAQNTAMNKLMGQLGKPYRWGGTSPRTGFDCSGLVYYAYKDLVKIHIPRTANEMYHLRDARPVDRDELQSGDLVFFRTRGRGAADHVGVYVGNGKFIQSPRTGRDIQITSLSEDYWVRHYVGARRVMTPKTIR

SEQ ID NO: 9642 - protein, 334 aa, Klebsiella pneumoniae
DYCCHIRVFTSITINSLCCCKKEYRGAMSPFSRFAHYFIAVARCGSLRRAAEQLHISASAINRQILQAEEAFGTPLFERLPEGLRMTTAGELLYDNLLRWQKEFRQTRQKFDELQGMKRGSVSVGMVQALAEGGFAAALAEIIASWPWLELDLQVADSHTVSQKVRQADLDVGLILDPQGQAGLSVLAFAELEVGIVMRPDHPLAGAKALSLGELSLERHIVPGAPLIVHERVALLYRHHDFAPENTISCNDIRLIKSLVLRGSGVTLLSLLDVLDEVQCGQLAFVPLRSTLLRPLTLALCTAPSRQLSRPAQMAIQTLSAVIESMATVSPAAR

SEQ ID NO: 9643 - protein, 62 aa, Klebsiella pneumoniae
NNGCQSRNRGVQTEVSRRDFPGEKLDYVRNIFYNENSKLMESNFLLAPVIRAEILTNLLLIL

SEQ ID NO: 9644 - protein, 1282 aa, Klebsiella pneumoniae
RFICRIAAYALSGLTSSFAHPAGWHDAGHHRSRRNVMSKLLDRFRYFKQKGETFANGHGQVYNNNRDWEDSYRQRWQFDKIVRSTHGVNCTGSCSWKIYVKNGLVTWETQQTDYPRTRPDLPNHEPRGCPRGASYSWYLYSANRLKYPLARKRLIELWREALAKHPDPVLAWDSIMQDPAKTRSYKAARGKGGFVRSSWKELNQIIAAANVWTIKHYGPDRVAGFSPIPAMSMVSYAAGTRYLSLIGGTCLSFYDWYCDLPPASPMTWGEQTDVPESADWYNSSYIIAWGSNVPQTRTPDAHFFTEVRYKGTKTIAITPDYSEVAKLCDQWLAPKQGTDSALAMAMGHVILKAFHLDNPSDYFLNYCRTYTDMPMLVILEPRDDGSYTPGRMLRASDLLDGLGETNNPEWKTVAYNSDGELVAPNGSIGFRWGEKGKWNLEQRADGKDVELKLSLLDIRDSVVSVGFPYFGGNENPHFRSVAQSLVTLHPLPAKQLTLASGESGLVVSVYDLILANYGLDRGLDDVNAAKDFAEVKAYTPAWAEQITGVPRQHIEQIAREFADTAHKTHGRSMIILGAGVNHWYHMDMNYRGMINLLVFCGCVGQSGGGWSHYVGQEKLRPQTGWLPLAFALDWSRPPRQMNSTSYFYNHASQWRYEKLTAQELLSPLADASKFSGSLIDFNVRAERMGWLPSAPQLNVNPLTIKQQAEAAGLSPAEFTVQSLKSGDIRFAAEQPDSGKNHPRNLFIWRSNLLGSSGKGHEYMLKYLLGTDSGIQGDELGASDEVKPEEVEWQTAAIEGKLDLLVTLDFRMSSTCLFSDIVLPTATWYEKDDMNTSDMHPFIHPLSAAVDPAWEAKSDWEIYKDIAKSFSQVCVGHLGKETDVVLVPLQHDSPGELSQPFEVLDWRKGECDLIPGKTAPSIALVERDYPATWERFTSLGPLLDKLGNGGKGISWNTQSEVDFLGKLNYVKPDGPAKGRPRIDSAIDASEVILSLAPETNGQVAVKAWQALGEFTGRDHTHLALNKEDEKIRFRDIQAQPRKIISSPTWSGLESEHVSYNAGYTNVHELIPWRTLSGRQQLYQDHPWMRAFGESLVAYRPPIDTRSVSQMKAVPPNGFPEKALNFLTPHQKWGIHSTYSENLLMLTLSRGGPIVWLSETDAKELGIEDNDWIEAFNANGALTARAVVSQRVPPGMTMMYHAQERIMNIPGSEVTGRRGGIHNSVTRVCPKPTHMIGGYAQLAYGFNYYGTVGSNRDEFIMIRKMKKIAWLDDEGRDQVQEAKK

SEQ ID NO: 9645 - protein, 79 aa, Klebsiella pneumoniae
ISPWRNTMIRSARSAASARSWVTNSTAVPDSRRRISSRSRMRFCTVTSRALVGSSAIIRSGCRAMAMAISTRCFIPPDS

SEQ ID NO: 9646 - protein, 89 aa, Klebsiella pneumoniae
GYPCNGKGFLLVKLSLNTSGLPLQDLVFGASVYFPPLFKAVLLGFFIWLFLHRQLRDWMYAGDIWHPLLMDLSLFALAVCLALVLLIAW

SEQ ID NO: 9647 - protein, 212 aa, Klebsiella pneumoniae
ALPWRPTMITVYGVPGWGSTISELMLSLADIPYEVVDVEGFDQPGPARERLRQINPLCQVPTLRLADGSIMTETAAIALMILDQRPDLAPAPGTPQRPQFQRLLVWLVANVYPTFTYADYPERWAPAAAEQLVENCRQYRKNLYLWFEQQLAAGPWALGASVTLLDCYIAAMYRWGPRQAWFDDHAPKFAAIARAVCQRPELAAALRRNKLI

SEQ ID NO: 9648 - protein, 151 aa, Klebsiella pneumoniae
LLAWATIMKSTSDLFNEMIPLGRLIQMVNQKKDRLLNDYLSPMDITATQFRVLCSIRCEVCITPVELKTVLSVDPGAMTRMLDRLACKGWIERLPNPADKRGVLVQLTPDGAALCEQCHQVVGQKLHQELTKNLSADEVAMLEQLLKKVLP

SEQ ID NO: 9649 - protein, 230 aa, Klebsiella pneumoniae
RGAWCWTSVSATETVRPLQPRELAVNEQTNTVYITGLGKERVIWVVDGATLKLKTTITGTGAMATGLAIDPQAKRLYTTNADGELLTIDSESNTIASRKKLQDDGKAHFYLNLSLDTAGHRAFITDSKQPEVLVVDTRDGKVLEKIAAPESLAVLFNPARNEAYVTHRKAGEVSVIDGKSYKVVKTFKTPTHPNSLALSEDGKTLYVSVKQASSREKEATAPDDVIRIAL

SEQ ID NO: 9650 - protein, 389 aa, Klebsiella pneumoniae
ADNCMIITTALANEIVARAMAIIHHNVNVIDHHGQIIASGERHRIGEQHEVAREVIRTGKRICINNAAEAARFHNVHPGINHPIIYDDRVVMVVGISGDPAAISRYAELAVLTAELLVRQAIEMRETNWRQRLRDTLFCQYLEQGATPAGQEALHRLLELGFDFDTPRVPIVVTVQVEQHQLSDILSTLLREFSQLSGVSDVILLGSHEILILNALSEAQETLLRGIEFVLSNQISHYHIGIGVQADSAPDIREAIRFARSVIEVGSKVQPQRQIYYFREMAMLCLFRVLEDSYMVNFFINNVRQLLEHDSGEVLLDTLSSFIANNAEPGKTSLLLGIHRNTLTYRLQQIKKHIQLDPMVFTDLTQLAVSVHCYRRLNPRQSEWIDSLS

SEQ ID NO: 9651 - protein, 387 aa, Klebsiella pneumoniae
CQRCAARYCVIQSRGWQLLRACEFMLAPGDKSVTVAGIFHHLRTQEPAMAIFDGHNDLLLNLWLHHREDPVSAFFAGIENGHLDYPRMLQGGFAGGLFALFVPPQEYIARMTPQYASQRWDPIDILWQQLAILKQLIAHSAGRLRLCLSAADIERCREDKVLAMVAHIEGAGGFDGEGRDLQAFYAAGVRSIGPFWNIANRFGSGVNGSFPGSPDTGPGLTAAGIDLIKQVNALKMQMDVSHMNEKAFWDTAHHSTSPLVATHSNAHALCPQPRNLTDQQLRAIRDSGGVVGVNFGNAFLRADGRRDSDTPLTTIVRHIDYLINIMGEDHVALGSDFDGITLPDELGDVAGLPRLINTLRASGYDQLVLDKLLWRNWLRVLKNVWQQ

SEQ ID NO: 9652 - protein, 168 aa, Klebsiella pneumoniae
KQSCQQTMKIKNPLVSPGRLVMIDNITLDNLHIGCKASNKAEVIAMIGEEFKAKGYVNQECVHFLLEREHQVSTFLGNGITLPHLPKSATDIILKTGIEIYQFPDGVIWDRSNVMFIAIGVIAKEKEHIDVLKEIASIFSDELIANALSLISDKHDFLKILQHNALPH

SEQ ID NO: 9653 - protein, 412 aa, Klebsiella pneumoniae
CRGCHSRQRRHNEEKAMSILIAFLGGMLTLLSPCTLPVIPLLFASVRGRRGQLAIMLAGMALMFGAVSWLVTVASGWVVNLTLAGRGLALAFFALVGLSLLSQRVAQRLTSPLVALGNQLNDASSRQRGWIGSLLAGLAVGLLWAPCAGPVLGAILILGFVHPGQATTGGLLLAYGSGGALMLFLLGWCGTALITRLRRGQAFGERLRRLAGRAMLASVALIASGGDRYLQSAGGLSQALEQRLAARLPQPEQKTSLQPIAAPQPSSAMPSLAGGSAWINSPALTPERLKGNVVLVDFWTRECINCQHTLPYVRDWANKYRAAGLVVIGVHTPEYPWERSLPLLRQAVKDWRITYPVVADNEYAIWNAFGNQYWPAHYIFDARGQLRYTAFGEGDYARQEQVIQQLLQESKA

SEQ ID NO: 9654 - protein, 177 aa, Klebsiella pneumoniae
LRGCLQAQGRQHQQQSDGEQGGEDGLPLEVHQQPAAQQRGQRRRQSYQRHNGGEDAVRALGRIVIGDHRLPGNGRGTDANRLQKAQRQHQGGVVHPQHPQTAGRENRQAAQQHRFTSIAVRQRSPEQLAQREAGEEQAQTGADGGGGGVEILLHGGKRRQVHIGGQKAQHAQAGQPD

SEQ ID NO: 9655 - protein, 421 aa, Klebsiella pneumoniae
FYRLTSFKKQPARGPLMKCKASRCTGQRIQTASVPDTMLTTGITALFSLTCALAVANVYSAQPLLDSMAVSLKVSPGMIGSVITATQAGYAIGLLFLVPLGDWLNRKYVVMSQLLLSVAALVAAGLSPNIATLLGAMLIVGLMAVVVQVLVAWVAVLATPQKRGQAVGTLTSGIVSGILLSRFISGAIADIAGWRAVYLTAACLMLVIAGVVWKIMPSPPQQPQPQKPTYLSLLKSVFQLYLTEPQLRKRGILALFIFAAFSMLWTTMVMPLTALSLSHTQTGMFGLAGFAGMLAAARAGKWADQGWAQRTTGLALALLTISWLPIGYAETSLLWLIAGVIALDFAVQAVHVSSQSLIIAARPAAASRLVGAYMCFYSLGSAAGAIVATQLYSHWGWQAVCLAGAAVSACAFLIWSGSRQS

SEQ ID NO: 9656 - protein, 89 aa, Klebsiella pneumoniae
YFLWRLNMLRDYLKVEKEDQLVEQQSRHDNSQHYSSVTEWVILSKDGQRKGRVSLFDRFTTRRSWSDSFRITQFDNAGKVVVDKLTDAL

SEQ ID NO: 9657 - protein, 280 aa, Klebsiella pneumoniae
PKIWMVPPESCSKPAISRRQVVLPEPDGPSIEKNSPSRMPMLTPSTARTSPYRRDTFWNSTAYVIVCLRSLAAAHYRNIVLSPAAIGHVFPAFRNRRFPEVNAVKLLIAVGLTAFITEQRAGFTALRHHRQRTEPGRHIALHLRRERPVHPFIGADRVLRLAVQHGGIRPAGYPLLREHGGDRLAFRLQAVGLIGPRTGGGYPFVFEVVHLYGGVMPVAMDQRLLVAQDFQHRVVLGFGQLIGVFDPQLRLGGFDKQRGVGDIDRAIIGLHPPLVGFTIR

SEQ ID NO: 9658 - protein, 276 aa, Klebsiella pneumoniae
PLTCRLTRSMLYPVSLLTQELHPMADWNPSLYLQFDAERTRPAADLLSRIAHLQVEHAVDLGCGPGNSTRLLRAAWPLATIVGIDNSPAMLVQAAQALPDCEFIDADIARWRPAQPPDVIYANASLQWLTDHETLFPHLVNQLADNGTLAVQMPDNWQEPSHTLMRQVASEMGLPDRGRQPLLPPAAWYDLLSRQGCEVDIWRTTYFHPLASHQAIVDWLQGTGLRPYLAGLDEQAGSAFLTRYLTILATHYPLQCNGKVLLRFPRLFIVARKIAA

SEQ ID NO: 9659 - protein, 418 aa, Klebsiella pneumoniae
RKEWQMDITQFSQINPPQRLLMGPGPINADPRVLRAMSSQLVGQYDPAMTHYMNEVMALYRGVFRTENRWTMLVDGTSRAGIEAILLSAIRPGDKVLVPVFGRFGHLLCEIARRCRAEVHTIEVPWGEVFTPDQVEDAIKRVRPRLLLTVQGDTSTTMLQPLAELGEICRRHDVLFYTDATASLGGNPLETDAWQLDAVSAGMQKCLGGPSGTSPITLSPRMEEVIRRRRCIEQGIRTDAHHDGVDEMIYSNYFDLGMVMDYWGPERLNHHTEATSALFAARECARLILQEGLDNGIARHKLHGDALLKGIQAMGLETFGDLRHKMNNVLGVVIPNGVNGDQVRKLMLEDFGIEIGTSFGPLHGKVWRIGTMGYNARKDCVMQTLSALEAVLNYLRFTTTQGAAMQAAWDHYRTEATL

SEQ ID NO: 9660 - protein, 304 aa, Klebsiella pneumoniae
ICRWTARTAFAVPANATAPGGEYDLGEDYLDEALSDDEAQNRQVLTCQMVPTSDCVIDVPVAAAQCKTTLANIGAQVRQVNLLSDTAIELVVALDEPLAFLPGQYVNIQVPGTLHVRAYSFSSQPGSLEGRFLIRNVPGGMMSQWLTQRARPGDRLTLSGPMGSFYLRHGERPLLMLAGGTGLAPLLSMLHTLQTQGSQRPVMLLYGVTRDCDLVKTDALDTFTQQLTGYRWLPVVADENSTCPQRGFVTDHLDDAMLNNGDVDIYLCGPPPMVNAVATALRDRGITPAGFWYEKFIASQSAAA

SEQ ID NO: 9661 - protein, 137 aa, Klebsiella pneumoniae
  UNSURE (137): Identity of amino acid at the above locations are unknown.
CCGCVFCSASLPASSYSALRANLSKPAAPAGFFVLRYNGALYIPLLPDTKDSLIASRQALIVLPTAPQWGYSRNQVEDFRMKKVLALVVAAAMGLSSVAFAADAASTTPSAAASHTTVHHKKHRLHHGAGRIRGDAX

SEQ ID NO: 9662 - protein, 159 aa, Klebsiella pneumoniae
PRQCHRRLLRRNDDRPGLWLEQRGAPRRRAVVSGDERLAHLWLSSAATSLLTTPTHARVRPGSASGGWPRRKRPRTAADPAGPEYLSPAHQAPPDDRRLMRVASPIARRRRRFPPASAAIARRADPLPASPPAACRRRSRPSPAAPLCGHAPRRSRYSR

SEQ ID NO: 9663 - protein, 460 aa, Klebsiella pneumoniae
ITRWEACHSHQYNEHLLRAEYMNTTANTTRIRWWIAGLMWLAIAINYIDRTVLSAAAPHLIDELKLDPEMMGFIMAAFFWSYSLLQIPAGWFADRFGQKKGLGLAVAWWSIATSMMGVATGFKSLLALRLALGVGEAAAYPSNAGIAARWFPDKERATVSGLFDSASKFGGAIAMPLIVWMIYTFDWRLTFLIIGSVGILWVIAWYFIYAENPEEHKRISPSEVRIIRDGQKQHHGDKTVLPMKWYKLLRYRNIWAMCIGFFTINYTSYFFITWLPTYLVKEKGMDFIKMGMVAALPLLCGMVIEVFAGWASDRLVHKKVLSLTATRKLFLTIGLLMALCIGFAPFTDSVFMTVFLLCVAKSGTTVAASQVWALPGDVAPKNSVSIVAGLQNTVSNMGGAVGPIITGAIVAATGSFNWALIFSAILVVIGIINYLFLMGKIEPINDKGGKSPVLNAAEQH

SEQ ID NO: 9664 - protein, 216 aa, Klebsiella pneumoniae
TDIRWRGMTGGTAARKMIQEYRQAESGNRGETEMNINVVGTSGSGKSTLARRLAHRLELPWIELDRLYWRPNWQGAPDEAFFAAIAAATATPGWVLDGNYNRSRSVKWRAVDLVIWVDYGFWRTLRQAVWRAASRAWRHQELWPGTGNCESFRRSFCSRESIILWTLKTWRQHRRRYLADMQDPQYRHIRFVRVRNPRQAEALLRELEAQRSAGHI

SEQ ID NO: 9665 - protein, 111 aa, Klebsiella pneumoniae
RPVRHQFQSPVLGNGPAAQQPDAAPSRSSNRPPPAAGPARCGAGGEPAPRRDPPSRPAGSPAHGAQRRRSPGPDGCLPRRRQSTLAFPRPPSLMPPEAGQRSGSDREDGSA

SEQ ID NO: 9666 - protein, 556 aa, Klebsiella pneumoniae
NQVRLSEASSMPHLPTGRERIMKRIAIVGVGPTGIYTFYELVKRGEPLAITLFEKEAQAGVGMPYSDDNTAAQMLANIASIEIPPIDLTYLQWLQQQSDDWLAARGLERHAVHERQFLPRVILGEYYRDRFLYLVERARDVGFVISVCESCEVTDIAVQPTGIAIHTDSAADPVIVDLVAIATGHLWPEEERASRQYFPSPWTGLMEARIAPCRVGILGTSLSAIDAAVAVVARHGVFHTEDDKTTHFSLHPGSEALEITLMSRHGVLPEADFYCPIPWEPLEIATPAALEAAIAEGSDALLDRIFELIVKELEYAAPDWSEAIGLRQLTPDSIADAWFADRLTHDPFQWAQRNLQEVERNKREHHTVPWRYAILRLHEAIETVVPQFNDADSRRFRQGLARVFIDNYAAIPPESIRRLLALHRAGILRILTLGEDYELQREPDRTLIVHHRQRCEFDVFIDARGQKALKTRDLPFPSLRQQLLACGDDIPDVGDDYTLQAPETVRGRVAFGALPWLMHDRPFVQGLTASAEIGSAMARAVSQQAAGRRRRLWYIE

SEQ ID NO: 9667 - protein, 278 aa, Klebsiella pneumoniae
PSPRRHTSARAGRARSPDRPGRPAAAADEGPTMTGRLWRGGMVFGGLMLLWGLASRSGIPHFLLPSPLAVAEALWVNRAYLGWHTLITLSEILSGLALGVTLGVTLALGMILSPRLQRWLMPLVLTSQAIPVFALAPLLVLWLGFGMSAKVAMAVLVIFFPVTSAFFDGLRRVNQEYLDLARSMNASFGAQLRHVRLMAALPALGSGLRMAAAVAPIGAIIGEWVGSAEGLGYVMLNANARLQTDICFAALFILVLLTLLLWLAVDTLLHRLIDWSPE

SEQ ID NO: 9668 - protein, 342 aa, Klebsiella pneumoniae
YAARAGLGNHVPRTVRRAALPRAGIEERMMSGKVCVFGSFNFDMVARVDRFPVPGESLVACGSMTSAGGKGANQATAALKAGANVHYIGKIGNDTFGHFARRHLKGVGFNAVTLLVAEETPTGNALIYVAGNDAENMIAVDPGANMTVTDDEIAGCIPAIGCADVVLVQLENNLSAIEQVIDAGKQAGALVILNPAPWQPVEHALLRKVDLLTPNATEAGLMTGRRVDSLTAAAEAADVLHAQGARNVIITLGASGALLSEHGVKSPIPCFPSHPRDTTGAGDAFNGALAARLACGEPLQAAARFAAAYAAVSVEKQGASSLPEYLEAQERLLRAAADYEMA

SEQ ID NO: 9669 - protein, 325 aa, Klebsiella pneumoniae
PGYRPTTGGGDDLRPRFRPDQPAGRPGHAATGSPTPFTDRRCEMSLVDYTIAVRRRPEWRRVRLQPGLWLAWAVMIAALLMAIAPQWFTSANPLEGIPGAQRLAPQAHYWLGTDQLGRDLWTRVVYGAVHSLSAALIAVAIGLVVGTTLGTLAGALAGRVESTIMRLVDVLLAIPSLLLQLTVIILLGFGTVNAAVAVGVAAIASFARLARAEVVRVRHSDYVEAARGSGGTFFAVFWRHILPNSLTAVLAFATLQFGQAMLALATLSFLGYGTPPPVPEWGLLIAEGRNYLSTAWWLTTFPGLAVVAVVLAANRLSRQWSGARP

SEQ ID NO: 9670 - protein, 276 aa, Klebsiella pneumoniae
SYCRQPVLRARWRQPARFFPAVRRPQGVVMSSVRIQVINPNTSLAMTETIGAAARAVAAPGTEILAVCPRAGVPSIEGHFDEAIAAVGVLEQIRAGREQGVDGHVIACFGDPGLLAARELAQGPVIGIAEAAMHMATMVATRFSIVTTLPRTLIIARHLLHQYGFHQHCAALHAIDLPVLALEDGSGLAQEKVRERCIRALKEDGSGAIVLGCGGMATLAQELTRELRVPVIDGVSAAVKMVESLVALGLATSKHGDLAFPEKKTLSGQFQSLNPF

SEQ ID NO: 9671 - protein, 452 aa, Klebsiella pneumoniae
RFRRRLLLRQNKVQRYRYQPTAGGCRTEQIADHRRKMAEKRRHRLHAKTRAKRQPHDQHIATSQRSLGNNPDPGRHYAAKHHHRGAPQHRRRDLPQQFAHRGEQPEQDQNHANVASDIAAGHPGHLDHAVVLREGGVRKSTEHGRHHTADAIRQDTALQPVTKSAIVNRLLRNQRVGRQIAHRLQNTDQRHQGDRQKYRAVKLKAERKQRRQAKQSVAQAVKMELTAQPRCDAAHGNAHHHRGEPQPAVFGAAQQDDNPEGARPERDIAHAGEILGLFPTAPVDDADLDQADADQRNHAAGNDGSKDFLQRFDKAADNHRHQSGDKVNAKQHRHHILRPAALGFYPHPSGHRHAEEGKTGALHADHPGADAPYPIGLQKSANARGQQRHTDEIRQPVAKPEGSADDQRRRDDPHQARQHMLESAEKGRKRWDPLFKAVKQATVMFVRHSDIP

SEQ ID NO: 9672 - protein, 557 aa, Klebsiella pneumoniae
RQLLRFIDQQGFRRDTAFDTAIVAEAIRQRLQQIKRLDVGLLRQSVDAAWGKRHIDADAGGSGRLLNADHAGQHDNIGQRRFAGGALDRLQGRQHPAGDGVNRPVFLRGQRQTRAVSAAAFIAAAEGGGGRPGDRDQLTDRQAGAGDGGFQAGDIFRARLMGRCRQRILPNQIFFRHFRPEVTGFWPHITVGQLEPRPGERLVKGLRIVEEAAGDFFKLRVEAQGQVGDQHGRFALFLRVKRIRDNLRRVFGFELDRASRAAGLHPFVFEQVFEKVVAPLGGRLRPDHFQTGGDGVRACAAAVAGVPAQTLRFQRRGFRLGADVAGFCGAVGFAQRMAAGDQRDDLFIVHRHIAEGGANGRRGGQRLAAGVRTFRVYINQTHFGGADGLFRQAFRMTVGQPLFLIAPVDVEIRFPDVFATGAKAKGAEAGVFQSDVTRQHVKVGPGDFLAIFLFHRPQQTAGLIEADVVRPGVQGGKALLSTTCAAATVNGAVGAGAVPGHTNKQANIATPVCRPPLLRIGQQRSEISLQRGVIELFKLFPVVKILTQRVGAIGVLV

SEQ ID NO: 9673 - protein, 300 aa, Klebsiella pneumoniae
IMGRLAGNTLSRNENVINTSSRLTIVASTKSQRGSQYVGSPDAIPGERAPSDVDRRAGLAVPKGRAMMRTLTPITLQEVSFAFAETPILDRFTLHIEPGRIVALLGPSGCGKSTLLRLLAGLSVPASGEIRFGDRLVARAGWGLPPEQRDIGMVFQDYALWPHMSVAQNVAFPLRMRGVSRSERERRVSEALARVGLNGFAERKPSGLSGGQQQRVALARAIVAAPRVLLFDEPLSNLDSELRESLCGEMSRLLRQLGITALYVTHDRREAELLADQIVYLSAGRVAAVRAVTPTSGEVA

SEQ ID NO: 9674 - protein, 102 aa, Klebsiella pneumoniae
SSIRRVWPNSMRPPRRSSSWSMAGATSRRLSPCLMNVSRKQAASMTTSSSSCRSPVNRSGSPAVSQSKPTVNPPLWLLAELTYRCPLQCPYCSNPLGLRPAG

SEQ ID NO: 9675 - protein, 61 aa, Klebsiella pneumoniae
ASVRREATAGSGGIRAARCQLPCNLLNHTSHLTVNQMKHIAFESFLNEVVLTFIKLYLLLD

SEQ ID NO: 9676 - protein, 181 aa, Klebsiella pneumoniae
YFPRVSFRQERNDKDILILDDIRTIDFVKMASLSQALFSSSAKNGGMMKKLALAMACLFAVGVAQADDKGGFSQDAAPPPPHKLDDGYRGVEDGRIMTVEQAKTMHDGATVSLRGNLLKRQGDDRYQFRDKSGTITVIIPVAAFNEQHVEPDDLVNINGSLDRKMTPPVVRIDRLLKQSPK

SEQ ID NO: 9677 - protein, 160 aa, Klebsiella pneumoniae
HVTRHPEAMLRICPGYAFSAVCSSVARARRFAPPPGRGFSGDALRETACSSILSAREPTEVGMKDELFADLLASAEEMVRIEKGEQMPMEQHVHTFSEIDVKAIREATGLKQQDFAAAVGVSYELVKSWETKRRHPTGAARKLLLLLQGNPLIINLLKVV

SEQ ID NO: 9678 - protein, 81 aa, Klebsiella pneumoniae
RIVLARHEFTAQQQLALHFEINNDYYSHSKIRVKPGLYRRKRCRVSTYWFIKGSRHVITSFCRAASAPFTARHFSAAGRQL

SEQ ID NO: 9679 - protein, 158 aa, Klebsiella pneumoniae
GIHRPASGPVTCYLESKIMVFIRAAEAEDIPSLQTLFLQLGYQTETAILAQRITAPQSMMSALVAETENAVCGVIVINFILPVHENRLWALISALVIEESSRGSGIGQQLLQAAERLARDKQCAQIELSSSEKRIRAHQFYENNGYKEVRKRFVKHLS

SEQ ID NO: 9680 - protein, 437 aa, Klebsiella pneumoniae
KSRRHTNTTGELTMGVSVKRIVVTGMGIVSPLGCGVQHVWQSLLAGKSGVTRLSEQLVADIPCKVAGQVPSIDSDPLHGFDPLATIPAKERKKMDRFIEFALVAAREALTQAGWSPASAAEQERTATVIATGIGGFSEIANAVHTTEERGPRRLSPFTIPSFLANLAAGHVSIAHGFRGPIGAPVTACAAGAQAIGDAARMIRSGEADIALCGGAEAAIHRVSLAGFAAARALSSAYSDQPESASRPFDRDRDGFVMGEGAGLIVIESLEHALAREATPLAELVGYGTSADAYHLTAGPEDGNGARRAMEIAIRQAGVTVDEIDHINAHATSTQVGDKGELAAIKTLFGAHPVAITSTKSATGHLLGAAGGIEAIFTIQALRDQVVPPTLNLHHPDEDAAGMNLVALQARPQKMRYALSNGFGFGGVNASLLLKRWQ

SEQ ID NO: 9681 - protein, 233 aa, Klebsiella pneumoniae
HPRRRPEMIQYLNVFFYDIYPYLCGTVFLVGSWLRYDYGQYTWRASSSQMLDKRGMVLWSNLFHIGILGIFFGHLFGMLTPHWVYSWFLPMSQKQLMAMILGGICGVLTLVGGIGLLMRRLTNPRIRATSTTADILILCILLIQCALGLTTIPFSAQHPDGSEMLKLVDWAQAVVTFHGGASAHLDGVAWIYRVHLVLGMTIFLIFPFTRLVHVWSAPVEYFTRRYQVVRSRR

SEQ ID NO: 9682 - protein, 155 aa, Klebsiella pneumoniae
MILRVLAVSMIGFTLAGCVSSSGLSGDVYSASEAKQVQSVTYGTIVHTRAVQIQSGDDSNAIGAIGGAVLGGFLGNTIGGGTGRSLATAAGAVAGGVAGQGVQGAMNKTQGVELEIRKDDGNTIMVVQKQGSTPFSVGQRVAIAGSGSQVTVSPR

SEQ ID NO: 9683 - protein, 258 aa, Klebsiella pneumoniae
STLRCFLRQRASGCCEPHKIPAKKCAITARLTLPVSAARYTGGTAEQEVSTMTITCNLYINGQWHDAEGRRTFTRRHPAHDEAASVAAAASLADGKRCVETAACAFPLWRDTAPAERRRLLLEAAEQMLLREAKFIAAMAAETGATAHWAGFNVHLAADILREAAALTTQIEGQIIPSNVPGNLAMGVRQGAGVVLGMAPWNAPLILATRALATPLACGNTVILKGAELSPATQGLIIDALDAAGLPAGRGELSYLCA

SEQ ID NO: 9684 - protein, 181 aa, Klebsiella pneumoniae
RPLRSHPDAGAAPPSTHLTADVIMSFLTLLRRVALTLLFTLLPAASGWACTPVFVHGQASTLRLNVGQLTVPADARPGTPLYHKSFAWNRLSDGGEQWIRCADDPHGLSPLLAEHLLSGGSAAPGGFIKLPSPALGFENRGGLSAGYGGFPDRANALAVYPRGGQSRRFAPMRCGNWAISA

SEQ ID NO: 9685 - protein, 475 aa, Klebsiella pneumoniae
ARIRTLRKQRERIMMNLSATHAVSVNPTTGEVVSSLPWASEREVDAAIALAAAGYRQWRQTPLADRADALRRIGAALRARGEEVAQMITLEMGKPIAQARGEVAKSANLCDWYAEHGPAMLATEATLVENNQAVIEYRPLGAILAVMPWNFPVWQVMRGAVPILLAGNSYLLKHAPNVMGSARLLGEIFAAAGLPDGVFGWVNATNDGVSQIINDDRIAAVTVTGSVRAGKAIGAQAGAALKKCVLELGGSDPFIVLNDADLDEAVKAAVTGRYQNSGQVCAASKRFILEAGIAEAFTRKFVDAVAALKMGDPRDEQNYVGPMARFDLRDELHQQVTATLDEGATLLLGAEKIEGAGNYYAPTVLGNVTAGMTGFRQELFGPVATLTTARDADHALALANDSEFGLSATVYTTDEAQAQRFARELECGGVFLNGYCASDARVAFGGVKKSGFGRELSHFGLHEFCNAQTVWKDRR

SEQ ID NO: 9686 - protein, 106 aa, Klebsiella pneumoniae
FIPRGPSRRRRWLRVGLVNADNIQRNNSDYKMDTKMTVLDYLLKFRKISSLESLEKLFDHLNYSLTDTQEIVNMYRAADHRRAELVSGGKLFDVGQVPKSVWRFVQ

SEQ ID NO: 9687 - protein, 165 aa, Klebsiella pneumoniae
WRPRLLRGNAYRYATVRKHGASFCGGARWRPARRDIIEKLLILTDINGLLFGGRVLILKKTQEVITMKDVVDKCSTKGCAIDVGTIIDNEDCVYRAEKVFPSREEAESTVAAVRERAAAAAPASEPPQVDYTIVAAGDAVKLDLSIAFSCQAEKIIFELSLRNLL

SEQ ID NO: 9688 - protein, 130 aa, Klebsiella pneumoniae
TPPRFAYRPERAAARSPAPGRPPRTPSASPPAAPERPAAGQSTAAPAVATPRAPWRRAQGSGPAGAARCRHSAPARATAGSNRRAAASTACYRASAARRADSTAGSNRPPPPRPAAPPASATARPPSRAL

SEQ ID NO: 9689 - protein, 207 aa, Klebsiella pneumoniae
PGQRPRRLPTGWTIPPLCPDAVWKLGYFRLTIELIKTGPAATPGELEYHSERFLMAEHTPLAALDLTGRISTAGCSVNDATPALIKLPAAMLDHFGGVGKTTGDTPFALQLDCNSAVTISLRVDGAEPLSARGHGVLRNDATDDRAQGIGVQLLYHRQPVVLNHEMTLGSASAGRFTLPLTARYYQTRSRITAGQVSAVATYTLHYD

SEQ ID NO: 9690 - protein, 276 aa, Klebsiella pneumoniae
NLQRLGDPGGPSVMITIEGLSKTYAGTGRPALNDIALQIPKGAIYGILGRSGAGKSTLIRCLNLLERPTSGRILVNGQDITQLNKAALRDYRLRTGMIFQHFNLLHARTVADNVAVPLEIAGVPRAAREVRVRELLELVDLSEKAAAFPSQLSGGQKQRVGIARALAARPEVLLCDEATSALDPETTASVLALLADINQRLNLTIVLITHQLEVVKTICDHAALLEQGEIVESGKLADLLVTPWSRLRQSLLHDPQAEQEFLTRHGVQGRPLCGVA

SEQ ID NO: 9691 - protein, 71 aa, Klebsiella pneumoniae
RLQRAIFLLIRCYSCHKGISGSRAVKISPEIRVVSGLTPPGEFIQVVTRDALRKNRQHKQDFMDYRQRVRE

SEQ ID NO: 9692 - protein, 424 aa, Klebsiella pneumoniae
IMQRRTLLKAFALSASVMAMGLSFQAYAADTIKVGIMHSLSGTMAISETPLKDVALMAIDDINAKGGVLGKKLEPVVVDPASNWPLFAEKARQLLAQDKVAVVFGCWTSVSRKSVLPVFEELNGLLFYPVQYEGEEMSPNVFYTGAAPNQQAIPAVEYLLSEDGGGAKRFFLLGTDYVYPRTTNKILRAFLHAKGIQDKDIEEVYTPFGYSDYQTIVANIKKFAAGGKTAVVSTINGDSNVPFYKELANQGLKATDVPVVAFSVGEEELRGIDTKPLVGNLAAWNYFESVDNPTNKAFVADYRAYAKAHKLPNADTVVTNDPMEATWVGLHMWAQAVTKAGTTDVDKVREAMAGQTFNAPSGFNLTMDATNHHLHKPVMIGEIEGNGQFNVVWQTDEPVRAQPWSPWIPGNDKKPDHPVKTVSQ

SEQ ID NO: 9693 - protein, 467 aa, Klebsiella pneumoniae
ADERDRLDPGKASDHEYGEIITMSAINEKAVNGTQLQRTHKKIYRHLMPLLIVAYIISFIDRTNIGMAKATMSVDIGLSATAFGLGAGLFFLTYAVLEIPSNLFLTRIGARRWIARIMITWGILSCGMAFVTGPTSFYVMRLLLGAAEAGLYPGIIYYLTLWFGREERAKATGLFLLGVCLANIIGAPLGGLLLSLDGMSGWHGWQWMFFIEGLPAIALAFVVWRRLPDKPADARWLDSDDVQAINAVLAKEAEETRHTPSRFSLKTALSTRVFLLLVLIYFTHQFSVYGLSYFLPGIIGSWGQLTPLQIGLLTAIPWIAAAAGGILLPRFARTEQRSRSMLMAGYLVMATGMAIGAIAGHGVALLGFSLAAFMFFAMQSIIFNWLPSIMSGHMLAGSFGLLNCLGLCGGFLGPFILGAFEDRTGAATSGLWFAVALLIIGALVSLFLKSSSSPGSVSAKQAHGEKV

SEQ ID NO: 9694 - protein, 111 aa, Klebsiella pneumoniae
KRERSQDLHLFRGDPGVQGCEQAMAVMLAKLPTRPFAGMTQIRFKGFGLRHLSPHGTPLGSAMLYDIHLLNTITAPPCRRMVVMGDSQRFSAQQLLTTGPRRTEERLLRAQ

SEQ ID NO: 9695 - protein, 527 aa, Klebsiella pneumoniae
RRGRSMSQAIQYNSSVAMIRHPRFLQRAADLTPALQRLRQTPQAIVEAVAEPGALNGWRGNTVCTPEQFYQQPLNVGDSIIIDFGSHFVGYLQFSCRSVGSPPDAPAHLHFTFGETLSEVCEPFSEYQGWLSSSWLQQQDLWLDVLPARVALPRRYCLRYLKVEVKALSRKFRLQFDEIALETVTSAGSPHPAVIADPQLKAIDDVAVRTLKNCMQEVFEDGPKRDRRLWLGDLRLQAQVNDVTFGHHDLVRRCLYLFAGHTREDGMVSANVFVQPEVRADDTFLFDYSLFFVDVLYNYLQSTGDTETVGELWPTARRQIELALTRCDSQGLVRDSDDWWVFIDWQAELNKQASAQGVLIYCLQRALWLAQRFEPQRVPDYTATLWQLKEAAFHHLWDNERQVFISGAVRQVSWASQIWLVLAEVGTAGQRQALMRRLQQQPPAIAMNTPYLRHHHIVALLQSGLREEAVAEIKAYWGAMVAYGADTFWEIFDPQHPDFSPYGSKLINSYCHAWSCTPAWFIRQYGL

SEQ ID NO: 9696 - protein, 231 aa, Klebsiella pneumoniae
GLMRYYLSPSLMCMDMMKLTEQLRFLNSKADRLHVDIMDGHYVKNLALSASFVAQIRPYTSLPIDVHLMVEAPASFIPALLDAGADAFSLHPETICREAFRVINMLRQAGKEVGMVLNPATPVESIQHYLHLLDKVTVMTVDPGYAGQPFIPEMLAKITQLHQLKETGSLRFLLEVDGSCNRNTYRALLGAGAQILVMGSSGLFRADMPLELAWETMSRELSAALHSPELV

SEQ ID NO: 9697 - protein, 525 aa, Klebsiella pneumoniae
RRSRSGTGGEKMKIRSQVGMVLNLDKCIGCHTCSVTCKNVWSSREGMEYAWFNNVETKPGIGYPKNWEDQDQWQGGWIRGISGKLTPRLGNRVSVLSKIFANPMLPAIDDYYEPFTYDYQHLHNAPEGKYLPTARPRSLISGERMDKINWGPNWEELLGGEFEKRARDRNFEAMQKEMYGQFENTFMMYLPRLCEHCLNPSCVATCPSGAIYKREEDGIVLIDQDKCRGWRMCISGCPYKKIYFNWKSGKSEKCIFCYPRIESGQPTVCSETCVGRIRYLGVLLYDADRIEEAASTEHETDLYERQCEVFLNPNDPAVIEEALKQGIPHNVIEAAQKSPVYKLAMDWKLALPLHPEYRTLPMVWYVPPLSPIQSVADAGGLPSNGNILPAVESLRIPVQYLANLLSAGDTGPVLRALKRMMAMRHYKRSQTVEGVTDTRAIEEVGLSVEQVEEMYRYLAIANYEDRFVIPTSHRELAEDAFPERNGCGFTFGDGCHGSDTKFNLFNSRRIDAIDVSGVRKHGEGE

SEQ ID NO: 9698 - protein, 114 aa, Klebsiella pneumoniae
RYPRWCVLRFRSAPPGALPSRRRASPAERPTSPRCWRTGAASPADRRRRRASPGADAAAAQEAGGHGAPVPPRPLSSSPRGHDGATAARRSRPPSCAASHWRTPGPDGHSPLRR

SEQ ID NO: 9699 - protein, 119 aa, Klebsiella pneumoniae
SLARRWAILATLFSAGWRNMAIAWSENIAVTASVRKCMRNRRCCITAAPAEGAVLQEGMVFTIEPMVNQGDSRIKTKKDGWTVVTRDKKLSAQWEHTVAVTANGFEVLTLRDDEQSRIR

SEQ ID NO: 9700 - protein, 326 aa, Klebsiella pneumoniae
LSARWCPCFSKVPHPQAPYRRNRPTAKKCNQEAIMRIEVLLDLKTRLGESPVWDVEQQRLWWVDSLDGRLFACNAQGGAIKSWDVRQKIGSFALRQNGEGAVVALQNGVHLLDFASGELTLLHHPEADRPFNRLNDGKVDRQGRFLFGSMDMREEEPSGALYRLDADLSLHVLKKDIIVSNAPCWSPSGETFYFADTWTGEICAWDYNTATGDLSGERVFCHVDRSEGGAADGATVDSEGYLWNALVYAGKLVRYTPEGKVDRIIEMPVKKVTSVMFGGENLDVLYVTSMAQPPLPRFPEDNQLRGSLFAIYDLGVTGVAERRFAG

SEQ ID NO: 9701 - protein, 176 aa, Klebsiella pneumoniae
TPWRVRNSCSACGSCSSDWRSRDHGVTSRSASLPLSTISPCSSSAAWSQMVFTTSSWCVISTMVRLRRWLISASRASTEAVVSGSSALVASSHSSTSGRAASARAMPTRCFCPPESCDGKAAAFSLRSTSSSSSRTRTSRAALGTPAISSGTATLSATVRACSRLKCWKIIPVRRR

SEQ ID NO: 9702 - protein, 454 aa, Klebsiella pneumoniae
KGRRFILCTFRIWRKVVYRQRCSRLYMENLMASSNLIKQLQERGLVAQVTDEEALAERLAQGPIALYCGFDPTADSLHLGHLVPLLCLKRFQQAGHKPVALVGGATGLIGDPSFKAAERKLNTEDTVQEWVDKIRKQVAPFLDFDCGDNSAIAANNYDWFGSMNVLTFLRDIGKHFSVNQMINKEAVKQRLNRDDQGISFTEFSYNLLQGYDFACLNKLHGVALQIGGSDQWGNITSGIDLTRRLHQNQVFGLTVPLITKADGTKFGKTEGGAVWLDPKKTSPYKFYQFWINTADADVYRFLKFFTFMDIAEINALEEEDKNSGKAPRAQYVLAEQVTRLVHGEEGLEAAKRITESLFNGNLSDLSEADFEQLAQDGVPMIEMEKGADLLQALVDSELQPSRGQARKTVASNAVTINGEKQADPEYVFSDSDRLFGRYTLLRRGKKNYCLVCWK

SEQ ID NO: 9703 - protein, 105 aa, Klebsiella pneumoniae
PLRRARRTVLNLAPQGCYYRENGPPYLWPHKKRAADFGLHFIRSLPGLPLKPEQDKGVRMKSNHQARHLLGLNYKLSRQKKVVLEGDEETTINHIHATGRKRRGG

SEQ ID NO: 9704 - protein, 408 aa, Klebsiella pneumoniae
RRRRHGAVRRKTMTQANDIVIVSGVRTAIGTFNGSLKHTHQHDLGAAVIREAIARAGIAPQDIDETIVGNVGQIAESGFIARICQLRAGIPQESTAYSVNRQCGSGLQALADGMMQLQSGQAEVVVACGTENMTQLPYYLRKARDGYRMGHGELEDGLISILTWPEGPYHNGITAENVAQRFGITREAMDDFAWSSQQKALKAIAEGRFREQILALEVPDGKKATRLFATDEHPRDTPREKLATLRPAFKADGVVTAANSSGINDGAAALVMMTRQQAEKRGLTPRMRIRGWAVAGCGAEIMGFGPSPATRRLMDRLNIDVQSIDLIELNEAFAAQALAVMNDLRLDPARVNVNGGAIALGHPVGASGAILPVKLMYEMARSGARTGLVTMCIGGGQGISMLFEREGA

SEQ ID NO: 9705 - protein, 390 aa, Klebsiella pneumoniae
SLGRDGEAMSSSCIEEVSVPNDDWYRIAAELLGRAGIEINGSAPSDLRVKNPLFFKRVLQEGSLGLGESYMDGWWECERLDIFFHKVLRAGLEKQLPHHFKDTLRIAGARLFNLQSKKRAWIVGKEHYELGNDLFSRMLDPYMQYSCGYWKEAQSLEAAQQAKLDLICRKLELEPGMRVLDIGCGWGGLAEYMARNYQVSVVGVTISAEQQKMAQARCADLDVEIRLQDYRDLHDSFDRIVSVGMFEHVGPKNYATYFEVADRNLKPNGRFLLHTIGSKVTDHNVDPWIDKYIFPNGCLPSVRHIAEASEKHFVMEDWHNFGADYDTTLMAWYERFLASWPEIADNYSERFKRMFTYYLNACAGAFRARDIQLWQVVFSRGIEHGLRVAR

SEQ ID NO: 9706 - protein, 195 aa, Klebsiella pneumoniae
PLGRRGGKHSAIGNQSARTGRLTGGAMSEAFRDISPEAPELQPIISGLFAEYAARYGDYFSRDAEVELSEWYVPPQGLFIVLEREGEIIATGAYKPKDRHTAEIKRIWTHRRLRQQGLAAKVVQELERRAVLAGYSHIYLTTGFRQPEAVKLYLSQGYEAQFDLTRDPEEYSQPPYDGRLRFTKALVVSAYSHSA

SEQ ID NO: 9707 - protein, 121 aa, Klebsiella pneumoniae
PTGRPAGRRKNRRTRRAARRGQSRMPAGAADREATAPESGGGIADSSVAAAQASFAVAPAASGLSAGRPLPAGRWRRPAPASRGADPDTASSAPHPRPAGAGAGRPSGCRGLHPAKTRALT

SEQ ID NO: 9708 - protein, 318 aa, Klebsiella pneumoniae
PILRAGPFCLKEMTMQDEKPPMKKLPTSMLPEETAPRPEFPEQEQTPPGLDAEMEPSPDHGETSYTGSGRLAGKKALITGGDSGIGRAVAIAFAREGADVAINYLPEEQKDADEVIALIKAEGRTAVALPGDIRSESFCQSLVADAVEQLGGLSILVNNAGRQQYCETLEELTTEDFDATFKTNVYAPFWITRAALPHLQAGSAIINTTSVQAYKPSPILLDYAQTKACLAIFTKSLAKQVAKRGIRVNAVAPGPYWTVLQSSGGQPDEKVKQFGKDTPMGRPGQPVEIAPLYVTLASDACSYTSGQVWCSDGGDGVV

SEQ ID NO: 9709 - protein, 462 aa, Klebsiella pneumoniae
PANSKRIAPTRDDLSTREFIISHSRRFPLASKVALAGAALIAAGMLFSCTSKAPKSLVTPPNAAAVKAGQAHREPVRGVWLTTVSRLDWPPVGSIIASTPESRITQQKLALIAKLDNLQRLGINTVFFQVKPDGTALWRSDILPWSDMLTGKIGEYPGYDPLQFMLDEAHKRGMKVHAWFNPYRVSVNTKPSTIAELNNTLTQVPASVFVLHRNWIRTASDRFVLDPGIPEARDWITSIVAEVVQNYPIDGVQFDDYFYTETASSPLNDNETFRRYGQGYASKGDWRRHNTQQLIAQVSTTIKKLNPNVEFGVSPAGVWRNRSHDPAGSDTRGAAAYDESYADTRSWVQQGLLDYIAPQIYWPFARDAARYDVLANWWAEVVKPTHTRLYIGVALYKVGEPSKNEPDWTVDGGVPELKKQLDLNETLPQIQGTILFRENNLNQPQTRQAVNYLRSRWGQPQS

SEQ ID NO: 9710 - protein, 87 aa, Klebsiella pneumoniae
PVDSFTDTVAMAVDCCNLSEMIGLIAHQKPVVYLSLDQRPENRNGFRFVKQRKQTAERLQQSIGNSTYPDTRSRVSFFDRRQASLGN

SEQ ID NO: 9711 - protein, 350 aa, Klebsiella pneumoniae
MVFRIASSPYTHNQRQTSRIMLLVLLAAVPGIVVQTWFFGWGTVLQIVLAALTAWATEAAILKLRKQPVAATLKDNSALLTGLLLAVSIPPLAPWWMVVLGTAFAVVIAKQLYGGLGHNPFNPAMIGYVVLLISFPVQMTSWLPSYEIAAHLPAFSDALQMIFTGHTAAGGDMASLRLGIDGVSQATPLDTFKTSLHAGHSVQQVLQLPVYGGVLAGLGWQWVNIAWLAGGLFLLWQKAIRWHIPVSFLVSLGLCATLGWIFSPQSLASPQMHLLSGATMLGAFFILTDPVTASTTNRGRLIFGALAGLLVWLIRSFGGYPDGVAFAVLLANITVPLIDYYTRPRVYGHR

SEQ ID NO: 9712 - protein, 135 aa, Klebsiella pneumoniae
TSPSRSGRRRDSGLRYAGLSPTAPAASFSPTAGCHTTQSAGRPRSRSDRHRSPADALRRPARRRIAGRFQTPPAPGRRTAVCRGGPASRSSRFWRCYRCAGHSSRWSRYYLSGHRCPGRSSPWSSVASCRKNGWR

SEQ ID NO: 9713 - protein, 312 aa, Klebsiella pneumoniae
ERTSMSNVFVQQPAIQKLLRDSAGLDVAGGDERFKAIIHRLLENICTLIDDYNVTEEEFWHAVNYLHELGGRQEAALLAAGLGLEHFLDLRQDAIDAAAHRETGTPRTIEGPLYVANAPLAEGHARMDDGADAGEVMWLHGEVKDTEGRPVANAIVDIWHANTLGNYSFFDPGQSEYNLRRRIRTGADGRYSVRSIMPSGYGCPPDGPTQKLLDRLGRHGNRPAHIHFFVSAPGHKHLTSQINLNGDKYLWDDFAFATRDGLIADPVKVTDREIIAQRNLEGEHTEVCFDFTLCKALSADEEQRGIRVRAKE

SEQ ID NO: 9714 - protein, 302 aa, Klebsiella pneumoniae
RRTRVNALLYALVVVIWGTTWIAIFLQQGPVAAPVSIFWRFAVASVTMLAILLVTRRLRPLGAKDHLCCLLQGCCVFCFNFWCFYTAAAWINTGLESVIFSMAVLFNAINSFLFFRQQPPGRFWAAAALGLAGIVILFWDDLLANGLNASLLWGIGLSALGTYGFSLGNMFSIRHQRRGLETLTTNSWAMLYGTLVMGAIALLRGDNFMPEWTVSYLGALLYLALFGSVIAFGAYFTLVGRIGASKAAYSTLLFPLVALSISTVYEGYVWHSNAVIGLALILLGNLVMFAKPEQLLLRRRLA

SEQ ID NO: 9715 - protein, 1004 aa, Klebsiella pneumoniae
PPASSNPVFASWRDELAARDNLPSSRRRQLDGEWQFSYARSPFAVDAQWLTQDLPDCRGTPVPSNWQMEGYDAPIYTNVRYPIDTTPPRVPEDNPTGCYSLHFTVEDTWRENGQTQIIFDGVNSAFHLWCNGVWVGYSQDSRLPAAFDLSPFLRPGDNRLCVMVMRWSAGSWLEDQDMWRMSGIFRSVWLLNKPQQRLCDVQLTPALDALYRDGTLQVQATIEATEAALVGLSVGVSLWRGEEQIAAGRQPLGTPTVDERGHYAERVDFSLAVATPAHWSAETPNCYRAVVTLWRGDELLEAEAWDIGFRRIEIADGLLRLNGKPLLIRGVNRHEHHHLRGQVVTDADMVQDILLMKQNNFNAVRCSHYPNAPRWYELCNRYGLYVVDEANIETHGMVPMNRLSDDPAWLPAFSARVTRMVQSNRNHPCIIIWSLGNESGGGGNHEALYHWLKRNDPSRPVQYEGGGADTTATDIICPMYARVERDQPIPAVPKWGIKKWISLPGEQRPLILCEYAHAMGNSLGNFADYWQAFREYPRLQGGFIWDWADQAIRKTFADGSVGWAYGGDFGDKPNDRQFCMNGLVFPDRTPHPSLVEAKHAQQYFQFTLLSTSPLRVRIISEYLFRPTDNEVLRWQVQAAGEPLYHGDLTLALPPEGSDEITLLDSLILPEGARAVWLTLEVTQPQATAWSEAEHRVAWQQFPLPAPLALPAPTVSAGAPDLIVSDEVWQIRAGSQCWTIDRRTGLLSRWSVGGQEQLLTPLRDQFIRAPLDNDIGVSEVERIDPNAWVERWRSAGLYDLEAHCVQCDAQRLANETLVDCRWHYLRGEEVVIVSHWRMHFTADGTLRLAVDGERAETLPPLPRVGLHFQVADQQAPVSWLGLGPHENYPDRRSSACFARWEQPLAAMTTPYIFPTENGLRCDTQALDWGRWHISGHFHFSVQPWSTRQLMETDHWHKMQAEDGVWITLDGLHMGVGGDDSWTPSVLPQWLLSQTRWQYEVSLRCF

SEQ ID NO: 9716 - protein, 883 aa, Klebsiella pneumoniae
KNASNANLAMVGKMLSINYQTENIIVDHLPIMVCWSTNYPQKSFSIKVYKGAELVSLIAREGNNTIVTLDAISLQSFTSYTIEVLTHGDNGENNVFRNSFTTSNLGHFSGRWVSGGHHFTNDIHYYRGKRNVVMRKTIYLDEDLLDAYISIVGLGFYKLYINGKEVTRGELNTDWTNYAKIIYYDTYNIKPFINQPKNEVIVELADGWFNPAPLKLFGKYNLRETLTIGEPQVIADIYMRFADREMIIGSDADWQYCEGAYTFNNIYLGERLDMKLFRGDNTTDLLMPDWKNVVLSNGPEGRLVSSFIPKINHTLSLGAEHIHVVDEETFIIDFGAIVTGFIDLSITASENQRVELLYSEDVDENYELNTDSTLAGFVGKQVTEGVIIDGGIGAPARAEQKDAFECRSGKNHFINAFTCHSFRYVQLSGINIEQLNNVQALSVHTVLRENGGFYCSDPYINKLFEIAKRTKLNNIHSVFGDCARERFAYGGDIVALARSQVYQFDSAAIYKKTIFDFINDIRPCGGVTETAPFMGIKTNGVGGETGPLGWQLVLPYLIAIHYRHYGNVNLLAESLPFLEKQILSLEMRDFDDLVTCCLGDWGSRVHDMRNYKNGSPALHFTSACFYYYHLLIIAKICDDLGFKEKWLKYIGKANKIREKILSLYKNTDGSFADRSQTSFVFAIYFDLCDDIESSLNALIDLIKKEQNVITCGIFGQSFAYEIFHRYGHNELILEWLRVEAGFKKMLKNDASTLKEFFGDNLNGSNNHAMFSSYSSWLFQALGGITVAEEAVGADVILISPSFTDTINFVDCWHQTIRGRIECRWRRYKKGIELVIKVPFNLKKCTLKLPKVYQLNKQLPAPIDCDTYHHFYDITDAGEIKVLL

SEQ ID NO: 9717 - protein, 298 aa, Klebsiella pneumoniae
GFYRQCVKTMGYGTFETLRRQNAVLKGTVELNSGIQLAAWYNNCDTVTVRSDHHTLSLYVADGYESYQKTPHGWKNGGGPDRFCLMPKGDESVWDIRGDLSFVHLYCTDAHLRRVGEEVWDRSPANFTLQEKTFASDDKITAVYRQFLLANDWRQPANQLTLSAASSLLLTHLIQHYSTVQWRLPTVTGGLAPGVKRHVLAWIDAHLDQPLTLADLAQQAGLSEFHFARMFRQSLNMAPHQYVMQQRMAKAQNLICHSALPLTEIALACGFSSPSHFSHRVKAATGLTPSQLRAAQRG

SEQ ID NO: 9718 - protein, 367 aa, Klebsiella pneumoniae
LVYRYDAAECRECIVACETLIFVTCIQKFCRQKMWSEYSLEVVDAVARNGSFSAAAQELHRVPSAVSYTVRQLEEWLAVPLFERRHRDVELTPAGVWFLQEGRSVIKKMQITRQQCQQIANGWRGQLSIAVDDIVKPARMRQMIVDFYRHFPDVELIVFQEVFNGVWDALADGRVELAIGATRSIPVGGRYAFRDMGMLSWDCVVASDHPLAKMDGPLSDDVLRNWPSLVREDTSRSLPKRTTWLLDNQKRVVVPDWESSATCLSAGLCVGMVPSHFARPWIDRGEWTALALENPFPDAACCLTWQQNDASPALNWMLDYLGDSDTLNREWLRAPERSAPARCLNDDNRQTGHPLPSGAQPDEGALR

SEQ ID NO: 9719 - protein, 330 aa, Klebsiella pneumoniae
TNRLIDNLYSVFRDNDQSGNSGSQTMIIRPEQHWFLRLFDWHGSVLSKIIFRLLLNVLMSIIAIISYQWYEQLGIHLTVAPFSLLGIAIAIFLGFRNSASYSRFVEARNLWGTVLIAERTLVRQLRNILPAEHDAHRRIVSYLVAFSWSLKHQLRKTDPTADLRRLLPEERVTEILASSMPTNRILLLAGNEIGQLREAGKLSDITYGLMDNKLDELAHVLGGCERLATTPVPFAYTLILQRTVYLFCTLLPFALVGDLHYMTPFVSVFISYTFLSWDSLAEELEDPFGTAANDLPLNAMCNTIERNLLDMTGQHPLPETLRPDRYFNLT

SEQ ID NO: 9720 - protein, 141 aa, Klebsiella pneumoniae
CYHRQGEDAMSVVTQFTPATSAEAIRWFSHKLHLETDCADVHSAQRAGEVDFVLLHVVGSEEAFARRHLPGAQHLPHSQITAERMAAWPADTLFVVYCAGPHCNGADVAALKLAELGRPVKMMLGGLTGWEDEGYAFVSGK

SEQ ID NO: 9721 - protein, 529 aa, Klebsiella pneumoniae
FMHSSNVSTHGMAVAPHHLASQSALAILREGGSAIEAMVAAAAAIAVVYPHMNGLGGDGFWLIVPPEGDPIAIDASGAAGSLATLEAYAGQQHIPHRGSQAALTVAGTVSGWDEALRISRDLTGRALPVARLLADAIGYAEDGIPVTASQAHATASKLEELRHQPGFSETWLVAGEAPRPGSRFRQPALAGTLRMLASDGLDSFYRGPLAERLAQGMATLGMPVTLGDLQAHRARRPGPLTLQHQQGTLWNLAPPTQGLVSLAILGITDRLKMADADDAQTVHRIVEATKRAFALRDAHITDPRHLDVDVQQLLTPEALQPLADSIDDASASPWGGGKGPGDTVWMGVVDNSGLAVSFIQSIYHEFGSGVVLPDTGIVWQNRGAAFSLDPQHLLALAPGKQPFHTLNPAAARLNDGRVMVYGSMGGDGQPQTQAALFTRYILQGVPLQESISRPRWLLGRTWGQSSDSLKLEGRFAPACIARLRELGHDVEVLADFSEAMGHAGAIVRHPNGLLEGATDPRSNGAAAGY

SEQ ID NO: 9722 - protein, 138 aa, Klebsiella pneumoniae
SCDRKKQPHMKEERYMYWNPEVLTRIDAADDLKIAPYHPDMNTTGTPTWIWEVKVDNRLFVRAYSGIRSKWYQAALSQQAGKILAIGQEFDVLFAKPSDPELESKIDQAYLKKYSGSSYVSAMTGIRARAATIEILPS

SEQ ID NO: 9723 - protein, 605 aa, Klebsiella pneumoniae
VSCRRASATSSRPRTLSSVSACSRCCSSAAMAGVASRCSVRAAEALSVTLSLKIRWLASAPAARLRSRLVRRTGRVSPCGAATAPNGCNPPCRVRKACFPSSITRLSVVNARSSGRRSACGAAAHWVNSCACWLRLAATKSSASAACARHGSKVSNSANTLTRRNAFMSFSSGQRPTGATLPPRRPWRLLADGFHRMVRFLIITGDPRTPRLRANGLIGLPDHVELAVAFNFTDHHRLMQMVVGGIHGQVKTGRRVEGLPGHRLAYFVNIGGARFGHRLRPHMQTHPGRFHRIVGHHRIGIRQLVRFGIRAIIGDKGFVGRIIDGLKVVPCREVADQRFGIDAAQLLFPHREGHHRYIGRFQTLVSQLFVERYVGIAIDGGDHCRFATGGEFFDIGDDGLVIAVAERGVDLLDIFVLDPFGMQKGAEDLVGGARIDVVRPQQKETFSAAAVLAQQVFHRRDSLLVRRRAGIEDVGGHLFPFVLHRVEQQAVQLLKHRQDRFTRDRRPAAKHHRHFILGQQLARLLGKQRPVGGRVDHHRLQFLAQHPAFGVDVVDGHQRDVFQRRFGNRHRPGERMHDPDFDGVGGIGLEGETHSHNRGGECKSF

SEQ ID NO: 9724 - protein, 531 aa, Klebsiella pneumoniae
KVSSKFIDAHEAARWVASGDTVCTVGMTLIGAAESILSAIEARFLTAGEPRDLTLLHAAGQSDRQRGIQHFAHPGMVTRLIGSHWGLAPRWMAMINNNEVEAWCLPQGQIVHLYSAMAAGLPGRLSPVGLGTFVDPRIEGGRMNARTRERPNLIEHVTFRGDEYLFYPALPLDVVIVRGTHADEDGNLTTDEEVMKLEVLHAVLAARRYGAKVLAQVKYRVAKGSLHPKSITVPGNLIDAIVVCEEPQTDHRQTSSWAFDPALCGDIQLPAAQNAPLPLDLRKLIGRIACRYLTPGCVINLGTGIPNDVIGAIIHEEQLGEQVTITVESGIYGGQQAGGVDFGIGRNLSAMISHQDQMLYYNGAGVDITFMGAGEIDPHGHVNATRLGASCPGAGGFIDITQNARHVVFCSSFTAKGLEIACEHGALHIRREGEVRKFVAGVNQISYNGELARAKGQTMHYVTERAVFELRPEGPVLTEIAPGIDLERDILAHMDFHPAIAADLQVMDSRLFAPPPCGLAEHLSRNSSSDS

SEQ ID NO: 9725 - protein, 419 aa, Klebsiella pneumoniae
LAISSTKKRWRKLWRKWAFSRTSHRCTGVSERRRGWRRSSGNGRSSRDSPSRGKAARMASSQEVIRMLNNGCVPSESGPTEVTADFRFTRVMAEQAARARLTLDDDQLSLIARLDALGQQLVSTTGRPQGMYVWGRTGRGKSFILDHFFASLPLAARRRVHFHHFFRELHQRLNAPGAPDLQTVMRQMTSGCRLLCFDEFHLHDPGDAMLIKALLEHLFQHGIVLLATSNYPPEMLLPNPLYHDRFLPSIALIRAHLTVVALNGEEDYRERHLSQDNAFCSGRMWVNPNAQQRQLYDLPSLPGEPVSLTVGYRTLLAAAASPALLHFTFTQLCQAATAVMDYLTLCESYAVWLLDEVPPLATVGPAAQQRFINVIDVLYEKQIRLLLVTRCDLETLVAGVELEDIQRTRSRLQQLPRAV

SEQ ID NO: 9726 - protein, 296 aa, Klebsiella pneumoniae
LHVRDTIMIGIRRMIEAQVLGLTGMALKEIDFERPKGEPGLFGPQSAIWQVHGDFTSMLCGGISALLLQMLHPLALAGVWDHSRFREDILGRLRRTSQFISATTFATTPDAERLIAKVQGIHQRIAGVDKDGTPYQASDPALLTWVHVAECSRFMASHLRYKRTVVSPERQEDYFRESAEIARRLGARDIPQTPQEVADYLEAMRPRLRCDERTREVAEVLLSTRLPGRMSQPVGRVMMNAGIDLLPEWAQEMLGLSLTPLQRRTTRLMVHGVARVLRASVRNGAWHCAMRRMTEA

SEQ ID NO: 9727 - protein, 95 aa, Klebsiella pneumoniae
MMVRNKAMNSPQIYSPVQLANYLKLLRQQNHWTQDALARRIGIKQATLSNFENHPDKTTLTTLFKILQSLGVVMTLNAKAAETAPAPDNNTDLDW

SEQ ID NO: 9728 - protein, 189 aa, Klebsiella pneumoniae
NAGLYHHRADAAGGHQIWPLAGSDLYAAAAGCASGPGRQSMNASLTLACLIAAGVGLVVQNTLMVRITQSASTILIAMLLNSLVGIVIFVTMLLLRQGVAGFQELALSVKWWTLIPGLLGSFFVFASISGYQNVGAATTIAVLVASQLVGGLIMDLVRAHGVPVRALIGPLCGAVMLVVGAWLVARRQF

SEQ ID NO: 9729 - protein, 417 aa, Klebsiella pneumoniae
KMLSNNCSILLIDDDADVLDAYTQLLEQAGYHVSACNNPFDAREQVPKDWPGIVLSDVCMPGCSGIDLMTLFHQEDDLLPILLITGHGDVPMAVEAVKKGAWDFLQKPIDPGKLLTLVDAALRQRQSVIARRQYCQQKLQVELIGRSQWTVRYRQRLQQLAETDIAVWLYGEPGTGRMTGARYLHQLGRHAEGPFIACELTPANAHTLNELIAQAQGGTLVLSHPEHLTHEQQHQLVQLQSHEKRPFRLIGIGSASLVELAASSQIVAELYYCFAMTQIGCQPLSKRPDDIEPLFHHYLQKTCQRLNHPVPEVDAGLLKGMMRRVWPNNVRELANAAELFAVGVLPLAQTVNPLMHIGEPTPLDQRVEDVERQIITEALNIHQGRINEVAEYLLIPRKKLYLRMKKYGLNKEHYKGV

SEQ ID NO: 9730 - protein, 383 aa, Klebsiella pneumoniae
HLMSKKIARCSLYVLGMACLTVQAAEPLTSLDKPEGRLDIIAWPGYIERGQTDKQYDWVSQFEKDTGCQVNVKTAATSDEMVSLMAKGGYDLVTASGDASLRLIMGKRVQPINTALIAGWGSLDPRIAKGAWFNVGGKVYGTPYQWGPNLLMYNTRVFPTPPDSWRVVFVKQDLPDGKTNQGRVQAYDGPIYIADAALFVKATQPQLGIEDPYQLTETQYNAVLKVLRDQQPLIHRYWHDATVQMNDFKNEGVAASSSWPYQANGLKAEGQPVATVFPKEGVTGWADTTMLHSEAKHPVCAYKWMNWSLTPKVQGDVAAWFGSLPVVPEGCKASALLGDKGCETNGYEQFNRIHFWKTPVAEGGKYVPYSRWTQDYIAIMGGR

SEQ ID NO: 9731 - protein, 376 aa, Klebsiella pneumoniae
WVTRWATAATRCSLVTTSCSRLKISLTPTFTNLRIRPGHHWLGQGLVFATLIVASKQETVMKVICTSPSFAKYDDAPISALKKADLELVMLPADASIEMLTQHLPDAIAMIVAFTDINESLLAKAPRLKIVCKHGVGVDNIDLNATRQRKIFVTNVPDANKHAVADFAFGLILNTARQIYQAISETKAGNWPRIFATDVYGKTLGIVGLGHIGKEVARRARGFNMRVLATDAWPDREFAQQHQIEYVSLDTLTAQSDFISLHTPLTPETENMFNAARLQQMKSGAFLINVSRGGIVDEQALYEALKSGHLAGAAADVFLEEPCATHPLFTLANFAPTSHIAGYTDGAISNISARCVNNIITCVCGGERPENIMNSL

SEQ ID NO: 9732 - protein, 237 aa, Klebsiella pneumoniae
IGQREAGVRNVKIDEVDRLDRDVVALGNDYAQGFILPPHQHRRAQLLYGATGLMYVTTQDGEWVVPPQHAVWIPPETVHAVRFAGVTTRSLYIEPDCVAAFIKHRRCEVISVSPLLRQLLLEAVDLPPLYDSPRDRTLIQLMLLELAAMPVREFDIPLPQHPALLALCQAFLLNPSIHDPAARWARALFMSPSTFRRHFLKQLGLSFSAWRQRACVVSALAWLIAGKPVNEVALSLG

SEQ ID NO: 9733 - protein, 112 aa, Klebsiella pneumoniae
PAKRITMSTPPVDRRTLAAIAPKLAELTETVLFGDIWARSELSPRERSLITLSALTAQGKTEQLPWHIALGYQNGLSREEIVELFTHLAFYAGWPAAASALTCLNAQEASCP

SEQ ID NO: 9734 - protein, 156 aa, Klebsiella pneumoniae
QSWRYGKMGLLNFVKEAGEKIWDAVSGDSKEDRAEKLKKHIDGLNLPGAEKVNIDVAEDGTATVTGDVASQEDKEKILVAVGNVTGVGQVSDGVKVTQSGAESRFYTVKSGDTLSAISKAMYGSANDYQRIFEANKPMLTHPDKIYPGQVLIIPAK

SEQ ID NO: 9735 - protein, 236 aa, Klebsiella pneumoniae
TVRRDNMQLGVIADDFTGATDIASFLVRNGMPTVQLNGVPTRDLPLTSEAVVISLKTRSCPAEMAVSQSLAALRWLQAQGCQQFYFKYCSTFDSTAQGNIGPVLDALLAELGETRTVISPALPVNGRTVYQGYLFVGEQLLNESGMRHHPVTPMEDAHLGRLIERQGRGKAALIAWPIVARGPEAVAAALAAVNDPAVRYVVLDPLNQKRSASPIGFVLPGTKNRSPGGPGPRPSG

SEQ ID NO: 9736 - protein, 305 aa, Klebsiella pneumoniae
RGGRRVIMQMNLFENIKIFIEIVDAGSFAQAAENLQIHRPAVTKALQQLEQESGVRLLQRTTRRLYLTPEGEEFYRRSKPLLSQADDLLESFAPDRPIRGQLRVDMPIAFARLLVIPHLPDFYQAHPEVEIVLSSSDVRRDMLRDGLDCLLRVGDLEDGDYVARSLGEVALTTCASPGYLARYGAPATLEDLQSHLAVNWVNSSSRQIMPWRFQTPEGIRQIAIPGKLVLDNSEVFTAAGLAGLGMLQGMRFFLQPYIDSGQLVEVLPDFPAPRRPLSLLYPHRHLSHKVRVFADWLQGLVATLD

SEQ ID NO: 9737 - protein, 473 aa, Klebsiella pneumoniae
TTGRHIMSAESSGVFTLKEINRIKIIQDVIERRITTRRAAEHLGISDRQCRRLLARYREGGPLGMASRRCGMRGNRQLPPGLADQALELIKTRYADFGPTLAREKLEELHGLFLGKETVRRIMVRAGLWVPRKQRAARIPQPRYRRPCTGELIQIDGCDHDWFEGRGPACTALVYVDDATSKLMELLFVKSESTFSYFEATRRYIDKHGKPLALYSDKAGVFRVNNKHATGGDGHTQFGRAMHELNIQTICAETSPAKGRVERAHLTLQDRLVKELRLQGICSMEAANDFAEAYMADYNRRFGKVPRHDFDVHRAVEHDEDLGLIFTVREKRKVSKSLTIQYDKMLYLIEDSELSRRAIGKYIDVYHYPDGRKELRLNGTLLPYSTYDRLSEIDQGAIVDNKRLGRTLEFISLVQSKRDNTRSQSIPAGDGPSRRRPKQEGKKSQRSLDNDDMLEALKQLQSRSEDIFGKRAR

SEQ ID NO: 9738 - protein, 264 aa, Klebsiella pneumoniae
ISFGATVLPWAIWFYPVKKLRKSARWLESKGRHDDAHTVMCEMEARCGLTPSPKHAHAAQSVVKRGTFREIWAPQYRQRTLMLMVMNFFQAIGFFGFGNWLPALLSGQGASITHSLLYAFFITLAYPLGCLFCTRFVHRFENKWQIVLSALMTVIFGTLFALQNSPILLVICGFMITWSNAWLTISYHAYQAEVFPTHIRARAVGFCYSFSRLSTAVTSILIGIILQYAGTPGVISFIVVSMLMVMLSVGIFGPRTRGIRLENI

SEQ ID NO: 9739 - protein, 528 aa, Klebsiella pneumoniae
QKVGHVFNNPAGSPSWTCVQYSILIEVQAMSRQWMTLMAILLVYIPVAIDATVLHVAAPTLSVALGSSGNELLWIIDIYSLVMAGMVLPMGALGDKIGFKRLLLLGSAIFGIASLCAALSPTAMTLIASRALLAVGAAMIVPATLAGIRSTFAEASQRNMALGLWAAVGSGGAAFGPLVGGILLEHFYWGSVFLINVPIVLVVIAINAKVVPRQPARREQPLNLLQALVLIAAILMLVFSAKSALKGQLALWLTALVALGGAAMLTWFIRKQLSAARPMVDMRLFTHRIILSGVMMAMTALITLVGFELLMAQELQFVHQKTPFEAGIFMLPVMVASGFSGPIAGLLVSRLGLREVATGGMLLSAFSFLGLALTDFSTQQWLAWGLMTLLGFSVASALLASSSAIMAAAPKEKAAAAGAIETMAYELGAGLGIALFGLILTRSYSASIALPSGLSGAMAQQATSSIGEAVSLSQALPAGVAQALMAAAKTAFIQAHSLVLATAGVLLLLLAAGIWRSLATVAKPQSAL

SEQ ID NO: 9740 - protein, 169 aa, Klebsiella pneumoniae
PGAGVRFLSAGRWRSRCQMPGESRAAAPPPITGRAAEAPAATALLLLARSGRRTGAWGTAAPTACRPAPCRGTRRVASVRRQLAVDPPAAGARPTAGGDPAGHPAAARAPGRLADPTAGKYRYPSSHGSTPRTAGYIRASGRLAGGPGRRQRRRCAVGSASAEPDYRPG

SEQ ID NO: 9741 - protein, 256 aa, Klebsiella pneumoniae
PYHGGIQVNGFYSSVAGATLRWHDFPGDGLPVVFIHGLGCASSYDYPRIASDPALRERRKILIDLPGFGYSDKPRAFSYNIHGQALVLEQFLNRLRLQRFALFGHSMGGSIAIKAAGLLGERVTTLLVSEPNLFAGGGEYSRRIAAQSESAFVADGYARLLAEERSPWAGCLQNSAPWAVWRAASSLICGSDTPWFTQLCQLRCQKMLIVGERSLPYADSDLVQAQGIPVGIVPHAGHSMAWENPQGLAQLIASHS

SEQ ID NO: 9742 - protein, 243 aa, Klebsiella pneumoniae
NRSGLMNNEHRLQAAPALQDKDESIYQALMTAIVEHQLPPGSKLPEEALAEVFAVSRTGIRKVLQRLAAVQLVTLTPKRGAHVTSPSVEESQAIFRTRALLEVANLPDVIARCQPPHLAALENIIQREQQAHAAHDGPAAIRHSADFHIQLQAISGNPVLTEMVTRLSQRSSLVIAAWGAPWRQGCRCDDHQQLVGLLRDKALQPLSEALMHHFDHIVASLCFERDGVSLPDFSRLFAGHKES

SEQ ID NO: 9743 - protein, 500 aa, Klebsiella pneumoniae
GPGGSPATAITTPETGNKTMKQDNAMQHNLLINGKLVAGEGEKVPVYNPATGEVILEIAEATAAQVDAAVEAADRAFDAWSQTTPKTRAECLLKLADAISAQAETLAQLESLNCGKPLHCVINDEMPAIADVFRFFAGAARCLPGMAAGEYLEGHTSMIRRDPVGVVASIAPWNYPLMMAAWKLAPALAAGNCVVIKPSEITPLTALKLAELAKDIFPEGVINVLFGRGKTVGDPLTAHVKVRMVSLTGSIATGAHIIGHTASSIKRTHMELGGKAPVIVFDDADIDAVVDGVRTFGFYNAGQDCTAACRIYAQQGIYDQLVEKLGAAVASLKMGAPEDAATELGPLSSLAHLERVSAAVEAARALPHIKVVTGGSRADGAGYYFQPTLLAGARQEDAIVQREVFGPVVSVTPFSDEAQALSWANDSQYGLASSVWTKDVGRAHRLSARLQYGCTWVNTHFMLVSEMPHGGQKLSGYGKDMSMYGLEDYTVVRHVMVKHS

SEQ ID NO: 9744 - protein, 433 aa, Klebsiella pneumoniae
IDGGEDADAGHKREIAAEAEGSILQGAEIHHRLRMAQGADNKGHAAEQGDPGGGRQGRVIKPAPARTFFEGIFQAAEGQGQQQNTEIVGAAQQSGVGAVYFYQQRHCHRDVNPRNNVDKEQPVPVVVFGDPAAHRWTQRRGEGGQAADRRRGDDPLFALKKGESGGEHQGDHRPARQSLQGAEGDHTLDVPRPAAQQAHQREARRGSGKQPAGRHDPGQPAGKRDNNDLGDQVAGLYPDGFIVARRQAAANIPQRGGDDLDVDKGNKHPHAHAGEGEDLLRRRHRQTLRGGQRLNGAHRGLFSFTVTITDSPGRRTSSFAPSPSSAMRTGTRCTILVKFPVAFSAGRMLKREPVAGARLATCPLKVWFGSTSATMVTGWPARICASWFSLKLASIHRPCAGTRESSCVPLLTKEPDHARRLPITPSNGARMSV

SEQ ID NO: 9745 - protein, 151 aa, Klebsiella pneumoniae
RRFGFRANIPSASGNRCMDGTGRQQSSRNDPARYRSPIRITDPHGEFLILAGNTDMHQSFNQRVHFYYCVLVALKMHGKSKKAGGIRGKNNFLLKWLRRAQDNNIFPPDITSEIEWLRGKIIQAGYDTDLEPMLDFVYATASRAEALKNAE

SEQ ID NO: 9746 - protein, 503 aa, Klebsiella pneumoniae
GGLGAVVIPGRLHRRALSGGEPEVVQDRFQRAERLHHAVFTRVIAHGANAPDFTVQRTKRGANFNAEIFQHQFAYLIAVDPVGDHHPQHVIHFVPQVAKGLEPHRLDALQQRIAVQFVAGDAVVESLLEDQARALPGGEQRRGRFGMVVKALRPPVIHHHAEIEIVGVDHLVDAIVMGIGADPLLNAAAAADDLFHPRAEGDGRGAGRTAQALLHPGGHGVQLPGVGFQRVTAERRGGVGIEQHIVTTANLSQLRQRLQHGGGGIALHGEQQARPHALDRILNLIRRKDLTPRHLDGVHLCPAATRDLAQQMTKPAEHRHQHLVTGTDRRQQNRFDPGARGAVDQHRPAIFGAKHAAVERHDFIHVVGHRRIVLANQLARHGAQHARVGIDRPRPHQQALRRVNLRKLSDIHLPFLTLVKTAHRGDKLFQFAGLRAGEQRFAVALLPDASLMHKHHAVAHFAGKIHFMGDEDQRHTFRRQLLQHLQHFTHQFRVERRGDFVTE

SEQ ID NO: 9747 - protein, 89 aa, Klebsiella pneumoniae
NSSGLFSGWGNSSTLWAWAAADKSRPAVRMVFTRCIVVSLCCYKKLMRKTIDSSDDKNMTIQRQYYYLTNIAMLSEFCAISVAKSHILY

SEQ ID NO: 9748 - protein, 810 aa, Klebsiella pneumoniae
RRPGVQQIPASSQNPRGPARSGLQRHKSQPAAVPQPYPLAADLPNPGPVMTLATRTVTLPGGLQATLVHQPQADRAAALARVAAGSHHEPSRFPGLAHLLEHLLFYGGERYQDDDRLMGWVQRQGGSVNATTLARHSAFFFEVAADALADGVARLQEMLQAPLLLREDIQREVAVIDAEYRLIQQHEPSRREAAVRHAASAPAAFRRFQVGSADALAGDLAALQAALGDFHRTHYVARRMQLWLQGPQSLEALGELAARFAAGLAAGEAPPPAPPLRLGEFTALQLAVSSQPALWRCPLIALSDNVTLMREFLLDEAPGSLMAGLRQRRLAGDVALNWLYQDRHLGWLALVFASDRPEEVDRQITHWLQALQQTTPEQQQHYYQLSRRRFQALSPLDQLRQRAFGFAPGAPPAGFADFCAALQAAPSVSLACQTVSPGEPVATQGFSLPLSRWRRRPESDPVLAFAFYPQAAGDLVAKCPEKAAPLLHLPSPGEPPRLLLRPPFYCSPDQAEGLARGEQLRPQLAALRHAGGHGEWHLFDGSWQLTLQLPEPGRRPEAILQAILRQLALPVASLTPPPESIAIRHLMAQLPERLGTSGHQEGWLAALAGGSAEDAQWVARQLSLITAPVNPPMPAPAPCRRGVERLVYPGGDTALLVFIPLPDGASLAALRLLAQHCEPLFFQRLRVEQQIGYVVSCRYQRVADRDGLLMALQSPDRRAGELLRCGKDFLRQLAPMDEATFRPLQQRLAAQIRASRPPEARALSALRQEYGLPELTPQAVDALRVAEVADLAREMTRRRRRWQVLFTTGD

SEQ ID NO: 9749 - protein, 101 aa, Klebsiella pneumoniae
SPPGSPAFSDRWQIRSDRGARHAHSSARPGYAARLPDKPGPPPPSGSLAPPSLPPVRRRDYRAAWSRSSLPASAGRMSPRRAAERRPCPPPRRRSSPGCRC

SEQ ID NO: 9750 - protein, 444 aa, Klebsiella pneumoniae
YCTGKSARRVLSRAQAPPSLCKYHSGLTSALRQQYLFIIIKKELYNIIVLKLRIIVGWWMNNQSRQALWLALAGSIVLMIGMGYGRFAFTGVLPLMLNEGLLTLHEGNLAASANYAGYLVGALLLARVQPGAATRLSIISAGLTIASLALLAWVSSPWTIITLRAVAGALSAITLIAGSLWLLEHMGHHHGAPLLYAGVGLGIFISAEGIALGHALSLTSQQIWLLCALCAGLLLALAIRWLLTPPAALVRVSHVETSSPASGSDTRRAAWRLLIVYGLAGFGYIITATYLPLFLSGSLQSVDPVHLWALFGLAAAPSCLIWHKLVLKWGYRQALTRNLLVQALGVILPACSASLLFCVLSALLVGFTFMGTVTIALPKAKSLSHQVSFNMIAAMTALYGVGQIAGPLIAGALYQIAASFNPALYAAALALLIAAGLVFTERQA

SEQ ID NO: 9751 - protein, 518 aa, Klebsiella pneumoniae
YAAGRCHPGLRHHLHCLNWRAVMNLQTLSWRALPWVKATRPQWRYALRNGIAMCLALSIAYALDLDEPYWAMTSAAVVSFPTVGGVISKSFGRIAGSLLGACAALLLAGHTLNDPWLFLFSISGWLALCTWACALFTNNVAYAFQLAGYTCAIIAFPVINISDSYELWVIAQSRVCEVIVGILCGGLMMMILPSTSDGSNLLTALKTMHTRLLEHASLLWVPETTDAIRTAHESVIGQILTMNLLRIQAFWSHYRFRRQNPLLNYLLHQQLRMTSVISSLRRMLLNWPDAPANTRQVLESLLAELATPHADSYHVARILAPLAPRQDADYRHIAFWARLRYFCRIYLESSRWIRRVENASAIAEFNVPAAPPLARHTDQAEALLNGVRTFCALVAIGAWGISTQWTSCAGGPEPGLHLLRALLGIRLAVSLADIADADSGSAVAIHFRGEVRPDGASNRPVAVSAVSCSRLLDTMQLLKLQWPKYAGLVGTAYRLYGLVNRRHQPAGVRLCGLFSMII

SEQ ID NO: 9752 - protein, 173 aa, Klebsiella pneumoniae
AKNGPHYLKNDIAYYVGTAHVKKGIAFLFIDDNEGIFMVEVEEIKKKYPGADAWQMGDSPQLANELADLIKKGIKTASCGSFASYQQEESAPRIGSYNIILDGQNVPVCVIRLISMQLVRFCDVTEAFARKEGEGDLSLEYWKKEHQRFFSSEGHFSEDMELIAEEFEVVEVL

SEQ ID NO: 9753 - protein, 93 aa, Klebsiella pneumoniae
RSCGASTCSMRPLLNTATRSDIDSASLWSWVTKMKVIPSDCCSFFSSTCICSRSFKSRAPSGSSSSSTRGWFTSARAIATRCRWPPESWEGLR

SEQ ID NO: 9754 - protein, 112 aa, Klebsiella pneumoniae
CQSGCPLHRQSRRSRLPSPAVAHAGADAGPPQSPPARRACRRSVRRCARCQDESPAAPPAPPPVVLHNVRRCCRRCPATPSCRQPASTAPPAGWPADARATDRPGSGRRRFR

SEQ ID NO: 9755 - protein, 169 aa, Klebsiella pneumoniae
RRSGRRWRRTRRRGWQIRPPAGRAHCACRRSPTPPPAPRRGSGFSPHQNFPPPAETGSAPAPGVPLPAPSAAAPPPASRWCEYRGRRHALPLDSASGKADRSPPRWATRRCPPAGQSPCRRCRLRRPARFSDRRAAGSARRSAASRGSARWWPPPAGRAPGSGAARAAS

SEQ ID NO: 9756 - protein, 142 aa, Klebsiella pneumoniae
LPSGAATTVATDTAEKMIASAFGTWAAGTRRIAVAVDIAQKPPMAIPNSRRPSRRNASESAKATIRLETICSTEKNISTQRRSILRVAVAISRPVTNATSAVAVTACPAIPSLTPRLLAIGVNRLAGRNSATIRPNTPRARA

SEQ ID NO: 9757 - protein, 390 aa, Klebsiella pneumoniae
QAGGQKLGHDQAEHPEGQGIDGAPGRFGGRQARVSSYAGTHIQLSRFINILVILGTYFRTIYDAYSSVIDYSSGITMSQPAIDLTSELLRGMRLFGVNYRRIETARPFGVGFSAVAGKAQFHFISRGPVLLRMASGEQFTLESGDALFIPNGDGHALLSDPQATVVNVAQLPSETVCSTVSCINAGDQPDCPERAVIFSGCMDFELGGMQPLVKAMPEVMRVSSLLNTWPEIQPLLVAMERESLTRQAGYAGILARLADVVAALIVRGWVACGCGNATGWVQVLRDPRLAKAIYAMHQRPGVNWKVEDLAREAGLSRSLFAERFLAATGTTPARYLTELRMRLAVQYITHEGQALEKVAFSLGYQSLAAFSRAFKRITGQPPGALRATAR

SEQ ID NO: 9758 - protein, 123 aa, Klebsiella pneumoniae
AEGGVPAVTGKVEGKRMKKILIAVVPFMLAGCSYYNQFVERMQTDTLEYQCDQKPLTVHRNNARQQVSFIYDNQQLNLSEGLSASGARYTDGVYVFWSKGDTATVYKRDRIVLDNCQLQTAKR

SEQ ID NO: 9759 - protein, 311 aa, Klebsiella pneumoniae
KNIFTSKGKIFFMLSYMLSQYARLPVPEVTLRSWLKQWLSEQESRCTDRSFSARFPWRETGLCQEYFLQRKLKIDGKQFLTGPRYQGGNINKPFIDIVGMDSDLNHTALELISKEWSQLRAQYVRILVPGQSFPQGIPDQYIYATSFSEPPEFNDKSLSLQVATYEDFDWCCQALGDAYKHTWQTVRELSASNLVAVDEEELCDHISEREVYIIYENDVRAGLLICQKGNLAFLRGYRITDKVILPAFRGRSLSARAQRLLYRLLTHSDSELSMYMGTIIPQNIPSMKTAERAGRTCILSYQFLPICRTHD

SEQ ID NO: 9760 - protein, 93 aa, Klebsiella pneumoniae
GILGFDVDVAVKIFAFILLAIGAVALSYGNAPAKRIQSCEKMGVGQAVCAAAEWDSEKVNVLPRYNPSLNKVIAAAQLAPAARQQENNSVVRA

SEQ ID NO: 9761 - protein, 100 aa, Klebsiella pneumoniae
DESGFILNIQPVSDFVIQVSLNHDVMADNHPTMERPSGKEKVRMTLYQKMLVFYAIMGVICAVISWFLTKESRMIRLLAALLIGATWPFSFPMALLVSLF

SEQ ID NO: 9762 - protein, 433 aa, Klebsiella pneumoniae
TGSGIHHRLVSGGGAGRRRPAGRQRGGGLWAGHFQQNSRTANGRGAGQDPDPGDDYSVYSETPTGSVRAEREGYRLMSQPITLTLAQRAPRPLRWLGILLVLGLLSMPFLALLPASHPLAVPSWLLTLSGKILCYAIVAVALDLVWGYAGMLSLGHGIFFALGGYAMGMYLMRQAAGDGLPAFMSFLSWSELPWFWWGTQHFAWAMALVVLVPGLLALVFGWFAFRSKIKGVYFSIMTQALTYAGMLLFFRNETGFGGNNGFTGFTTLLGFPVTATGTRATLFMATVLLLLLTLWLGSALAQSKFGRILTAVRDAENRLMFCGYDPRGFKLLVWTLSAVLCGLAGALYVPQVGIINPSEMSPTNSIEAAIWVALGGRGTLIGPVLGAGLVNGAKSIFTVAMPEYWQLFLGLIFIIVTLFLPRGVMGLLRRGDR

SEQ ID NO: 9763 - protein, 159 aa, Klebsiella pneumoniae
RPPGNVQTAWPMASARRWRWRHALRRSAASGNAPAPPPPPRSAPPAGDCRRRWRRCDNTPRRRNSAGGARQSPAPAPAVPPAAPSAAHPAGREYPASTAPRPVSRLPRPAHSAGCRPSPPGYRRAGGSGFPPAPSIPPPRRGRPCDEASAPCRHGQLRR

SEQ ID NO: 9764 - protein, 81 aa, Klebsiella pneumoniae
FVTGSFSIYQPILIKPKVKIMAEHRGGSGNFAEDREKASEAGRKGGQHSGGNFKNDPERASEAGKKGGKNSHGGGRKSGDS

SEQ ID NO: 9765 - protein, 445 aa, Klebsiella pneumoniae
RMTGEGVAMSENRQLRLGTILHGASGNMSAWRHPAAQADASINFDFVTQTALKAEAGKLDFIFVADGLYINEKSIPHFLNRFEPLTVLSALAAITRRLGLVGTLSTSYSEPFTTARQFASLDHLSQGRAGWNVVTSPLEGSAKNFSRAQHPDHALRYRIADEYLQVVKGLWDSWEEDAFVRNKETGQFFDKNKLHTLDHHGDFFKVAGPLNIARTPQGRPIIFQAGASDDGKKLAARHADAIFTHQDSLAEAQAFYRDVKSQLAAYQRSPDQLHIFQGVSVIVGDDAEDAERQYQTTAALVSIEDALNYLGRYFEHHDFSQYPLDEPFPDIGDLGQNSFRSTTDEIKRHARERGLTLRQVALEAASPRPRFTGTASDVADGLQLWFEQHAADGFIIQGGTPETFPRFVDEVVPLLQARGLFRRDYPGTTLRESLGLALPANQFQK

SEQ ID NO: 9766 - protein, 294 aa, Klebsiella pneumoniae
PAAGGSDGVCAGGGGRRSFVTRALPAARRCASGNTAYACEEFILPQEQPLERIDHILVVDDDRDIRELIVDYLEKSGYRASGAANGKAMWSVLKNHQIDLIVLDIMMPGEDGLTLCRQLRANPQQDIPVLMLTARTDDSDRILGLEMGADDYLIKPFVARELLARIKAILRRTRALPPNLQITEAGRLIAFGDWLLDTAARHLLDDSGAIVALSGAEYRLLRVFLDHPQRVLNRDQLLNLTQGRDAELFERSIDLLVSRLRQRLREDAREPAYIKTVRSEGYVLSVPVSIRERA

SEQ ID NO: 9767 - protein, 441 aa, Klebsiella pneumoniae
EKAGSMMDYQTAVRGAFFDIAGVAETPDEVAAQARYLDDGLLFLQEGKIIALLPWQEGEAFLHPLKGYVDLRGKLLLPGFVDTHIHYPQTEMIGAFGEQLLEWLTTYTFPVESQFADAEYAQEIAQFFVNQLISHGTTTALVFCTLHPASVEALFSEALRLNMRLIAGKVMMDRHVPDYLCETAGESYEQTRALIRRWHQRGRLGYAITPRFAPTSTPGLLEAVQRLRAEFPDTWLQTHLSENREEIAWVKQLWPEHARYLDVYHHYQLTGERSVFAHGIHLDDAEWQCLHDTGSAVAFCPTSNLFLGSGLFRLPACWQHQVRMGIGSDVGAGTTFSMLRTLGEAYKVGQLQSYRLRASEAFYHATLGGARALRLEEKIGNFQPGKEADFVVIDPAVTPLQRLRIGRCHDIYEQLFVLMTLGDERNISETWVNGERVWCQD

SEQ ID NO: 9768 - protein, 317 aa, Klebsiella pneumoniae
RNKGKQMKKSLFAGATLTALFSGHALANEPLTLVLDWYINPDHAPIMVAEQIGAFKAQGLDVRIVPPSDPALPPRMVAARQADLAITYQPQVHFFADEGLPLVRVGTLINSPLNTVIALDKQIKTPADLQGKKVGYSVSGIEQATLATMAQHAGIDPASIKLVNVNFQLTSALLAGQVDAVIGGYRNIEAQELKLQGKTPVVMNVEDYGVPAYDELVIVAHRDAIHEAKIRKFLTALQEGVGYLRAHPQKSWEAFAAAHPELRTELNHQAWLQTVPLFATDPAALDKPRYETYEQFLYNNKLVKKVTPLTNYAVQLH

SEQ ID NO: 9769 - protein, 113 aa, Klebsiella pneumoniae
PGRGLRAKSGYLSYLTPGFMPDGGYALSGLQGPLTGSYPVGPRKRSAAGQDIRHGSCNFAGWRLSPCPAYRVLSQAHTSQARASAAPPGMRRFTSRLPDGYRTPPSPPPAPLR

SEQ ID NO: 9770 - protein, 166 aa, Klebsiella pneumoniae
YERGGGMSNPAYLWLTDENDSPIIGSCLMPTRTGSIELRAVNHHVWLPTDNNTGKLTGTRLHTPVKIQKEFDRTTPLLFRALCEGRTLRSATLKMYRINEAGLEVEYFNIAMANIKITAITPNLHPAGMTSTHLEDIDFRYETITWIYTEGNIMYRDSWNDRCCAW

SEQ ID NO: 9771 - protein, 236 aa, Klebsiella pneumoniae
INGGPVIVPAFSQGLYGRLRQLAAADWQRYVAHPFVQQLASGTLAENAFRRYLTQDYLFLIHFARSYALLVSKLRTLPEMRAATASMNAILNELPLHVGYCAQWGISEPEMAAQPEAPETLNYTRYVLDIGHSGDALDLLVALMPCVAGYAEIGLGLLQHPATRLDDNPYASWIRNYGDEGYLQGVSAALALLETVWQQRGSEARITELSEIFTTATRLEAQFWQMGLNAAAETRA

SEQ ID NO: 9772 - protein, 237 aa, Klebsiella pneumoniae
AWGGRVMRILKVIGLLLEYPDELLWENRDDALALVRADVPSLTPFVGELLTAPLLDRQAEWCEVFERGRATSLLLFEHVHAESRDRGQAMVDLMNQYQQAGLQIDCRELPDHLPLYLEYLSILPPAEAREGLQNIAPILALIGGRLKQRACPYYQLFDALLALAKSPLTSDSVTKQVAGEKRDDTRQALDAVWEEEQVKFIEDNATACDSSSMQAYQRRFSQDVAPQYVDIRAGGPK

SEQ ID NO: 9773 - protein, 151 aa, Klebsiella pneumoniae
TPSGEIMIRDWLTPDKIKVINSIDSWENAVRLAAEPLLMQGYIAGSYIEAILQSHKELGPYYVLAPGLAMPHARPEQGVLRNGLSLLHIKEGVSFGSEENDPVYVVIMLCARSGNEHITMIGELAEIFSDQQKLHRLLNADDSKAIQAVID

SEQ ID NO: 9774 - protein, 160 aa, Klebsiella pneumoniae
HTPGRFTGTVSTQLMLTGVIMSFCHMRIARPVSELDTTASMYCAGLGLEQLGSFTDHEGFSGIMLGAPEAGWHLEFTHCRHHPVTPSPGDEDLLVLYYPQQAAWEAQCAAMDAAGFLRVTAFNPYWEVNGVTFVDRDGYRTVLQNRAWGMVCDSSGIAAS

SEQ ID NO: 9775 - protein, 517 aa, Klebsiella pneumoniae
ETAGLVARLKTSPELVMKDKILTIDVGTGSTRAAIVRIDGAMIGFAQREYEQTTPRAGWSEQAPSLWWQAACDCIREVLYRYPETAAQIAVIGACGQMHGTVLLDDRGELVEDRALLWNDKRSQPQVDAFNAREGWEKWLAHLNNPPAAAWPAFKLAWWRENHPDRWSQLAKVLMPKDYINFMLTGAMATDYSEASCYFLMDSETRSWSSQACETFGLRVDQLPDLKLSSDIIGQVTQRAADLTGLPAGIPVVAGTSDMAASLLGSGVYEPGMASDSTGTSTLMTVVSPRPLHHPLVNNLHLANAAWGGFTILDAGGDAVRWARLALADNQITHPQLLQEAAAVPVGAEGLLFLPYLTGERLAEHTNSRAQFFGLQRKHRRGHLFRAVLEGVAFASWRNLRQLQKCGQYPQQMIASGGGARSSLWLEIKAAAYNLPILSTRNQENGVTGCGIIAGVGVGLYADFASGVRQTVQFDKLISPDPRLRDYYHACCELFDTLYRQSAALYDRLDALSVGPD

SEQ ID NO: 9776 - protein, 194 aa, Klebsiella pneumoniae
KFKGTPLCWQHHTFHKGYAMRDKYSGLQIGIHWLVFLLVVVAYAAMELRGFFPRSERPLINMVHVSCGITIFVLMVARLLVRLKSPAPPIVPKPSPMMTGFAHLGHLAIYLLFIALPLIGMVMMYWRGNPWYAFGLTMPYAPQSDFERVDTLKAIHEWLANAGYFVIGLHALAALLHHYWWKDNTLLRMMPRKR

SEQ ID NO: 9777 - protein, 388 aa, Klebsiella pneumoniae
WSEGIQGSWNEGKRMRSGRFIGVMSGTSLDGIDVVLATITENMVAQQASLTWPIPHAIKEEILAICQGQSLTLSQLGRLDTRLGRLFADAVLALMRQESLKPTDVIAIGCHGQTVWHEPQGEAPHTLQIGDNNQIAAHTGITVVGDFRRRDMALGGQGAPLVPAFHHALLAHPVERRMVLNIGGIANVSLLVPGQPVRGYDTGPGNMLLDAWIWRQKGKPYDKDAQWASEGKVLLPLLQDMLSDPWFALPAPKSTGREYFNYGWLEQHMARYPGLRGEDVQATLAELTAVTISEQVLLSGGCERLLVCDGGARNPLLMARLAALLPGTEVSTTDEAGISGDDMEALAFAWLAWRTLAGLPGNLPSVTGASEASVLGAIFPANPPQNRS

SEQ ID NO: 9778 - protein, 276 aa, Klebsiella pneumoniae
RQRGRRIAGDPRGLRRTAAYSPPGIAGRADRRRHRQRLGRGAAYFTGLNRPRAAGGPPVGRCDRLCRRRHSGHCLAGPRHRQQTGRAAPSAGLQRNLAGRGRGPAARQPLPPARPRRYPAHAGQRRSRQLLSRAAGRASGAGYGHAGDACHPRRPAGPPRQASGAADAPAPAGNAVESCPSHAGTGVAGDPWHHRPPEDGRCRRRANGAPYRRSHQAGVCPARCAYHRSAPSGCGCTAVAHPGSPAAAGRQHRRRQRFPLGRRQRPGRYRLDGRRG

SEQ ID NO: 9779 - protein, 625 aa, Klebsiella pneumoniae
IVRGKKRQAACMPRLHVRGNEKNRLFLWTGLFYLFSAGNNWIINRFCLEWAEIITQRDDALRINSPVQKDAFSGMNRRRFLKSSMAVAAVCGTSGVASLFSQAAFAEDAGIADGQTRRFDYAVLQAMAHDLARQPWGGAPRDLPPTLANLTPQAYNSIQYDANHSLWNNIEERKLDIQFFHVGMGFRRRVRMFSLDASTQQAREIHFRPELFKYNDAGVDTRQLEGQSDLGFAGFRVFKAPELARRDIVAFLGASYFRAVDSTYQYGLSARGLAVDTFTDTPEEFPDFTSFWFETVKGDATVFTVYALLDSPSITGAYKFTIHCQDTQVIMDVENHLYARKDIKQLGIAPMTSMFSCGNNERRMCDTIHPQIHDSDRLSMWLGNGEWVCRPLNNPQKLQFNAFQDKNPRGFGLLQLDRDFSHYQDVMGWYNKRPSLWVEPRNQWGKGAVSLMEIPTTGETLDNIVCFWQPEKAVKAGDELDFRYRLYWSAQPPVSTPLARVLATRTGMGGFPEGWAPGEHYPDKWARRFAIDFVGGDLKAAAPRGIEPVITLSSGEAKQIEILYVEPFDGYRILFDWYPTTDSTDPVEMRLFLRCQGEAISETWLYQYFPPAADKRNYVDDRIMK

SEQ ID NO: 9780 - protein, 225 aa, Klebsiella pneumoniae
MAGGTGLMTTFTDWDIIRNLLLAGRWTVLLSLVAFTGGALVTLPLLLLRLTGGRQVKRLIRGYIELFQGTPLLMQLFLAFFGVALFGVDVSAWTAASVALTLYTSAFLLDIWFGSIRALPKGQWEASRCLGLSFGQTLYRVVAPQALRIAIAPTVGFAVQVIKGTALASIIGFVELTKAGTMLTNVTYQPFKVFALVALGYFILCYPLSRYSRFLENKFNASHHH

SEQ ID NO: 9781 - protein, 531 aa, Klebsiella pneumoniae
NLIFVYKIHHSGLDPAIASAIHIKGFSFRGAGFMPHSSHTQQTKTHKAAAGYSPRLCNDDLAPTRDQNWSWYNIFSFWMSDVHSMGGYVVAASFFTLGLASWQVLLCLLVGICIVQLCANLVAKPSQMAGVPYAVICRQAFGVFGANIPAVIRGLIAFAWYGIQTYLAANALMLVLLKFWPSLASLTSSSFLGLSPLGWLCFATMWLLQATVFWHGMNAIKRFIDIAGPAVYVVMLALAGWIVYKTGLDGISFTLASKSLSAGEQTWQMITATALVVSYFSGPLLNFGDFSRYGKSMGEIRRGNRWGLPFNFLLFSVVTVVIVSGTQSLFGKMITDPIETVSRVGNDLAVAIGLLTMITATIGINIVANFVSPAFDFSNCAPQKISFRTGGMIAAVGSILLTPWNLFNSPELIHYTLDVLGAFIGPLFGILIADFYLIKRGRVSVDDLFDDTPQGKYWYRNGFNPKAIAALLPSVGLGLIISFIPALHEVANFSWFIGVCLGATTYRWLARDEREVQAKAAFRSGAVAQKE

SEQ ID NO: 9782 - protein, 61 aa, Klebsiella pneumoniae
PWFIAQVSYAPGASKLSCTIKCTRMRLSSCNIFDDQNDKSRTHCLRLYSGWFQFRYDNGRG

SEQ ID NO: 9783 - protein, 72 aa, Klebsiella pneumoniae
NYLMTDLTVIYGTGWIPDAVSPSLLRSLILLYLTPYDSLRNNHILPINASRGVLPGPGHPLCAKSGSRLKIN

SEQ ID NO: 9784 - protein, 228 aa, Klebsiella pneumoniae
RHLMTTSSMAMSDNDELQQIAHLRREYTRGGLRRHDLPAEPLPLFERWLRQACDAKLADPTAMVVATVDERGQPYQRIVLLKHYDEKGLVFYTNLGSRKAHQIENNPQVSLLFPWHMLERQVMVIGKAERLSTLEVVKYFHSRPRDSQIGAWVSKQSSRISARGILESKFLELKQKFQQGEVPLPSFWGGFRVSIEQMEFWQGGEHRLHDRFLYQRDSGAWKIDRLAP

SEQ ID NO: 9785 - protein, 537 aa, Klebsiella pneumoniae
SGLITMSTGKTTLALLLSALLPAGAAWAAGNDTLVYCSEASPESFNPQIASSGPSFVASSQVLYNRLVSFDPVKNTPIPSLATEWHVSEDGKTWTFTLRQGVKFNSNKFFKPTRDFNADDVLFSVLRQMDPQHPYHKVSQGNYEYFHDVGLDKLIKSVKKVDDYHVQFELNEPNAAFLADWGMDFASILSAEYGEAMLKKGTPENVDNWPVGTGPYALQQYKVDSQIRYIANPHYWEGEVPTKHLIFSITPNVETRLAKLQTNECQIIPAPSPVQFPVIKGNKDLALHAVEALNVGYLAFNTEKKPFDNVLVRQALNYATDKQAIVKAVFLDSGSVAKSPIPSTMLGYKKDLPDYDYDPQKAKALLKQAGLEQGAEVTLWSMPVQRPYNPNSKRIAEMIQNDWAKVGVKAKIVSYEWGEYLAGMRKGEHDSALYGWMSDNGDPDNFAGTLLSCDNIQTGSNAARWCDKSYDALVKKALLVSDPQARAKLYEQAQEIFYQQAPWITLATGKTFYATRSNVSGYTVSMMGSDFSKAKLN

SEQ ID NO: 9786 - protein, 311 aa, Klebsiella pneumoniae
GGIMHSSETIKVVPARYPLRVVGALVALLVLAVVIQSVAFNPRWEWGVFARWFFDPVILEGLGQTLLLTLLGTVLSVIFGGLLALARLSSSWLLSSLAWGYIWLFRSLPLIVVLIILYNFSYLYDTLSLGIPFTGVTWASYQTINVLGQFSTAVVGLTLVQSAYTAEIIRGGFLGVDHGQYEAAAALGLPAWRRTRRIILPQALRTILPSGFNEIISLAKGTAMVYVLAMPELFYTIQMIYNRTQEVIPLLMVGAAWYLAITSVLSAIQYLVERGLARSERRSAVNSARSSRLNQPARQAQPQEAVHAQLS

SEQ ID NO: 9787 - protein, 234 aa, Klebsiella pneumoniae
ARIMSLKPRRIVLIPGFMLNEMLWHEFETYLPSNCIVHHAAVTEGRTIHDVVQHLITLLPEKFSLIGFSMGGYIARQLAAEFPERVESLVLIASSLREDTPLEAEAKRKSVQSLSPTTFKGLSRHAIARSLHPLNTSNQDMISAIQKMGCSLGFEAFITHSSLSRQGIPSATIRCPTLVIASEDDAIRSMKEAEELVEAIPYASLRIILDCGHMIPLEQPRELARIIVEWIPAT

SEQ ID NO: 9788 - protein, 196 aa, Klebsiella pneumoniae
CYVMNTIEDNLNQRISARIRIERESRGWSLNDLAERAGASRAMIHKIERGESSPTASMLGRLSGAFGISMSTLIARAEMQEGKLLRFASQPVWRDPQSHYLRRHVSPRSDLPIDLVQIELPPGSDVPMPAASYALARQLIWLQQGELVFVEGNTRHEMQAGDCLELGPPNDCRFINESAETCVYLVVRLNQSPSGS

SEQ ID NO: 9789 - protein, 303 aa, Klebsiella pneumoniae
KTVINVIVVVKPAQFSAPHFAQGIVICRELYAATEKDAMSDNIPNTLSARQAEHDPNFMLSLARGLEVLNAFTPQRQRLTISQLSQKTQISRAAVRRCLYTLAALGMVHSPDGRSYELLPRVLAVGHAYLAGTPLAKVAQTALDNLGKALGESCSAATLDGDNVLYIARAAVNNLLSIDLGRGSRLPAWATSMGRVLLSALPEEQLEVTLSRVTLIRYTPHTLCDLSGLRAEIARVRMQGYALADRQIEVGLCSLAVPVLSRHGQVVAALNVGVPAATVSAAALKEKALAPLRRAAMDLSLQL

SEQ ID NO: 9790 - protein, 80 aa, Klebsiella pneumoniae
CRSIGITALPLPFFHTRRHHPGYGPGDTLCCYRALPLFLGYFRARIAVVQPLSACEFFIFMWVIRDNSHINSHDNALFYH

SEQ ID NO: 9791 - protein, 391 aa, Klebsiella pneumoniae
ESSMRSFSLPLPTLFAGFVAVLVGYASSAAIIWQAAAAAGATPGQIAGWMTALGLAMGISTLALSAWRKVPVLTAWSTPGAALLVSGLQGVTLTEAVGIFIFANALIVICGATGLFARLMQIIPHSLAAAMLAGILLRFGLQAFAGLQDHLPLCGGMLAAWLLCKALWPRFAVVAALVIGALIAAASGDVASAAVPLAFVTPEWIAPQFTPALLLSVGLPFFLVTMASQNAPGFATLQASGYTVPVSALIVVCGGLALLLAPFGVYSICIAAITAAICQSPEAHPDPNQRWLAAIAAGGFYLLAGLFGGSITALMSALPPAWIQMLAGLALLGTIGGSLFQAVHQASERDAAVLTFLVTASGVTLAGIGSAFWGVVLGGVSYGVLSALRRP

SEQ ID NO: 9792 - protein, 60 aa, Klebsiella pneumoniae
RNTIVCAPLLHNHPPRRVIPGLAVKIMLKTDDSVAFIIVIILYYYSVRKIEVCYVHSPCH

SEQ ID NO: 9793 - protein, 214 aa, Klebsiella pneumoniae
PCLFRRQEMLVTDSLLAYTLAATLLTLTPGLDTALILRTATAEGGRKALHAALGIDLGCFIWGALVAFGLGALLAVSELAYTLLKWCGAGYLCWLGIQLLLRPRQQFNTHPAESDSTSNWFLRGMLGNVLNPKMGVFYVSFLPQFIPAGHSPVSWTFLLVAIHVLIGTLWSLTLITATRYAAGILKKPAVVKWMDRTTGCLFLLFAAKLAMSRR

SEQ ID NO: 9794 - protein, 317 aa, Klebsiella pneumoniae
DLNMHTKARKVMIIGAGNVGASAAYALLNQSICEELILVDLNQQRAEAHAQDLSDAAAYLPGMMTISTREASDCADVDIAVITVSGGALRPGQSRLDELTSTAKIVKSIVPTMMANGFNGMFLVATNPCDIITWQVWQLSGLPRSQVLGTGVWLDTTRLRRLLAQELEIGAQSIDAFILGEHGDTQFPVWSHSSVYGTPIADLYQQRTGLPLDREAMADKVRKLGFEIYAGKGCTEYGVAGTIAEICRNIFTGSHRALAVSCILDGEYGVSGAAAGVPAVLAQGGVKQIIELQLAGEEQAKFSQSIAVIKANIARLP

SEQ ID NO: 9795 - protein, 308 aa, Klebsiella pneumoniae
KDDIYAGCICVTIRKSMEKKRATTIGFAAIILWSTMVGLIRGVSEGLGAVGGAAMIYSLSGLLLIFTVGFPNLRQIPRRYLLAGSVLFVSYEICLALSLGYAASRQQAIEVGMVNYLWPSLTILFAILFNGQKSSWLVIPGLILALLGVGWVLGGEHGLQPDEIISNVISSPLSYLLAFVGAFIWAAYCTVTAKYARGKNAITLFVLLTALTLWLKFLASDQPPMLFSWPVVIKLMTVSVALGLAYAAWNVGILHGNVSLLAAASYFTPVLSSALAAILLSATLSWSFWQGAGMVCLGSLLCWYATRR

SEQ ID NO: 9796 - protein, 157 aa, Klebsiella pneumoniae
IMDISTVLNVKNIKLNITARTKEEVIEELTDLLVQDGAVTNKEDFIRDVWLREEQGSTGFENHIAIPHGKSSGVSRTALAIGRTQHTIPWETMDGSDVRCIILFAVCLVDQNATHIRLLAQVSGSLADEDIIAKLLVESDPYKIIALFNSETESTEA

SEQ ID NO: 9797 - protein, 118 aa, Klebsiella pneumoniae
RKDIAMKKLALLSAVMTLGMSSWAFAADNPPPPPEKGAQHQGKPPVKNGQHEGKQAQYNSKQPQRDGKQPQHDGKQPQHDGKQPPHNGKLPPKGSEHSGKPLPPKGSEHSGKPLPPKA

SEQ ID NO: 9798 - protein, 107 aa, Klebsiella pneumoniae
GNRMDMEATVMELIINAGESRSLAMQALQAARKGVWQDVDRLMQDAADAAKRAHDVQTMLIGMDEGCGKVPVNLILVHAQDHIMTSMLARELIAELIEVQRQLQHQN

SEQ ID NO: 9799 - protein, 156 aa, Klebsiella pneumoniae
RRRIAAILNVLIYQINCIGDIMRLLHTMLRVGDLQRSIDFYTNVLGMKLLRTSENPEYKYSLAFVGYGEESETAVIELTYNWGVDSYELGTAYGHIALSVDNAAEACERIRQNGGNVTREAGPVKGGTTVIAFVEDPDGYKIELIEEKDAGKGLGN

SEQ ID NO: 9800 - protein, 165 aa, Klebsiella pneumoniae
RTLFPGRTTNRPPVITKLHSFVTYRATAAAIVQNVWQTTRPWEIRMKEIGLPLLLLTALASPAFAADCQPNGIGGSFCINDDGTTTDTVPNEVNGMDTYSNNGGYTSSLPDRSGADEALEGSSLSTQQGVGSGQSDSALAGRDWHSPANLNDGAATSSMSLLDKP

SEQ ID NO: 9801 - protein, 190 aa, Klebsiella pneumoniae
GLSMKEKGTLLVVGSLLALSLATVTTARAAGTLNFTGKIINESCQIANNGGDVNVDFGNVDMSALKSHEAKTAETPFTINLTGCPLAQNISISLEGTPDTNANGTSAAVLALSDAADTAKGVGIEVFSSPDGSTEGTQLTFDKQSKTAVSQADENGDIAFNFIADLKSDSSQDVTAGNINATANIDIVYE

SEQ ID NO: 9802 - protein, 267 aa, Klebsiella pneumoniae
GQGMQEIQFYLVDAFSDKNFGGNAAAVCPLSEWLADDVLLKMAQQHNQSETAFFVRTDEGYELRWFTTLAEINLCGHATLAAAHVIFEYLDHPSATILFSTRFVGELRVTRNGDWLTLDFPAWSTSPVENPPADLLAGLGLESAVEVREGRDYLVVLADRQQVEAVRPDMARLRTLGKMICVSAPDEEYDFVSRFFCPGEGVPEDPVTGSAHSMLIPWWGEKLGKTTMMARQVSARGGDLRCQWQGDRVLISGQATTYMRGTVYLRG

SEQ ID NO: 9803 - protein, 142 aa, Klebsiella pneumoniae
LAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 9804 - protein, 340 aa, Klebsiella pneumoniae
IDIINKMNKTQTPRQVLNLPAGYFGMVLGTIGMGFAWRYASTLWPVSRSIGDGLVTLAMAMWVLLSMAFISRAIRFPASVLREMRHPVSSSFVSLFPATTLLVAIGLATWCRPLAIGLFVPGVALQLAYAAWQSGGLWRGNHPREATTPGLYLPTVANNFISAMACGALGFSDAGLVFLGAGVFSWLSLEPAILQRLRSAGELPTPLRTSLGIQLAPALVACSAWLSVNGGEADTFAKLLFGYGLLQLLFMLRLMPWYLRQPFNASFWSFSFGISALATTGLHLGQARGDGFFHHLAMPLFIFSNLVVGLLLLRTALLLVSGKLLLQVDRETLLNKKEGS

SEQ ID NO: 9805 - protein, 426 aa, Klebsiella pneumoniae
QGIMVMKFSELAPRERHNFVYFLLFFFFYYFIMSAYFPFFPVWLADVNHLTKTETGIVFSSISLFAIIFQPVFGLMSDKLGLRKHLLWTITVLLILFAPFFIFVFSPLLQMNIIAGSLVGGIYLGIVFSSGSGAVEAYIERVSRANRFEYGKVRVAGCVGWALCASITGVLFGIDPNITFWIASGFALVLGLLLWLSRPESSNSAQVIEALGANRQAFSLRTAAELLRMPRFWGFIVYVVGVASVYDVFDQQFANFFKSFFASPQRGTEVFGFVTTGGELLNALIMFCAPAIVNRIGAKNALLTAGMIMSVRILGSSFASSAVEVVILKMLHMFEIPFLLVGTFKYISSAFNPRLSATLFLIGFNLSKQLSGVVLSAWVGRMYDTVGFHQAYLILGCITLSFTLLSFVTLRGGNRLLPTAETQSPA

SEQ ID NO: 9806 - protein, 64 aa, Klebsiella pneumoniae
VLVIPAGCKFGVIAVILIFAIAMLKYSTSSPASFILYIFSVADLNVRPSQRALNSKGVVLSNSF

SEQ ID NO: 9807 - protein, 375 aa, Klebsiella pneumoniae
NIVMNICCANAKAIADKNSSLNLTEMPAMNPTSKKNILVLAALGAAALAAASYGAYWWHTGRFMQTTDDAYVGGDISAISSKVSGYIQQLAVQDNMAVKKGDLLIRIDDRDYRAALAKAAGEVAAQQAALADIQATRQLQQATIAGSAASLLAATAATEKLANDNRRYNALAASSAISAQIRDNASADYRRAHAEQEKAKADKTVAERQLAVLDARQQQILAALAQAQANLEMARLNLSYTDIRAPFDGVIGNRRAWSGSFVSSGTQLLSLVPAHGLWIDANFKENQLAHMRAGQPVTIVADVLPNHTFKGHVASLAPATGSRFSILPAENATGNFTKIVQRVPVRIALEGDGAKLDVLRPGLSVIVTVNEKSPR

SEQ ID NO: 9808 - protein, 327 aa, Klebsiella pneumoniae
MRSIVRISLFDRIPETRDAEFHKTCRSGGVMDRVIAAQVYLRICELGSLSAAARALGMSRPMVSRYLEQMESWAGARLIHRSTRRLTLTPAGEKVLLKTRGLTRIADEIAGERQRADPSGTLRVACAHFTAMQLISPLLPDFLARYPLLRLELDINNHPVSLIGERIDVAIRITDNPEAGAIARRLGVCRSLLCAAPGWMRQHGPLTTPDDLQRHNCLLYSHFASQHWQFSDAQGREASVAVNGNLSAGISSLLLEAAVAGCGIAMLPELEARGAIASGTLEVVLPEWTPKALSVYGIYLSRDYQPDGLPLFLDALQRRLGEETGHG

SEQ ID NO: 9809 - protein, 366 aa, Klebsiella pneumoniae
GVPMTLSQDILAELAEIAPGSPLDQARAVRDAATRHAQGSYEVLFRQQDADFPLDERFAVAAKVAKLHQADALAAHYAGFGLADPTTDRLVPALAFARLLTFTPVEATPGALHTLTGAGWSLRGIVTLAQLVAFVSFQSRLLLGLRALNHKPIVSADTPLVAGYWHTTPYAQSGKAAPVRFTRDELHWEPWLADKPLAEFNAEEQAILAKYGHSDSPYFRLLARNQPVLEQRTLTDKGIFYTAGGLPRAERELAATVASKINGCIYCASVHARKAAQLAKDETAVDTLLAVTPGEDLRDGQSPRWQAEIDAAAALSVTPPALNADHLAALDEQGLDTLAQLDLLQSAAFFAWANRLMLTLGEPWRE

SEQ ID NO: 9810 - protein, 487 aa, Klebsiella pneumoniae
REPIVKTLNRRDFPGAQYPDRIIQFGEGNFLRAFVDWQIDLLNEHTDLNAGIVVVRPIATDFPPSLNTQDGLYTTIIRGLNEQGEAVSDARLIRSVNREISAYADFDAFLRLAHNPEMRFVFSNTTEAGISYHAGDRFDDAPPVSYPAKLTRLLFERYQHFAGAADKGWVIIPCELIDYNGEALQALVLRYASEWELPQAFITWLTSANTFCSTLVDRIVTGYPRDEVAALEAQTGYKDAFLDTAEHFYLFVIQGPASLAAELRLDKLPLNVRIVDDIKPYKERKVAILNGAHTALVPVAFQAGIDTVGEAMNDAEICAFVEKAIYDEIIPVLDLPRDELVSFASAVTGRFRNPYIKHQLLSIALNGMTKYRTRILPQLLAGQKAHGALPPRLTFALAALIAFYRGERDGESYPVQDDADWISRYQTLWARHRDGQMSTRELVTAVLSVADHWQQDLSQIPGLVELVTADLDAILTCGMRDAVKPLC

SEQ ID NO: 9811 - protein, 493 aa, Klebsiella pneumoniae
VTAMSTLNPILAGSAQSVESYHQVIEQTSQAVVQWLKQPEMYQGKSVDELRERISLEFNEQGLGNQAAIDRAIEYFLKDSLSVHHPQCVAHLHCPSLVISQAAEVLINATNQSMDSWDQSPSATIIEMKLIEWLRARVGFPAGDAGVFTSGGTQSNLMGLMLARDAFFARQGHSIQQDGLPGDIRKYKVLCSENAHFSVQKNMALMGLGYRSVTLVKTDEFARMDVSDLQAKIAQAQANGEQIMAIVATAGTTDAGAIDPLRDIAGIAAEHQIWLHVDAAWGGALLLSEQYRDYLDGLELVDSVTLDFHKQFFQTISCGAFLLKDARHYELMRYQAAYLNSEFDEEHGVPNLVSKSLQTTRRFDALKLWMGLEALGQKQYAAIIDHGVTMAKNVAEYVKSQPTLELVMQPQLASVLFRSRPAQMAGSDAAAIALLNQRVGDALLASGRANVGVTEHNGVTCLKLTLLNPVVTLDDVKVLLNLVERTAQELLAQ

SEQ ID NO: 9812 - protein, 329 aa, Klebsiella pneumoniae
GSAMRKYRLSEQTRQYCYEEEHGKQSVTLRQIVALIDFADVKAGSEGGWVDEECALSQQGECWIYDVNSVVFAGARIRDDARLTGFCVVSHEATIGGRACIHASQISHHAQISDNVTVMQSQVRGYCRLADEARLLPHCQVIAARGLTADRDKVLQIYQRATVSASRILHQAQIYGDAFVEHAFVEHRAEVFDQARLEGNEENDVWVCDNARVYGHARLIAGRGEDAIPTVRYSSQVAENAVIEGNCLLKHRAMVGGEAQLRGGPILLDDDVLIQGRTVITGDVIVEHQVSINDEVQIAAQEGEAIHLRGPKTLAGQQHITRTPLLGAL

SEQ ID NO: 9813 - protein, 688 aa, Klebsiella pneumoniae
GDYMATGNAPRGFPRILQWLLAGLMLIIGLAVGILGAKLALVGGTLYFALMGVVMVIAAVLIFRNRRGGILLYAVAFIASVIWAISDAGWNYWPLFSRLFALGVLAFLAALVWPFLASPPAKKGPAYGVAAVLAVALAVSFGWMFKSAPLVSATEAVPVKPVAPGEQQKNWAHWGNTTHGDRFAALDQINKQNVNQLQVAWVAHTGDIPQSNGSGAEDQNTPLQIGDTLYVCTPYSKVLALDVDSGKEKWRYDSKSSSPNWQRCRGLGYYADSQAQTAPASGTQPAACSRRLFLPTIDARLIAIDADTGKLCENFGDGGIVDLSVGMGEVKAGYYQQTSTPLVAGNVVVVGGRVADNYSTGEPPGVVRAFDVHTGKLAWAWDPGNPALTGVPPEGQTYTRGTPNVWSAMSYDAKLNLIYLPTGNATPDFFGGERTALDDKYSSSIVAVDATTGQVRWHFQTTHHDLWDFDLPSQPLLYDLPDGKGGTTPVLVQTSKQGMIFMLNRETGEPVAKVEERPVPAGNVKGERYSPTQPYSVGMPMIGNQTLTESDMWGATPIDLLLCRIQFKEMRHQGVFTPPGEDRSLQFPGSLGGMNWGSVSLDPNNSLMFVNDMRLGLANYMVPRAKVAKDASGIEMGIVPMEGTPFGAMRERFLSPLGIPCQKPPFGTMSAVDLKTGKLVWQVPVGTV

SEQ ID NO: 9814 - protein, 265 aa, Klebsiella pneumoniae
RVNIMKKLLIALAGAACLLSSVSAAQADQLQDIEKRGVIRIAVPQDFPPFGSVGTDLQPQGYDIDMARYLAKSMKLKLQLVPVTSANRVPYLQTDKVDLVISSLGKNAEREKVIDFSRAYAPFFLGVFGPKGAELKDAAALSGKSIGVTRGAVEDMVLTSVAPQAAQIKRYEDNNTTLSAYLSGQVQYVATGNLVVAAISRQNADKAPVPSFMLKDSPCFIGLKKNEPALKAKVDTLIEQGIKDGTLNGLSEKWLKAPLPASLGA

SEQ ID NO: 9815 - protein, 149 aa, Klebsiella pneumoniae
GRNMTSQSAERIGGWLLAPLAWLLVALLSASLSLLFFANALMSPQTYTILRAMSAGHMALWVASLLFALAMWYYTLWLTIAFFKRRSVVPKHYIIWLLITLLLAIKAFAFSPVSDVLALRQLLFPLLAAALLAPYFRRSQRVKRTFVNP

SEQ ID NO: 9816 - protein, 175 aa, Klebsiella pneumoniae
LLNMRILTVVDYDEMWPTLFENERTLLQMTLGKVISRIHHIGSTSVPGLSAKPVIDILIEVANLEELDTLNQAMEGVGYTVRGENGILNRRYFTKGGNQRSHHIHAFTTGDAQIIKHLAFRDYLIKHNDVAIQYALMKKSAMLLCENDSHRYSIYKADFIQKHLRMALIDAGHLG

SEQ ID NO: 9817 - protein, 501 aa, Klebsiella pneumoniae
PSDIFILIFHESLRLRNILSACPYYAQERKLALATHRRCRCLLCGILPMPEHVHHIVKRLILYICICLLAGIGISGMTAFFHTSFSSTSSILFPLLTSFLMVFHITIACFMGMKYWSSKRRLYLTPVSFGFACSALLMLGTLSSYPDWLTCNPAPVVNQNDAVIYYFFRNIMMAVLFMSSIILYYFRQRIMHSWKAHVLTFTACILFTLTIIVLSWLYSSHSPWLSVNFIDDLSHTFTPLWQSIIGWLLMAVWFITLILLISLSKLRNIFWFSGAFFCSAYLFTLFQLLSTAGELDQTWYQARFFETLCTLFLILVLLVDVFILYRESNHKYVHSYQNSIRDPLTRLYNRSFFYDTLNQQLAKVNAQHPLSVLISDLDHFKRINDSYGHVAGDKVIQFAASVLESHSRVDDAAARIGGEEFALLLVNTGEKEAQAIAERIRLAVSAGESHLPERMTISMGVYTTHDNSVTAEACVQRADEAMYEAKNNGRNQVIVWHRQGG

SEQ ID NO: 9818 - protein, 370 aa, Klebsiella pneumoniae
GDSMQRQQAPFRADIVGSFLRPDSIKQARQQLAEGIIDAAQLREIENNAIRHLVQQQCDCGLHVVTDGEFRRAWWHFDFFDGLQGVERYDAEQGIQFNGVQTKAHGVRVTGKLAFGDHPMLEDFRYLKSISGDAQPKMTIPSPSVLHFRGGRKDIDATVYPDLSDYFDDLATTWRDAIRAFYDAGCRYLQLDDTVWAYLCSDAQRQQVRERGEDPDALARIYARVLNQALEGKPADLTVGLHVCRGNFRSTWISEGGYEPVAEVLFGGVNVDAFFLEYDNDRSGDFAPLRFIRPGHQQVVLGLITTKNGELENPQGVKARLAEAAQYVPLEQICLSPQCGFASTEEGNALSEDQQWQKVRLVTSIAADVW

SEQ ID NO: 9819 - protein, 98 aa, Klebsiella pneumoniae
AHFLMRNGRIVMHSSKDPLHGVTLEALLNALVARYGWAEMARQVNINCFKSDPSIKSSLKFLRRTPWARKEVEAMYLASLDDDAPVEKADPWANWQKK

SEQ ID NO: 9820 - protein, 180 aa, Klebsiella pneumoniae
MLLMQRITKLDNDLTCKGMLMKLWNKTLLASALCLTLFGCDDASKVDNKLDKAKDNAEQMKDAAADKAQAIKQDADKQIDTLKSQADAEADRLKDQASAIKAEADKKADAIAQQAKAQADAVKQNAKQESDRIVKEAGQIKDNAIGDANQLSAEAASKTKAIQDSIAKDKQNAAPPAAQQ

SEQ ID NO: 9821 - protein, 426 aa, Klebsiella pneumoniae
LNIINLRFYRLQGRTMNDGNNRVLVLADDFTGANDAGVSLAEAGMSVEVAFTAGQPSTARALILNSDSRAMTAAAAADKVAALLRGAATFVPHWQVKKIDSTLRGNPGGELEAMMAAQGCRMAVVAPAYPAAGRHTRDGRCYVHGVPLDQTEFASDPKTPVSRAEISEIIAMQSRLPCLTLNAGQLPAALATAGEEKRVLIVDAWEDSHLDQVIDAVAPHARETLLVGSAGLCEALARRLRRSEQGPLLAVVGSMSEMAQRQVAALQVHSRVRVIEIDVEQAFSGSPKEEASRIAGALREGQHCVVTTRPNHAVRQGIEARCRERGLSRAAYGEHICAWLADVTAQAVAQSSPGALYLSGGDVAIAVAHALGATGFQIRGRVAECVPYGHFLGGRWSRPVMTKAGGFGTDTTLLHVVNFIEEKLSV

SEQ ID NO: 9822 - protein, 435 aa, Klebsiella pneumoniae
KLIISRTVYMSSHTNIVQEKALQLMQSIGQNTYLKSIMSGMMLILPVTIMSSVATLVKVFPFAPYQDFLLRHNLTRFFDIPITFTNNFLAVIVAFSVAYTLAKNFDVDGFMSGLISMISFFILTPYDLGEIGPLGQSFSIPGQWLGPMGLFTAILVAIISTRIFVAITRKGLIIKMPENVPEFISKSFSSLIPGIAILTLFTIISAVITSVGYGSIHEIIYKLIQVPLTSLGSGIWSLIFVAVVAQLLWFFGLHGHAITLGIVAPIWFAMDAQQLAAYAAGVDLPNITGFAFFMTYGAAGDLLPLAIMLAFFAKSARYKTLGKIALPPAIFTIGEPMAYGVPLVMNFTLAIPYIFINGIMLGIAWYLTVIGVLPRVAGVSTPAGMPIIISGFMQGSWKIAAFQFIGLFARFAGWYFFFKTADLVACREENQTDTI

SEQ ID NO: 9823 - protein, 182 aa, Klebsiella pneumoniae
TRIIAFTGPKDSSRHSRISRVTPSSRVGLIWVSLALPPVSRRAPFANASSMSALQRAMVFISTTGPVRAAGRAAARLASSGINASATALSTIMRSVDMQICPALAKAPKTAPAAACSISASSSTSRGAFPPSSSTAGFRYCPQVRAIMRPTGVEPVKLTRRTAGWAISDSTSAGASSGAQVR

SEQ ID NO: 9824 - protein, 483 aa, Klebsiella pneumoniae
YMIMGRYRTGTAAMKKYQQLAQQLTEQIALGVWLPGDRLPSLREQVISSGMSFMTVSHAYQLLESQGRIVARPQSGYYVAPQPVKLRQPAPPAQVTRDEAVDINTYIFEVLQASRQASMLPFASAFPDPRLFPLQQLNRSLAQVSKTATAMSVIENLPPGNAELRHAIARRYALQGMNVSPDEIVITAGALEALNLSLQAVTEPGDWVVVENPCFYGALQALERLRLKALSVATDVREGIDLTALEAALQNYPVKACWLMTNGQNPLGFTLSAEKKAALVALLTRYNVMLIEDDVYSELYFGREKPLPAKFWDRQEMTLHCSSFSKCLVPGFRIGWVAAGKQARRIQQLQLMSTLSTSSPMQLALVDYLSTKRYDAHLRRLRRQLAERKQQAWQALLRHLPPEVIVHHSDSGYFLWIELPEGADASALSARALASHISIAPGKMFSTSDSWTSFFRFNTAWGWGEREEQGVKRLGELIREQLA

SEQ ID NO: 9825 - protein, 91 aa, Klebsiella pneumoniae
MSVMIETITVSLGRKATLCPPWPMPLRLPGNPVGDAHSVIKSDYPFWHCCYAVEIKLLLKAASLLLVKLRAKSPSEGFTGRITDYTWRARA

SEQ ID NO: 9826 - protein, 122 aa, Klebsiella pneumoniae
FISIPVRSLKCILQRDYFSRVNTTLVLRLGYLFSRPASLWGWLMCNAFNGIAIVLCFRGISSVTGFSEAIWQVIITLAIIISTWYNANYFAALEARRDKRRYLLLAWVVMTILLNFIHLGGG

SEQ ID NO: 9827 - protein, 392 aa, Klebsiella pneumoniae
IQSITTKEKRVATIHSTIISGAGASSALLPLLAGKTSILLVTDKNVGALEATQAIHRLLAAEGREVEVIDSVPAEPNHHDVTQIVSQLGASQPQMVVGIGGGSVLDVAKLLSVLLHPEAPSLTSLLAGEQPQRRICSLLIPATAGTGSEATPNAILAIPEQQTKVGIISPVLLPDYVALLPELTTSMPPSIAASTGIDALCHLLECFTSTVANPVSDNAALIGLHKLVRHIERSVNQPQDLTAKLEMLWASWYGGAAINYAGTHLVHALSYPLGGTWHLPHGVANAILLAPCMRVVRPHAVAKFAQVWDLIPDADRTLSAEEKSHALVAWLAALVKRLPLPDNLAALGVPQESISALSAAAQNVKRLMNNAPCSVSREEIAAIYQTLYPEHA

SEQ ID NO: 9828 - protein, 235 aa, Klebsiella pneumoniae
GAPMLQVSQLHQYYGGSHILRGVDFSARQGEVTCLLGRNGVGKTTLLKCLMGLIPARSGEVRWQDQNITHRKPHQRVQAGVAYVPQGREIFPRLTVEENLLMGLSRFPAREAQQVPEEIYQLFPVLRTMKQRRGGDLSGGQQQQLAIGRALASRPQLLILDEPTEGIQPSVIKEIGEVIRQLASRGDMAILLVEQFYDFAAGLADHYLVMSRGAIVQQGKGGDMESDGVRAMVTI

SEQ ID NO: 9829 - protein, 259 aa, Klebsiella pneumoniae
PGTIAGEIMATLQWDHAVQFVNQPEAAIEIFAGQQLRAVAGGRHPGWGTRNALSYFGLTYIEFLAIADPDELRAATDKFLLSRDAARLLPENEALFRVALRSDDIDATHDQLRHTGVTVSPIVDGQRNDPQGNIIRWRIFTIDGDTAGLVYPFVLQWGEDDATRLTRLRAQRLDAPHPLGDIALEQAVFEVVNPQAVRDRWQALLGFPPLGEQGLDVGGQQFIFREGAANQLTELVFRVANPALKGQRFRVGNGVYRFT

SEQ ID NO: 9830 - protein, 93 aa, Klebsiella pneumoniae
RTTISDLPGFNMQISDTGRSHTPDFHAVLAREELAENQSMAHLNRLPAAIPFSPAGAMSLPPAITYLHPAAVNWTASGSSLTPAARLPSMHSG

SEQ ID NO: 9831 - protein, 234 aa, Klebsiella pneumoniae
MKAIKNKGQDKTMNETTHRFARLVDLSAVQATSTEADVRACAELAARYNIISVHVLPCWTRFLSTLLPQQGTGEVMIGGPVGFPGGGHTTDTKVQEVRQLIADGAREVDMVVNIGKVLSGDYDYVREDLRRVVEAAAPVPAKVILETHYLNEEQIRRVCEIAVEVGMKWVKTSTGWAPTGATVEKVSIIADQLKGPNRYQRRRGHSRSVHGACAVPAWRAPLWHEPWRGNQGAG

SEQ ID NO: 9832 - protein, 161 aa, Klebsiella pneumoniae
TAAICKSPLSLRSCALCMSLSTASGACVRGYNMRELINTIAHIGYQVSDLTRSLAFYEPLGFQRQQRFSKPSPQGTIEVAFLEMAGAVLELYQLPAGTPFDAPRCGIDHLALEVSDLDAVQQRLAALGYPLDEGPIEEDNVRFLLIRGPDGERLEFDACKR

SEQ ID NO: 9833 - protein, 74 aa, Klebsiella pneumoniae
GNKMKLTPVFIKRCHLVAAVMWVGLAIPSLIWWKDSVLWVILISIYANIVGHLSGYSAARADQAAEESEDSTSK

SEQ ID NO: 9834 - protein, 260 aa, Klebsiella pneumoniae
GDKMRFTDKVVVITGAAQGIGRQTAEQAAAEGAALLLIDRSSYVHELAATLAQSGCLVLALEADLEAWESTEQAFAAGVAHFGRIDVLINNVGGTIWARPFAEYQPEQIEKEIRRSLFPTLWGCRAALPWMLKQGKGSIVNISSVATAGVNRVPYSAAKGGVNALTRSIAMEYSGSGIRINAVAPGGTEAPPRLTPRNEEQPSEQEKAWYQQVVDQTVASSLLHRYGTLAEQANAILFLASDEASYITGVTLPVAGGDLG

SEQ ID NO: 9835 - protein, 117 aa, Klebsiella pneumoniae
PEKMLNISPLVGLFCMVLAIHATKCQGHPALDCIRCIYESLRYISMGIVKISDLLHDDIRDASKAMSRSVNAQAEYWIRLGMMSELYPELNHQQIKLLMLKSGSDRLLEVINAINNH

SEQ ID NO: 9836 - protein, 338 aa, Klebsiella pneumoniae
ACEMSYRISILDKSPLAAGETAAQALARTLTLAQHAEAWGYHRFWVAEHHNTDQLASPSPELVIAWLLGHTRRIRLGSGGVMLQHYSPYKVAENFNLLAALAPGRIDLGVGKAPGGLPLSTRALQQGLHQEEKGTFADQLAQLDNWLSLTEPGGEESLRATPIPPRRADGFLLGASLESAELAARLDWNFVFAAHLNGDSALRRAVFNRWRELSPREAMVAVQVVVADDPATAAALAQQVEVWGVELENGQRVTVGSEAQAVAFARQAGSRPTRIARRESSLISGTPEQVKTRLDALQAEEQLDELIIDTPISDGPARLHSLRLLAQAHYGKEVLNVL

SEQ ID NO: 9837 - protein, 146 aa, Klebsiella pneumoniae
PPPLMPRCSVSRQGPMGNRPVPPRWHSTPVFYETLMLVRPQTPGPLRFAAFASGCSYRALGERWLAEQQAAVEVHEVNSYHSMLACVASGRYACLLPQSVLSLMTLPENCLSEPLCEATTQLIWRSGLSAPALSEWRKLLQSVAIG

SEQ ID NO: 9838 - protein, 405 aa, Klebsiella pneumoniae
CWGIWLPMSPPAWRSLTACRPLSGHNGCQSWRAAIIAICWTSGSAAITRTAGAPGTPARSLQEALSAQYPVSIVAIPGPRQHIQARITLRDGAPLTLDLWPNLPAIARWLPVVLIAQFVLLLACAWYAVRQVLLPISRFTHAVNALEPASDTAGTMAEQGPEEVRRAARAFNAMQARIHDHLQERARILAAISHDLQTPITRMKLRVEMADQPELRDKLLQDLDNMTRLVREGIAFARTSQPLEEARQRLNLDAFLDTIVCDYADVGRPVQFCPEETAGVVWIPPQALRRVMTNLIDNALKFGTTATVTLTRDAVGDITLHVLDEGPGIPEASLQAVLQPFYRLEDSRNRDTGGTGLGLAIAAQLVSQMDGALRLANRPQGGLDASVRLAAAGLYPVVSPGKTDN

SEQ ID NO: 9839 - protein, 218 aa, Klebsiella pneumoniae
ENLMSENAQLNGLCGRFRGFYPVVIDVETAGFNAKTDALLEIAAITLKMDEHGWLMPDETLHFHVEPFEGANLQPEALAFNGINPHDPQRGAVSEYDALHAIFKMVRKGMKESDCSRAIMVAHNATFDHSFTMTAAERAGLKRNPFHPFVTFDTAALSGLALGQTVLSKACIAAGMPFDGAQAHSALYDTEQTAQLFCEIVNRWKRLGGWPLPVATPE

SEQ ID NO: 9840 - protein, 61 aa, Klebsiella pneumoniae
LWMIIRLYNKQLVHSFFISAKFLCICDPDHARNFMLIECYWNGNKCQAIQRMSKDCQDNDP

SEQ ID NO: 9841 - protein, 704 aa, Klebsiella pneumoniae
VLSMKILSVRHAALPALLLPLIAAAQAADEQTMVVTAAPTTVSELDTPAAVSVVNGDEMRQAAPRVNLSESLGAVPGLQVQNRQNYAQDLQLSIRGFGSRSTYGVRGLRIYVDGIPATMPDGQGQTSNIDIGSVDTIEVLRGPFSALYGNSSGGVINVTSQTGTQPPTVEASSYYGSFGTWHYGMKATGAVGDGSHAGDVDYTVSTNRFTTHGYRDHSGARKNLANARLGVRINDVSKLTLLLNSVDIKANDAGGLTADEWRDNPRQSPRGDQYNTRKNTRQTQAGLRYERQLSAQDDLSVMMYAGERETTQFQSIPRAPQLKPSHAGGVIDLTRHYQGIDTRLTHRGELLVPVTLTAGLDYENMSERRKGYENFVMVNGAPQYGEQGALRRNERNLMWNVDPYLQTQWQLTDKLSLDAGVRYSSVWFDSNDYYITPGNGDDSGDASYHKWLPAGSLKYALTDAWNVYLSAGRGFETPTINELSYRSDNQSGLNFGLKPSTNDTVEIGSKTRIGNGLFTAALFQTNTDNEIVVDSSSGGRTSYKNAGKTRRQGMELGLDQQFGESWRLKAAWTWLDATYRTNVCDDASCNGNRIPGIARNMGYASFGYQPEQGWYAGSDIRYMSDIMANDENTAKAPSWTVVGLTTGYKWSYGRMDMDLFGRIDNLFDREYVGSVIVNESNGRYYEPAPGRNYGIGMNLAWRFE

SEQ ID NO: 9842 - protein, 93 aa, Klebsiella pneumoniae
SGAMDDNRLPTVKIPIRKISALRRARCDNSSVISGAPTMTPMAYALISIPATGIETSTPFAITGSNPIGENSVVPMPKAPIASASKGKLIFIQ

SEQ ID NO: 9843 - protein, 250 aa, Klebsiella pneumoniae
TRAIAAATAALRGSSLAAADARSCCVACCSALRALARAMAASTAALRGSTGSTAGASTGAACCSALRALARAIAASTAALRGSTGSTAGASTGAACCSALRALARAIAASTAALRGSTGSAAGASTGAACCSALRALARAIAASTAALRGSTGSAAGASIGAACCSALRALARAIAASTAALRGSTGSAAGASTGAACCCALRARASALRASRAAIASLLSGLAPAWITIGCAASRCLSRTRARAALIAS

SEQ ID NO: 9844 - protein, 84 aa, Klebsiella pneumoniae
GRQMSNDIPLKFYDIVDEYETEAAAPVKDEERDALARYFQLLIARLTNNEEIDEEAQREMAREAAINEDRIDDIANFLNQWGNE

SEQ ID NO: 9845 - protein, 328 aa, Klebsiella pneumoniae
VSKMIAVTMGDPAGIGPEIIIKSLAEGALSGAPVVVVGCAQTLRRILALNITPRAELRIIDHPAEASFSPATINVIDEPLSDPQGLRPGEVQAQAGDLAFRCIRRATALALEGAVAAIATAPLNKEALHLAGHAYPGHTELLAHLTQTTDYAMVLYTEKLKVIHITTHISLRQFLDTLNQPRIETVIGVADRFLRRVGYPRPRIAVAGVNPHAGENGLFGDEEIRIVAPAVAAMRAKGVEVTGPCPPDTVFMQCHEGMYDMVVAMYHDQGHIPLKLLGFYDGVNITAGLPFIRTSADHGTAFDIAWTGKAKSESMATSIELAMHIAQE

SEQ ID NO: 9846 - protein, 251 aa, Klebsiella pneumoniae
SSKILQELNLMRVHFIVHESFEAPGAYETWAINQGHDVTYSRVYAGDRLPDDAVGIDFLVVMGGPQDPDTTLEACPHFNAKAEQALIASAVKTGKAVIGICLGSQLIGEALGAPFSHSPEKEIGKFPITLTEDGRKDEMFSHFGKTLEVGHWHNDMPGLTPEAKIIAYSEGCPRQIVAYSDRVFGFQCHMELTLDVVERLIAHSEKDLSRAAEYRFVDTPEALRAHDYSEMNQVLFGFLDKLEARYKAAQA

SEQ ID NO: 9847 - protein, 357 aa, Klebsiella pneumoniae
  UNSURE (248),(249),(250),(251),(252),(253),(254),(255),(256),(257),(258): Identity of amino acid at the above locations are unknown.
GEKMPRRTATLEDVARAAGVSQQTVSRVLNRPEVVSARTREQVIRAMQALHYVPNRSAQLLAGKAAPSIGLITASLTLHAPSQIAAAIKSHASLHQLEVAIAMPAQADFIALQARLDELRAQHIRGVIVSLPLESATAERLVQDNPDMACLFLDVSPEADVCCVRFDHRDGCGACVRHLWELGHREFGLLAGPESSVSARLRLASWREALHSLNIARSTTVFGDWSAASGWQKTFELLHLQPRISAIXXXXXXXXXXXLSALAQLNRSGSQAVSVTGYDDTADSLYFQPPLTTVAQDFDLLGKRAVERLIALMAAPQLRIRELLPTRLIVRQSAWPVAAAEDRQQTLAQLKALVEKL

SEQ ID NO: 9848 - protein, 67 aa, Klebsiella pneumoniae
GEWMDFLKRWLKEEFILFLWGWGIVLLIIIFSMIAVSLFPDIAINLIGLFVLLIIGFHVVVWFKVKN

SEQ ID NO: 9849 - protein, 169 aa, Klebsiella pneumoniae
GVRMIALSQFNSLSKDEAAGLLAPCVAIPAWGEMLVSLRPFASRHALLQAAREAMANWGEDELNAALSAHPRIGEKPTGSQAHAALSRQEQSSVDSENERLAQALREGNARYEARFGRVFLIRAKGRSGEEMLQALTRRLQHTADEEVAEALAQLREITMLRLEGVIGE

SEQ ID NO: 9850 - protein, 217 aa, Klebsiella pneumoniae
NNRMIEPMLRYELTPNNAGFILWGDSEALNELHELIHYIVDESPLIKVKDGFMLSLAYDIRKAREGNRRVEQHQYDQHDTYKLYGVELLWPLVLVQSSILRNSMGYIQTDKNQLSVMYAFEYLIESALTESERTTSNDIMLTVKYASDSDFNFIEDNIDSRCCYFISLSPEQRKKQLISIVRSFHSLWGKYAREKQDIKMLNEMNNTSWVWPDNINW

SEQ ID NO: 9851 - protein, 202 aa, Klebsiella pneumoniae
EGRIMTKRDADYFSQKYSLTRTHSEVLHAATIVPPGRALDLGCGKGRNSLYLAANGFAVTAWDKNPMSLNNLESIRAAERLDNLQTAVKDLNSLSFDGEYDLILSTVVMMFLEPDTIPGLIANMQRCTAAGGYNLIVAAMDTEDYPCTVGFPFAFKPDELRDYYQGWELLKYNEDVGELHRTDANGNRIKLRFATLLARKPA

SEQ ID NO: 9852 - protein, 224 aa, Klebsiella pneumoniae
GLGMTEQLHFSELWPHWPELLAGLWVTVQLTVLATIGGLAIGILGAAIRSGRPGMLSRVWGGYVEIIRNTPFVVQLFFIVFGLPNLGLKMTAGEAALLAMVVNLGAYSTEIVRAGIQVTPKGQWEAGRVLGLSRTQTFVRVVLPPALQRIYPALVSQCIIVMLGSSVVSQVSYEELTFAANLIQSRTFLSFEVYLVTTGIYLALSIAMRQLLMAAGRKWLGVQA

SEQ ID NO: 9853 - protein, 470 aa, Klebsiella pneumoniae
PMHFSLLRDITMSDEHHSGLLYGLEQRIPPLPAFFSALQHVLAGLVGIITPPLIIGATLGLGDWLPYLISMSLLASGIGTFLQSNRVWGIGAGMICMQGTSFAFLGVTVAGGMWVKAQGGGPQDMMAMLFGVNFVAALVPVIVSRFIEPLKKIFTPIITGSVIALIGISLIKVSVINWCGGEKAEDFASMSNIALGAGTLGVIVLLSCAKNRWLRLSSVVVGIAVGCIAAGLSGQFHLHSLGDTLFRLPTLFPFGFQFNSAIFLPVALVSLVCILEAVGDLTANSLISQQSVDDRAFRNRLKGGILADGVSCMVAAMLCAFPNTTFAQNNGVIQMTGVASRYVGRYIGVILILLGLFPPVGELLRQIPAPVLGGATMVMFGCVVAAGIRIITQTPLTRRDVLIVGLAFGAGLGVESVPAFLSHFPPMVGDLFGSAATSGGLVAIALNLILPQEQAATKSLRSQDDRAESV

SEQ ID NO: 9854 - protein, 473 aa, Klebsiella pneumoniae
INFVVESCMFGLDAFHLARVQFAFTVSFHIIFPAITIGLASYLAVLEGLWLKTKNPVWRSLYHFWSKIFAVNFGMGVVSGLVMAYQFGTNWSGFSQFAGSITGPLLTYEVLTAFFLEAGFLGVMLFGWNRVGPGLHFFATCMVALGTIISTFWILASNSWMQTPQGFEIVDGQVVPVDWLAVIFNPSFPYRLLHMTVAAFLSSALFVGASAAWHLLRGNQSPAIRKMFSMALWMTLLVAPVQALIGDMHGLNTLKHQPAKIAAIEGHWENPPGEPTPLLLFGWPDMDQERTRYGLEIPALGSLILTHSLDKQVPALKEFAPEERPNSTVVFWSFRLMAGLGMLMLLLGVLALWLRRGDRLYHSRPFLRFALWMGPSGLIAILAGWVTTEVGRQPWVVYGVQRTADAVSAHGDLHMSVSLLTFIVVYSAVFGVGYSYMLRLIRKGPQEMLPATTGTPARPLSAATEGYLQKESR

SEQ ID NO: 9855 - protein, 337 aa, Klebsiella pneumoniae
TNSVKKITFQDMKKILIIVPDGGMLFESAGIADILMQANRLHPEGAREICYQVKLATTQPHQVIHGQSGLNLLADHRLHEIDPREPLDTIMITGRGQNPQEGMAVVDWLRLAAPHARRIVSICGGAMLLAQTGLLDGRRATTHWKLLETMQAEFPQIRVEGGPLYIQDEHIWTSGGVSSGFDLTLALVEEDYGFSLARDIAQDFVMYLRRPGGQLQFSRYNLQQTATQGPINDLLAWLLENLTADLSVDKLAEKVAMSPRNFTRVFTRETGASPARYVAEARLAAARQRLEQTHETLDRIAEQTGFGSSINLRRLFEKQLNLTPGEYRQRFHCRKMA

SEQ ID NO: 9856 - protein, 423 aa, Klebsiella pneumoniae
RSDFGARRHRSGADPRPAAAATAAAGSELPVHYPRSGDGQADRRQRHGAARRPGGGAWRRKPPVRRPAAGLHPRTDRRHSPGFLPLSTGPHGERIMPKRLGFFTRLLDQGSAQTRYRLAAEQIRHAERLGFDSAWIAQHHFHEQEGGLPSPLVFLSHVAVQTDRIRLGTAIITLPMENPLRVAEDAAVLDLLTDGRLEVGFGSGGTPTSFLPFGLTSEQRGAAFADHLHLIHSAWRGDTLSHPDNRLYPPAPQLAERIWIATFSAEGAIRAGQAGHGLMLSRTQPRPPGEPRLPLDAIQNPIIDAYLAALPNGVAPRILASRTAFVADSHAHALQVAEPGLRKQATQHRAAGHTIEGDSVTDYLQQLDAHVGDPEHVIASLAQDSVLARATDISFQVHSVEPSHRDTLRSIELIAQHIAPHIR

SEQ ID NO: 9857 - protein, 352 aa, Klebsiella pneumoniae
SRAVSRPDCLFIRGPRGRCPRRYANLRGSCMNTVMTVKKGVVLAMALSAMMLSSAHALTVYTAGPGSLAKSLASGFEQQTGVKVTVFQATTGKVMARLEAEQANPQADVLISASWDTAEDLHQRGWLLPFASANADQVPANLKSADYIAQGVSALGIVWNSKSGTPEPKEWRDLTQPAFKDKVTTPDPALSGASLDLLIGLQNSMGDQAWQLFDDLKKNGMVVSGPNAQAVTPVMQGAKAAVFGAVDYVSYGNIQQGESLKVIFPASGTVIAPRPMMILKTSQHPGDAKAFIDYVLSPEGQAKVADAWLMPARRDVAAKRPLLDALKVLPTTSEGSSERGAVLARFSQLYAQ

SEQ ID NO: 9858 - protein, 275 aa, Klebsiella pneumoniae
SDYVLQERAMLPLERHRLIVELLGQHGVMRVNEIAQATRVSRETIRRDLSELERKGILTRSHGGALAAENPLPATRAAASALPVEDSQGSFQHRTLLHSEGKMRVARKALQFLQPGQTIVLDGSSTSWFLARQMPEMALTVITPSIRILQTLMSRRSLHLVGLGGDFSPTEESFFGETASRTLREYAIDTLFFSCQGLERDSGLYAGTQAHAALLKQMLLAARQTVALVDGSKLGRTGVARIGGLGELDCLVTERFVDPLLEKEMTWHNVSLQIA

SEQ ID NO: 9859 - protein, 61 aa, Klebsiella pneumoniae
SQDFTAGSDVGSAHTGLSKGVVMSLRHFAAPRLRHSLLVTSLLLAGSFSAHAAEEMLRKAV

SEQ ID NO: 9860 - protein, 309 aa, Klebsiella pneumoniae
LTNVHKETSMAAHTNVCVIGLGSMGMGAARACLQAGLNTWGVDINPDNCRALLAAGAKGAGPSAVPFAAELDAVVLLVVNAAQVRGILFGESGLAAHLKPGTVVMVSSTIASADAQAIAEALAEYQLLMLDAPVSGGAVKAAAGDMTVMASGSDAAFARLAPVLDAVAGKVYRIGSDIGLGSTVKIIHQLLAGVHIAVAAEAMALAARAGIPLETMYDVVTHAAGNSWMFENRMQHVLDGDYSPKSAVDIFVKDLGLVNDTARALTFPLPLATTALNMFTSASNAGFGREDDSAVIKIFNGITLPGHKQ

SEQ ID NO: 9861 - protein, 568 aa, Klebsiella pneumoniae
MDNVVYADCVLINGKVATVDAHFSFKRAIAVKQGWIINVGEDQEIQQHIGPQTQVIDLGGKLILPAAHDSHIHIGWLADSWHCLNCQDVRSLAVLRERLRDQAARTPAGAWIRVCGLDPNAIKECAAEQRSLTRWDIDDVTADHPTLLALWDGHSCIVNSRALALSGLDASTPDPLGGHLGRTASGELDGNFIDLPALHLASGMMPRLTVAALKENLLAAQRLMNSEGYASYTEGAMGPGENTREVGAAGDRAIAAYRELQDEGKLTARVSIAFYSAERGVQSCATLKRDLDSFDFSQFTDRDWLDCRTIKLFCDGVPTSHTAWMNQDYADRPGYRGRSVFGGPEATEEAQVEALQQMILLAHQRGFQVAVHAVGDKAVKVTINSFVQAIQRYPGESRRHYVLHGSMGDRQDFVTAAKYGILLSEQPSPGGPAYDYEQRARYCGIKGEICKGLRDIIDLGVIVAGGSDGIMALVNWRKMVQAAVTRKSSSSGNVIRPELAISVADGVRMYTINAAYQEGKEAVRGSIEVGKVADFQVLDRDIFAVAHEEIGASRVVMTMVGGNVVFQD

SEQ ID NO: 9862 - protein, 293 aa, Klebsiella pneumoniae
AINVGHLQLEALMSPFLRAYFSRLSWTGEPDVSIDTLRELHLQHNSAIPFENLDVLLPREIHLDDGALEEKLIAARRGGYCFEQNGLLERALREIGFNVRSLLGRVVLANPPQMPPRTHRLLLVEVAGERWIADVGFGGQTLTAPIKLLADIPQQTPHGSYRLVHEGDEWTLQFNHHEHWQSMYHFDLGRQYASDYVMGNFWSAHWPQSHFRHHLLMCRHLPDGGKMTLTNFQFTHWENNHVVEKIDFADVSALYEGLQTRFGLGVDDPKHGFSEAALAAVMAAFDTHPEAGK

SEQ ID NO: 9863 - protein, 186 aa, Klebsiella pneumoniae
YKNVLIVTLLAKRNAGKILMIKNQQPCPIVDENERSLRFEYRFRRYGIIVLSLIILTALSGLWSSGYFSEAHRETGGGELSVDYQRYARLMSETELNIQIKPDTASDTIISFAAPLLTRYQIGDIRPQPDKMYSADGKLHLVYQRSNPPSPISVWLAVTPKTAGNISLQAVVNDRYSVTWQQFVYP

SEQ ID NO: 9864 - protein, 838 aa, Klebsiella pneumoniae
ASDVAMRHGPAHTVTVVSLSILLGGQSALLHAQATFNMDLLEKNDHLPAVDLQRFNQQAGQPPGAYPVSWQVNGVTLDARKTVTFRQNDRGQLTPCLKPEDLLQAGVNPAVLFQAPSATPRSCPELNALLPGSTVNFDFAHQRLVMTIPQALMTHRARDNVPSALWDEGISAFQSNYRYSGASQRTREGSTERDNYLMLKSGVNVGAWRLRASNSLTANSDDKPQWTTSGAWLERDLTRWQSELTLGDTFTSGDVFDAVQFQGISLASSDAMLPDSQKGFAPTIRGIARTNAQVTVRQNGYVLYQTYVTPGAFVIDDLYPTASSGNLEVAVKESDGEIRRFTQPYASVTSMQREGSLKYNLVAGRYHSDDASQRPLMMQLSLMRGFAHNLTLFGGLQSAAQYHNLSVGAGQGLGEAGALSLQLLNARDRHQQDPIDGRAWQLQYSKGFDRLGTQFTFTGWRYSHQRYATLSEAFSSPGSEDDLQDSDNKKATLQITASQSLPYDITLYLSLDQDSYWSGGASQRTANMGISSQVHGIAWSLSYSDSRSSHGDEEDDEPHSDKVVTLSLSVPLSHLLPGSYAGYTLTSSRHSVGSQMVSLNGTLLDNHALSYAVSQTRDRQNGSSGSLTAGYSSGRGDLNLGYSHDSQAARLNYGASGGILIHRHGVVFTPEMNGAVVLIDAGGAGGVTLANQKTIATNGDGYAVLPFATAYHRNDVSLDSHSLPENVDLANSTVTLVPTKDAVVLARFHTHVGYKALFTLLSRGQPLPFGSEVRAKDTSSIVASEGQVYLAGLAPKGTLYAQWGPGPQQRCSARYDLTPTLAQPPHPLILQQTLSCPF

SEQ ID NO: 9865 - protein, 88 aa, Klebsiella pneumoniae
ITDVNRLHYKRRIEEIMKLFAAAAIVLLSLASSLSYAEQNTTPVRQNQRDTMIIPSEHNDSPFDFNHMAAGNDKSDELGVPYYQQHDL

SEQ ID NO: 9866 - protein, 510 aa, Klebsiella pneumoniae
IWDVKKEVYVSTANNKPAESVSLNAFKQPRAFYLIFSIELWERFGYYGLQGIMAVYLVKQLGMSEADSITLFSSFSALVYGLVAIGGWLGDKVLGTKRVIMLGAIVLAIGYALVAWSGHDAAIVYMGMATIAVGNGLFKANPSSLLSTCYDKNDPRLDGAFTMYYMSINIGSFFSMLATPWLAARFGWSVAFALSVVGMVITIINFAFCQKWVKQYGSKPDFAPVHMGKLLATIAGVVVLVAIATWLLHNQGIARMVLGVVALGIVVIFAKETIGLKGAPRRKMIVAFLLMVEAIVFFVLYSQMPTSLNFFAIRNVEHSILGLAFEPEQYQALNPFWIMIGSPILAAIYNKMGDRLPMPHKFAIGMVLCSGAFLVLPLGAKFASDAGIVSVNWLILSYALQSIGELMISGLGLAMVAQLVPQRLMGFIMGSWFLTTAGAAIIAGKIANLMAVPENVTDPLVSLEVYGHVFLQIGIVTAVIAALMLLTAPKLNRMTQDDSADIKARETAAA

SEQ ID NO: 9867 - protein, 107 aa, Klebsiella pneumoniae
RRIVMNIVGVTACTVGIAHTYIAQKKIETAAKKAGHNVKIETQGTIGIENQLTADEIAMADIVLLAADVKVTGEERFAGKKVVKVATETAVKSPNKLIEKLSEIVNS

SEQ ID NO: 9868 - protein, 687 aa, Klebsiella pneumoniae
KFVVARRRKRFSSAPGSDYNSRHFDPLILDNNTRMRLHNHRLELLSPARDAGIAREAILHGADAVYIGGPGFGARHNASNSLSDIAGLVPFAHRFGAKVFVTLNTILHDDELEPAQRLITDLYDAGVDALIVQDMGIMELDLPPIELHASTQCDIRSVEKAKFLSDAGFSQIVLARELNLSQIKAIYDHTDATIEFFIHGALCVAYSGQCYISHAQTGRSANRGDCSQACRLPYTLKDDQGRVVAYEKHLLSMKDNDQTANLAALIDAGVRSFKIEGRYKDMSYVKNITAHYRQMLDAIIEDRGDLARASAGRTEHFFIPSTDKTFHRGSTDYFVNARKGDIGAFDSPKFIGLPVGEVLKVGKDHLDVEVSEPLTNGDGLNVMIKREVVGFRANTVEKTGENRYRVWPNEMPADLHKVRPHQPLNRNLDHNWQQALLKTSSERRIAVDVTLSGWQEQLVLTMTCEDGVSVTHTLDGEFAEANQAEKALANLRDGVTKLGQTIYYAREVQVNLPPLFVPNSLLNQLRRETAEMLDEARLNAWQRGTRKPVSVPPPVYPETHLSFLANVYNHKARAFYQRYGVQLIDAAYEAHEEKGDVPVMITKHCLRFAFNLCPKQAKGSIKSWKATPMQLIHGDEVLTLKFDCRPCEMHVVGKIKNHILKMPHPGSIVASVSPDDLMKTLPKRKGA

SEQ ID NO: 9869 - protein, 174 aa, Klebsiella pneumoniae
TAAVAHRARLSEWPEPGRNCRIVYPSGVLCRLAGGGQRPDLSECAGGVMPLTRISLGTAWRPAEFAQLSALFHECLVAEFDVPSADRFQFIERAADEQRIYDPHYLSEGRSARFVLFHIFAGKPRSRAQKQGLYRRLCARLDDEMAVSPQDVMVVIQFNQLEDWSFSAGKMAGE

SEQ ID NO: 9870 - protein, 84 aa, Klebsiella pneumoniae
LSGVDNPLSQLLTRLFNAVRAQKTADDVCAERGLLTLHAVSLAVGALVAHRDSSLFEFLDFWMAICPDTGMQSGGSQTRIFHGT

SEQ ID NO: 9871 - protein, 96 aa, Klebsiella pneumoniae
YGGVIVPHSPEDKKRALSRVRRIRGQVEALERALESGEPCMTILQQIASIRGAANGLMGEMVEIHLQDELVSGDTTPEQRAARMAEVGHLLRSYLK

SEQ ID NO: 9872 - protein, 166 aa, Klebsiella pneumoniae
ARSVDKLIRSAQMAKQESLRTSECPVARTLESIGERWCLMIIREAFDDVRRFSEFQKNLGLAKNILASRLKHLVDIGIFEILPASDGSAYKEYVLTEKGRSVFPIVVALRQWGERYMFEQGETYSVLLDNAHGQPLQYLDVRSAQGDKLQPGDCHRRRIVSDTRAE

SEQ ID NO: 9873 - protein, 83 aa, Klebsiella pneumoniae
TATVNRSPGGSMMKKECRVVIYKEGLLGSLFFGEAKADPDKMSHFLSSYTREGWEVKTMSVERRRTALFWSREAYLFVLERPL

SEQ ID NO: 9874 - protein, 160 aa, Klebsiella pneumoniae
GCKVKTSFTLGELSMQSVDVGFTHVAFTVRCLASSIDFYTRYTAMTVIHQREPDLPSARKVAWLSDRTRPFALVLVQSDDPADTPLGPFGHLGVACATQAEIDEKVALARREGVLRREPEQLGDPVGYFAFFADPDGNTLELSWGQRVGLEVILAGKPGE

SEQ ID NO: 9875 - protein, 390 aa, Klebsiella pneumoniae
RSRVCCGSYFSSQYDNNVDLTIFKGDGKPPASLMHEETMSNPLLSLLDIDYPLIQAPMAGVSTPALAAAVSNAGALGSLGLGASTVAQAEAMIVATRQLTDRPFNVNLFCHAPPRRDARREADWATTLRPHFARYGSTPPDSLSEIYQTFIGHAPMLELLLDLSPAVVSFHFGLPEGETIQRLRRQGIVTLATATSLQEALLIEQQGIDVVVAQGYEAGGHRGIFAPQAPDAQLSTFTLVQLLRRRLTIPVVAAGGIMDGAGIASVMQLGAQGVQLGTAFLLCPESAADAGYRAAIHNSLDGRTVLTSAISGRPARCLANAFCALGEGYPASAVPDYPLAYDIGKALAAAAKAQGVHEYGAHWAGQGVGLIRECDAATLVRQLAAESGWN

SEQ ID NO: 9876 - protein, 81 aa, Klebsiella pneumoniae
SQGVFAMPHVDIKCFPRELTDEQKTALAADITEVLIRHLNSKEGAVSVALTQVEPDAWQAVWDSEIAPQMAQLIKQPGYSM

SEQ ID NO: 9877 - protein, 68 aa, Klebsiella pneumoniae
NISVSYYFVLFHIFAGKPRSRAQKQGLYRRLCARLDDEMAVSPQDVMVVIQFNQLEDWSFSPGKMADE

SEQ ID NO: 9878 - protein, 372 aa, Klebsiella pneumoniae
MKQVGIVGWRGMVGSVLLQRMIEENDFDDITAHFFSTSSAGAPGPVINGKSDRLKDANSLSALAEMDIIITCQGGDYTKAIYPALINHGWQGYWIDAASALRMDEKACIILDPVNRENIDRAVKAGIKLFVGGNCSITLSLMGLAGLIKADLIEWMSVMTYQSASGAGAKQVRELIAQSAYISQHLSADELTSSGSVLPLVNKVSELINSAGMPVENFGVPLMGSIIPWIDSDLGDGNSREEWKGEAETNKILGLAPGTIPVNGLCIRVGVIRCHSAAITLKLKREVSEAEFAELVTHSHPWVNYVRNNKQESVSKLTPAAISGSLQVGIGRYKKMSLNNDPVYSVLTVGDQLLWGAAEPLRRMLNILLGKI

SEQ ID NO: 9879 - protein, 123 aa, Klebsiella pneumoniae
KPKVRTPSTTASMSASSKTITGALPPSSMWVRLIDEAVWPMIWAPVAIDPVRETIRTLTWAVKGSPTVLPRPNSTLITPSGKISFASSASFSAVSGVISEGFITTQLPAASAGASFQAAIISG

SEQ ID NO: 9880 - protein, 440 aa, Klebsiella pneumoniae
GRLLRQQLLSGALHQVQQNLHVIQRHHRVQQSQLQAGNAVVLGYADVSAAGGQQGVADALVEQRDSRRVAPGHLRRTGTEQHARQLRLHHQLQRRLRLHVLRHVFRHRDAVIDDRRILFLAQRFQTHPQLQRIEATGGLQRLRHQVRYAVFFIELGVQIGRLITHQLVMARVLQQECAAADGLEELLMEVQGNGIHQLQTVKVVAILLRQQQGAAPGCVNVQPDLMFRSDTGDVAQRVDSACVGGAGGGDDRHDLLAVSLRLRNLRLQVGHVHPREFVGFHQRYRAVAEAHQRHVLLHREVGVFRAQDFVLADIPRQPILLDGVALTGEEGVARQHQAHQVALGAAAGEDAGVARRKTDPGAQPFDQLHLDNGCRRALIPGVHALVGGVNQHFRRLANHQARAVQVRHALRVMHRQAVFQEVLDRTINRRLVTQTLFVKF

SEQ ID NO: 9881 - protein, 307 aa, Klebsiella pneumoniae
GKLFCMQISRADVADLIYFMAIARHRSFSRAAIELGVSASALSHALKGLETRLGVRLLNRTTKSVTPTAAGEELVQSVLQPFDTIEGALESLNRYRNTPTGRIRINAAVEAANLLLAPVMPAFMDRYPDIEIDIVASNRMVDVTDAGFDAGIRYGGTVPEDMVARRLSADIRWVIAASPDYLERYGTPEHPDDLLHHRCISNRLGDDRVYRWELARDGETYQMTVPGSVTVNHAETGLVAVLGGAGLMYFPEPLVAPYVKDGRLRLVLTEWSPLEEGFHIYYSSRRQLPTGLRLLIEFIQEARPLGL

SEQ ID NO: 9882 - protein, 165 aa, Klebsiella pneumoniae
RSLFCNLAAVCLSVGVAMEMVLRAAAIYLILLIIFKIAGRRTLMQLTNFDLILLLIISEATQQAMLSTDYSVTGSMLTIVTLVSIDILFGYIKKKFAQAENFLDGTPVIVVENGAVIDEKIKLVNISVDDILLAARQHHGIYELKAIKFAILERNGQISIIPEQE

SEQ ID NO: 9883 - protein, 143 aa, Klebsiella pneumoniae
KTILSACRSPLPTVRWRCRKRRALASSWMKTNCIFIPASRSGEQEKKMLFKVEMTVNIPPGFPANEAEEIKQREKAYSQQLQREGKWRHIWRVAGLYANVSIFDVQDAEELHQILMGLPLYPFMAIKVEALCRHPSSIRDDDR

SEQ ID NO: 9884 - protein, 358 aa, Klebsiella pneumoniae
FLSLRSFIATITLKKIATKITLADIAREARVGVATVDRVLNKRAAVKESTARRVLEAARRLGFTLEQPHYRLAAGKAPVTIRMGFILLQESHSFYLPLARALTREAAPWLPAGQAPVILHFAIDAVEAMAQAIHRLSDEVEVLGLVALDHPLIRHAVARAAARGVRVFTLLSDLSVPQRSGYIGLDNHKAGRTAAWFIERLCRGNGEIGIIIGDNRFTCQESCEISFRSCLREQGKGQQILEPVRSHERADIARTVTEQMLTQYPALQAIYAPCGGVEGIVDALRDSGRQQEIALVCHGPLSDSELALIDGTIDIMLNHRLDEFAAVTLRAMADAASRPHSEVISLPQPFDIITKENM

SEQ ID NO: 9885 - protein, 346 aa, Klebsiella pneumoniae
VNQFPHKETGMKAAVVTHDHQVNVTEKTLRPLEYGEALLKMECCGVCHTDLHVKNGDFGDKTGVILGHEGIGVVQKVGPGVTSLKPGDRASVAWFFEGCGHCDYCNSGNETLCRSVKNAGYTVDGGMAEECIVTANYAVKVPDGLDSAAASSITCAGVTTYKAVKVSHIKPGQWIAIYGLGGLGNLALQYAKNVFNAKVIAIDVNDGQLELAASMGADLTINSRNEDAAKVIQEKTGGAHAAVVTAVAKAAFNSAVDAVRAGGRVVAVGLPPEAMSLDIPRLVLDGIEVVGSLVGTRQDLVEAFQFAAEGKVVPKVTLRPLEDINAIFKEMEQGQIRGRMVIDLRS

SEQ ID NO: 9886 - protein, 200 aa, Klebsiella pneumoniae
LCQFAGKSHLVTGQPMKNEPLCHAPCPIARSLGRIGDSWSIMILRDAFAGFTRFDEFQKSSNVAPNILSRRLKELVDDGLLEKVCYSSTPPRYEYHLTPRGRDFRMVLLALAEWGNRHFAPEGRQMQLVEMATQRHVEPVMVDKATGEEIIPGKYAMVPGPAASPLMKYRHEYLLRKREGDSGQKFQPEPYRDASNESDQ

SEQ ID NO: 9887 - protein, 355 aa, Klebsiella pneumoniae
SLFSKSRRCSPARRGSKASASRPSVVRRSTARGWTSTKRPVMSAYLLRRFGQGLLVLWAAFTLTFFLLQVLPGDAVLIKFQNPDLGLSPAQIAEMRLAYGADSPLWRQYLHTLLAMLHGDFGYSLQAGLAVSSLIASNLPDTLSLALPAFLLAVALAFALAFASRLPGLRWLSNFLQSLPVLFISLPTFWLGIALIQLFSFQLRWIPVINPGPLEGLILPVIAVALPISAPLAQILMRSMDQVAVQPFVAVARAKGMSETGVLWRHVMGNALLPALNIAGLLLGELIAGALITETVFGRSGLGQLTQQAVNNQDIALLQAVVMISALGFVLINLLVDLVMPRLDPRLHLQTGGAK

SEQ ID NO: 9888 - protein, 219 aa, Klebsiella pneumoniae
RKFSRDFAVSFLRAMNQHPAWRNAMDVSRRKFFKICAGGMAGTTAAALGFAPKMALAQARNFKLLRAKEIRNTCTYCSVGCGLLMYSLGDGAKNAKEAIYHIEGDPDHPVSRGALCPKGAGLLDYVHSENRLRYPQYRAPGSDKWQRISWDEAFNRIARLMKADRDANFIEKNEQGVTVNRWLSTGMLCASAASNETGMLTQKFVRSLGMLAVDNQARV

SEQ ID NO: 9889 - protein, 284 aa, Klebsiella pneumoniae
IMKLSALAVATALFSGAVFAAPLTLQTYNPQEKGLFAVNSTLVSGPHEAVLFDAQFSVKDGEKLVEMIKKNGKPLSRIVITSGDPDFYFGLEPLVKAFPQAEVVATPEVVKHIAATKAAKLAYWGPQMKDGAPTQVYVPQALEANSFTIDGEKVTIMQPHDYAAFVWIRANKTILGGTGVAWGMHLWTADTQTPASRQQWRNTLDQMIALHPQRVIPGHYLGTPPEGDSAVRFTKTYLQQFEQALKTHSDSAGVIKAMEAQWPGLAETSSLELSAKVNTGEMKW

SEQ ID NO: 9890 - protein, 485 aa, Klebsiella pneumoniae
PLISPFGVITPDVHININTGDDMLSLLKKGPSANKVPAEKIQATYGRYRMQALLSVFLGYLAYYIVRNNFTLSTPYLKEQLDLSATQIGLLSSCMLIAYGISKGVMSSLADKASPKVFMACGLVLCAIVNVGLGFSTAFWVFAALVVLNGLFQGMGVGPSFITIANWFPRRERGRVGAFWNISHNVGGGIVAPIVGAAFAILGTEHWQSASYIVPACVAVVFAISVLVLGKGSPREEGLPSLAEMMPEEKVVLKTKHGQKAPENMSAFQIFCTYVLRNKNAWYVSFVDVFVYMVRFGMISWLPIYLLTVKHFSKEQMSVAFLFFEWAAIPSTLLAGWLSDKLFKGRRMPLAIICMTLIFICLIGYWKSESLLMVTVFAAIVGCLIYVPQFLASVQTMEIVPSFAVGSAVGLRGFMSYIFGASLGTSLFGVMVDKMGWHGGFYLLMGGIVCCILFCYLSHRGALELEQQRKITEQEEARLALADAQ

SEQ ID NO: 9891 - protein, 237 aa, Klebsiella pneumoniae
TGISYPPRRSGEAIMRSSMSWEDLWPLLLDGTLDTLYMVGLAALFTVLIGLPTGVLLFISRANGLAPMPKLNALLGAVINIGRSLPFIVLLIALIPFTRLIVGTTLGSTAAIVPVTIGAFPFFARLTENALDEVDYGRIEAILSMGGNVWHVIFKSLLPEALPTLLAGITLTIVMLIGFSSMAGVIGGGGLGDLAIRYGYQRFNNEVMFGTVLILVAMVQGVQMAGDRLVRSLAHRR

SEQ ID NO: 9892 - protein, 324 aa, Klebsiella pneumoniae
NLYSILSGIPCMKKEADMIHPIANAPCSWGVDDPKNPNLPAWATVLKEAAQAGYRSIELGPWGYLPTDPASLRAALEQHQLSLVAGTIFDDLVSEAHFPTLVALTHQICRNLSQVAAAEPIPGRPFQPPYLVIIDFGNPERARFAGRGALAPRLNDKDWQRMMEHIIALSTLAWQEYSVRAVIHPHAGGSIEFADEIERLANDIPHDVAGLCLDTGHLYYAGMDPLDWLDRYYHRLDYLHFKDVDPQVYQRAIHEGIDFFTACAEGVMCPLGSGAIDYPAIKDFLARRGYQGWITIEQERDPRHAAGSLQAVTESLRYLRDVGF

SEQ ID NO: 9893 - protein, 131 aa, Klebsiella pneumoniae
ARHSVVDARCHDHGLCPAAPALSHGHRQGGLAHDPTGVIMQKTSIVAFRRGYRLQWEAAQESHVILYPEGMAKLNETAAAILELVDGRRDVAAIIAMLNERFPEAGGVDDDVIEFLQIACQQKWITCREPE

SEQ ID NO: 9894 - protein, 301 aa, Klebsiella pneumoniae
ATHSQKKNIMDLTQLEMFNAVASTGSITQAAQKVHRVPSNLTTRIRQLEADLGVELFIRENQRLRLSPAGHSFLRYSQQILALVDEARMVVAGDEPQGLFSLGSLESTAAVRIPSTLAHFNQRYPKIHLALSTGPSGTMIDGVLEGALSAAFVDGPLVHPGLEGLPVFPEEMMIVAPYGHAPITRASEVNGANVYAFRANCSYRRHFESWFHADRATPGRIHEMESYHGMLACVIAGAGLALIPRSMLESMPGHQQVSAWPLAEEWRWLTTWLVWRRGAKTRQLEAFIALLNEDRQTVVSP

SEQ ID NO: 9895 - protein, 484 aa, Klebsiella pneumoniae
VVRSGCARRAQPFFEGEVMQQYQFPQGFLWGAAASGPQTEGVTNKRHRSIWDSWFAEQPERFYQQVGPQTVCDTYHQYPQDVALMKQTGFNSFRTSIQWSRLIADLETGAPDPDAVRFYHAYLDEMIANGIEPMINLYHFDMPEALQKQYGGFESAHVAELFARFARTAFSLFGHKVKYWITFNEPIVPVEGGYLYDFHYPCKKDGRLAAQVAFNIMLAHAKAVTAYRELALAGEIGVVLNLTPSYTLTDSDADKKAAGYADLFFNRSFLDPLVKHEFPKALCEILAAHDCLPTTSKDDAALILSADIDFLGVNYYVPRRVKARESEYDLDYFTPEYYFENAVNPQGRFNPYRDNNEILPQAIYDIAANIRDNYGNIKWYLAEIGIAMDRQSEGEPGADGVIDDTFRIQLMEEHLVQLHRAIADGANCFGVHQWTFIDNWSWINAFKRRYGFWRLDLETGERQIKRNALWFAELATSNGFTSDK

SEQ ID NO: 9896 - protein, 314 aa, Klebsiella pneumoniae
ILSSFIGELNTMHHDASLNIRQLQVFEAVARLESYSRAQQELGISVSAISNAMSQLEGQLGFTLCQRGRGGFSLTEKGQQFLQQAIRVLSELNELERQSALLKGEHSGTLCISTLDSIETETALSLPVVLRSFSDKFPHVHIKLIIRTPAEQLNGVLNNHIDLAIGSYNSQVHNIISEPLYREQHWLYCSDLHPMFFSRQLDKEQISQCPLVTRSYWNTSDLRRRGFSKGSATVETVDAQLLLILSGKYIGYLPEHYAWPWIKENRLRVLLPNEFGFQSPFSAICKRGRSNEPYLKAFRDLLKKNTVARPKWNY

SEQ ID NO: 9897 - protein, 136 aa, Klebsiella pneumoniae
SRGSFPDLFTSKRFLQMTVIYQTTITHIGACATMALEEQMLITFREGAPADIEEYCFIHNHGELAGTLQPGAELQLGEQRYPVTAVGEVAEQNLRELGHITLRFDGHREAEFPGTVHVAGPVPDAIAPGCVLKFVA

SEQ ID NO: 9898 - protein, 178 aa, Klebsiella pneumoniae
LFTSAVPKRTRFTATHDTAMLDYRFPTALQMVLSVAMAEQMGERSTSAILAYGLEANPSFIRKLMVPLTRDGIIVSTLGRIGSIHLGRPADKITLRDIYLSVIEDKKLWASLPDVPARCVVSANACWYFKSVADEAEQASLNVLARHTVASALEAVKNADTSGCDPVPEMIARFKKAH

SEQ ID NO: 9899 - protein, 467 aa, Klebsiella pneumoniae
RENSSMNTAELETLIRTILSEKLAPTPPAPQQEQGIFCDVGSAIDAAHQAFLRYQQCPLKTRSAIISALRETLAPELATLAEESATETGMGNKEDKYLKNKAALENTPGIEDLTTSALTGDGGMVLFEYSPFGVIGAVAPSTNPTETIINNSISMLAAGNSVYFSPHPGAKKVSLKLIARIEEIAYRCSGIRNLVVTVAEPTFEATQQMMSHPLIAVLAITGGPGIVAMGMKSGKKVIGAGAGNPPCIVDETADLVKAAEDIISGAAFDYNLPCIAEKSLIVVASVADRLIQQMQDFDALLLSRQEADTLRAVCLPDGAANKKLVGKSPAALLAAAGLAVPPRPPRLLIAEVEANDPWVTCEQLMPVLPIVRVADFDSALALALRVEEGLHHTAIMHSQNVSRLNLAARTLQTSIFVKNGPSYAGIGVGGEGFTTFTIATPTGEGTTSARTFARLRRCVLTNGFSIR

SEQ ID NO: 9900 - protein, 579 aa, Klebsiella pneumoniae
APLSARCLLMSEKHPGPLVVEGKLSDAERMKLESNYLRGTIAEDLNDGLTGGFKGDNFLLIRFHGMYQQDDRDIRAERAAQKLEPRHAMLLRCRLPGGVITTTQWKAIDKFAAENTIYGSIRLTNRQTFQFHGILKKNVKPVHQMLHSVGLDALATANDMNRNVLCTSNPYESQLHAEAYEWAKKISEHLLPRTRAYAEIWLDQKKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDKWHLTLFIENGRILDYPGRPLKTGLLEIAKVHQGEFRITANQNLIVASVPEDQKARIEKLARDHGLMNAVTPQRENSMACVSFPTCPLAMAEAERFLPSFIDKVEGLMSKHGVSDEHIVTRVTGCPNGCGRAMLAEVGLVGKAPGRYNLHIGGNRNGTRIPRMYRENITESEILDSLDELVGRWAKEREAGEGFGDFTVRAGIIRPVLDPARDFWE

SEQ ID NO: 9901 - protein, 211 aa, Klebsiella pneumoniae
GYSSQRSGDAAGGVRHCPARRTTLRPAAAGCLRGQRHPAGLFRPLQYPRRCCGAGPRGGSRPGNSGGLMTTLHPFGTTITDATLRQIFAPLNQWEDKYRQLILLGKKLPTLTDERKAQAHEIAGCENRVWLGYEEDAEGRLHFFGDSEGRIVRGLLAVLLTAVEGKTRAGILAQDPLALFDELGLRGQLSASRSQGLSALSEAVLAAARER

SEQ ID NO: 9902 - protein, 555 aa, Klebsiella pneumoniae
FMRSKRFEALAKRPVNQDGFVKEWIEEGFIAMESPNDPKPSIRIVNGAVTELDGKPVEQFDLIDHFIARYGINLARAEEVMAMDSVKLANMLCDPNVKRSDIVPFTTAMTPAKIVEVVSHMNVVEMMMAMQKMRARRTPSQQAHVTNIKDNPVQIAADAAEGAWRGFDEQETTVAVARYAPFNAIALLVGSQVGRPGVLTQCSLEEATELKLGMLGHTCYAETISVYGTEPVFTDGDDTPWSKGFLASSYASRGLKMRFTSGSGSEVQMGYAEGKSMLYLEARCIYITKAAGVQGLQNGSVSCIGVPSAVPSGIRAVLAENLICSALDLECASSNDQTFTHSDMRRTARLLMQFLPGTDFISSGYSAVPNYDNMFAGSNEDAEDFDDYNVIQRDLKVDGGLRPVREEDVIAIRNKAARALQAVFAGMGLPPITDEEVEAATYAHGSKDMPERNIVEDIKFAQEIINKNRNGLEVVKALAKGGFPDVAQDMLNIQKAKLTGDYLHTSAIIVGEGQVLSAVNDVNDYAGPATGYRLQGERWEEIKNIPGALDPNELG

SEQ ID NO: 9903 - protein, 116 aa, Klebsiella pneumoniae
RSRSIWPLTSWRGSLTSGAASSAVAVKRCARRRRLSCRRSMSWRCGRKRISSSSRASLSATAGSASVRSRCRRRSTTPSRCSSITAIPAPSCTAKASKPARNASARNAWCRPIVLN

SEQ ID NO: 9904 - protein, 629 aa, Klebsiella pneumoniae
RSGSAFCRRNSGGGLMTFEQLLLAAVEQRLLRPLDVQFALMVAQNDPPAVKLAAALLSRDAGEGHVCLPLSRLSGDEALSGKAGEIRERLLAEAGAPEDWSALLLASSAVSCGDAPAPMILCGDRLYLNRMWRNELTVARFFNEANRVLEMDEARLASTLNALFPATGETDWQKVAAAVALTRRISVISGGPGTGKTTTVAKLLAALIQIEDSPRCRIRLAAPTGKAAARLTESLGAALRKLPLTDAQKALIPTEASTLHRLLGAQPGSQRMRYHAGNPLHLDVLVVDEASMIDLPMMSRLIDALPAHGRVIFLGDRDQLASVEAGAVLGDICAWASSGYTAARAQELTRLTGSPVPAGEGAIAGALRDSLCLLQKSYRFGSHSGIGSLARAVNAGARAEVKATLRQPFDDIALHPLSTTEEYEAMLGAAQQGYERYLQLRRERAEPQAMLAAFSEFQLLCALREGPYGVSGVNERLEQRLNRQRAIALPRHSRWYDGRPIMISRNDSALGLFNGDIGIALERNGELRVWFLMPDGAIKSVQPSRLPEHDTAWAMTVHKSQGSEFEHAALILPARSVPLVTRELVYTAITRAKRRLSLYADEQVLSQAIVTRTERRSGLAEIFAGRETP

SEQ ID NO: 9905 - protein, 596 aa, Klebsiella pneumoniae
PEGSVMKKISLPKIGIRPVIDGRRMGVRESLEAQTMNMAKATAALISEKLRHACGARVECVIADTCIAGMAESAACEEKFSNQNVGVTITVTPCWCYGSETIDMDPLRPKAIWGFNGTERPGAVYLAAALAAHSQKGIPAFSIYGHDVQDADDTSIPADVEEKLLRFARAGLAVASMKGKSYLSLGGVSMGIAGSIVDHNFFESWLGMKVQAVDMTELRRRIDQKIYDETELEMALAWADKHFRYGEDQNAEQYKRNETQSRAVLKESLLMAMCIRDMMQGNPKLAEKGLVEESLGYNAIAAGFQGQRHWTDQYPNGDTAEALLNSSFDWNGVREPFVVATENDSLNGVAMLMGHQLTGTAQVFADVRTYWSPDAVERVTGQPLTGRAEHGIIHLINSGSAALDGSCQQRDAQGNPTMKPHWEIEQSEADACLAATEWCPAIHEYFRGGGFSSRFLTEGGVPFTMTRVNIIKGLGPVLQIAEGWSVALPKAMHDQLDARTNSTWPTTWFAPRLTGKGPFSDVYSVMANWGANHGVLTIGHVGADFITLAAMLRIPVCMHNVEEAKIYRPSAWAAHGMDIEGQDYRACQNYGPLYKR

SEQ ID NO: 9906 - protein, 483 aa, Klebsiella pneumoniae
CRGSPALVPGQNGQSAGCQCHRTAGRQRPAPRRGARYGPQSTPAAPAYRPPARSARRRSRETAGDGGCRPPAPQRRRLPRARPGSATAAPPGPFPRPSTCQLPGNCRQRTAAAQYLVIKRKQNRVAGGRLLSEAQHLKNTLADSLSQMVIEALESPGVDMLHCRFGSVALADQRQQRQRRAKQRQMSDESFHPRIGDMAVGMKDPGGDFDQFAGMANEHNLVETEPNRLFNHVADEVAHGDHHLRVDAHLLADKALTVVARHQHHALQPGGAFYLQLEGERALPALFRHRGNDPRGADNRDAAEDPQPGVIGFLRAKRAFRGKNLHLRAAGRTYRFAHGGLDGVPRSAVYRRAACRQADPFAGHRTDALPALQANLSAVIEGDPGKNQHAVGGVDIIAAVFTDRGDSLLPFDVRGLNVQAQGDAGGGDDRDLMNQMLAHHHQRSHFCRRCGAGAGGVALAQRFAVMPHRGVKGLIAHCASRRW

SEQ ID NO: 9907 - protein, 168 aa, Klebsiella pneumoniae
SPLSQARSAIVRNRKLQQLSPVAANALPGATRARLVARLRSADQGKPLLFRSIFFRQRRHRAPVVQQMANSEDRVAPEHPRPGPAHNLLHLLALRRLVAMHRTLLAGRFVLAKHALIKALVSVGVQRLIVRIIGLRLGTAPLVEGNHPLNRHFFPFDTLPHLPAFRLF

SEQ ID NO: 9908 - protein, 275 aa, Klebsiella pneumoniae
GSMSVVISDAWRQRFGGTARLYGEKALQCFADAHVCVVGIGGVGSWAAEALARTGIGAITLIDMDDVCVTNTNRQIHALSGNVGLAKAEVMAERIRLINPECRVTVVDDFVTPENVAEYLGVGFSYVIDAIDSVRPKAALIAWCRRYKVPLVTTGGAGGQIDPTQIQVADLAKTIQDPLAAKLRERLKSQFGVVKNSKGKLGVDCVFSTEALVYPQADGSVCAMKSTAEGPKRMDCASGFGAATMVTATFGFVAVSHALKKMLAKAQRDAAASGK

SEQ ID NO: 9909 - protein, 482 aa, Klebsiella pneumoniae
NPMSKNYAALAQQIVAAIGGVDNVAAVTHCMTRLRFVVKDDEQVDSSTLKGLAGVLGVVRSDNQCQVIIGNTVSQAYREVVNLLPGDLRPAEPQGKAPLTLKRIGAGILDALIGTMSPLIPAIIGGSMVKLLAMILEMSGALPKGSPTLTLLALIGDGAFFFLPLMVAASAAVKFKTNMSLAIAIAGVLVHPGFIELMAKAAQGEHVEFAFIPVTAVKYTYTVIPALVMTWCLSYIERWVDRITPAVTKNFLKPMLIVLIAAPLAILLIGPLGIWIGSAISALVYTIHSYLGWLSVAIMGGLWPLLVMTGMHRVFTPTIIQTIAETGKEGMVMPSEIGANLSLGGSSLAVAWKTKNPELRQTALAAAASAILAGISEPALYGVAVRLKRPLIASLISGFICGAVAGIAGLASHSMAAPGLFTSVQFFDPANPMTIVWVFGVMALSVVLSFALTLILGFEDIPVEQAAADARARQARAQASHA

SEQ ID NO: 9910 - protein, 227 aa, Klebsiella pneumoniae
PRSSACCRAWWKKGGELRVEVADTNESKELMKFCRKFTVPLRAALREAGVLTNYETPKRPVVHVFFIAPGCCYTGYSYSNNNSPFYMGIPRLKFPSDAPSRSTLKLEEAFHVFIPADEWDERLANGMYAVDLGACPGGWTYQLVKRNMWVSSVDNGPMAQSLMDTGQVTWLREDGFRYRPNRNNISWMVCDMVEKPANVAGADGAVAGQRLVPGDHLQPQAADEKAL

SEQ ID NO: 9911 - protein, 177 aa, Klebsiella pneumoniae
LYASAWPGRQPGAALAGGGERSASDRDRHPSQPGGRGGAYPMSETVVFSQLSRKFIDENDATPDQAQQVVYYSLAIGHHLGVIDCLEAALSCPWDAYLAWIATLEAGSAARRKMEGVPKYGEIVIDSSHVAMLANAFDKAQSAQTPQQQAWSKTLLSMLHDIHQESAIYLMVRRLRD

SEQ ID NO: 9912 - protein, 328 aa, Klebsiella pneumoniae
TGASGGAGSRGPLRRRAVCRFAERRRRPGADLARPAARHHRNHRQRYPGRDEEAAMNAAQAGLYVNQLTVTWRNGHTALRDASFSVPRGSIAALVGVNGSGKSTLFKALMGFVRVGHGEIAILGQPVNRALRQNLVAYVPQSEEVDWSFPVLVEDVVMMGRYGHMGWLRRAKPRDREIVDAALARVGMSEFRHRQIGELSGGQKKRVFLARAIAQQGQVILLDEPFTGVDVQTEARIISLLRELRDEGCTMLVSTHNLGSVSEFCDYTVMVKGTVLASGPTETTFTAENLERAFSGVLRHVALTGGEAQVITDDERPFISRRAAGGPR

SEQ ID NO: 9913 - protein, 103 aa, Klebsiella pneumoniae
QSRSSDPPAWRRERPRHRDGSPPDRPASTPDSRPSGRSPPSTSRWRQGWSGRHAPAAAPGTAERSPPAPPPRPARRGSPPDRRRSDASSCRSPTGSSAPKEQK

SEQ ID NO: 9914 - protein, 377 aa, Klebsiella pneumoniae
KPSPDCARHAEAAMKSVFRLLPFLFLLGLSAYLPGVRAETCRANIGQTTVNIPNIKYLPTLPVNTQMTSAMADNGSGIPFSCDLQLPTASAKRIVYKQLKTGGSPMVINGQHVYPSAIDGIGYALSFQCAGGPMRAIDGSHSAGDESVVVCDSATLPALMTQQQTTVRIAVTFYKTGTVQLADGTHTNSPPLPQVGEMTIEQQTSASASFVASAPVSIDIAALNVDIGSSGSCQVATSTIQVSLGTVNRGEFHGKGTTGGQAKRFSIPVFCPTPTDVRIGFFGVSVESDTLALSQASNSASGVGVKLTYGNNPGAAVPDGTSVKINEASNLPILKRVTGASAGTAEAINFNAQYVQTDATVGAGTANSMVTFALEYN

SEQ ID NO: 9915 - protein, 115 aa, Klebsiella pneumoniae
SAHPTSSGAVIMKKIMLCCSAGMSTSLLMKKMIAEAEQRGLPVEINAYGVAEFAEQVGHYQVVLLGPQVKYMQQDLQKQADKYGIRVEPINMMDYGMQKGAAVLDFALSLIENKN

SEQ ID NO: 9916 - protein, 121 aa, Klebsiella pneumoniae
TYHPLLLMELHMNPFKGRHFQRDIILWAVRWYCKYGISYRELQEMLAERGVNVDHSTIYRWVQRYAPEMEKRLRWYWRNPSDLCPWHMDETYVKVNGRWAYLYRAVDSRGRSSPRGWKDPR

SEQ ID NO: 9917 - protein, 161 aa, Klebsiella pneumoniae
RGRPASASESSRGCGWWATAAGSSLCRWRRWWPDGPPGPPSPPGWRRDRLLRCPARPSSGSPAVRRRPAAPASRPPASPASARGRLCTPAGAGGASRGRDPHHRTPPPRGWADCGQSAAPGHAGRYRRRVNPAPRGCGGLDLTRRRLTDEQPQIPPYSQRL

SEQ ID NO: 9918 - protein, 98 aa, Klebsiella pneumoniae
CESPAERFVVSLPALRAGSRHRGFSPPRRRRAGGPARQPPRPAAAGAAGGGSPVAPGRRPAVGGDPFRPRRPGAAYSRRYPGAAKGPARGAGSRQSVE

SEQ ID NO: 9919 - protein, 146 aa, Klebsiella pneumoniae
RPAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSAKHSSSILFSPERINNPCLVMTPTY

SEQ ID NO: 9920 - protein, 132 aa, Klebsiella pneumoniae
FHCPPGAPSPAATAAHGDPRGRRGRRSPDGRPAGGKADIYAADRRTGERRSSRASRSPGRRHRRYRHISPAPAGAGSAVPAPPPDIPRSGSPRPPCRSAWSHRLSAGRRRGGRKTGCSDGHYRSDGRRWPTG

SEQ ID NO: 9921 - protein, 403 aa, Klebsiella pneumoniae
TPCPLDWPEHPRPETAVLYPAGRLHRGGAADRRRLSGHLPGCDSRGHRVAVNRPLSAPAGHRRVYRQPDKFLRRLAQLLSRRRHRRHYRGRANAAVPHHLYLRAEARPAGQPPPRQGGRMLNLFLAPFQFPFMVNAIAISIVVAIPCALLSVFLVLKGWALMGDAMSHAVFPGVVLAYIIGIPFAIGAFIAGLLCAVTTGFLDDNSRLKRDTIMGIVFSGMFGAGLVLYVAIQSDVHLDHILFGDMLGISLRDIGQTTAIALVIALIIGLKWRDFLLHAFDPTQAKASGLRGGLLHYGLLCMIALTIVATLQSVGIILSISLLIAPGAIALLLVRRFIHALLLAVAVAIGCSAGGVWLAFYLDSAPAPTIVVLFTALFVVAFVASTIRDSQKQKTSAIIPGGG

SEQ ID NO: 9922 - protein, 89 aa, Klebsiella pneumoniae
PRRPVGRPHPAAPPGTSGRPGHAAGGDPAAGYPSLVRGGCPPRPAPGQRGPPGLSGAVTPARRNWNPDRAARFRRFPSPAHLRYYVSSM

SEQ ID NO: 9923 - protein, 210 aa, Klebsiella pneumoniae
GSRPRLAPPAPAGVQSRPRADAGDAGGRDAGAAGRLRTAGDPLLGLAGQRSRRSRRHPGGEGGPGGPSGHHRLHRQRLLPAAVAHHPHPRLLSEALAGRPLHRQRVRRHPGAAGGLLGAGGDQQLEGAGRGGHWTQKRRPAAERVSGPGGAVRPSGRGPGEVAQKAGRASGDGLHLPGGGPPADRPPAGRQSAAAAADALTFVKRCAGAG

SEQ ID NO: 9924 - protein, 375 aa, Klebsiella pneumoniae
SDSPWAQYSLTMSGVLPTKDQPQKPGGAQQAGEQTDRYLRRRRHGAGQGVGQQKQDRAGQQRAGDQSAMVRSQPQAHQVRHHQADKADDSADGHRDGHQHRAAQQQPALQRLHVDPKIVRLFIAKLQQIEAGRHPPHRQRRRDNQGRGHQQRRPFGLAQTAHSPQRQLAQLGVIAQPGQDADQRAAQRVDGDPHQQQARQRTLLRPTEDENHHHHRQAANKRRQHRHIQSDQPRSGEREHQPAGHRQRGAAADAQQARVGKRVAKQPLHHAAGEGQRRAHQQGQQHPRQTDGQPDMAQHVIPGRQQVDQRQAHGAEGGGKQRQGDQQQRHQQQTASEGRAHQGNCSALFLSAIIACGVRGPKPSRAISSIVSSCL

SEQ ID NO: 9925 - protein, 209 aa, Klebsiella pneumoniae
QQSPAIIVFIINILKTWNVLCILRRVTFLLLEKWMNRFIIADASKCIGCRTCEVACVVSHQEHQDCASLTPHTFQPRIHVIKGVNVSTATACRQCEDAPCANVCPNGAISRDKGFVHVMQERCIGCKTCVVACPYGAMEVVVRPVIRHSGAGLNVVAEKAEANKCDLCFHRESGPACMEVCPTHALVCVDRNKLEQMNIEKRRRTALAW

SEQ ID NO: 9926 - protein, 383 aa, Klebsiella pneumoniae
ARVPRGDPARKTVRRRPASGRASPGRQLPPRCAHGGIGRGEGDMIAIDDLYKSYRTADGRLSAVLKGLSLQVPERSITAVVGPSGAGKSTLARCISLLEQPDSGSIRINGQDLSALSGEALRRERRAIGTVFQSSALLSRRTAWENVALPLAWLGVVERDIKARVGELLESVGLSHKADAWPAQLSGGQRQRIGIARALALRPSVLLADEATSGLDPQATASVLALLKRLRDEYQLAIVLITHEMDAVRTAADAVAEIRDGTIVQYGRIEDLLARPDSLLGQQLLPLTPAAATHSDLLLRLSYRWDVPVATDWISRLSQQWALQIDLLGGHVEVINGRLAGRLQAGVRFQGERLSPARLQGLLAQLGITAEILDSAPLLREAV

SEQ ID NO: 9927 - protein, 159 aa, Klebsiella pneumoniae
CASPPAQLPGPEPMKRLMLIGPSQCGKTSLTQVLRGETLRYQKTQAIVWTPAAIDTPGEYLENRCLYSALLTSACEADVIALVLNADAPWSPFSPGFTAPMNRPVIGVITKADLAAPPRLQQVRAWLEAAGAGHIFITSALTGDGLDDLFACLNAEEYQ

SEQ ID NO: 9928 - protein, 81 aa, Klebsiella pneumoniae
QSPPAPPAQPARSRAAAPAPRPIASPAPDAPDSASDAASAAAQRPLSPAWQSRGPLPPSTARGRNRRPTPRRASAPPGDRL

SEQ ID NO: 9929 - protein, 99 aa, Klebsiella pneumoniae
MTTPEDLQARAGEAAALMKAMSNPHRLLILCMLCDAPRASAGELARATGLSPSATSQHLARMRDEGLIDSERDAQRIHYFITHPAVQQVINTLKTLYCP

SEQ ID NO: 9930 - protein, 185 aa, Klebsiella pneumoniae
REKPVDHQTAEALRAFTQRYCALWQQQRHSLPRSEELYGVPSPCVVDTQGEAVFWQPQPFSLAQNISAVERALDIVVQQPLHSYYTTQFAGDMSGRFAGETLTLLQTWSEEDFQRVQENLIGHLVVQKRLKLSPTLFIATLESELDVISVCNLSGEVVKETLGTAKRITLSPSLAGFLNHLEPVL

SEQ ID NO: 9931 - protein, 172 aa, Klebsiella pneumoniae
RMPLLDSFTVDHTRMEAPAVRVAKKMNTPHGDEITVFDLRFCVPNQEVMPERGIHTLEHLFAGFMRDHLNGNGVEIIDISPMGCRTGFYMSLIGTPDEQRVADAWKAAMADVLKVKDQNQIPELNVYQCGTYTMHSLEEAQDIARHIIERDVRINSNDELALPKEKLQELHI

SEQ ID NO: 9932 - protein, 519 aa, Klebsiella pneumoniae
PTMPLTWRRKRYSRSGSRRTPDVLRTEYLSFFSLIHFAACAPATGRAMEIAMSSQREIRLNAFDMNCVGHQSPGLWAHPRDRSWQYKDLEYWVDLARLLERGKFDGLFIADVLGIYDVLNGSGDAAIRQATQVPVNDPLALITPMALVTEHLGFGLTASLSFEHPYPFARRLSTLDHLTKGRVGWNIVTSYLESGARNIGQQTQTDHDTRYDYADEYLQVIYKLLEGSWEDGAVLRDRERKIFSDPRKIHPINHQGQFFSVPGIHLCEPSPQRTPVLYQAGASSRGKQFAAGHAECVFVAAPSKVLLKKTVADIRRRAAEAGRDPHSILIFNLQTVIVGDTDREAQAKWQEYKQYVSYEGALALLSGWTGIDFGQYQPDQVLKYLHTNAIQSAVEAFSTADPNRQWTVQALADWAGIGGFGPLVVGSAQTVADELQSWVEETDVDGFNLAYAVTHETFRDVVELLVPELQKRDVFKQEYREGTLREKLFGGGPRLAAPHPGASYRRDARTAASVEEKVT

SEQ ID NO: 9933 - protein, 348 aa, Klebsiella pneumoniae
LPMPILTRDSSGRWKPKVLKSLLLENIMSNFLLEAGRQTLMLELQEASRLPERLGDDFIRAAETIIHCEGKLIVSGIGKSGHIGKKLAATFASTGTPAFFVHPAEALHGDLGMLDSRDVMLFISYSGSAKELDLIVPRLEEKGIPLLAMTGKSTSPLALAAKAVLDIAVEREACPMHLAPTSSTVNTLMLGDALAMAVMQARGFNEEDFARSHPAGALGARLLNKVHHLMRRDEEVPRVNTEANVMDAMLELSRTGLGLVAVCDEANRVQGVFTDGDLRRWLVAGGTLNDGVTRAMTRNGVTLQADSRAVEAKERLMKHKISAAPVVDENGQLVGAINLQNFYQAGIL

SEQ ID NO: 9934 - protein, 265 aa, Klebsiella pneumoniae
TDPPHEGGQLMSTLLGPRDENGIPVPMTVDESIASMKASLLKKIKRSAYVYRVDCGGCNGCEIEIFATLSPLFDAERFGIKVVPSPRHADILLFTGAVTRAMRSPALRAWQSAPDPKICISYGACGNSGGIFHDLYCVWGGTDKIVPVDVYIPGCPPTPAATLYGFAMALGLLEQKIHARLPGELDEQPTELLHADMVQPLRVRIDREARRLAGYRYGRQIADDYMRLLGQGDSQVLRWLEAEKDPRLTEIVTHLNQVVEGARIR

SEQ ID NO: 9935 - protein, 170 aa, Klebsiella pneumoniae
PSPPPRRCRKPVANTASAPGSWRIKALTISAQSCAMSRSSAPPGPAAAPATAKAASTAEVTPATTFAVWRATASASTWTVSRNPTPPAAATSAAPGSTPSASAAIISTRICTAAWISSPAPPRRKRPTALSGGMSPSARNQRMITCARARPAPSATAAVTTLRIAAGTTG

SEQ ID NO: 9936 - protein, 360 aa, Klebsiella pneumoniae
PGQPWQGFCMQNLNTVLRAIPAPDADAMARAQQHIDGLLKPPGSLGRLEALAVQLAGMPGLGGQPQVAKKALLVMCADHGVWDEGVAISPKAVTAIQAANMTRGTTGVCVLAAQAGAKVHVIDVGIDSEPLPGVVNMRVARGCGNIARGPAMSREQGQELLLEVMRYTRALAQEGVTLFGVGELGMANTTPAAAIVSVLTGSDAQEVVGIGANLPLAKVGNKVEVVRRAIAVNQPDPNDGLDVLSKVGGFDLLGMTGVMLGAASCGLPVVLDGFLSYAAALAACQIAPEVKPYLIPSHYSAEKGARIALAHLGLEPYLNMGMRLGEGSGAALAMPIVEAACAMYHRMGMLAASNIVLPKG

SEQ ID NO: 9937 - protein, 477 aa, Klebsiella pneumoniae
ARWPAAALLLRQNELHRKLSLRYRLRPPLWGTSPCGSHCRRGAKRRSARAGPLATLYRCLCPQPGVGDQYSRPAGDCAGRRSVQRQPDLSRSACRHRAVDLLRHLPHADQTGPFRRRQRRARRGLAAPASRRRARAAVDTFFSRYVKLGENVQTEKAMPTIDDVSRLANVSRATVSRVLTGTRGVREESREAVLRAVEELNYRPSFAAQNLASQTSSHVGLVISAQDESHGARLLPLLSQALKGLNKSLLVQYVSDPVEQAAVIDDLQRQCVAVVVLGAVAADAPRNVIAFDRFGVAGSNSQGYDFAFATESACRYVIGKGHRNIALLVDSDSDDASRQMLEGYRNVLQNYSIPFNRQLVLTANDDVEQALLTLINSFSKYSVIIVKRDRYAAEAMRLLREFTIAVPQEVSLLSLEDSPLASLLYPPLTCISWPLEALLDNCIQRIRSLIDDRPTFATEGRSLAGRLIPRQSVADIS

SEQ ID NO: 9938 - protein, 505 aa, Klebsiella pneumoniae
IQRPYQQRLRGDYGPDCHLRDLLLSVQLIHSTPPPAPLYGGALSDSTGIHMISVFDIFKIGIGPSSSHTVGPMKAGKQFTDDLIARGLLAEVSKVVVDVYGSLSLTGKGHHTDIAIIMGLAGNLPDTVDIDAIPGFIQDVNTHGRLMLANGQHEVDFPVDQCMNFHADNLSLHENGMRITALAGDKVLYSQTYYSIGGGFIVDEEHFGQTTEAPVAVPYPYKNAADLQRHCRETGLSLSGLMMQNELALHSKEALEQHFAAVWEVMSAGIERGITTEGVLPGKLRVPRRAAALRRMLVSQDTTNSDPMAVVDWINMFALAVNEENAAGGRVVTAPTNGACGIVPAVLAYYDKFIRKVNSNSLARYMLVASAIGSLYKMNASISGAEVGCQGEVGVACSMAAAGLAELLGGSPGQVCIAAEIAMEHNLGLTCDPVAGQVQVPCIERNAIAAVKAVNAARMALRRTSEPRVCLDKVIETMYETGKDMNAKYRETSRGGLAMKIVACD

SEQ ID NO: 9939 - protein, 153 aa, Klebsiella pneumoniae
AIGPFTAATALVTPLPRKRDLSPSRSSSASREPVEAPDGAAAIPTKPPSRCTSASTVGLPRESMISRPMTLTILDIRFSSVQVKLKLQTNNAPGWVHCRSNSFYFAWRFWYSLAAFTKPANSGCPSRGVEVNSGWNWQATNHGWFGTSMISTN

SEQ ID NO: 9940 - protein, 494 aa, Klebsiella pneumoniae
QKELCRTMARHADAWRASRLIAGNNLHRQTTAGGFPVLGVHVFAGFVHGLDHFIETHSRLAGPAQRHSRGVDRFHGSDSVAFDARHLHLAGDRVAGQAEVMLHSDLCRDAHLTRAAAQQFRQTGRRHRAGDPHFTLAADFGAGDGGVHLIQRTNRAGDQHIAGQGVAVHLADKLVVVGQHRRHDTAGAVGWRGHHPAAGGVLFVHRQGEHIDPVDHRHRIAVGGVLAHQHTAQRGGAARDAQFARQDAFGGDAALDTGAHHFPHRGEVLLKGFFAVQRQFVLHHQAGERQPGFTAVTLQVGGVFVRVRNGNRRLGSLAEVLLINDKAAADRVICLAVEHLVAGQGGDTHAVLMQRQVVGMEIHALIHREVHFVLTVGQHQAAMGINILNKARNGVDVDGVRQVAGESHDNRDIGMVAFTGQGEGAVDVDDDFAHLGQQAARDQVVSELFARFHRSNGMGAGRANADFKDIEYADHMYSRAVGKRAAVKRRGGRR

SEQ ID NO: 9941 - protein, 291 aa, Klebsiella pneumoniae
IMCTTCGCGEGNLYIEGDERNPHSAFRSAPFAPAPRQTMTITRVKTDHFAPTRTPEGDLHYGHGEAGTHAPGQSQRRMLEVEIDVLDKNNRLAARNRARFAAKQQLVLNLVSSPGSGKTTLLTETLTRLKGRADCAVIEGDQQTVNDAARIRATGTPAIQVNTGKGCHLDAQMIADAAPRLPLADRGILFIENVGNLVCPASFDLGERHKVAVLSVTEGEDKPLKYPHMFAAASLMLLNKVDLLPYLNFDVERCLACAREVNPHIEIILVSATSGEGMEQWLTWLETQRCA

SEQ ID NO: 9942 - protein, 455 aa, Klebsiella pneumoniae
FRSTTMSSLSQAATAAEKRTNARYWIVVMLFIVTSFNYGDRATLSIAGSEMARDIGLDPVGMGYVFSAFSWAYVIGQIPGGWLLDRFGSKRVYFWSIFIWSMFTLLQGFVDIFSGFGIIVALFTLRFLVGLAESPSFPGNSRIVAAWFPAQERGTAVSIFNSAQYFATVIFAPIMGWLTHEVGWSHVFFFMGGLGIVISFVWLKVIHDPNNHPGVNQKELDYIAEGGALINMDQKSSAQKVPFSVKMGQIKQLIGSRMMIGIYIGQYCINALTYFFITWFPVYLVQARGMSILKAGFVASIPAVCGFVGGVLGGVISDWLMRRTGSLNIARKTPIVLGMLLSMTMLMCNYVNVEWMVIGFMAMAFFGKGIGALGWAVMADTAPKEISGLSGGLFNMFGNISGIVTPIAIGYIVGTTGSFNGALIYVGIHALVAVLSYLVLVGDIKRIELKPVAGR

SEQ ID NO: 9943 - protein, 317 aa, Klebsiella pneumoniae
EYITMTQNNILLISGAILPVIITVIIGYISGKRKDFNWQQAGDINKIVMLYALPLSIFSNMVMTPRHIVMTMGPVAVAIILALILSFVIPLLVARYLFRRDLALSTLQALAIGSPAVPFIGTSVLAFLFGTVSASLITVSSITQNVFQLPLVMILMSVATGDKSQHISFGARVVNAIKQPVVWSPVIALIIVLADIHIPQTISMSLGLLGKASGGLALFAAGIVLYTRSIVITTATIITVIARNILVPGACYLILLKMGFSMEQIKEVVLTMAIPVGSIAIIIAMQYKTGEQEMASTMALSIIASIITMGGFIFLTF

SEQ ID NO: 9944 - protein, 1178 aa, Klebsiella pneumoniae
MTDTAESLDPLRLPLIGERLIEASAGTGKTFTIAALYLRLLLGLGGEAAYPRAISVEELLVVTFTEAATEELRGRIRSNIHELRIACLRGESDNPLYSALLAEIADKDDAAKTLLLAERQMDEAAVFTIHGFCQRMLSLNAFESGMLFEQQLIEDESRLRYQACADFWRRHCYPLTRDIAAVIHDVWKGPRDLLKSLDRWLQGEAPQLKSPPAPNETLAERHQQIIARIDSLKQQWREQVGEIEGVLENSGLDRRKFNRGNQGKWMEKVNAWAQEETLSYQLPDALEKFAQSFLLERTKAGGEPPVHPLFSAVESLLASSLTLTDLVLARAMVEIRDAVAREKRRRGELGFDDMLSRLDEALRGDSGETLASAIRQRFPVAMIDEFQDTDPQQYRIFRRIWRRQPETALLLIGDPKQAIYAFRGADIFTYMKARGDVAAHYTLDTNWRSSPGMVGSVNRLFSLSDNPFMFHEIPFLPVKAAAKNKGLRFTVDAADVPAMNVWLMPGDTVGSGDYQTFMAQLCATQIRDWLSAGQRGRALLWRGETSRPVQASDITVLVRNRLEAAQVREALQTLGIPSVYLSNRDSVFETLEAQELLWLLQAVLAPERENTLRSALATSMFGLTALDIENLNQDEQAWDALVEEFSEYRQIWRQRGVMPMLRALMTARHIAENLLATRGGERRLTDILHISELLQEAASQLESEHALVRWLAQHIAEPDSNAASQQMRLESDKHLVQIVTIHKSKGLEYPLVWLPFIARFRKQDQAFYHDRETFAAVLDLGQDEASLELAEAERLAEDLRLLYVALTRAVWHCSLGVAPLSSRKSGNSDFHLSALGRLLQAGEAMDAAGLAARLADFCHGDIALQRPGELDLTPWQAPAATIPRLSARELQRRIADDWRVTSYSGLQQHGFSGGQDLLPRLDVDAAGVGEVVEEPQLTPHQFPRGAAPGTFLHSLFEELDFTQPVPEGWMAEKLQLSGFDAQWAPVLTDWLGGVLKTRLPGPDIALNQLAARDKQVEMAFYLPIAQLLTAERLDALIRQYDPLSADTPPLDFRRVRGMLKGFIDLVFRHEGRYYLLDYKSNWLGEDREAYTRPAMEQAMRAHRYDLQYQLYSLALHRYLRHRLADYDYDRHFGGVIYLFLRGMDGQEGGQGIFTTRPVRPLIDGLDQLFAGETQEEAS

SEQ ID NO: 9945 - protein, 505 aa, Klebsiella pneumoniae
KVGTQLDISQSTEFKHTVLIEVAMSIVVKNNILWVGQRDWEVRDFHGTEYKTLRGSSYNSYLIREEKNVLIDTVDHKFSREFVQNLRREIDLADLDYIVINHAEEDHAGALTELMMQIPDTPIYCTANAIDSINGHHHHPEWNFHVVKTGDTLDIGNGKQLIFVETPMLHWPDSMMTYLTGDAVLFSNDAFGQHYCDEHLFNDEVDQTELYEQCQRYYANILTPFSRLVTPKITEILGFNLPVEMIATSHGVVWRDNPTQIVEKYLEWAADYQEDRITIFYDTMSNNTRMMADAIAQGITEVDPRVAVKIFNVARSDKNDILTNVFRSKGVLVGTSTMNNVMMPKIAGLVEEMTGLRFRNKRASAFGSHGWSGGAVDRLSTRLQDAGFEMSLSLKAKWRPDIDALELCRQHGRDIARQWALSPLPVAEAATTPEPQDCACAAAAAADLGPMMQCSVCQWVYDPAKGEPNQDVQPGTPWSEVPDNFLCPECSLGKDVFDVLATEAK

SEQ ID NO: 9946 - protein, 550 aa, Klebsiella pneumoniae
LLRFSMTTNYIFVTGGVVSSLGKGIAAASLAAILEARGLNVTIMKLDPYINVDPGTMSPIQHGEVFVTEDGAETDLDLGHYERFIRTKMTRRNNFTTGRIYSDVLRKERRGDYLGATVQVIPHITNAIKERVLAGGEGHDVVLVEIGGTVGDIESLPFLEAIRQMAVEIGREHTLFMHLTLVPYMAAAGEVKTKPTQHSVKELLSIGIQPDILICRSDRAVPANERAKIALFCNVPEKAVISLKDVDSIYKIPGLLKSQGLDDYICKRFSLTCPEANLAEWEQVIYEEANPAGEVTIGMVGKYIELPDAYKSVIEALKHGGLKNRVTVNIKLIDSQDVETRGVEILKDLDAILIPGGFGYRGVEGKIATARYARENNIPYLGICLGMQVALIEFARNVAGMENANSTEFVPDCKYPVVALITEWRDEDGNVEVRSEKSDLGGTMRLGAQQCQLSDDSLVRQLYGEPTITERHRHRYEVNNMLLKPIEAAGLRVAGRSGDDQLVEIIEVPNHPWFVACQFHPEFTSTPRDGHPLFAGFVKAASEYQKRQAK

SEQ ID NO: 9947 - protein, 76 aa, Klebsiella pneumoniae
RRRLSPGPGEGLLPARVQAPSPAPDVAVTEENTALTDAPSHSTERVTCNLCLDPHCPRQKGDPRSQCLHAGKRGDA

SEQ ID NO: 9948 - protein, 94 aa, Klebsiella pneumoniae
WRLTMRWQNSVIYYRPSLYLPKEVRRLFFYWNINNGAVIINIFHFMQALHAGDIDSVVTVRQQHKVFQRIDFAFVVDRLGINNRNMQWAVVSKR

SEQ ID NO: 9949 - protein, 309 aa, Klebsiella pneumoniae
ARITMSKRLPPLNALRVFDAAARHLSFTRAADELFVTQAAVSHQIKSLEDFLGLKLFRRRNRSLLLTEEGQSYFQDIKEIFSQLTEATRKLQARSAKGALTVSLLPSFAIQWLVPRLTSFNSAYPGIDVRIQAVDRQEDKLADDVDVAIFYGRGNWPGLRVEKLYAEYLLPVCSPLLLTGDKALKTPADLAQHTLLHDASRRDWQTYTRQLGLSHINVQQGPIFSHSAMVLQAAIHGQGVALANNVMAQSEIEAGRLVCPFNDVLVSKNAFYLVCHDSQAELGKIAAFRQWILAKAASEQEKFRFRYEQ

SEQ ID NO: 9950 - protein, 356 aa, Klebsiella pneumoniae
LGVTMAIDENKQKALAAALGQIEKQFGKGSIMRLGEDRTMDVETISTGSLSLDIALGAGGLPMGRIVEIYGPESSGKTTLTLQVIAAAQREGKTCAFIDAEHALDPVYARKLGVDIDNLLCSQPDTGEQALEICDALARSGAVDVIVVDSVAALTPKAEIEGEIGDSHMGLAARMMSQAMRKLAGNLKQSNTLLIFINQIRMKIGVMFGNPETTTGGNALKFYASVRLDIRRIGAVKEGDNVVGSETRVKVVKNKIAAPFKQAEFQILYGEGINFYGELVDLGVKEKLIEKAGAWYSYNGDKIGQGKANAITWLKENPAAAKEIEKKVRELLLNNQDAKPDFVVDGNDAEETEQDF

SEQ ID NO: 9951 - protein, 734 aa, Klebsiella pneumoniae
GETTMKPMKNLLLMGLLSALGAGGALAAERSHFTHFITRDGATLKDGDKVFRFAGIHAPELHRIEDDARGPCRADPRGWGQYFKWPTAQEQQNWIQAMVQTGAKAQRVYVLSVQQEFDKACGRETHILAPETADGMPRLNEKAMRVYDNMIAEADKQGLRLILPFIDHWWWWGGREQLAAFYHEKAEDFYRTDSKTFKAYLDVIRQVITRTNTVTGRAYYDEKAIMAWETGNELEDTNADFLHQTAAWIKKWAPHQLVVDGTYKKINPFALTDPNVDIVSNHYYTNADNNHPGQVTQDLRAVGGQKVYLVGEFGLLPADQLNAIMQSIVHSDVNGAQAAGGLIWGFRGHRHDGGFYWHKESTGHYSYHLPGFAKEGEANQEQAVVDLVRTAAAQMAGQQTMAPLPKPEAPLLRETTSPFAINWMGAAVGRSYDVERAASPNGPWTVVGRGISDGVNEWNPETMVLFRDDYRQLQLGHTYYYRVTAKNESGRSAPSNVISVQHSEENQPPVVTLEPALTTTQDQGVELTASWQDDGLPSREVKVGWQHAGDGQVHFCHADRAQTRAWFTAPGTYALTFTADDGLLKSSKTVTVTVGEAAGKAPADFCRYHGEVYGVAEGRLTVMKSDKDALTVGEDGFLGPFANEGDKVSWQVQAPWSGQFLLNVTFNGKWGGKQNSFVVNGGAPQTVAFPQTDEQGQQLRIPVTLKAGSNQIDFGRFAGDWGYMFIKSIEVVAE

SEQ ID NO: 9952 - protein, 171 aa, Klebsiella pneumoniae
MKGLSLPTTAVRMKRIRSIQGDNSMAEVGIFVGTMYGNSLLVAEEAEAILSGLGHKATVYEDPQVNDWESYTGKYVLVVTSTTGQGDLPDSIVPLYEGIKDMYQPHLRYGIIALGDSTYANFCGGGLKFDQLLQEQGAKRIGEMLKIDASEDPEPESVSNPWVEQWATLLA

SEQ ID NO: 9953 - protein, 223 aa, Klebsiella pneumoniae
DMKTLLAVIIGALAFQTQAAITIDASRVIYSGKDKSASLKINNRSSKNYIVQTWLDTGPETPSSGLPIVATPPLVKLRPEQSAQLRFIYSGTGLPADRESLFWVNIQEVPPAPEENNILQFAIRTRLKLFYRPQGIATSLPKAVENLQWQQSANTLSFTNNSPLHITVINAEAIDNKGKIYPLKNFMLLPYSHHAVNIASMQRLHKMKYINDYGAVVDIPIKK

SEQ ID NO: 9954 - protein, 107 aa, Klebsiella pneumoniae
RMETKPNWLVRHINLITTAVALYPWLLMILLLWDNQRHHQHGYAALGAAIAILFLLALTSGMNLLISSLVIFCARCSTPPLAGGAAVRFFAMNSISALWLIPLFFSY

SEQ ID NO: 9955 - protein, 260 aa, Klebsiella pneumoniae
AGRTQCRPAKQANEVHMSVLDLNALNALPKVERILALAETNAQLEKLDAEGRVAWALENLPGNYVLSSSFGIQAAVSLHLVNQIRPDIPVILTDTGYLFPETYQFIDELTDKLKLNLKVYRAAESAAWQEARYGKLWEQGVEGIEKYNEINKVEPMNRALKELNAQTWFAGLRREQSGSRATLPVLAVQRGVFKVLPIIDWDNRTVYQYLQKHGLKYHPLWDQGYLSVGDTHTTRKWEPGMAEEETRFFGLKRECGLHEG

SEQ ID NO: 9956 - protein, 330 aa, Klebsiella pneumoniae
KIRTRSRSSTSTSAGLTPCTRWKRPRTSLAISLSAMCASTATTNWRCRKKNCRNCTSSASATARRLSPGRSSDAAMTTTLSFSFQHRPLVPFAHDYAHGDQEDWHQHDCAQLLHILSGVVRVATPVGYWVVPPGRGVWLPAGTPHALRMTGNVAARTLFIDPLARADLPAGCQIVQITPLLRELIVSSLALAERYAPASRDERIYELILDEIRGMAILPFGLPEPQSETLRRLCQQVREAPGEAWSSGQAAKACSMSERTLNRHFQQQTSLTWSEWVRRAKLMEALVRLAQGHSVLRVALELGYGSHSAFSAMFRRVMGVAPSDYFRPPA

SEQ ID NO: 9957 - protein, 304 aa, Klebsiella pneumoniae
IFLTIIRTTMLNLQRVAMFIAVVDAGSFTLAAAALGQTKAVVSFNVRQLENELGVTLLLRSTRRLRLTDAGVLFYQRGVALLNAAENLQDEVRASHSGLSGELRITTTPEYGAQVIIPALAAFARRHPALRVRHVLSSHHADLISERFDVAIRLGTLADSRYRATRIASFAILPVASPAWLASHPVQTLSDLAQAEWIIHERLPTPLRWQLRTDHQTEVDFAIASAPRFSADSATALMSFALAGCGVALLPAWLVAKKVAQRELVPLLPEYHFPQQGVYALYPDSQHLPTRVRAFIDFLREKVG

SEQ ID NO: 9958 - protein, 437 aa, Klebsiella pneumoniae
PSLTDVESHSDNSTGRRDLVTPGKLRDDRGIDTRNSMNAFNPAHFRAQFPALADAGVYLDSAATALKPLAVIDASDQFYRLSAGNVHRSQFAAAQRLTERYEAARDRVAAWLNAPSGKDIVWTRGTTEAINMVAQSYVRPRLQPGDEIIVSEAEHHANLVPWLMVAGQTGARVVKLPLGADRLPDIASLSALITPRSRVLAIGQMSNVTGGCPDLAQAIRLAHAAGMVVMVDGAQGAVHFPADVQALDIDFYAFSGHKLYGPTGIGALYGKSELLAAMSPWLGGGKMIAEVSFDGFTPQPAPYGLEAGTPNVAGVIGLSAALEWLAQSDIGQAENWSRSLASLAEEELAKRPGFRSFRCQQSSLLAFEFEGIHHSDLVTLLAESGIALRAGQHCAQPLLAALGVSGTLRASFAPYNTQDDVAALVHAVDRALEILVD

SEQ ID NO: 9959 - protein, 98 aa, Klebsiella pneumoniae; identical to SEQ ID NO: 9193

SEQ ID NO: 9960 - protein, 293 aa, Klebsiella pneumoniae
SRSTGWVTHAIDWIVLHFRPLFQGIRVPIDYILSAFQQLLLGMPAPVAIIVFALIAWQISSLGMGVATLVSLIAIGAIGAWSQAMVTLALVLTALLFCMVIGLPLGIWLARSPRAAKIIRPLLDAMQTTPAFVYLVPIVMLFGIGNVPGVVVTIIFALPPIVRLTILGINQVPADLIEASRSFGASPRQLLFKVQLPLAMPTIMAGVNQTLMLALSMVVIASMIAVGGLGQMVLRGIGRLDMGLATVGGVGIVILAIILDRLTQAVGRDARSRGNRRWYTTGPLGLITRPFCR

SEQ ID NO: 9961 - protein, 614 aa, Klebsiella pneumoniae
ISPTGGPGAGALLFGQSEVDVDAQLPGAARHHRQRFIVGVLVGAGLDIAAAQVIPVFTIGEVVDPAIEAHVFRHLPVRGPVQHAVARHAHIVAAGIGDGGSAVAVAFAVGGGRLFPFDKGRRQGGAVAFRRIVPRHADDGFHWRHAVEVDVFIAAVAGFRFPFAIAEGEGGAQAVHLLKPGAKVKFGANLTAVDIGFIAVFRLINGVDVRRHIRELARIVGAGIAGIGDKVLIAVVEQRRAQGDAFGNFPFQPPLEIIAGFRLQIGIADQGILLAAGVAGAEVPGAIQLAGVGELRPALVLQVGHQARGEVVLEGQRRQNLGIAVFAVQIRHRRFAQHAAVGGEIGQIFRLSRLMHHAHAGNNGEVVAVEIEVDLILDKAAEGVAAAVCLRLHDLAVNAGDRRLAERPLGFAGAGVETGAQIVAAQGFRQRGLQAPGVGIVVRVHRLHFAGDAVRHISPVMGFGMLVVDFCGDAVEVVVHRRPVILQAQAPAPGLAGLVGGADGAVAAGVPGIVVGVVGFMVIVEGAGQLVLIVRLPDPGGQKSIGVPVRRVGVDGAAVVFGFLAVTAAIDQNPAQELIAAGDGHPVVPAAIRRVVTAAVAEGAGLARAQVIIR

SEQ ID NO: 9962 - protein, 742 aa, Klebsiella pneumoniae
GLPTSAGRSLKERTMVAVRSAHLNKAGEFDPKKWIASLGISSQQSCERLAETWDYCREKTQGHPQADLLLWRGVEMVEILSTLSMDIDTLRAALLFPLADGEVVSEEVMQESVGKSVVTLIHGVRDMAAIRQLKATHTDSVSSEQVDNIRRMLLAMVDDFRCVVIKLAERIAHLREVKDAPEDERVLAAKECTNIYAPLANRLGIGQLKWELEDYCFRYLHPAEYKRIAKLLHERRIDREHYIEEFVGHLRSEMKAEGVKAEVYGRPKHIYSIWRKMQKKHLAFDELFDVRAVRIVAERLQDCYAALGIVHTHYRHLPDEFDDYVANPKPNGYQSIHTVVLGPSGKTVEIQIRTRQMHEDAELGVAAHWKYKEGAGAGTSGGRGYEDRIAWLRKLIAWQEEMADSGEMLDEVRSQVFDDRVYVFTPKGDVVDLPAGSTPLDFAYHIHSDVGHRCIGAKIGGRIVPFTYQLQMGDQIEIITQKQPNPSRDWLNPNLGYVTTSRGRSKIHAWFRKQDRDKNILAGRQILDDELEHLGISLKDAEKHLLPRYNFNELDELLAAIGGGDIRLNQMVNFLQAQFNKPSAAEQDAAALKQLQQKTYTPQNRTKDNGRVVVEGVGNLMHHIARCCQPIPGDEIVGFITQGRGISVHRADCDQLAELQSHAPERIVDAVWGESYSAGYSLVVRVEANDRSGLLRDITTILANEKVNVLGVASRSDTRQQLATIDMNIENYNLQVLGRVAR

SEQ ID NO: 9963 - protein, 317 aa, Klebsiella pneumoniae
GEQTMSNRFRPAWLLVLAALSTSALAKAPETVNIGYQKANIFALLKYRGTLDESLKKQGIAVRWVEFPAGPQMLEGLNVGSIDLAATGDAPPAFAQAAQADLVYLAHSPANPKTEAIVVPEQSAIHSVADLKGKRVGLNKGSDVNYLLVAALEKAGLSYKDITPVYLPPADARAAFQRGAIDAWVIWDPFLAEVETNAKARQIRNAEGLVPHYTFYLASRKFADTYPETAKQVVDELGKLSAWANSHQDEAAGLLSTSTGLDKAIWLKTLARLPYGAERMTPAVYNEQQALADTFTRIGLLPVKVDVRSATWSLDKP

SEQ ID NO: 9964 - protein, 455 aa, Klebsiella pneumoniae
KKQTIMEAINLPLYQRIARQLKSAIERGELTPGSRLPASRVYAQEQGVSRATIENAWGELVAQGWLERRGQAGTFVSERLSPRQLAPVPPVQPAAPTEPLPFQMGLPALDLFPRGQWARVMGRRLRTQSRFDLAPGDPGGDPLLRQAIVDYLRLSRSIDCQPDQVLITGGYAASMNLILRTLAQPGQHMWMEDPGYPFIRPVVEAGQLAVDAIPVDDEGMDVGWGQRHHPQARFALLTPAHQSPLGVALSLPRRRQLLAWAAERDAWIIEDDYDSESRYHGKPMPPMKSLDAQQRVIYAGTFSKSMFPAMRTAWLVVPTPLVARFHQTAERQSCTVPTLWQQTLADFIQQGHFWRHLKKMRASYSQRRQWLESALQAQGFQVTPQLGGIQLVMSVSGDDRLLARRAVVAGLAVQALSDWRIRHAGEGGLLMSFTNIRSPAMADGLARRLREAIAI

SEQ ID NO: 9965 - protein, 67 aa, Klebsiella pneumoniae
TGGTADRNRSHWSTSKTPSYTKSVSWQHHRLFLHKMQVLLLHLNPRRDRGFLSPPGPHIKCNNYSCT

SEQ ID NO: 9966 - protein, 60 aa, Klebsiella pneumoniae
IMFAVGDLVQPRAGGPKLKVVEVQGEQLVVVQAAQEQGERYSLKSDEVTPYQEEGDFGVC

SEQ ID NO: 9967 - protein, 146 aa, Klebsiella pneumoniae
RAFAVSDALSLTSLFASSFLSATLLPGNSEVVLVAMLLAGVSHPWWLVLIATIGNSLGGVTNVILGRLFPLRKTSRWQERAAGWLKRYGAVTLLLSWAPVVGDLLCLLAGWMRISWGPVLFFLCLGKALRYIAIAAATLQGMTWWH

SEQ ID NO: 9968 - protein, 163 aa, Klebsiella pneumoniae
VTLAPPRQRHGRLPAAGPSVRQNARGRPDRPPAPAAPQRAAQPLPGNGCPPPGPCRGHRRESGRGGRGPVKMAGCRSGRGVRVRWSGSGDRRSASARRRRAAPASDAAFRLHRLSTVAWPPAPADCPCAGAPPAPRRPAAPRGSGGHPSNGADGAENAGDRRR

SEQ ID NO: 9969 - protein, 455 aa, Klebsiella pneumoniae
GGSAPHRHYALAECLAAQSGGTHPADLHFCQKWPVLRGNRRRRRRVYHLHHRHANRRRHHLRADVRPPAALRVDQRFFHSLTGGAMHTFSLQTRLYSGPGSLAALQRFSHQHIWIVCDGFLARSPLLDRLRAALPASNRVSVFSDITPDPTIHTVAKGIAQMQALRPQVVIGFGGGSAMDAAKAIVWFSQQGGLPVDTCVAIPTTSGTGSEVTSACVISDPEKGIKYPLFHEALCPDMAIIDPTLVVSVPPTITAHTGLDALTHALEAWVSPQATDFTDALAEKAARLVFRALPVAIRQGDCIATRSKMHNASTLAGMAFSQAGLGLNHAIAHQLGGQFHLPHGLANALLLTAVIRFNAGEPRAAKRYARLARACRFCPPAAGEQEAFQALLTAVETLKQQCAIPTLKDALQEKYPLFLSRIPAMVPAALTDATLRTNPRPVDGAAIAQLLENLQ

SEQ ID NO: 9970 - protein, 123 aa, Klebsiella pneumoniae
GTPAPRRAPAPESATLPLSAQTAGSRRCRRWRSRQGVPAKVASPGRRSAAKAASAADRPAAPAAASRSGSRRRTADRSPCSAPAGARPSPARPAPASPGAASPRPARQRRHTAARRRRESGGT

SEQ ID NO: 9971 - protein, 203 aa, Klebsiella pneumoniae
NQPAISKKNNMLKERTMIDVVTHGAEWFIGLFQKGGEVFTGMVTGILPLLISLLVIMNALINFIGQQRIEKLAQRCAGNPISRYLLLPCIGTFVFCNPMTLSLGRFMPEKYKPSYYAAASYSCHSMNGLFPHINPGELFVYLGIANGLTTLGLPLGPLAVSYLLVGLVTNFFRGWVTDLTTSIFERKMAIQLSQKVHLSGATS

SEQ ID NO: 9972 - protein, 77 aa, Klebsiella pneumoniae
SRYAVLHSSLPSSGMLSHGRAPGHQLALTWRTGRLSPPMVSPNGPVFTLRAFDEAPFSSGNRGITSSAKRCASSRCG

SEQ ID NO: 9973 - protein, 322 aa, Klebsiella pneumoniae
AGGAGGDCHFARSLRMSLLIALLQALVLFAVAPLLSGIVRVARARLHNRRGPGVLQEYRDILKLLGRQSVGPDASGWVFRLTPYVMVGVMLTIATALPVVTVDSPLPVLGDLITLIYLFAIARFFFAISGLDTGSPFTALGSSREAMLGVLVEPILLLGLWVAAQVAGSTHISAITDTLYHWPAARSIPLILALCACAFATFIEMGKLPFDLAEAEQELQEGPLSEYSGSGFGILKWGISLKQLVVLQMFVGVFFPWGQMTSFSVGGLLLALVVAIVKLVVGVLIIALFENSMARLRFCATSRVTWAGFGFAFLAFVSLLVA

SEQ ID NO: 9974 - protein, 216 aa, Klebsiella pneumoniae
TFPALGRPRPAGRQIMAQHDENVVWHAHPVTQQQREQHHGHRGVVLWFTGLSGSGKSTVAGALEEALHERGVSTYLLDGDNVRHGLCSDLGFSDEDRKENIRRVGEVARLMVDAGLVVLTAFISPHRAERQMVRERLGEGRFIEVFVDTPLAICEARDPKGLYKKARAGELRNFTGIDSVYEAPEKAEIHLDGEQLVTNLVHQLLDLLQQSDIIRS

SEQ ID NO: 9975 - protein, 415 aa, Klebsiella pneumoniae
SATAPHRRAIPCFYRKPVPQNHGEFQLISQEIKKYDLNFVILIAKRRREPDRVGEQGSAVKAGNVQYTACNFCNRKNHMATMLEVAKRAGVSKATVSRVLSGNGYVSQETKDRVFKAVAESGYRPNLLARNLATKTTQTLGLVVTNTLYHGVYFSELLYHVARMTEDKGRQLILADGKHSAQEEREAIQYLLDLRCDAIIIYPRFLTVDEMDEIVENHSQPIMVLNRRLRRHASHCVWSDQKASAMRVVERLIALGHRDIAFITGSLDSPTGVERLAGYKDALAGHGIALNEALIAEGRWTPETGAAGVESLRQRGVTYSALVASNDDMAIGAMKQLHQLGVKVPEQVSVVGFDDIALAPYMVPSLASVRVPVTEMIKESINRLIFMLDGGEFNFQQSFPGALIERESLVAGPCA

SEQ ID NO: 9976 - protein, 360 aa, Klebsiella pneumoniae
TGTAAMTAVKHAFTELPTIDIRDLAGDDLARRQAVADAIGRAAREVGFFYITGHGIDPALIAGVREAAKQIFALPMEEKMNYYIGHSKSHKGYVPEGEEIYGSGKPDHKEAFDIGFQAADDHPLVLAGTPLIGANEWPDLPDFRARVLAYYDAVFALGHRLFDAFALALGLPEGYFKPMVTCPPAKLRLIHYPFDASVEDVPGIGAHTDYECFTLLLADQPGLEVLNEESVWIDAPPVKNAAGEEAFVINIGDMLEVLSAGTFVATAHRVRKVPQERYSFPLFFACDYHTLIRPLPTFLAAGEAGEYQELSIGEHMWSQALQTYRYLREKVNRGELQLPERARGTNTFGHLKKQAQQKTP

SEQ ID NO: 9977 - protein, 391 aa, Klebsiella pneumoniae
CRNANRRATMANRMILNETAWFGRGAINALTDEAVRRGYRKALIVTDSTLARCGVAAKVTDKLDAAGLAWDMFSDVISNPTIAVVQQGLQAFQRSGADYLIAIGGGSPQDTCKAIGIIQRNPVFADVRSLEGLSPTRQPSVPIFAVPTTAGTAAEVTINYVITDEEQRRKFVCVDPHDIPQVAFIDADMMDAMPPALKAATGVDALTHAIEGYLTRGAWALTDALHLKAIEIIAGALRGSVAGDAGAGEAMALGQYVAGMGFSNVGLGLVHGMAHPLGAFYNTPHGVANAILLPHVMRFNAEATGEKYRDIARAMGVRVEALSLTAAREAAVEAICQLNRDVGIPGHLREVGVRKEDIPALAQAALADVCTGGNPREASLADIVGLYQAAW

SEQ ID NO: 9978 - protein, 112 aa, Klebsiella pneumoniae
PGCAKTVSAIVRTATTSRGWSAIWWRNRRMWPALMAQWLVNGWCRETIFNLKLPMKKRYEEVSHNLAYIQAQLDEHGVNAQIQARQLYHDREEVTVHVRRLWAAVGGRRDER

SEQ ID NO: 9979 - protein, 539 aa, Klebsiella pneumoniae
ALCAPGQGLPLLPARSWRTGGFPGAAYRGGNAETAVRHSHPQGRAAGKVSPFLIANSRHGAGRADRRHPAHQPASGRWRGHRATAGEPAMSEAIGPLSSIDAAEIRERVRAAGVVGAGGAGFPTHIKLQARVDTVLVNAAECEPMLKVDQQLMAQQADRLIRGLGYAMTATGAREGIIALKAKYAPAIAALTPRLPEWARLHILPDVYPAGDEVLTIWLATGRRVPPAALPVSVGVVVNNVQTVLNIARAVEQGYPVTRRTLTVNGAVARPLTLAVPLGISLREVLDLAGGATVDDPGFINGGPMMGSLITSLETPVTKTTGGLLVLPGNHPLIQRRRQDERTLLAIARTVCEQCRLCTDLCPRHLIGHELSPHLLVRAVNYRQAATPSLLLSALTCSECNVCESVACPVGISPMRINRLLKRELRAKNLRYDGPLRPADEMAKHRLVPVKRLISKLGLDPWYQEAPLTAVEPEVACVTLPLRQHIGISAVPCVAPGERVTRGQLLADIPADALGAPVHASIDGLVSAITEQAITLVRG

SEQ ID NO: 9980 - protein, 119 aa, Klebsiella pneumoniae
QRGANRLTLTIQRIIMELEEQVMGIIINAGQSRSLCYEALHAAKAGDFATADAKMQEAAHYSREAHLVQTQLIEADEGEGKTKMTLVMVHAQDHLMTSILAKELIAELIAIYRAQPLHA

SEQ ID NO: 9981 - protein, 360 aa, Klebsiella pneumoniae
DAPAVAGRMAVRQRLCQLSPCPFCPASHHAQPLVAGSKEGAMTLLAWCVAWILDVVIGDPPHWPHPVRWIGRLIAVSQRVVRRVCHSDRALRIGGGVMWLVVIGLTWGVAWGVLALAHGIHPWLGWLVEVWMIFTALAGRCLAQSAMAVARPLQAGDLAESRHKLSWIVGRDTSQLQPAQINRAVVETVAENTVDGIIAPLFFLLLGGAPLAMAYKAVNTLDSMVGYKHEKYRAIGMVSARLDDVANFLPARLSWLLLSLAAVLCREDGARALRTGWRDRYQHSSPNCAWPEATVAGALGIRLGGPNDYFGQRVEKPWIGDAVRDIAVDDISRTIRLMWVASSLALALFIGVRYWLVGAA

SEQ ID NO: 9982 - protein, 435 aa, Klebsiella pneumoniae
SAAARQGCPGRCRGAFAEKRYAWRPRLANGKTVGQHAAPQAGERPRGGGAFSGWRGDGEGGKPFAADADSRVRRAIFDKNGGLQGACRQIEPRDILRVHNGGVVQTLLNAQGQRQGAVKVGDPDDRQHRHQLLAGHPGVVRLHLGNQQARGARRNGETRRRQQRSRAFTDQFFIRRAVGQADGTQGIGLLSAQQQRVKILHLLDQAVSDGGDDDQAFFGDTGQVVIEGGAADDIFGGFDEIGGFINDARRIAGASADHFFTAFHAHRHNARAAGDSQNGNQRVGHHLLGGFKGRLGNGHHQVTDPAAAVGDLFDPGDKLQRDLFRAGMGAEIDAVTRRQHADTVVDNGFRWVGAGRHGANNPERRVLKQHHPAIAGEGAGSEILYARRVFKSGFIFQIFIFFVAHAGFRGALFRQRRQLGGQRLPQGADNGAAGF

SEQ ID NO: 9983 - protein, 210 aa, Klebsiella pneumoniae
PAAAGAAGANRQRNAGDPRYGDSPFRAAVGKTAGLVGAGGAGLPGAGAAGLARLSAYLRRRFTGAQQRQRRGAGLAVRRGARRAGAFFRPRLERFLPAQGGELMSNALKRQRGFSLPETVLAMALMVLTVTALGGYQRGMAQGIVQLNQTRQLWRDAWRYSQLSAPPSPARGQVSRMQTSRQRCVSITVTISRPVAKRVQMTRLHCPVSQ

SEQ ID NO: 9984 - protein, 236 aa, Klebsiella pneumoniae
MKAARQQAIVDLLITHSSLTTETLSKQLNVSRETIRRDLSELQAQGKVLRNHGRAKVIHQRSQDSGDPFHMRLKSHYAHKADIAREALAWIDEGMVIALDASSTCWYLARQLPDRPLHVFTNSQPICQELAKRDQITLTCSGGTLQRKYGCYVNPALISQLKSLEIDLFIFSCEGIDPQGALWDSNAFNADFKSILLKRAAQSLLLIDKSKFNRSGEARIGHLDDVTHIVSDAPQP

SEQ ID NO: 9985 - protein, 447 aa, Klebsiella pneumoniae
RREALRLPSPTGLPRRFLTIAYLPDKGGRFTVHQPVTDITCLINHRIMRGNRPRIAPVAIQRKASSRIRRPEGIKQLRRRPRDPVAGDHLRLRRFHFRQLVTPGNQCFVVADVRHIGLLQRFRGLQDRGPGRPCPAADLPNDLQNLGVIARHGGVAVAVHPGAMFDALRGIPLNRQANAREGRQQHMLVEGGLIAKALGKIIDMFGFHPSAGKAGGPAAGQPLAKAIPVIFPHHAGLLGADQGYHIAGGITAPGKHIDPVGVQRAGAVKLLAVESPAALCRRHSGVHLSQLNRADLRPAAAHQLTVEEATKPAVAPGGIRLIQLIFHKGKVRAQGLRQVRVRLRQLDQQRAELRQRSAPAALLARDTQRAEARFFQPADRLIGQNALLFALRSALGDTGEYRAEGGRQRVIIGASREQGHCQFLIHEVRRYLLASVHDGPPAGRKWE

SEQ ID NO: 9986 - protein, 611 aa, Klebsiella pneumoniae
NRRAGNGLDDGAEYYCLHHYDGRIYFLNLLITAITPREYGENMASITLSAAELLLHRLQALDVAYIFINSGTDYPPVIEAWAKARATGQKVPELVICPHENAAIGMAHGYYLGTGKVQAVMVHTNVGLANAACGVINLANSNIPVLIFGGRTPISEHSHFGCRNTPIGYGQEMRDQAALIRESVKWDFELRLADQIGEHVDRAWAIASSLPKGPVYLSLPREPLCETFAVDETALQAGPSQQPVRYAPVREDIARAAEAIACARHPVIFAQRGARTAEGFARLDSLVREWAIPLVEYWGTEVTLSADNPLLAGADPSVWLADADVILVVDSQAPWMIAEGDCRQDCTVIQMGPDPLFSRYPVRGYRADINLAGETDEVFSLLEEALRPLQAARQQHVAERAAYTQNRIQQQKNQRDALLHASQTGAITKPWLSYCLGHLANQHRGRIVSELTTLPQFAGLTHAESYYQEALAGGLGEALPIALGLQLARREELIIAAVGDGSYLFANPAVCHHIAEVMKLPVLVVVGNNGGWGAVAGGTKALYPDGYAARAETIPATAFTTSPDFAAIAASSRAAALSVSRAEDLPGVLEEAVSLIRTRRQSVLVDVQLAR

SEQ ID NO: 9987 - protein, 385 aa, Klebsiella pneumoniae
IRLALASASWCCSAAARAHATFSAARMRPSILPSWALLTHFHAKGAPVAIYTRTGDAGSTSLFTGQRVSKTHPRVEAYGTLDELNAMLSLCVCAVAEEEQRTLLEALQQHIFWFSAELASDSEQPSPGKRYISSEEIALLEQTIDREMARVPALHQFVLPGRCEAASRLHLARTVARRAERRLVELAAEVTIRQILLRYLNRLSDCLYALARSEDHAAHQRRLVTEIAARYLAASGSPAPDAPKAQAGSLSFHELHQLIRQAIEHARQLQVPVVVSIVDAHGTETVTWRMPDALLVSSELAPKKAWTAVAMKTATHELATTVQPGAALYGLESHLQGKVVTFGGGYPLWRDGQLIAGLGISGGSVEQDMAIAQTAMAAINVRTHQ

SEQ ID NO: 9988 - protein, 198 aa, Klebsiella pneumoniae
VRLAISFPGSQQKELAMKMKSLCLAMALVGLTSHYASAADGTLYFSGTIVNSTCKLASGNNDGLIEVKMGAVPLSKLKNDTNGTGPEVGVNISVKDCDEGTYYIVLDGASATEAPITNVLALDAGNPTAKKVGIKLTDRNNTPVTLDKPFDPTVDPRITVNADGTGTFNLKAYYYTWDKDNAEAGDGNATARFTIIQQ

SEQ ID NO: 9989 - protein, 373 aa, Klebsiella pneumoniae
SWSAPSSAMSITTQNCTQRILAMNTVKPESIALFCLTPGGVRLAKRLAAMLPLTCYTSEALQEEGFIPFNGGFASAAREAFSSFSALIFIGATGIAVRVLAPLVNDKLSDPAVVVIDERARHVISLLSGHAGGANALTRYLAGMLDADPVITTATDVNELAALDTLAFQLNARMTDFRAAVKTVNQMLVSGKRVGLWCDGEFTGALSRCDRRGFILVSDLASLPALDALICVTLRRSLPPLPVPHWKLVPQRVVAGIGCRRDTPCALLSTLLDRQLAAQRLDPLALKAIGSVSLKANEPGLRQLAHRCRVPFETFSAEALREHEHRFPASSFVRETVGVGSVSGPVAWLLSQGNLSGETLREQGVTITLGVTH

SEQ ID NO: 9990 - protein, 183 aa, Klebsiella pneumoniae
ALPATFATSRSWCWWAARPSISRSPSWSPTRWRTTGWLPGAATSAAVKAHAMRSPADYSFPGKKEAHMESSVVAPAIVIAVTDECSEQWRDVLLGIEEEGIPFVLQPQTGGDLIHHAWQAAQRSPLQVGIACDRERLIVHYKNLPASTPLFSLMYHQNRLARRNTGNNAARLVKGIPFRDRHA

SEQ ID NO: 9991 - protein, 171 aa, Klebsiella pneumoniae
PATAPISTKRPRPRAPIPRDKRGTGVGCLLHPLHAFFSSLIPVSGLPPVYNNWYFIQYFYRGIFSKEHIMSAQHPTAARGIARAIRQLTVGYVRKRHEDRKTRETRRYTRHAALSLNGDWLEQAGFPVGTQVRVSVSPGKLVIENLELAAPGTGLPSGQSCAGGEPGSPQG

SEQ ID NO: 9992 - protein, 405 aa, Klebsiella pneumoniae
LVAAENGTFAVECPAGDQVLHRARVVARAARQRFIGLMGSAHLLPVKFHAESRRVWHGNAAVNNLQRIFGQARVALLPDPVGIDGGGVARRGGADVGKHRQGNIKVVVGMAAPGEPPVVAQLRHPHRAGERPEVRVRQRDIDGVEHHRMAHFAPVSGYHIGGDRQPGGAAELGHHLPAGETLLGAARIFGVGQNILQPFTQRDGLIQQPGAVRVDGDARIRETLFQRPRGVNLLLAGQHAAFELKVFETVAILGGFRQTHYRLAAQRLLVAQAVPFVIARRMVQITKVGFLPIADIEQVAQHGDGITLLTRAQQLADRHIKHLAEQVEQRRFQRRHRVNLQFEGPRPFAEGVEIRRLIAFVHLLHHAIESGDLLAHHLRDRRQQRLVDDLSAGRFADAGMAGVIG

SEQ ID NO: 9993 - protein, 98 aa, Klebsiella pneumoniae
RLRASARPVVRDPPAWPYDFKRGALADAEVSLFLIRRDLVRLQRIALSLLLCGLNHHQLLPLHFHHFQFWSARSGLYQIADSKHNSLLTVNTMDKPKP

SEQ ID NO: 9994 - protein, 271 aa, Klebsiella pneumoniae
PARAKPSIVWYRMRLNAIRHRGNSRTIDNQAQDYNMAATFPGVCAVVPAAGFGRRMQTECPKQYLSIGNKTILEHAVAALLADARVQRVVIAVSPGDRRFSQLPLAQHPQITVVDGGAERADSVLAGLQALPEAQWVLVHDAARPCLHQDDLSRLLSLCETSRVGGILAAPVRDTMKRAEPGKTAIAHTVDRNDLWHALTPQFFPRELLVDCLTRALNEGATITDEASALEYCGFHPQLVAGRADNIKVTRPEDLALAEFYLTRSRHQEKA

SEQ ID NO: 9995 - protein, 146 aa, Klebsiella pneumoniae
NVRALFMNKVVLYCRPGFEKECAAEITDKAARLEVFGFARVKEDSGYVIFEGYQQDDGEKLVRDLPFSSLIFARQMFVVGELLRDLPPEDRITPIVGMLQGVVEKGWRAACGSGGYQRKQRADEVLPQVYGAVTRGAARGGRADQL

SEQ ID NO: 9996 - protein, 78 aa, Klebsiella pneumoniae
SRRARWSRAAKAPPASAAAPSSAARPSAPRRCAPDRPPPAPGSLRLLWQTPAGGSCSARSTPYASRSRRRDDGRGSPR

SEQ ID NO: 9997 - protein, 78 aa, Klebsiella pneumoniae
SCHFLLTTAASLAARTAKRRARSRWWRRIINPGSSRYMNRRAARLRVCCLPLQGSLGAAVIFYILGYARGRQRRDDRV

SEQ ID NO: 9998 - protein, 176 aa, Klebsiella pneumoniae
WPLYPEQSGAIMTDSELMQLSEKIGRALKARGATVTTAESCTGGWIAKAITDIAGSSAWFERGFVTYSNEAKSQMIGVSEATLRDNGAVSEPVVVEMAIGALRAARADYAISVSGVAGPDGGSVEKPVGTVWFGVASVSGQGVTRRECFAGDREAVRRQATAYALNLLWQQFLQNT

SEQ ID NO: 9999 - protein, 319 aa, Klebsiella pneumoniae
IILLRRLYAARFPQDANTLPLPVSIVGLAVPNEPADGWLAWTRTSSRGVTMNGSLRAQCIAEFLGTGLFLFFGICCLSALKLTGASLGLWEICIIWGLGISLAVYLTAGISGGHLNPAVTVALWLFACFPGRKVVPYIVAQVAGAFGGAVLAWILYSTLFTQFETVHHMVRGSLESLQLASIFSTYPAPELSIWHAALVEVVITSMLMGMIMALTDDGNGVPKGPLAPLLIGILVAVIGASTGPLTGFAMNPARDFGPKLFTWFAGWGNIAMTGGRDIPYFIVPIIAPLLGACLGAAIYRFLIANNLPCHTCVEEENTR

SEQ ID NO: 10000 - protein, 139 aa, Klebsiella pneumoniae
SGDYPSPAHHSGEVMNPYLQEVLDAHVLIERWLSHGEGSAEALMKRFAADFTMIPLSGEKMDYPTVSRFFHHAGGSRPGLDIVVDQMEIISEWHDGAAVLYRESQTLADSSQNVRWSTAIFQQAEGKIVWRHLQETRLG

SEQ ID NO: 10001 - protein, 149 aa, Klebsiella pneumoniae
TTDYRQRLRRAARRRDDGAYRAERRREIHSAAPVDRLSDSGQRHPPSCRQAAGGLVSRGAVAPAGGHAAANGPAGRLDGGNGHCHGTLTVGRDGGSGGAGGGDGRHRLRWPCRSPLSRPLRRRAAAGTAGPLSGAAMARRRAAGLAVSR

SEQ ID NO: 10002 - protein, 142 aa, Klebsiella pneumoniae
QFCYGVFMELRNEAFHLLRQLFQQHTARWQQALPDLTKPQYAVMRSVAEHPGIEQVALIEAAVSTKATLAEMLSRMEARGLVRREHDPADKRRRFVYLTDEGEALLNRSIPQGNEVDDEFLGRLSDDEREQFSRLVHKMMAP

SEQ ID NO: 10003 - protein, 406 aa, Klebsiella pneumoniae
QELLYCMAIKLEIKNLYKIFGEHPHRAFKYIEKGLNKAQILEKTGLSLGVKDASLAIEEGEIFVIMGLSGSGKSTMVRLLNRLIEPTRGQVLIDGVDIAKMSDAELREVRRKKIAMVFQSFALMPHMSVLDNTAFGMALAGVPAAEREQKAREALRQVGLENYAHAWPDELSGGMRQRVGLARALAINPDILLMDEAFSALDPLIRTEMQDELIKLQAKHQRTIVFISHDLDEAMRIGDRIAIMQNGEVVQVGTPDEILNNPANDYVRTFFRGVDISQVFSAKDIARRSPVGLIRKTPGFGPRSALKLLQDEDREYGYVIERGNRFVGIVSIDSLKTALSAGQGIEAALIDAPLAVEAQTPLSDLLSHVGHAPCAVPVVDEEQQYIGIISKRMLLQALDREGVNHG

SEQ ID NO: 10004 - protein, 265 aa, Klebsiella pneumoniae
WRCYPKDAENKGVSVAVHLLIVDALNLIRRIHAVQGSPCVDTCLHALEQLIVHSQPTHAVAVFDDEDRAHGWRHQHLPEYKAGRAPMPETLVAEMPALRAAFEQRGIRCWASPGSEADDLAATLAVKVAQAGHQATIVSTDKGYCQLLSPTIRIRDYFQKRWLDAPFIASEFGVTPEQLADYWGLAGISSSKVPGVAGIGPKSAAQLLNEFQDLEGLYARLAEVPEKWRKKLAAHQEMAFTCREVARLQTDLQLDGNLQQLRLTR

SEQ ID NO: 10005 - protein, 178 aa, Klebsiella pneumoniae
AALLLCEIIEVPVTEPSSRRSGYARLLDRAIRILAMRDHSEQELRRKLVAPVMSKNGPEALDATPDELEQVVAWCIENRYLDDNRFVGQFIASRSRKGYGPARIRQELSQKGIARQVVDQAMRECDIDWVSLAREQAQRKYGEPLPSAFTEKVKVQRFLLYRGYLMEDIQEIWRNFAD

SEQ ID NO: 10006 - protein, 119 aa, Klebsiella pneumoniae
SCVLHLNCTLFTICPFRLSETTMNSKAAITITYCSQCNWMLRASWMAQELLHTFSTDIASVTLVPGTGGIFTIDVDGQQIWERKQDGGFPDAAELKRRVRDVCFPEKPLGHVDKGDQKG

SEQ ID NO: 10007 - protein, 401 aa, Klebsiella pneumoniae
TMTYRHRVATVFLFGFFLDLINMFIASIAFPAISRALAVSVSQLAWVSNAYILSLTVVVPFSAWLSERWGAKRLFLLSLGLFSLGALAAGLANSLSELILWRTLQGMGGGLLIPLGQALTWPLFQPHERAKLSAAVMLVGLLAPACSPAIGGLLVEAFSWRWVFFASLPVALLTFVLAVRWLNDTPGPVRPTRFLPLSLLADPLLRFAMLIYLCVPGMFIGVNVVGMFYLQRVTGMAPGAIGALMVPWSLASFAAITFTGRYFNRFGPRPLVVIGCLLQAMGIMLLLKIDADSPLALLILAFTLMGGGGSLCSSTAQSSAFLHTPAEEMPDASALWNLNRQLSFFAGSALLALLLRVFPPAYAWQGVFISAAVITLLPLLFCLRLNNRAIIHRLHTTLEKS

SEQ ID NO: 10008 - protein, 762 aa, Klebsiella pneumoniae
ADEYRETSPYGAGLVSQGMNGVQIRIRGKVQGVGFRPFVWQLARAQARCGDVCNDGDGVLVRLVGGDDGFTAALADHCPPLARIDSTACIPYRWAATPQDFTIRESGAGRMRTQIVPDAATCPACLAEMNDPRARRYRYPFINCTHCGPRLTIIRAMPYDRPFTAMAPFPLCSPCEAEFRDPADRRFHAQPVACPDCGPRLEWRAEGEALDGEAALQAAIARLAAGDIVAIKGIGGFHLACDAGNPAAVAMLRARKHRPAKPLAVMLPTATGLPAAAAALMGSPAAPIVLIAKAQVSGLCDEIAPGLAEVGVMLPSNPLQHLLLQGLARPIVMTSGNLSGRPPALSNAQALNDLADIADGFLLHNRDIVQRMDDSLVRSSGEMLRRARGYVPDALPLPPGLGDIPPLLALGADMKNTFCLARGSEAVLSQHFGDLGEEGVEQQWRSALQLMQSIYAFVPQRVVVDAHPGYRSTQWAASLPLPLETVLHHHAHAAACLAEHRWPLDGGDVIALTLDGIGMGENGALWGGECLRVNYRECEHLGGLPAVALPGGDLAARQPWRNLLAHCLAFVPDWQDYPQAATLRQRNWPLLAQAIERGINAPRASSCGRLFDAVACALDCAPESLSYEGEAACRLEALAASCPGVSHPVTLPLRDDALDLATFWRQWLSWQATPAQKAWAFHDALACGLAAMARDCATVRGIDTMVCSGGVLHNRLLAARLTFYLADFTLLFAQQLPAGDGAIAYGQAVIAAARGQAQGIQP

SEQ ID NO: 10009 - protein, 281 aa, Klebsiella pneumoniae
FSPLRISMLATTDLWFRYQDEPVLKGLTLDFSRHAVTGLVGANGCGKSTLFMNLSGLLRPQQGAVLWQGEALNYSKRGLLALRQQVATVFQDPDQQIFYTDIDSDIAFSLRNLGVAEEEIARRVDEALTLVDALGFRQQPIQCLSHGQKKRVAIAGALVLQARYLLLDEPTAGLDPRGRAQMIAIIRRIVGQGRRVVISSHDIDLIYEVSDAVYVLRHGEVLAAGDPGEVFACAETMDRAGLTQPWLVKLHSELGLPLCKTEAEFFQRMHNNAIGAIKEAS

SEQ ID NO: 10010 - protein, 321 aa, Klebsiella pneumoniae
PSRYLLQRLTPMSDITIVVDCNDADFARDICAALQQFPDVTALLPHHQAARDAQYASCWFPDPQLLTRSPGLKLIQAASAGVDHLPPALFASEIPLCRVIDEDFRHGMFEYALWSVLWFQRHFDRALAHQRTQTWKLYPQRAAADFHIGIMGLGEIGGYIADQLARLGYRVSGWSRSEKQLAGVTCYRGEEALDSFLGSLDGLINLLPLTAQTRGILAAPLFNRLPAGAVLINCGRGEHMVNEDVLAALESGQLAGAVLDVFPQEPLPADDPLWRHPQVVITPHMASAASAEVIARQLLENIQRQRRGLPLKNLVNKHAGY

SEQ ID NO: 10011 - protein, 532 aa, Klebsiella pneumoniae
NSRYDNAYCQNDNGAAMSFSVDELARIAIDLQSDIGHTDRFSRLITTLRQILGCDASALLRYEAHQFVPLAIDGLAQDVLGRRFALEGHPRLEAIARAGDVVRFPADSDLPDPYDGLIPGHESLKVHACVGLPLFAGQTLIGALTLDGMDADRFDSFSDEELRLIAALVAGALNNALLIARLEAQNVLPAQAVNYPLPERQEIIGLSGPMLQLKKEIDIVAASDLNVLISGETGTGKELVAKAVHQGSPRAANPLVYLNCAALPESVAESELFGHVKGAFTGAISNRSGKFEMADNGTLFLDEIGELSLALQAKLLRVLQYGDIQRVGDDRSLRVDVRVLAATNRDLRQEVVEGRFRADLYHRLSVFPLSVPPLRERESDVVLLAGYFCEQCRLRMGLARVILAEAARNRLQQWSWPGNVRELEHAIHRAVVLARATQAGDEVVLEPQHFQFAVAAPMLPTETAAAAPATGNINLREATDSFQREAISRALEANQGNWAATARALELDVANLHRLAKRLGLKGSPPGKSSAG

SEQ ID NO: 10012 - protein, 321 aa, Klebsiella pneumoniae
KRRYAGRRSQIRRTQKAGEMADHPRGDGFCPSGYDQSGDRWQQSDLHRQRPDDHPARLRAVNHGDVLVIGGTSDARAICQQLDAADVRYTLSVATPTGERLAGDIRGQIRCGRMEWQQMAEWLRAQRTRWVIDASHPYAEVVSQNIVRACASVGVLLSRYQRPEQLSDLRHPLLHVVGDLNEACAVARRFGERILLTTGSKDLAAWRAGLAEKTLLARVLPVPEVVQHCSDLGFGVGEIFALCGPFSAEFNAAFYRQCRADVVVTKASGAEGGYQEKVQPCLDAGIPCIVITRPAPLVTGDELLQSQADFTARLTRWLSAT

SEQ ID NO: 10013 - protein, 691 aa, Klebsiella pneumoniae
AMSYTPMSDLGQQGLFDITRLLLQQPDLAALSETLTRLVQQSALADEAAIILWNAGNHRAARYACDEAGHPVSYEDETVLAHGPVRRLLSRPDALHCDHETFADTWPQLIRSGLYRPFGYYSLLPLAADGRIFGGCEFLRRDNRPWSEKEFQRLHTFAQIVAVVTEQIQNRVSNNVDYDLLCHERDNFRILVAITNAVLSRLDIDELVSEVAKEIHRYFRIDAISVVLRSDRKGKLNIYSTHYLDASHPVHDQSEVDEAGTLTERVFKSKEMLLLNLHEHDTLAPYEKMLFEMWGNKIQTLCLLPLMSGNTLLGVLKLAQCDEQVFTTTNLKLLRQIAERVSIAIDNALAYREIQRLKERLVDENLALTEQLNNVESEFGEIIGRSEAMNNVLKQVEMVAHSDSTVLILGETGTGKELIARAIHNLSGRNGRRMVKMNCAAMPAGLLESDLFGHERGAFTGASAQRIGRFELADKSSLFLDEVGDMPLELQPKLLRVLQEQEFERLGSNKLIQTDVRLIAATNRDLKQMVIDREFRSDLYYRLNVFPIHLPPLRERPDDIPLLVKAFTFKIARRMGRNIDSIPAETLRTLTRMEWPGNVRELENVIERAVLLTRGNVLQLSLPERDIVEAPRTPAVLPEEGEDEYQLIVRVLKESNGVVAGPKGAAQRLGLKRTTLLSRMKRLGINKDELV

SEQ ID NO: 10014 - protein, 92 aa, Klebsiella pneumoniae
TMHLARVTGAVVSTQKSPSLNGKKLLLVRRVSADDDRPILPTSGDEVAVDSVGAGVGELVLLCSGSSARHVFSGPNEAIDLAVVGIVDSLSR

SEQ ID NO: 10015 - protein, 81 aa, Klebsiella pneumoniae
YHIHKVRIYSFHTLQHNVTIITHAIRRLMKDRAMSILSTDYAQATGRFSLKIRFSSHVKAVNRTSSESFPQLSHFSVDNMV

SEQ ID NO: 10016 - protein, 172 aa, Klebsiella pneumoniae
ILPHPFPTPGESLMRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKMLPHIPQMRVFIAEDLGCHMDDVNVKATTTEKLGFTGRGEGIACEAVALLRKADK

SEQ ID NO: 10017 - protein, 170 aa, Klebsiella pneumoniae
FADLVQQQRPPFRGFKPAGLSLLRAGEGAFLMAEQFGFGEALGQRAAVNGQKRLLATGAVMMEIAGHHLFAGAGFAHDQHGRLRWREFVQQALEGLRRRVDQRGSGGRGFWVQHSGPPIVDALNLSCGGRRNQRGKARGCCKCASGCAAAARFATARRGEAVFSALILKD

SEQ ID NO: 10018 - protein, 425 aa, Klebsiella pneumoniae
RAAQRRRDSAAGKRSRAVTSASCGLPFTGQAVYLLAPLRLLGVPLAALAVELGNLGAVFSEQFDAGDVSVRSRLAGHPHFIDALFAQMQGKSSIEDIQPAAHGGQLFQGAGKDLHAAAIADENHDFIALLAHRLQQRRQRMAIHAAGEVVAHQTEGLLAGKLIFTQQTEELVNVGHRAPVVLQGGAIGGIGIFHRLQRAQGQRCRRRHPIFRDQGLPGRHVGLRGRIDFQQGVAVVVEKLDALTAIIVQMEGAGPLAEEQTQVERARVQHQPGVAAEVLVRELAHLLMHGILVAADAFGFADALQGGNQRPGVIAQAHGIMAEAGGGQLGFADPHFRGDIAGIFRGTGRFGGLVALPQVRVCIWHNHILLDDEYPRPAGRGQVRYYSGNQKSTLTPSCQVRPGITASALSLASWLVPVSILRLLR

SEQ ID NO: 10019 - protein, 499 aa, Klebsiella pneumoniae
RCHHSFCLRRQYVKDIFAKRTLRAEEIVRHFAPRRTRLYILIRFAFRRVIDPLAHAALHHGTEIGGRGRGTGAVLWFRRCRCFSNRQRREGPLASDVATVLAAQLQRVDIRAPFGFQAQRHLKAGILQAGGQAVYRAAAPAVRAKGAGAFIAKTQPGHLFHQPGDFRHHHVVHGGRADKYAFRAENIGEDVVFVAAGDVKDFHRYPWVNLGDPLGNGVRHHAGIIGHGVVKDGDAIFLIIRRPLEVFLDDLRRVIAPDHAVGGGNHLHRQVEAEDFSNFRRHQAAEGRQDVGVVALALFVQFSLVHFIVEQMFVAIVLAEGVVAEQHRVAGQVGHHAVRPVQHRRFHEDQLFTVTDVESIAGFHHVEVPLRMMMVAVDRVDGVGGAVDRRIRDLHHQFGQRAGMVLFGVVNDDIVEVGEVDFAAQVLYELAAEFMIDGIDQHVFLFADEIAVVAAAAQRFIFGAVEITHFPVTLANPKNVIFHHNRHSNLNQYSVFKLS

SEQ ID NO: 10020 - protein, 376 aa, Klebsiella pneumoniae
AKHQLTGARAVSTFLSQRGQGKSSRRRLLMCRGRCFAQGSRVGATFMSQNTLKVHDLNEDAEFDENGIEVFDEKALVEEEPSDSDLAEEELLSQGATQRVLDATQLYLGEIGYSPLLTAEEEVYFARRALRGDVASRRRMIESNLRLVVKIARRYSNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQGQGLNIEALFRE

SEQ ID NO: 10021 - protein, 145 aa, Klebsiella pneumoniae
EVNHDPGYRNFRTDQHRQGDGAGRRHAEKRERTAPALQNPLPREIPADARRRRRRRAAGNRRRHRARRGDAGGQPGAGQHSPQRTTGDQRSQRGRAAAGGGDRRNLERGGVHQRRRPRGESGQRHPGAGPYGVWYRRQMLHGGGG

SEQ ID NO: 10022 - protein, 467 aa, Klebsiella pneumoniae
RSCHLLLYRCRRARIAAVAGARVRRGQTRAAAEQFFAQGPLAVLLLKDVALLQLRHQQLDDVAEGFVSDGIGEVKAIDVRLFDPGLQFVRHGLRAANHQRTEAADPRPIGQGLHRPLAVRISGRKGLHRRLNGVGVQILQHLIRLILAEIDPRPAGEQRQRAFIADVLLIFLPLRLCLAVGVADNHRLQVEDQDAVRIAPRLSCPAANIRHRLLQQHLRRRCDEDAFGMAGGELFAAAGRPRLIQHRRALRGWLAEVDPRHGKELSLMVNGMDFPRIAEDLPLSVAQHRPILPASLQQLIDHLQILIGIVIAGVMVGLGLLADIARPALQIGGDDIPAHPPFGQMIERRQTTSEGVRMLKRQRGGQAEAQMLRHQRHWGDQSQRIVDRNLRRLADRRIAAAVQHVIDPQHVGDKQPVELAALQQPRQIHPVLQIFILPGAIPGMRPQARRLMADAVHIESVKTNFTL

SEQ ID NO: 10023 - protein, 306 aa, Klebsiella pneumoniae
PSGQPFTPHAGEPCMTTEQFELRKARRWPWLAALAVIILLAIAFWWWRGHTQSQQVVFGSTLKIHYEPAMAGEQRIIEYINQHIAPDYGLKLEAVGVQDPVQADRAVAEGQYAGTIYQHQWWLKQVVDANGFALSTTVPVFQWAFGIYSDRYSSVQALPNGATIVVPDDGANQGQALWLLQRIGLISLDPAVEPRTAKLKNIVGNPHQFVFKELDLLTMPRALNSVDAAIGYVSQFDAGKVPREKGILFPPAPRTFASQLVIGTPYLSQENIVKLKQAFSDPRIQTWLKTTDDPLVKDVLVPVSAE

SEQ ID NO: 10024 - protein, 537 aa, Klebsiella pneumoniae
QFIHYNYAYSNDFDRREVKLIPDVSQALAWLEKHPQALQGIQRGLERETLRVNADGTLATTGHPPALGSALTHKWITTDFAEALLEFITPVDGDIEHMLTFMRDVHRYTARQLGDERMWPLSMPCYIAPGQDIELAQYGTSNVGRLKTLYREGLKNRYGALMQTISGVHYNFSLPMAFWQAKCGVEDAESGKEAISAGYFRSIRNYYRFGWVIPYLFGASPAICSSFLQGKPTTLPFEETGNGMYYLPYATSLRLSDLGYTNKSQSNLGITFNDLHEYVAGLKRAIKTPSEEYAKIGLQKDGKYLQINSNILQIENELYAPIRPKRVTRRGETPSDALLRGGIEYIEVRSLDINPFSPIGVDAQQVRFLDLFMVWCALADAPEMSSDELLCTRTNWNRVILEGRKPGLTLGIGCESAQFPLAQVGKDLFRDLRRVAQTLDSIHGGQAYQQVCDELLACFDDPELTFSARILRSMIEEGIGGTGRALADRYRTQLREEPLEILSEDDFIAERDASVARQKKVEAEDSEPFEALLARHA

SEQ ID NO: 10025 - protein, 525 aa, Klebsiella pneumoniae
YTVQTPFTGEVAMTSIFSSAQRGQIIFFSLFTVGQHSGQFFSPDFGFRQILHRLAVVAAKVRRNRGGGVDNQFVGNACRAGAWVKFKDRHVRQLHQVSRRVNLRGERPHHLRQVERVDVFINHDHHLHIAEAVGSGHRPQAHRAGKTAVAFFGGDDRQQTMGVHGVDRLHLRKFGLQLLIQRYAGRRAHQIVNLGPRHTEVERFKNRFAAIRDFVDTHYRHVTTAGVVTGKFTERPLDLTLTPFNDPFEDHFRTPGHVKAGQRRGSDGIRALAQRASHLIFRLIVFQRRGAHQGNNRVVTEGNGDRQIFPTLFRFVQMQRDIVHRYRLQAELALAFYFHAVDTDVLLTEVIFIQRIARNDTGFIEVETAVTIVEAEQRQNIEQVDIIAINSIFCPRRVGAALWRHREVIPAANELINLLFHRRVRRQAQRDGMVLPRADGVHRHASVVKAANIIEPQRRGTVADASGRIGGRRQIGLSVHLFTDFQQLSLVIQRLQKAAQIIKSHYSISCANCSAVRKPFQRRAL

SEQ ID NO: 10026 - protein, 180 aa, Klebsiella pneumoniae
GHTQMDSSFTPIEQMLKFRASRHEDFPFQEILLTRLCMHMQGKLLENRNKMLKAQGINETLFMALITLESQENHSIQPSELSCALGSSRTNATRIADELEKRGWIERRESDNDRRCLHLQLTEKGHQFLREVLPPQHNCLHQLWSSLSTSEKDQLEHITRKLLSRLDQMEEEGVLADSLR

SEQ ID NO: 10027 - protein, 499 aa, Klebsiella pneumoniae
STAQVVPQGGDKGFQRRPLAQRRQRQGVFPQAPQQIFTEFSGADPLGQVAVGGADQGEIHRHAAAGAQRSDLFLLQDAQEAGLQRQRHIADLIKKQHPAVSLADFTDIAIFAGAGKRPRLVAEELGFDQRFRNGGAVNGDKFTAAPAAVPVQRAADILFAAAGFSFNAQGDAGVEQPQQLFAFARAGKGEMHGRRGAYRHPAAGGLPQAIVVAALRRGQRQRDADRRLRQRRKKRGKGELAKLRRAQAELAHRQPVAGGEDVVGKDQQQLLDAVEFVHLPVQAHQPLLRMQTLFHPQIFNLLCRRFYPAKGVLVGKIRRAGDIQHPGDASVRSLERHRRAVQILVAGKKVLTAIDLAAIVNRQRGADGVGPAPAFTPQIAGSQRHALGLLQRLGIAESMQHQAVGVGKDHHRLQVCDLARQGFHHRLRQLLQAAVAGEPVRQLAGAEAGKILGGGIQPVALAARPRIAQQGIRINLWCEKKGIACHRAPLGRCCCVAIL

SEQ ID NO: 10028 - protein, 514 aa, Klebsiella pneumoniae
RYHQSYRHPGAGSVWPRLSQSAPLERLAHGRTICTGDRIMAFDDLRSFLQALDDQGQLLKISEEVNAEPDLAAAANATGRIGDGAPALWFDNIRGFNDARVTMNTIGSWQNHAISLGLPPNTPVKKQIDEFIRRWDNFPVTPERRANPAWAENTVDGDDINLFDILPLFRLNDGDGGFYLDKACVVSRDPLDKDNFGKQNVGIYRMEVKGKRKLGLQPVPMHDIALHLHKAEERGEDLPIAITLGNDPIITLMGATPLKYDQSEYEMAGALRESPYPIATAPLTGFDVPWGSEVILEGVIEGRKREIEGPFGEFTGHYSGGRNMTVVRIDKVSYRSKPIFESLYLGMPWTEIDYLMGPATCVPLYQQLKAEFPEVQAVNAMYTHGLLAIISTKKRYGGFARAVGLRAMTTPHGLGYVKMVIMVDEDVDPFNLPQVMWALSSKVNPAGDLVQLPNMSVLELDPGSSPAGITDKLIIDATTPVAPDLRGHYSQPVQDLPETKVWAEKLTAMLANRK

SEQ ID NO: 10029 - protein, 410 aa, Klebsiella pneumoniae
KKCQPEGWHDYFTRTGLSLTFDLFTTVERRLLTQRFFDTNQLVVFSNAVRTAHRTSFDLACSGTNSQVGNGSVFSFARTVRDNSGVASVFRHLDSSQSFGQRTDLVELDQDGVSDAFFDAFFQDLGVGYEQVVTNQLDFVAQYFSLVSETFPVRFVQTIFDGDDRVLFGQLFQEVSELFRGERFVAFASQNVFTVFVEFRRRAVHRQGDVFAQLVACSFNRFSDNSQRFGVGTQVRRVAAFVTNGSVHAFGLQHFRQVMEHFRTHAYCFFQGRRANRLNHEFLDVDVVVSVLTAVDDVHHRNRHGVFARSAVQFSDVRVQRQAFGRSCCFGVRQKNGQDSVRTEVRFVFSTVQVDHDLVDASLIFSIFAQDCLSDRAVYRSNSFGYAFTQETGFVAIAQFQRFAGTSRST

SEQ ID NO: 10030 - protein, 463 aa, Klebsiella pneumoniae
FFRQPGRRLQHFPSPGLGVSGGFAPGENLRQAAAPFGARHNGLGEHLLVGIERQPPFRAGDRRVDQFAGHQRDAARRQDQRRVFELRALRFMHGHRPGGIMLRQTARLHRLDGAVGHQEPHPQLAVALQGDADIAVKQPQRAVVARYHDRSAIIPARVARQGDRPLAVEPLLQPLIDAAHAVRPLAQRAQQLEFTESGQHGLRFGPLAAQLQVALIALLSRAEHGFVLFGCAEGMKRDIVKRLAQRGLHLRARASVHRPRQAPDAGVTTEAIALLQQAQTVSQRARDSPLARRHRRTGQPGQLLRPRGGIARTRPGADIPQHRPRFYGGQLVAIAEENHPPVGRQRVDKPRHHRQVDHRGFIHHQHVQMQRVAGVIAHPLAAGLGAQQTMQRAGLGGNQRFLRVGQRQFSQRRAQRFGQTRRRFPGWRRQANTTARAVFNLDQRRQKLRHGGGLPGPGTAGDH

SEQ ID NO: 10031 - protein, 193 aa, Klebsiella pneumoniae
NLRHHAPTSGAPMLTLVTGGARSGKSRHAEALIADAPQVLYIATSQIFDDEMAARIQHHRDGRPAHWRTAERWQQLDELITPAIAPAEAILLECITTMVTNLLFALGGDSDPDGWDYAAMERAIDDEIGVLIAACQRCPAHVVLVTNEVGMGIVPENRLARHFRDIAGRVNQRLAATADAVWLVVSGIGVKIK

SEQ ID NO: 10032 - protein, 98 aa, Klebsiella pneumoniae
GRSHRRQTPDARRGTAHRHGLPELQPVPPPHGARQRDAGPALSPAAGPAGRPRAGPGAARPRRPAGPCPQVPRTALRRPAAARGDRPGAGAEAGHYAV

SEQ ID NO: 10033 - protein, 202 aa, Klebsiella pneumoniae
RPGLRHHGAGHYACKRLIMTQAIGILELTSIARGMELGDVMLKSANVQLLLCRTLCPGKFLLMLGGDVGAVQQAIAAGTARAGEMLVDSLVLANIHPSVLPAISGLNVVGQRQAAGIVETWSVAACISAADRAVKAANVTLVRVHMAFGIGGKCYMVVAGDIADVDNAVTVASDSAGEKGLLVHRAVIPRPHDALWQQLMEG

SEQ ID NO: 10034 - protein, 313 aa, Klebsiella pneumoniae
KSKQPASLQRERGLINVLPHVGLYVPVFKNRMNALARAADTVTDAAGHSGMKNDNFKDGEMRLTVGLALTLAIMTCGAQARDMQSIEHSGELKVGVPGDYAPLAFRNAAGELQGYDVDMARDLGRTLGLKVSFVYTSWPALAADLQADKFDIAMGGVTETPARAQAFALSHPVVANGKIALANCQAAPRLGSLEKIDRPDVKVVVNPGGTNQSFVDEHIKQAQIIRVQNNVDNLQALRQKTADMMVTDLIEGDYYQSKEPGVFCVANETPFAGTASNKVYMMSKDNPALLKKVNQWLDSQDKEVLKRKWKIRG

SEQ ID NO: 10035 - protein, 241 aa, Klebsiella pneumoniae
RSLFNQRYCPMPAIAPLASPPQSQEQLLAQARQLAGYSLGELAALAGIPIPRDLKRDKGWTGILLELWLGASAGSKPEQDFAALGVELKTIPIDSRGRPLETTFVCVAPLTGNSGVTWESSHVRHKLQRVLWIPVEGERTIPLAARRVGAPLLWSPDEDEERQLRMDWEELMDLIVLGEVERITARHGEVLQLRPKAANSKALTEAIGARGETILTLPRGFYLKKNFTAALLARHFLLQHD

SEQ ID NO: 10036 - protein, 187 aa, Klebsiella pneumoniae
LPLLMQRYTLRTSKQAAQKRYTNAHFSALMTSFSRSTPMFSAHSRLRHAVADTFAMVVYCTVVNMMIEIFLSGMTFEQSLSSRLVAIPVNIIIAVPYGIYRDFAMRQARRISPARWMKNMADVLAYVTFQSPVYVAILWSVGADWHQIVAAVSSNLAVSMMMGAAYGYFLDYCRRLFRVAPYQQAKA

SEQ ID NO: 10037 - protein, 183 aa, Klebsiella pneumoniae
VISHRGGVKAGCTCLWMNMVRRPQEKFSRTSREHQCSGTAAKRTGSTVYTVLPFFISPADLLSCARFLTHRGFPMTLHDSVRDRLRAIEALLRETEHWQETAPDSSAFASDKPFCLDTLEPLEWLQWVLIPRMHQLLESGQPLPQNFAVAPYYEMALDQAHPVRESMLAELLLLDALFAGEQA

SEQ ID NO: 10038 - protein, 92 aa, Klebsiella pneumoniae
QRSHQHSACCSAICSSHPSASVPRQTSSKQKVRALASTQENAPTLSHTPVTRRAPACCACCSIISSARWLRVISCIVASVSRCAFYAITMPE

SEQ ID NO: 10039 - protein, 391 aa, Klebsiella pneumoniae
IMTQQAPDKINVFWFLPTHGDGRYLGTTEGGRPVDLPYLQQVALAADSLGYYGVLIPTGKSCEDSWLVASALAPLTRRLRYLVAVRPGLQPPTLAARMAATLDRLSEGRLLINVVTGGDPVENKGDGIFLSHSERYQVTREFLDIYTRLLRGEKVDYHGEHIHVEGAEVLFPPVQENGPPLYFGGSSDAAIDVAAEQIDSYLTWGEPPELVAEKLAVVRERAAARGRTLQYGIRLHVIVRETEEEAWAAADRLIAHLDDDTIAQAQKIFARMDSAGQARMSALHQGSRDNLRIAPNLWAGVGLVRGGAGTALVGNPQQVAERIREYQALGISNFIFSGYPHLEEAHRFAELVMPLLPLENGASSKARSVNTGPFGETIGGDKRPVRQVSAS

SEQ ID NO: 10040 - protein, 516 aa, Klebsiella pneumoniae
DNKHCATGVSMAFDWGYFFSLFSIGAFWQACVTVIVISTLSWGIGLVVGFLLACAKLSAPRWVKIPVELYIWFFRSVPLMVLLVFVYNLPQLFPVTQPLLGVPFIAGLVSMTVTEAAYMAEIHRGGLLSVAKGQSEAGHALSFSFIGIQRLIVIPQAFRISLPTLINEYITIIKLSSILSVVSLPELLLTGQRLYAQNFLVMETLLAVAVYYVMVVTVFTWLFRALENRLDIQRKRPQTLSEAECQALRQSLPALSEESNTPAVNGAPPALDLRGIHKSWGQHEVLKGIDLQVENGEVISIIGPSGSGKTTLIRTINALESLDGGEIILYGEDYLKGGAIVDKRQMRAGVRRIGMVFQSFNLFPHRTVLDNVMLAPRYHQLLDQPVAREQALALLDRVGLLAHAHKYPGQLSGGQQQRVAIARALALKPDIMLFDEPTSALDPELVGEVLKVIQSLAREGMTMLIVTHEMDFALSISDRVVLMENGVVQADIAPQVIRSPLEAPSLQRIREFMGVR

SEQ ID NO: 10041 - protein, 522 aa, Klebsiella pneumoniae
GLEQALHAVYRYHHGAVRDQQNPAGPLWRRMPLLYQRPAGGARGAKPGDDPLDGGGGYCGAGARGESVRLRQCANRTVSPAGTSRDRHRRRGGGAGRVRRRRGVESGAQRERPAGHRRARPQRGKQRGGSDCERSALPPAGGAMSDQTFDAPVWHHGKALRKGYTTGSCATAAAKVAALMVMRQHLIHQVSIVTPSGVTLCLNVESPHVEGQQAVAAIRKDGGDDVDATHGMLIFARVTLNDSGEISLQGGEGIGTVTRKGIGLPTGSPAINRTPRHTIETAVREAIGPTRGAQVEIFAPEGALRAQKTYNARLGILGGISIIGTTGIVTPMSEESWKRSLSLELEIKRAAGLERVVLVPGNHGERFVREQMGIDPQMVVTMSNFVGYMIEEAVRLGFHQIVLIGHPGKLIKIAAGIFHTHSHIADARMETLVAHLALLGAPLPLLTLVSECDTTEAAMEHIDAWGFQRLYNHLAERICQRVLEMLRFTQQPPTCDAVLFSFDNQVLGSSRPLAAIARELTC

SEQ ID NO: 10042 - protein, 403 aa, Klebsiella pneumoniae
TGLNKALNGPLFYLIVVYFCPPRIPQTNHNEIAFMTTLLITGVTGFLGGAALEKILHQETRLDLLLLVRADSPEAGLERVKENMRKFNIAEEKLAMLRQQHILLGDLASPEHFLNDPRLDQVTHILNCAAVASFGSNPLIWKVNVEGTLRLAQRMAQVTGLQRFLHVGTAMSCSPEPDSLVAESAEFRERAEHLVEYTHSKSTIEQLMQQQCPTLPLVIARPSIVVGHTHHGCRPSSSIFWVFSMGLMLQKFMCSMEDRIDVIPVDYCADALLMLLNQPLAHGEVVHISAGEENSVKFAEIDRAMAQALEQAPVGDKYAQVSYETLVKMRRELKGIFGPCNERLMLKAMRLYGAFATLNVRFSNDKLLSMGMPKPPRFTDYIDRCVETTRGLSIPQQMAVDFK

SEQ ID NO: 10043 - protein, 355 aa, Klebsiella pneumoniae
IILNLHSNPLEVIMRRLSDTLFLTWLSVLFMLSAFPAQALTCKTTSSTISEVVNIESIIKVSSSELIANKKIWVSSPITATFSCEDTDNFPNGESAYFWLDPENKASSLPNFIQVGITYNGIDYLLQNKKSVEIGPATLCDKSGNTCKSPAIGQTFSLVYQVYIISTGRSVTGDGKIDDNLKLSLFQVDGQGGLRNGTAGANYNLFITGLNRIRTMACVPTVSISPSEINFGDIPAGNARPGYYEKTRPFTVTYGLVKQGNGSDCGTEAMLATFSTTNTIQESAIILPQPDSGFGIVISPNASMLPRIEMNAPIHFTLATGTTLASTYTAGLLWLSRTPKLGPFSATAKITVTFE

SEQ ID NO: 10044 - protein, 1059 aa, Klebsiella pneumoniae
LIPNQRIQDMDFSRFFIDRPIFAAVLSILIFITGLIAIPLLPVSEYPDVVPPSVQVRAEYPGANPKVIAETVATPLEEAINGVENMMYMKSVAGSDGVLVTTVTFRPGTDPDQAQVQVQNRVAQAEARLPEDVRRLGITTQKQSPTLTLVVHLFSPNGKYDSLYMRNYATLKVKDELARLPGVGQIQIFGSGEYAMRVWLDPNKVAARGLTASDVVTAMQEQNVQVSAGQLGAEPLPQESDFLISINAQGRLHTEEEFGNIILKTAQDGSLVRLRDVARIEMGSGSYALRSQLNNKDAVGIGIFQSPGANAIDLSNAVRAKMAELATRFPEDMQWAAPYDPTVFVRDSIRAVVQTLLEAVVLVVLVVILFLQTWRASIIPLIAVPVSVVGTFSILYLLGFSLNTLSLFGLVLAIGIVVDDAIVVVENVERNIEEGLAPLAAAHQAMREVSGPIIAIALVLCAVFVPMAFLSGVTGQFYKQFAVTIAISTVISAINSLTLSPALAALLLKPHGAKKDLPTRLIDRLFGWIFRPFNRFFLRSSNGYQGLVGKTLGRRGAVFAVYLLLLCAAGVMFKVVPGGFIPTQDKLYLIGGVKMPEGSSLARTDAVIRKMSEIGMNTEGVDYAVAFPGLNALQFTNTPNTGTVFFGLKPFDQRKHTAAEINAEINAKIAQIQQGFGFSILPPPILGLGQGSGYSLYIQDRGGLGYGALQSAVNAMSGAIMQTPGMHFPISTYQANVPQLDVQVDRDKAKAQGVSLTELFGTLQTYLGSSYVNDFNQFGRTWRVMAQADGPYRESVEDIANLRTRNNQGEMVPIGSMVNISTTYGPDPVIRYNGYPAADLIGDADPRVLSSSQAMTHLEELSKQILPNGMNIEWTDLSFQQATQGNTALIVFPVAVLLAFLVLAALYESWTLPLAVILIVPMTMLSALFGVWLTGGDNNVFVQVGLVVLMGLACKNAILIVEFARELEIQGKGIMEAALEACRLRLRPIVMTSIAFIAGTIPLILGHGAGAEVRGVTGITVFSGMLGVTLFGLFLTPVFYVTLRKLVTRRKPVQEDLPA

SEQ ID NO: 10045 - protein, 798 aa, Klebsiella pneumoniae
ADTNNDQGVATMYKSTPSAAWCKKRLLVTSLFAAIYQTSAIAADTSAVSGEAVDDTSEQMTVTAPAPVQKAGSEHSISARELENKGANDFGSIMRYEPLISATGASGGSGNGKSGFDRGGYTGYNIRGMESNRVGIDVDGIAQPNATGRGYVGRAGLNTFGIGRDYIDPYMYGSVDIQSGATSTETANSAIGGNVSFRPKSADDYLRPGKTSAFGYRSGYDSADRSWHNGVTVAGGDEFLRGILVYSRRDGQETENNSGTVDAYPANWHSDAFLASGIWQPNDEHKLTSTFDYYHKTNHTHYDTWDSSGNSTIGTANQTSQTRRWGLSLKDDWTPMNDYLDSVSTKIYYQHTEAHDWTYMPDSVTRKMQTVNSNYDTDTWGLQTALAKTLGRHDLSAGFNASTSKTQRPFSQSPIPSVYSEIMQPEADSRSYTLGGFVQDKINFDLDSHNFAVIPGVRVVHQSTKPENLSDLAANSSVLSESSVANLYGKNSDTQVLPSLTFQYDLTPRLMTYLQYQRGAQFPNASQLYGSWNLGSSYAGSQQYALIGNTDLKTETSDNLEWGLKGEVTEGITLRTALFYNSYKNFIAYTRYTRANNPGQFTNVPSNIYTIYQAENRDKAYIYGGEISTKFNFGTWFEQVDGLSATLALGYSEGKSKSSYSGDKYVDLDSVAPMKAIVGVAWDDPAKRYGTALTATFVKGKQATATNRESYSNSGSAITDASSDYMRVPGYGMLDWTAYWQVAKNVRLNGGVYNLTDRKYWDYLSSRNIETGTNQDANDKALAVMPGRTWQLGVNVDF

SEQ ID NO: 10046 - protein, 212 aa, Klebsiella pneumoniae
FKYKVRTRTKVMRSGMKLIIGMTGATGAPLGVALLQALRDMPEVETHLVMSKWAKTTIELETPWTAREVAALADFSHSPADQAATISSGSFRTDGMIVIPCSMKTLAGIRAGYAEGLVGRAADVVLKEGRKLVLVPREMPLSTIHLENMLALSRMGVAMVPPMPAYYNHPETVDDITNHIVTRVLDQFGLDYHKARRWNGLRTAEQFAQEIE

SEQ ID NO: 10047 - protein, 61 aa, Klebsiella pneumoniae
EIDNDAASSRQDQCLLVLTYPRRWPLSGYHRGWTPGRFTLSAAGGAGSRQPGLLRRADPHR

SEQ ID NO: 10048 - protein, 148 aa, Klebsiella pneumoniae
TIGNKFGAPTIRPAATERYYQILKRQRHRGVPVARSTGFDMRNTQNLSIIRSEPPPAIGDETTWSLSGAAVGFISWLLALGIPFLLYGSNTLFFLLYTWPFFLALMPVAVVVGIALHSLLNGKLLYSVSATILTVGLMFALLFLWLLG

SEQ ID NO: 10049 - protein, 100 aa, Klebsiella pneumoniae
AMTNTLGYKQSWHHILLNLSLADIHNFNPTLSLSVFLTQGAVTLWLWHLYPSYFKLHVCWLSSLTPVTYLSKLLGIRCVAAFLQLELFRVNAFIVITVLR

SEQ ID NO: 10050 - protein, 103 aa, Klebsiella pneumoniae
PSKKEHRVKQSLGLLEVSGLALAITCADAMAKAAAITLLALEKTNGSGWMVVKIAGDVASVQAAVMTGAELAERQQGLVAQKVIARPGGRPAAGPRPGAFTSA

SEQ ID NO: 10051 - protein, 194 aa, Klebsiella pneumoniae
IMKKQPRFITILIGALLSGVALQATAANTINPDSGTSSEGAGGQVIFNGSITDSSCNVDSSSNGQKVDLGKWASNYFTGTGFETTKTPFHIKVKDCPASVTTVAVLFDGARDQSDNSLLAINGGASGVAIKLYEHDRSTAVSLGKTSAKQTVTPGTSGGTGSADLEFYADYISTAATVTAGKADGTANFNMIYN

SEQ ID NO: 10052 - protein, 450 aa, Klebsiella pneumoniae
RGKKIMIKLKHSIPLALLSLAGASSPACADPKYDFALHGYIRSGILANSDGNRADSVGLMPDGKWRLGNEEDTKIELIPTVTLTADSGVVAKVQANLTHQSKCTSDWNCQDDDGHDVQFREGFAELSNLDFAPEMTFWAGKRYSSSNTSSHQFDWEYIQYNGTGGGFDNMDLGFARFDAGVYAFSPTDETKAYPVDKGDQGYPDDYSLNLWLKKIAGTGFDLELIGHHMNRNENHPTSAEKGYGVTGIYNFDGFYGLTGGYSRLALQYGKGLAAGDSLGKNGWGWANLENTQSWRVVLDSVASMGDLEISTFAFWQKDKNYRWWTEDENGWGRSMWVAGIRPYHQITRNFAMQYELGYEYLDDKNYKGVNGKGKGGLTKVTVAPTLTFDSGFWARPQLRFFVTYAKWDKGVSDALDGNYNWDTNTITAGGYSRSGSTDTVNFGVQAEVWF

SEQ ID NO: 10053 - protein, 259 aa, Klebsiella pneumoniae
TPMKPRQRQAAILEFLQSQGKCSVEELAQHFDTTGTTIRKDLVTLENAGTVIRTYGGVVLNKDEADPPIDHKTLINTHKKAQIAEAAVRYIHDGDSIILDAGSTVLQMVPLLSHFNNITVMTNSLHIVNALSEFDNEQTILMPGGTFRKKSASFHGQLAENAFEQFSFDKLFMGTDGIDLNAGVTTFNEVYTVSKAMCNAAREVILMADSSKFGRKSPNIVCGLERVDKLITDADIDPGFQRALEAKGIEVIITGEHHE

SEQ ID NO: 10054 - protein, 367 aa, Klebsiella pneumoniae
DTMKGRWAKYVATGAMLAMLAACSSKPTDRGQQYSDGKFTQPFSLVNQPDAVGAPINAGDFSEQVNQIRNASPRLYNSQSNVYNALQEWLRAGGDTRTLRQFGIDAWQMQGVDNYGNVQFTGYYTPVVQARHTRQGEFQYPIYRMPPKRGKLPSRASIYAGALSDNYVLAYSNSLMDNFIMDVQGSGYIDFGDGSPLNFFSYAGKNGWPYRSIGKVLIDRGEVKKEDMSMQAIREWGEKHSEAEVRELLEQNPSFVFFKPQSFAPVKGASAVPLIGRASVASDRSIIPPGTTLLAEVPLLDNNGKFNGQYELRLMVALDVGGAIKGQHFDIYQGIGPDAGHRAGWYNHYGRVWVLKNAPGAGNVFSG

SEQ ID NO: 10055 - protein, 266 aa, Klebsiella pneumoniae
GTMKQYLDLMQKVLTEGTPKNDRTGTGTISIFGHQMRFNLQEGFPLVTTKRCHLRSIIHELLWFLQGDTNIAYLHENNVTIWDEWADENGDLGPVYGKQWRSWPAPDGRHIDQISTVMNQLKNDPDSRRIIVSAWNVGELDKMALAPCHAFFQFYVADGKLSCQLYQRSCDVFLGLPFNIASYALLVHMVAQQCDLQVGDFVWTGGDTHLYSNHLEQTNLQLSREPRPLPKLVIKRKPASIFDYRFEDFEIEGYDPHPGIKAPVAI

SEQ ID NO: 10056 - protein, 221 aa, Klebsiella pneumoniae
VMMKKIIAVAAFLLCTTAAQAGIVMGGTRVIYQEGKREAAISVTNADTHTPYLVQSWVENYAENDKARVPFIVTPPLFRLDPEQNNVLRINFIGASLPRDRESVFWLNVKSIAPTPQGEVNKLQVNIKSKFKIFYRPNDLAGDPAKAWQQLKFSQSGGRLTVINPTPYFVSFYAVEVGGQSIDDPGMVAPFGEKTWPVSGHGTVKWRAINDYGGVSDFAQQ

SEQ ID NO: 10057 - protein, 191 aa, Klebsiella pneumoniae
SSMKDELFLRGAQVPMTKEAVRALALAKLELHRARHLIDIGAGTGSVSIEAALQNPALRVTAIERQADALRLLAENRQRFGCDNIAIVAGVAPLAVADKADAIFMGGSGGHLTALIDWSLAQLHPGGRLVMTFILQENLHSALAHLRQSGIHEVDCQQLAVSTLATLGSGHYFKPHNPVFVIACQKEENHG

SEQ ID NO: 10058 - protein, 89 aa, Klebsiella pneumoniae
RVTNSINSRKERRMKMTKAAAIISACMLTLGLSACSSNYVMHTNDGRTIVTDGKPQTDNDTGMISYKDAWGNKQQINRSDVKQLGELDE

SEQ ID NO: 10059 - protein, 613 aa, Klebsiella pneumoniae
QGANNSFAYWNKRRMTTQAPPSNLLPLNPEQLARLQAATTDFTPTQLAWVSGYFWGVLNQQSGAAVAAPAPAAEVPTITLISASQTGNARRVAEALRDDLLAAKLNVKLVNAGDYKFKQIAAEKLLVVVTSTQGEGEPPEEAVALHKFLFSKKAPKLDGTAFAVFGLGDTSYEFFCQSGKDFDNKLAELGAERLLDRVDADVEYQAAAAEWRARVVEALKARAPVAAPAQLATSGAVNDIHTSPYTKEAPLTATLSVNQKITGRNSEKDVRHIEIDLGDSGLRYQPGDALGVWYQNDPQLVKELVELLWLKGDEPVTVEGKTLPLSEALQWHFELTVNTATIVENYATLTRSESLLPLVGDKAQLQQYAAATPIVDMVRFSPAQLDAEALIGLLRPLTPRLYSIASSQAEVESEVHVTVGVVRYEIEGRARAGGASSFLADRVEEDGEVRVFIEHNDNFRLPANPETPVIMIGPGTGIAPFRAFMQQRAADGAQGKNWLFFGNPHFTEDFLYQVEWQSYVKEGLLTRIDLAWSRDQQQKIYVQDKLREQGAELWRWINDGAHIYVCGDANRMAKDVENTLLEVIAEYGAMDAEAADEFLSELRVERRYQRDVY

SEQ ID NO: 10060 - protein, 494 aa, Klebsiella pneumoniae
RVENFRLGNILPVHPRDAGAVAVTADVQVIAARRFAHQSHFRQHRAAAAVRAAGDAGDDMLIAHAVLAHQPFHLVDKRRQETLGFRHRQRAGREGDAGHRVFALRGDGIHQAMIPRELLDPRLLIFRYAGDNQVLVSGDAEFALMDLSNLQQASLQRTTRIIENAAVFNKQRQVPLIINPLHPADAIAAAGKFVRADRLKLNACPALHFRFEGFDTDALKGVLGFRILTVGTVAPVALGGHNRFRHRQRMLQRQITEFARRAGVGFFVTMFDRETAAHQQVKAYQLAIFGNRHEVHVVSVQIDIVLRRDHHRGFKLTRQIGLAEDRLFVGSGDLFLIQPDLGISAGTRQQMLRDLFRPLVGLSVQLRLVRVGGAQHVTVHIVGGGQRVQPHRVQHLMHRLDVLFQNAVELKGLPVGQANTAVNGVFSGKLIDRLPLGGGDHPARQTAAEQHRMTRLQLLGGALRADIAIVLLVHAVETDQQEVIAFKTAGQTVV

SEQ ID NO: 10061 - protein, 459 aa, Klebsiella pneumoniae
KEFERQCTHPGALFVWSFSLTCTEENLMSKIVKVIGREIIDSRGNPTVEAEVHLEGGFVGMAAAPSGASTGSREALELRDGDKSRFLGKGVTKAVAAVNGPIAQAILGKDAKDQAGIDKIMIDLDGTENKSNFGANAILAVFLANAKAAAASKGLPLYAHIAELNGTPGKYSMPVPMMNIINGGEHADNNVDIQEFMIQPVGAPTLKEAVRMGSEVFHHLAKVLKSKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWEGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEQAPFNGRKEIKGQA

SEQ ID NO: 10062 - protein, 547 aa, Klebsiella pneumoniae
LSSESLALSGLRRVVSLADGVFTFLGPQLFFVSFEKWQVHHHGGGHTNEAQDHRAKAPVRRPRGADRRRRCPRRHRHYATDQVQLQREVRQGRVDHRHQHERQEKQRVHDDRRAEQNRFVDVKYARHDPHPADRPQMHGLAAQQHQRQRQGGADAADQQIVIPEALDIDVRDSGASGHGRLIDRQVGHPERVHDPGDDQRAVDPGEPQHLTDQHRQQDRRQRIGSRDQRLHQRHDRFRNDHPQLGFDKQVQRMQRQNDRQHRDQDFKRARHPGRHFRRQANGDVMPFEEGVQLGGIDGHQNGGKDPLTGEVGSRDLAIFQRRGYQQKRHQRQHPGGQRVQMMVFGEAGGDPDGDKQGHHPHAEVERQHQRIAMIERKLQPGAGKPPRRIRRKRREDKHQQERADDHKGQGSDKAIADRGDIFLLADRAGQRRDLPFDHVDQFSVQRAHDLSLVLVFDKGKGEIKDRGAFLHAVVHHIDGFDADTVFIRLFLQILLHVFHLRPQQHHLIMADLFGELRYAICVDLYRQAPLFGFRNHFFHQQAGGHAC

SEQ ID NO: 10063 - protein, 294 aa, Klebsiella pneumoniae
STPEEAAMELKCFRTLWGVTTPWPQTLDELQRVGCCGIEARVPLTVAERRQLADRLQASGLEYIAILFSGGGVLPAQHETPDQHLARLQTRFAEASSLNPRFVNLLAGNDRWPLAQQVDFLGKAHELAAGFGLTCSFETHRATSLYSPWLTLEIIQQLPQLRFTADISHWVVVSERLLDDPSDDFSAFIDRVHHVQARVGYDQGPQVPHPAAPEYQPALAFAERFWQQIWRSQRQRGYPQTTLTPEFGADGYLHHLPFTNVPVADLWSLNAWMAARQQAHFQQFLSLTEQEPQP

SEQ ID NO: 10064 - protein, 144 aa, Klebsiella pneumoniae
RKPEMLKTISPLISPELLKVLAEMGHGDEIIFSDAHFPAHSMGPQVIRADGLRVSDLLQAIIPLFELDSYAPPVVMMAAVEGDALDPTVEQRYRQALSAQAPCPDIVRIDRFAFYDRAQKAFAIVITGECAKYGNILLKKGVTP

SEQ ID NO: 10065 - protein, 242 aa, Klebsiella pneumoniae
MATEQHLRQQLAAAYRLAALFGWEDTLYTHFSVRLPGDGEPRFLINPFGMMFDEVTASNLIVVDMQGKVVAGDAPANSAGFTIHSAVHMAREDAHCVIHTHTLPGMAVAACEDGLLQLNQISTEFYQRVGYHPYEGVAFDLDERARIQRSLGNNIAMILQSHGLLSVGRTVADAFYIMYYLNRACEIQMAAAQLAALSPIHTIAPHLSQHACEQLMGVEHERQQVWQAWLRRLDRLDTSYKD

SEQ ID NO: 10066 - protein, 364 aa, Klebsiella pneumoniae
TAADDRRYGPAGLRAAHTAGDNRAEKQSGAVALMRPALARRLLLMTLLLVSLTLFATTLGAMRLPLVNLLPSGDDMLRHIWLTIRLPRVLLALLVGAALALSGCVMQGLFRNPLADPGLLGISSGAALAVASWLVLPFSAAGLIALYMPMLAAFIGSLAVMVVIFILSRAEEGSLSRLLLVGIAINALCGALVGVLSWLSNDAQLRQLSLWGMGSLGQAEWPTLLVAATLIIPAALAVWWMASRLNLLQLGDEEAHYLGVNVQALQRWLLLCSAVLVAVAVAISGVIGFIGLVVPHLMRLWLGPDHRGLIPGSLLAGAILLLLADTLARTVAAPAEIPVGLLTSLLGAPWFLWLVFRRENSRHG

SEQ ID NO: 10067 - protein, 126 aa, Klebsiella pneumoniae
ESADGHRSRSHRQSPARCRWRWSRARFHSTDCREPAPRAGPFAAPGYRREYAAPGRRGRKGSPPTAGLRPGATGLPPPAAPAAAGRGGWRAGPPARRRRGGENPRWRDPARSAGSETTNRSAGDSH

SEQ ID NO: 10068 - protein, 255 aa, Klebsiella pneumoniae
IMADQTNPWGSAPSTDSAAQAADAWGGASTAAPANGGGADWLHSAPAPQPEQFNIMDPFHKTLIPLDRLGDPRHRLDRAALPSAVPGDPRADRLHPQRLPAAAFGDAGAGGDYRLRANRLADLQPRHGGRHSGIADCHRRHRRVVASHGHSGAGPHRPAVLHGYRLAAGDLASAQPAGGENHPPAIRCHADHAGVRLSGADRDAVRHRQRTGRGGDDYLRPAADRPSDHPRDKPGACGSDRSVALIWRQPAPAAV

SEQ ID NO: 10069 - protein, 174 aa, Klebsiella pneumoniae; identical to SEQ ID NO: 9228

SEQ ID NO: 10070 - protein, 253 aa, Klebsiella pneumoniae
AGRDHYFGSNTLMLSVIGIGPGSQAMMTMEAVEALQAAEIVVGYKTYTHLVKAFTGDKQVIKTGMCKEIERCQAAIELAQAGHNVALISSGDAGIYGMAGLVLELVNKQQLDIEVRLIPGMTASIAAASLLGAPLMHDFCHISLSDLLTPWPVIEKRIVAAGEADFVICFYNPRSRGREGHLARAFTLLAASKSADTPVGVVKSAGRKKQEKWLTTLGEMDFAPVDMTSLVIVGNKATYIDNGLMITPRGYAL

SEQ ID NO: 10071 - protein, 209 aa, Klebsiella pneumoniae
LSPEDDPVNRFVIADSTVCIGCRTCEAACSETHRQHGLQAMPRLQVMRNEKESAPQMCHHCEDAPCATVCPVNAIQRVDGAVQLNESLCVSCKLCGIACPFGAIEFSGSRPLDIPANANTRLAPPAPPAPARVSSLLDWVPGVRAIAVKCDLCHFDDQGPACVRTCPTNALMLVDSRDIAQASKRKRQLTFNTDLGDLSLFQAQQGERE

SEQ ID NO: 10072 - protein, 415 aa, Klebsiella pneumoniae
PVRLPECRGISMIYKIMAINAGSSSLKFQLLNMPQGALLCQGLIERIGLPEARFTLKTSAQKWQETLPIADHHEAVTLLLEALTGRGILSSLQEIDGVGHRVAHGGERFKDAALVCDDTLREIERLAELAPLHNPVNALGIRLFRQLLPAVPAVAVFDTAFHQTLAPEAWLYPLPWRYYAELGIRRYGFHGTSHHYVSSALAEKLGVPLSALRVVSCHLGNGCSVCAIKGGQSVNTSMGFTPQSGVMMGTRSGDIDPSILPWLVEKEGKSAQQLSQLLNNESGLLGVSGVSSDYRDVEQAADAGNERAALALSLFAERIRATIGSYIMQMGGLDALIFTGGIGENSARARATICRNLHFLGLALDDEKNQRSATFIQADNALVKVAVINTNEELMIARDVMRLALPQARELAVSA

SEQ ID NO: 10073 - protein, 316 aa, Klebsiella pneumoniae
AQRDRGMTPGRPRLSPRFFPSPCLLLTFVTFPLTDADLHSFFASLLLCYNIKLRQGYVHIDFYGIRRGARGYRRRAAGGAMVSNLVGGDAAMIELEQLVAGYDGVAITPPLSGMICPGSLTAIVGLNGCGKSTLLKTLAGFLPPVSGRLRWQGKRPVIGWLAQRHALESQFPLNVQDVVSQGAWPGVSLLRGLGGGTRRRIGAVLERVGLAGLAKTPIEALSGGQFQRMLFARVMVQQAPLVMLDEPFTGIDEATSRELMDLILEMHRQGQTILAVLHDNQRVADFFPETLLLTPQRACWGATRAVLPAFSHVRSA

SEQ ID NO: 10074 - protein, 384 aa, Klebsiella pneumoniae
RTGDGGKMSDGIVIIGSGFAARQLVKNIRKQDAQIPLTLIAADSMDEYNKPDLSHVISRGQKADDLTLQSAGEFAEQYTLRLFPHTWVSDIDAENRLVKSHDNQWRYDKLVLATGATPFIPSVPGRELMLTLNSQREYGAAQSRLHDAKRVLIVGGGLIGCELAMDFCRAGKAVTVVDNSASVLAALMPPEASSRLQHRLTEMGVHLMLKTQLEGLEQTADGIRVSLDRQRAITVDAVVAAAGLRPETSLARHAGLQINRGIVVNSQLQTSDPAIYALGDCAEINGVVLPFLQPILLSAMCLSKNLLAQAGELKLPPMLVKVKTPDLPLHLAGDTRRDDLTWNIVAAKEGLVAKGVDAENQLRAFVVSEDKMKEAFALLKQLVS

SEQ ID NO: 10075 - protein, 120 aa, Klebsiella pneumoniae
MLGDFPPSSTVQGIIFSAAQARICRPTGVEPVNASLAIRLLVASASPASLPKPCTTLSTPAGNRSPISSSSRVMLSGVCSAGLSTTQFPAARAGASFHAAISSGKFHGIICPTTPSGSWK

SEQ ID NO: 10076 - protein, 244 aa, Klebsiella pneumoniae
PPAEITNRRPMAPVFLCPSHHPMGALSVTTGRRSFSPAPGHRWLRWAKLGRRSQKNVLLSSMQSFFAYLAGKAIFRRRARANRRGILDAMNREHGYTLMETLVTLTLMMILSVGGLYGWQCWQQQQRLWQTAVQVRDFLLFLRDDANAYNRDRVLRVGQDEVGWCLSAEGEGPDCASGTSFTLRPRWPGITLAGVTPGLGFYGLRSTAWAGNLRLQSAAGSWSIVISHWGRIRLCRSDSAGGCQ

SEQ ID NO: 10077 - protein, 219 aa, Klebsiella pneumoniae
DKKDSVSLCFYLSFEALIMANVLVLKSSINGETSLTNQLINEFLAARQAAGHGDRLTEHDLSAMALPTLDRPLFVALRGAVDPQPAIREAVALSDQLIAELKASDLLVIGAPMYNLNVPTDLKKWFDLVARARETFRYTESWPQGLVEGVRAVVVSSRGGIHQGETTDAVTPYLRAVLGLMGIQEVEFIYAEGLDNRPHGRDAGIASARAQIARLAVPA

SEQ ID NO: 10078 - protein, 410 aa, Klebsiella pneumoniae
CGRDEMLQGMKARRGGAVEGLFCLQTDCRFLVGRRMLYHNYPLLNLLNGIPMLKRRYLALLPLCVLLAACSSKPKTPAETEMASGTGGFLLEPQHNVMQMGGDFANNPAAAQFIDKMVAKHGFDRQQLQEILSQAKRLDYVLRLMDRQAPTGLPPTGPTGAWLRYKKQFITPDNVQNGVVFWNQYQDALNRAYQVYGVPPEIIVGIIGVETRWGRVMGKTRILDALATLSFSYPRRAEYFSSELETFLLMARSESDDPLELKGSFAGAMGYGQFMPSSYKQYAVDFNGDGHINLWDPVDAIGSVANYFKQHGWVSGDLVAVQALGQAPGLENGFKTKYSVSQLAAAGLTPTQPLGNHQQASLLRLDVGTGYEYWYGLPNFYTITRYNHSTHYAMAVWQLGLAVAQARGGY

SEQ ID NO: 10079 - protein, 263 aa, Klebsiella pneumoniae
KEREMNQVAVVIGGGQTLGEFLCRGLAAEGYRVAVVDIQSEKASRVAQEINAEYGEGMAYGFGADATSEASVTALAHGVDEIFSRVDLLVYSAGIAKAAFISDFALGDFDRSLQVNLVGYFLCAREFSRLMIRDGIKGRIIQINSKSGKVGSKHNSGYSAAKFGGVGLTQSLALDLAEYGITVHSLMLGNLLKSPMFQSLLPQYATKLGIDESEVEQYYIDKVPLKRGCEYQDVLNVLMFYASPQASYCTGQSINVTGGQVMF

SEQ ID NO: 10080 - protein, 97 aa, Klebsiella pneumoniae
STGERSMNNALGLVETKGLVGAIEAADAMVKSANVQLIGYEKIGSGLITVMVRGDVGAVKAAVDAGSAAASVVGEVKSSHVIPRPHSDVEAILPKSV

SEQ ID NO: 10081 - protein, 110 aa, Klebsiella pneumoniae
MQGEKSMKWFKAIPAFCATLLVTTALAGCAGSATKESTGGYIDDTVVTTKVKTALFNDKDIKSSEISVQTFKGRVQLSGFVSSAESAKRAVEVTRRVQGVRMVENDLRIK

SEQ ID NO: 10082 - protein, 471 aa, Klebsiella pneumoniae
RVLEVRGREPAGGRRQAMPRRERGKSGDDFVARNIGGAARKLHAVLGDEALQQIVHTAHHLRIAVQFVRTVLLNDLDAHLFDVPRDNPGEGTTQVGGQHFHRLIRGEFEVGHVLVGRIKRHLQVRRDANRPVKAIGVIGLATALFHQRHRFFHLPRHFRRVVNDDPVVATGRFAQGMGDKLVQYAEVVGALLRPGEDQRQHLRFVVGVHQNTQQVEQLFGSADAARENNDPVGDTYEGLQTLFDIRHDDQFIDQRVRWFRSDNGWFGHADKAAVFVALLRMADGGAFHRRLHCAKPAAGADIQFPQAQLRTDAAGVEIFVFVDGVAAPADDHVRRLADVQRAGVAQDREHQVSDMNRTFEIEVREANGIVDLAVNEQDIAQHGEQVGLQGADNPPVNEGVFRRVDQFQLHAAFAPQHVNLEIFETGQELLAVIGQAPRIEHSKRAVAKELVQVAAGGALKHIHFQLRQHIH

SEQ ID NO: 10083 - protein, 107 aa, Klebsiella pneumoniae
PCLEFSRRKTSHRNQGAPSRLVSRPTGISAGAATVRARVSASRSRIAPASSEPGISPRWSGPSHRRIRCGTTRPIKPMTPLMATATATSTALHSSSQRCSACTLTPR

SEQ ID NO: 10084 - protein, 159 aa, Klebsiella pneumoniae
AALERLPPGYDQSPAPLLYGGQRMSLIVYFSSRSENTHRFVQRLGLPAVRIPLNEREHLRVDEPYILIVPSYGGGGTAGAVPRQAIRFLNDVHNRQLIRGVIAAGNRNFGDGWGRAGDVIAQKCAVPYLYRFELMGTPDDINTVRKGVSEFWQRQPQNV

SEQ ID NO: 10085 - protein, 212 aa, Klebsiella pneumoniae
RVMDKQQLASTVNKVLDEMRQRPIPIGISSRHIHLAAADYARLFPAQPIQPKKALLQPGQYAAEQTVTLVGPKGRLNNVRLLGPLRQTSQVEISRTDARILGIAAPLRMSGNLQGTPGIRLISPFAELQLSGGTIVAQRHIHMSPLDALILRVSHGDSVAVAIEGSDRRLIFDNVAVRVAPDMRLEMHIDTDEANAAGADAAQAWATLVTKP

SEQ ID NO: 10086 - protein, 403 aa, Klebsiella pneumoniae
ASPDKGSGAASHAASCPAATFTGIKIMSLQKTWGNIHLTALGAMMLSFLLVGCDDSVAQNAAPPAPTVSAAKVLVKSISQWDSFNGRIEAVESVQLRPRVSGYIDKVNYTDGQEVKKGQVLFTIDDRTYRAALEQAQAALARAKTQASLAQSEANRTDKLVHTNLVSREEWEQRRSAAVQAQADIRAAQAAVDAAQLNLDFTKVTAPIDGRASRALITSGNLVTAGDTASVLTTLVSQKTVYVYFDVDESTYLHYQNLARRGQGASSDNQALPVEIGLVGEEGYPHQGKVDFLDNQLTPSTGTIRMRALLDNSQRLFTPGLFARVRLPGSAEFKATLIDDKAVLTDQDRKYVYIVDKDGKAQRRDITPGRLAERLPIVQKGLNPGDNVILDGLQKVFMPGLPG

SEQ ID NO: 10087 - protein, 269 aa, Klebsiella pneumoniae
NFQDCHRTQIDRLLGIMRRLRDPENGCPWDKEQTFATIAPYTLEETYEVLDAIQREDFDDLRGELGDLLFQVVFYAQMAQEEGRFNFDDICAAISDKLERRHPHIFGEASAGNSTEVLARWEQIKSAERAEKAQHSALDDIPHSLPALMRAHKIQRRCSAVGFDWTSLGPVLDKVHEEIDEVMHEAQQAVVDEAKLEEEVGDLLFATVNLSRHLGVKAEVALQKANLKFERRFREVERIVAARGLEMTGVDLDTMEEVWQEVKRQETDL

SEQ ID NO: 10088 - protein, 435 aa, Klebsiella pneumoniae
FLQEIQMETTQTSTIVSGETRSGWRKTDTMWMLGLYGTAIGAGVLFLPINAGVGGMIPLIIMAILAFPMTFFAHRGMTRFVLSGKNPGEDITEVVEEHFGVGAGKLITLLYFFAIYPILLVYSVAITNTVETFMAHQLHMTPPPRAILSLILIVGMMTIVRFGEQMIVKAMSVLVFPFVIALMVLALYLIPQWNGAALETLSLSGASVTGNGLLMTLWLAIPVMVFSFNHSPIISSFAVAKREEYGEGAEKKCSSILARAHIMMVLTVMFFVFSCVLSLSPADLAAAKEQNISILSYLANHFNAPIIAWMAPIIAMIAITKSFLGHYLGAREGFNGMVIKSLRSKGKSIEINKLNKLTALFMLITTWIVATLNPSILGMIETLGGPIIAMILFLMPMYAIQKVPAMRKYSGHISNVFVVIMGLIAISAIFYSLFS

SEQ ID NO: 10089 - protein, 297 aa, Klebsiella pneumoniae
WGKEMMKRSAIVVALALGLMAQGAMAKTLNVVSSFSVLGDIAQQVGGEHVHVDTLVGPDGDPHTFEPSPKDSALLSKADVVVVNGLGLEGWLDRLIKASGFKGELVVASKGVKTHTLDEEGKTVTDPHAWNSAANGALYAQNILDGLVKADPEDKAALTSSGKRYIDQLTSLDGWAKAQFSAIPLAKRKVLTSHDAFGYFGRAYHVTFLAPQGLSSESEASAAQVAALIKQIKADGVHTWFMENQLDPRLVKQIASATGAQPGGELYPEALSKPGGVADSYVKMMRHNVELIANSMK

SEQ ID NO: 10090 - protein, 67 aa, Klebsiella pneumoniae
SFKEQRMLILTRRVGETLMIGDEVTVTVLGVKGNQVRIGVNAPKEVSVHREEIYQRIQAEKSQQSSY

SEQ ID NO: 10091 - protein, 441 aa, Klebsiella pneumoniae
TDEDAMGNTTIPTQSYRAMESGQSKSYIIPFALLCSLFFLWAVANNLNDILLPQFQQAFTLTNFQAGLIQSAFYFGYFIIPIPAGMLMKKFSYKAGILTGLFLYACGAALFWPAAEVMNYTLFLIGLFIIAAGLGCLETAANPFVTVLGPESGGHFRLNLAQTFNSFGAIIAVVFGQSLILSNVPHQPQEVLDKMTPEQLSAWKHSLVLSVQTPYMIIVAIVLLVALLIVCTRFPSLQSDDHSDSAQSTFFASLTRLMRIRHWRWAVLAQFCYVGAQTACWSYLIRYAIEEIPGMTAGFAANYLTATMVCFFIGRFTGTWLIRRFAPHNVLAIYAFIAMLLCLLSAFSGGHVGLLALTLCSAFMSIQYPTIFSLGIKHLGQDTKYGSSFIVMTIIGGGIVTPVMGFVSDAAGNIPTAELVPALCFAIIFIFARFRSQAATN

SEQ ID NO: 10092 - protein, 461 aa, Klebsiella pneumoniae
VDREHVEPVVEIAAEFPVDNHLLEIAVGGGDQSNVGLNQLVAPQTFELLLLEDAQQFGLQFQRHIAHFIEEQGAFVRQFEAADTLGAGPGERAAFVAEQIALQQPGGHRGAVHLHHPPTVASAEVVDSAGDKLFAGAGFAEDQHGAVAVRHHLYLLEHIVHRLAAADNLPEFALDIIELLGEGEVLIHQPLFQALNFAVGEGVIDSDRHPLGDLPQQLEIGGGEDLFVALRQLKHPEQGIAGHQRQQAQGLDLIAPHLEEHFLIRRESVMFVQIKQQHLFAFEHALGEGAGFIHLALVVNRVAGVKIMRGIDVELPLAVAAQHHADGVDPEVAMDLFRHLADQLVDIQSREHRVGDRHQDAKVVALVAQQIVIDVIADPVLNLFGDDGDDLREGMQPLELFLAPRPVVTAEEFATAKDPPVRRQRQQRVVTERTIQSAADKLRPGIGKGFMIAMQGIRPGE

SEQ ID NO: 10093 - protein, 247 aa, Klebsiella pneumoniae
VKTLHATSFIRIFLMILLIILFTPLLSSSNTWLQKQCIRKYIMIIIISANKFFINGIRSLVNMTMSAQRRYSQTLFLDNISDVNHKSLTIARTIIVDYSHPDIQQLAALLYRKKKIIHGNIVFVVKSEILADPVENIIINSISTIVLDYIDVTQRLQKYLQNASDHRCIKVFRKSISSLDSCVNIKLTKQEDSLLPYIISGLNNKKIAQATDLSNMMISHYRRNIYQKLNVRNIAGLYHFLHSLEGG

SEQ ID NO: 10094 - protein, 77 aa, Klebsiella pneumoniae; identical to SEQ ID NO: 9235

SEQ ID NO: 10095 - protein, 440 aa, Klebsiella pneumoniae
LRQLSTMAQFYSAKRRVTTRQIITVTVNDLDPFGQGVARHQGKALFVSGVLPHEQAELVLVEDKKQYARAEVKRRLTDSPQRQAPRCPHFGVCGGCQQQHASVPLQQQSKRAALGRLMKREVDDVIAGAPWGYRRRARLSLNYQPKTQQLQMGFRQANAKAIVDVVQCPVLVPQLEALLPAVRECLSALSALRHLGHVELVQADNGPLMVLRHTAALPATDREKLERFSQTHGLSLYLAPQSEILEHIHGEAPWYTSDGLRLVFSPRDFIQVNDGVNQQMVRTALEWLDLRPEDRVLDLFCGMGNFTLPLATRAAHVVGVEGVPALVEKGRENAARNGLSNVTFFHENLEEDVTRQAWAKHGFDKVLLDPARAGAPGVMPHIIKLAPRRVVYVSCNPATLARDSETLLQAGYQIQRLAMLDMFPHTGHLESMVLFERRLT

SEQ ID NO: 10096 - protein, 308 aa, Klebsiella pneumoniae
LRGFIMISASTLNSELINKIAQDFAQATSLAVVVVNIHGDEISELFNFTPFCQLMRQHPEHSGRCRMSDRCGGLEASKKDQLCIYRCHAGLTDFSIPLVIAGHLVGFVLCGQVRLSNDVELVDILNVDDRWQDDPALVQAFRDVPEMDYSRVIASADLLKLIVENCLKKQLNFVVIKDNPSQNDPAQASRAPSPHDGKMKKALRYIDAHLSDELRLEDVAAHVYLSPYYFSKLFKKYQGIGFNAWVNQQRMASAKELLCHSDWSIASIARNLGFSQTSYFCKVFRQTYQVTPQAFRQQINAGSQTESF

SEQ ID NO: 10097 - protein, 315 aa, Klebsiella pneumoniae
LLFCRKTFIAPWRTCGRAASTRWTASSWRSPPWLPWAAATTSNPIIPFLSSPVRRKKTMAETFDPHCVWFVGAGPGDRELITLKGYRLLQQAQVVIYAGSLINTELLAYCPPQAECHDSAALHLEQILDLMEAGVKAGKTVVRLQTGDVSLYGSVREQGEELTRRGIRWQVVPGVSAFLGAAAELGVEYTVPEVSQSLIITRLEGRTPVPAREQLEAFASHQTSMAIYLSVQRIHRVAERLVEGGYPATTPVAVIYKATWPESQTVRGTLADIGDKVRDAGIRKTALILVGPFLGDEYHYSKLYAADFSHEYRKA

SEQ ID NO: 10098 - protein, 113 aa, Klebsiella pneumoniae
NYSCLRHQRRRHGAMAHLAGDAAMCIGIPGQICAIDGVLAKVEVCGIQRDVDLTLVGAVDEQGQPRLGQWVLVHVGFAMSVINEAEARDTLEALQNMFDVEPDVGALLYGEER

SEQ ID NO: 10099 - protein, 625 aa, Klebsiella pneumoniae
YRPWRLVAVPGATGGEGMSVIGLVNQAVAWYAASAVLAFLFAMRKPLSGAIAGIGGAVASAMLVVAGGAALLMPERIHGGMLQFLHLTIRVGGVNALWLLAIGLSALPVSLFNISWHRHPQVKANGPLVNLLLAAATCAVVVTNIGSLVVMAEIMALCAAFLTGCAASGKLWFALGRLGTLLMAWTCWLVWSTYGTLELAQINLQAVDMMQNPLLWLPGLVGFALLAGAIPLHGWAPQAHAGASAPAAALFSTVVMKVGLYGMLTVSLAGGVPPLWWGVMLLALGMITAFIGGLYALMEHNIQRLLAYHTLENIGIILLGLGAFVTGVATRNSTLMVLGFIGGMYHLINHSLFKTTLFLGAGAVWFRTGHRDIEKLGGIGKKMPLISLAMLVGLMAMAALPPLNGFAGEWVIYQSFFKMSTGDLFIGRLLGPLLAVGLAITGALAVMCMAKVYGVTFLGAPRTKEAENATCAPWLMTLSVVLAAVFCLVGGIAAPWLLPLVSGAFPVQAQVSSVVSQPMIALLLIACPLLPFLLMIFFKGDRLAARSRGAAWVCGYDHEQSMVVTAHGFAMPVKEAFAPLLKLRHWLNPVRLVPGWQSASAPALLRGIALVELAVLVVIVISRGA

SEQ ID NO: 10100 - protein, 512 aa, Klebsiella pneumoniae
SKDWEGRARTRLSQKTCLPVTDQQLRWEVGGLAVRGRRTRHARSYTLTARTGQGMATRRAFILAGTGSGCGKTTVTLGLLSLLQQRGMRVQPCKVGPDYLDTAWHTAISGIASRNLDSFMLPAPILNALFTEQLQQADIAVIEGVMGLYDGYGTDPNYCSSAAMAKQLGCPVILLVDGKAVSTSIAATVMGFQHFDPALDIAGVIVNRVNSDAHFQLLKSAIERYCQVPVLGYVPRVEGVALPERHLGLVTARESVVNQQAWRDFASLLGRTLDIDRLLALSELAAMPIGEWGEQLAADAGEGLTLALADDEAFNFYYPDNLALLARCGVKMVRFSPLRDRQLPACQMIWLGGGYPELHAAGLSANHEMLTQLRAAHRRGVAIYAECGGLMYLGTTLEVTSGERYTMADIIPGHSRMGTRLTRFGYCEAQAQQQTLLAAPGEWLRGHEFHYSDFSPATPAVLACRKQRDGKTLQQWQGGWQSGSAFASYLHVHFAQRPTMLNHWLRAARRAL

SEQ ID NO: 10101 - protein, 476 aa, Klebsiella pneumoniae
ESCCTVDYLPLFAELKQRPVLVIGGGEIAERKIKFLLRAQAQVQVVAETLSPALADLAARQALSWRATEFSDSLVDDVFLVIAATEDEALNQRVFAAANARYRLVNVVDNQALCSFVFPSIVDRSPLLVAISSSGKAPVLSRILREKIEALLPTNLGRLAESASYWRNHLKTRLTTTEARRRFWERVFTGRFASLMVAGNSAEAEKALQDELDKPERETGEIILVGAGPGDAGLLTLRGLQAIQQADVVFHDHLVTQPVLELVRRDAELICVGKRAGEHSVPQHETNQLLVEAAKAGKTVVRLKGGDPFIFGRGAEELQAAAEAGIPFQVVPGVTAAAGATAYAGIPLTHRDYAQSAVFVTGHYKPDSAPFDWSLLAKSQQTLAIYMGTMKAAEISAQLIAHGRDSDTPVAVISRGTRDDQQTITGTLQQLEHLAKDAPMPALLVVGEVVQLHQQLAWFQHTSSAEGFNASVVNLA

SEQ ID NO: 10102 - protein, 105 aa, Klebsiella pneumoniae
FPHWHISCKVFMQQEALGMVETKGLTAAIEAADAMVKSANVLLVGYERIGSGLVTVIVRGDVGAVKAATDAGAAAARHVGEVKAVHVIPRPHTDVEKILPKGNSQ

SEQ ID NO: 10103 - protein, 280 aa, Klebsiella pneumoniae
PLNCVSGCRRAASPPAWSGSLSIQRVTMRILLSNDDGIHAPGIQTLAKALREFAEVQVVAPDRNRSGASNSLTLESSLRTFTFENGDIAVQMGTPTDCVYLGVNALMRPRPDIVVSGINAGPNLGDDVIYSGTVAAAMEGRHLGFPALAVSLNGYQHYDTAAAVTCTILRALSREPLRTGRILNINVPDLPLDQIKGIRVTRCGNRHPADQVIPQQDPRGNTLYWIGPPGDKRDAGPGTDFAAVDEGYVSVTPLHVDLTAHQAHEVVTDWLERVGVDRQW

SEQ ID NO: 10104 - protein, 90 aa, Klebsiella pneumoniae
PLCWPTVNKEKKMICPRCADEKIEVMATSPVKGVWTVYQCQHCLYTWRDTEPLRRTSREHYPEAFRMTQKDIDEAPQVPHVPPLLPEDKR

SEQ ID NO: 10105 - protein, 275 aa, Klebsiella pneumoniae
RAGCRRLEEEDMKKALLVVSFGTSYHDTREKNIAACERDLAASCPDRTLFRAFTSGMIIRKLQQRDGIHIDTPLQALQKLAEQGYQDVAIQSLHIINGDEYEKIVREVQSMRPRFQRLTLGAPLLSGHGDYVQLMQALRQQMPTLAATERVVFMGHGASHHAFAAYACLDHMMAVQGFPARVGAVESYPEVDIVINELSRQGVTGVHLMPLMLVAGDHAINDMASDEDDSWKTRFNAAGIPATPWLNGLGENPAVRAMFVAHLQQALNDTMEKAA

SEQ ID NO: 10106 - protein, 444 aa, Klebsiella pneumoniae
QVICLSLKFLVNLFVLGINAFLLLGSGMSGYNSGLSRRRLLQGAGAMWLMSVSPVGLAAAARVVAVRVWPASTYTRVTVESNHVLKYRQFALSNPERVVVDLEGVNLNSVLKGMGGQIRADDPFIKSARVGQFDPQTVRMVFELKQNVKPQLFALAPVAGFKERLVMDLYPANATDVQDPLLALLEDYNKGDLERQVPPAQSGPQPGKAGRDRPIVIMLDPGHGGEDSGAVGKYRTREKDVVLQIARRLRALIDKEGNMKAYMTRNEDVFIPLKVRVAKAQKQRADLFVSIHADAFTSRQPSGSSVFALSTKGATSTAAKYLAQTQNASDLIGGVSKSGDRYVDHTMFDMVQSLTIADSLKFGKAVLEKMGNINNLHKNRVEQAGFAVLKAPDIPSILVETAFISNVEEERKLKTAKFQQEVAESILAGIKAYFADGATLARRG

SEQ ID NO: 10107 - protein, 158 aa, Klebsiella pneumoniae
YRRCRQRRHGGQRQRRRERITGSPGSDPATARCAVATADGGIMEPQPPTERMIQEYVPGKQVTLAHLIANPGKDLFKKLGLPDAVSAIGILTITPSEASIIACDIATKSSTVEIGFLDRFTGAVVLTGDVSAVEYALRQVTRTLGELMRFTACPITRT

SEQ ID NO: 10108 - protein, 63 aa, Klebsiella pneumoniae
TAWWTSLTLNRTKKTAVGYRKVHFFALTKTAVNRKWTCLSALFDLISYISIAYLIDFVVNNYN

SEQ ID NO: 10109 - protein, 254 aa, Klebsiella pneumoniae
TGWWRWWKTATRSPFTRATRGREVWLTPPSSGSHQDAIKKGFDARQPGDPWQMPYLPIDPQDIGCSYEAVIRVNSQSGKSGSAWLIEQNHGLKLPRGLQQDFSQHVQQATDSDGKEMTHHALWQLFRTRYGLQAQPALTLLDYQSASQQDGQLSLQATLRHHGETRRLQGQGNGLLSAAASGLSALFRQPFMIKDYHEHTLGARSDSRSVAYIRCVFPQGESYWGVGIDNDVARASLQALCNALSAADQAGGRK

SEQ ID NO: 10110 - protein, 378 aa, Klebsiella pneumoniae
SLLRRRRDAGPPRITTQERDMALLKSAHGGNIREAAALLGIAPGELLDFSANINPLGMPASLRQAIVDNPGCAERYPDVEYQQLHQALAAHHQLPAAHILAGNGETESIFTLVHGLKPRRAMIVIPGFAEYRRALQTVDCEVVEYALRERDGWQLTDAILDALTPALDCLFLCTPNNPTGLLPERGLLEAIAQRCRALNISLILDEAFLDFIPDQPGFIPLLAQHPHVWVLRSLTKFYAIPGLRLGYLLNADAQAVARLRARQMPWSINAYAALAGEIILQDRAYQRATWQWLQEEGARFYAQLQEMAGLTVWPGRANYLFLRCDRPDFDLQYALLRQHVLIRSCANYPGLDSRYFRVAIRSAEENDQLLAALRRVLA

SEQ ID NO: 10111 - protein, 120 aa, Klebsiella pneumoniae
ATLRRGVGSDERRYRARHHHRRRPAGQTARPAPRRRAAPYAGEPGHHQQRSDGGGRLDQYVRPGGERRERRRRPGGDRANQRRLRYRAGGAGLLRQVYPQGEQQLPGPLYAGRQRDWFAV

SEQ ID NO: 10112 - protein, 110 aa, Klebsiella pneumoniae
PRSRPPFPIFRSVVFAGSSASQQRGLRGIYTPFPDTKLVSNLSVCFADAPCIDGYYFMFSFTVSSLVTMTSVKESGVVIISCLVLTDTLSHHKNKNWCSLSLEYHYFVAL

SEQ ID NO: 10113 - protein, 312 aa, Klebsiella pneumoniae
SPARCWPARSCFCWPTPWPAPWRRRRRYRSVCSPACWAPPGFCGWSFVGRTPDMVNEYWAQGLSLHLGKRQIIDNVSVALRGGEMTALIGPNGAGKSTLLRLLTGYLTPDSGTRHLAGKPLEAWSPEALSRRRAVMLQRTALQADWTVETVIAMGRSPWGATADPAVLAAVMAVTGCDGLAGRRYPGLSGGEQQRVQLARCLAQLWRDGAPQGWLFLDEPTSALDLYYQQHLLRLLKRLTAGGQLHVCVVLHDLNLAALWADRILLLHQGHLVAQGTPQEVIQQPVIHRWYGADVRLVQHPDNAVPQVYLAP

SEQ ID NO: 10114 - protein, 113 aa, Klebsiella pneumoniae
TCHRYIADRGRSVLRNRRRAWPALHPSLHILPNVLSWCLIFCCEALVRVEDNKAPELLKCAISSMAQICVKKHHNVAFYKPILTKMSIWSKKGCIISLAEYSALPRTRGGAAW

SEQ ID NO: 10115 - protein, 123 aa, Klebsiella pneumoniae
KAHRDTEATMHEITLSQRALEIIEQQAQQAGARRVTGVWLKVGAFSCVEASALTFCFELVCRGTLAEGCELHIAEQQAECWCDRCQQYVHLVSQHVRRCPHCNNDQLQIVADDGLQIQRLELE

SEQ ID NO: 10116 - protein, 307 aa, Klebsiella pneumoniae
PAGRHATMRPGEGKRKGENVAVAQCPASCGELIQGWILGSEKLVSCPVDWYSTVEVETGVPRKDERPLSRAMVDQLLAHWGYPPALSQQIRITLHSTIPVAKGMASSTADIAATAVATAHHLGHLLDEPTLARLCVALEPTDSTLFRELTLFDHNTAATQIACPPPPALDLLVLESPLTLRTTDYHQLPREPGLLANASRLQLAWEKVQQACHCGSPQLLGEAATISAIASQQLLPKPGFDVLLDLVESAGLYGLNVAHSGSVVGLLLDRRRHDVEFLQWRLADSDIAAHWPQQHLLAMVRGGVILQ

SEQ ID NO: 10117 - protein, 516 aa, Klebsiella pneumoniae
RSLRRSVQYVRQYLRHRHPNRHRLYRRHHRLVQRRADLRRYPCPGGGAELSGAGGRYQTYRTETCSGTLIMTTQSSPIITEMKVIPVAGHDSMLLNIGGAHNAWFTRNIVVLTDNAGHTGVGEAPGGEVIYQTLLAAIPQVVGQEVARLNRVVQQVHKGNQAADFDTFGKGAWTFELKVNAVAALEAALLDLLGQVLNVPVCELLGPGKQRDAVTVLGYLFYIGDRQKTDLGYLDHTPGDHEWYRLRHQQALSSEAIVRLAEAAQDRYGFKDFKLKGGVLPGEQEIDTARALKKRFPDARITVDPNGAWLLDEAIALCKGLQDVLTYAEDPCGAEQGFSGREVMAEFRRATGLPVATNMIATNWREMGHAVMLNAVDIPLADPHFWTLSGAVRVAQLCDDWGLTWGCHSNNHFDISLAMFTHVGAAAPGNPTAIDTHWIWQEGDARLTKNPLQIINGSIAVPDAPGLGVELDWEQVRRAHEAYKALPGGARNDAGPMQYLIPGWTFDRKRPVFGRH

SEQ ID NO: 10118 - protein, 136 aa, Klebsiella pneumoniae
PVIRQRGMSSLLMVLLLLTLGSLLLEGLNLQQRALLAQTASETQAIRDTAIAHSALQWGKQQVWSAQVALACREQAPQGWRACLRIFGDGSLVLSSASGEVQVWQSGEVRGGQVRFSAHGWSDFCPLREASLCQMP

SEQ ID NO: 10119 - protein, 503 aa, Klebsiella pneumoniae
TPVRLAKPSAAISARCARSAPADGPERDHETAYRRRAAMSAEPHIVIIGGGFSGAAVAIELLRLAPNGVRVTLLEPRQSPGAGVAYSTAEPTHRINVPAARMQLAGDEEGAFDHWYRHQPVFTVDVQALRPDGSVYPQRGQFGRYVAQRFADAAASSGGRLRHLRDRALAFHQGTVTTDGGLQLKADLLVLAISHPPPSLPAQAEAWRHHPALIANPWQPGALDAIAPHARVAVMGTGLTMADTVATLDRLGHRGSIVAFSRHGLLSRGNLSGAGATWPGDYQQGSLRQRLRQIRLDVAYAAQQGLSWQVVLDAVRQQGQRIWQALSVADRQRFLRHLRHYWDVHRYRVAPQVAEVLEARQRTGSLQVQAARLLSISGEGETLRLTLARRGGGVQTLSVDHLILTTGPAHRALTDSQPFLQDLARRGLIRADALGMGLEVDSRSRAVAEPHVEALPVLVAGPAARGRFGELMGLPQVADHAADVAAQALLTLGIPQDSRCPAY

SEQ ID NO: 10120 - protein, 276 aa, Klebsiella pneumoniae
RAARMMRWLLLLIAFPLLSHAAVERLVTLGGDVTEIVYALHAEESLVARDSTSSWPPAAQKLPDVGYLRQLNAEGILALRPQLVLASAQAQPSLVLHKVQASGVKVVNVPGGESLSAIDNKVAVIAEALGKTAAGDALRQQLQQQIAAIPTQPVAKRVLFILSHGGMNTLVAGQHTAADGAIRAAGLQNAMQGFDHYRAMSQEGVAASQADLVVISADGLKGMGGEAGLWKLPGLAQTPAGRHKQLLTIDDMALLGFGPRTPQAIIALRNKAEQLP

SEQ ID NO: 10121 - protein, 391 aa, Klebsiella pneumoniae
HLRRGDAPRRPGAVADPVLPPIPPPPAISTRRKFTPGRKASRHSTTSVCASWRWKALKLKAACPARCKENRMTHLTRVSAINWNRIDDDKDLEVWNRLTSNFWLPEKVPLSNDIPAWQTLSAAEQQLTIRVFTGLTLLDTIQNTVGAPALMADALTPHEEAVLSNISFMEAVHARSYSSIFSTLCHSKEVDAAFAWSESCDPLQRKAQLMLGYYQADEPLKKKIASVFLESFLFYSGFWLPMYFSSRGKLTNTADLIRLIIRDEAVHGYYIGYKYQKGLEIVSPGKREELKNFALDLLMDLYDNELAYSRELYGESGWFDDVSAFLCYNANKALMNLGYEALFPAEMAAVNPAILAALSPNADENHDFFSGSGSSYVIGKMEETADDDWDF

SEQ ID NO: 10122 - protein, 153 aa, Klebsiella pneumoniae
GVSRHPTKKRHRGSLGLGARAVTRAVPAPLKERPMVTALIIVAAIAWLTQLAFGGWQIRRFNRAFDSLCQQGRVGVGRSAGRFQPRAIVAIAVDDNDRISDTLLMKGFTIFASPRKIPALAGKHIAELQPDVIFPHDPRCQNALSLALNPKHG

SEQ ID NO: 10123 - protein, 472 aa, Klebsiella pneumoniae
QQGRQRRGERQRVDGRDHRRDGDGHRELFVELSGDPGEKRHRHEHRTQHQRNGDNRPGDLTHRLMRRGKRRKPFFDITLDVLHHHDGVVHHDTDSQYQPEQAQGIQREAQQIENAEGTHHRYRHRDQRDNRRAPGLQEQDHYQHHQHYRLQQRLHHRADGVADENRRVVRRRPLHIFREAGGQLGHFGAYRVRQIDGVSAGGLEDTDPDRILIVELGAQRIATGTHLDARHVAQADQRAILRRFQNDIAKLFFGMQTALGVNGDQEIALLRQRLGAKLSGRHLDVLLLHRRHHIRGRQTAGRDLIGIQPDAHRIFTGAKNLDLADAGQARQLILHFQRGVVAHIQRVVLTVWRKQMHHQGQRRRLLLGGDPQTAYILRQTRFGLRDAVLHLNLRLIRVGTRAEGDGGDQHAVGAGDRFHVHHVFNAVDRFLQRRRHGLGNHFRVGAGILRAHLDARRDDIRIFAHRQQWDSD

SEQ ID NO: 10124 - protein, 86 aa, Klebsiella pneumoniae
MEIRIMRIIIYTRNDCVQCHATRRAMESRGLAFEMVNVDQQPDAADTLREQGFRQLPVVIAGELRWSGFRPDMINRLRPSFTAASA

SEQ ID NO: 10125 - protein, 148 aa, Klebsiella pneumoniae
WPRRTEQSRWFRSAGDDRCHAGGGVLWAAGGAGWLSLLRGGAGGVSDSAGGETVSDPVPLFGGEGGAYRVGAPGSRTVSQYGHASGRRQRRGAGDADRRGGLRDVPSHGHAGGKQYCVTEGVSRRWGRQWPFPFSAEVLPAAETKKHP

SEQ ID NO: 10126 - protein, 232 aa, Klebsiella pneumoniae
SPLRVVRRRRSGRSRTDYSQRLPSATAGAGSDLRRVADQHRATGLLSATGGVPRQRRAASGADPRPDGGGGEGGKNGGASADGRRLAIWLGARAGRRADPPRDPLAGGAGRQRFPRRGGGAGGGVHGTRSLAESDYYPSGRAHAGSRARTAGSLCQPSNLDGDLPVGATYSPGGGAAGGGRLPRDHPGRGDLQGHLAGKPDRPRYPRGHRRQSTRRRDPQNGADPGRPLPRR

SEQ ID NO: 10127 - protein, 90 aa, Klebsiella pneumoniae
SNLRLACEVNFLISRAKAGQTQIPLRTVLFNANAILCSASRALSPRDLSTPAAPNPVDNLEAVAWQPQPGRATGCRSFFEQGKLPRRAAR

SEQ ID NO: 10128 - protein, 359 aa, Klebsiella pneumoniae
LLPRLGHRPDHLDFREKNGDSAFPESASVRSDIMTLIRIEKGTGGWGGPLELDAVEGKKIVYITAGTRPAIVDRIASLTGWQPVDGFKEGEPAESEIGVAIIDCGGTLRCGLYPKRRIPTVNIHATGKSGPLAQYITEDIYVSGVKEDNIQCIAPDSAGVSEPPAENKSAGRDYDTSKKITEQSDGLLAKVGMGMGSVVAVLFQAGRDTIDTVLKTILPFMAFVSALIGIIMASGIGDWIAHGLAPLASHPLGLVTLALICSFPLLSPFLGPGAVIAQVIGVLIGVQIGLGNIPPHLALPALFAINAQAACDFIPVGLSLAEARQDTVRVGVPSVLVSRFLTGAPTVLIAWFVSGFIYQ

SEQ ID NO: 10129 - protein, 132 aa, Klebsiella pneumoniae
DWPRHVHLRRAIAGVGLCGKSGQQNQGADPVRHPLLRAHPAAGENGRRRQRPPRRAGARRYHRLYAQRAGRRGQQELWPGGRRAGGGAERGDQARAAETARAGEYLAQRGGDPGRRHADVATRRPGRDLACG

SEQ ID NO: 10130 - protein, 418 aa, Klebsiella pneumoniae
RNQRGLAHIGTFTAHVRPGDNQHPPLRRQLQRVSDKRLFQHLLDHRMAAFANANAWLIAKGRAAVVQGFRTFRQVDQHVQLGQRAGAGLQIGEMRQQQVEQFVIKLFFQRQRFALGGQHLIFVFLQLRNNVAFGVLQRLAAHVVDRREVALAAADLDVVAVDGVVADFQGIEAQPLALADLQFIEIIGGAIGQRPPLVQLFAIAWSDDPAVADQHRRRVDHRALQQFAQFGELAHFLAQFLHRLTVNVGQQLTQQRQLLQGMTHAGKIARPGGTQRQTRQNTLQIADLAQHRLQLGIALLQRADGLLALHQHGGIADRHMQPALEHPATHRRHRTVEYRGQGVVGAAGQILGDLEVTAGGGIHNDAVLLAFHGDGADVRQRGTLGVFDILQQAAGGAQAARGVFDAEADQIAGAELQV

SEQ ID NO: 10131 - protein, 708 aa, Klebsiella pneumoniae
RSQRILATTTAERITAAVDFHALNAMLNLYDSEGRIPFEKDRQAVEAFMATQVQPNALTFPSQEDKLSWLVSEGYYDPQVLAGYDRGFVLALFAHARRAPFRFQTFLGAWKFYTSYALKTFDGKHYLEDFAERSVMVALTLARGDEQQARQLTEEILSGRFQPATPTFLNAGKQQRGELISCFLLRIEDNMESIGRAVNSALQLSKRGGGVAFLLSNLREAGAPIKRIENQSSGVVPVMKMLEDAFSYANQLGARQGAGAVWLHVHHPDILRFLDTRRENADEKIRIKTLSLGVVIPDITFQLAKEDAQMALFSPYDVERLYGKPFADCAIGDLYPQLVADERVRKRWIRARDLFQRLAEIQFESGYPYIMFEDTVNRASPVAGRVTMSNLCSEILQVSTPSAYNEDLSYAHIGEDISCNLGSLNIAHTMDSPDFGRTIATAVRALTAVSDMSHIQSVPSVAAGNAASHAIGLGQMNLHGYLAREGIAYGSPEGLDFTNIYFYTVTWHALHTSMQLARERGQRFAGFEQSRYASGAYFDKYLQEEWQPKTERVRTLFARAGISLPDRESWRQLRDDVMRYGIYNRYLQAVPPTGSISYINHATSSIHPIVSKIEIRKEGKTGRVYYPAPFMNNDNLALYQDAYEIGPEKIIDTYAEATRHVDQGLSLTLFFPRYRHHPRYQQGANLRLEERHQDTLLHPSAPAGAGRH

SEQ ID NO: 10132 - protein, 238 aa, Klebsiella pneumoniae
CGWRQAWRWRCLSACATGWSARPEENLMQYIQQPQAIEAKSFDIISEIIAETRPDYRFASPLHEAIIKRVIHTTADFDWLDILWFSPDALIALSEALSRPCTLYTDTTMALSGINKTLLARFGGECRCYISDPRVVREAQSRGMTRSMAAVDIAVQEPGEKVFVFGNAPTALFRLLEHRETAIGGVVGVPVGFVGAAESKAALSESGLPAIAALGRKGGSNVAAAIVNALLYHLREAQ

SEQ ID NO: 10133 - protein, 488 aa, Klebsiella pneumoniae
STRRSPILLPFAPPGSVSAGHSPGSAARWRCLFCRCCRPPSARRCSGWSRLPPLFPFSSCWRSVMNRREKISTHFMNKELTMTLLSTGTDYDALAAAFRPIFTRIAQGAAEREQQRILPDEPIRWLKEAGFGTLRIPREKGGWGASLPQLSALLIELAQADSNLPQALRAHFAFVEDQLNQPDSAGRDRWFRRFLDGELVGSGWTEIGAVKLGEVNTRVTPAEGGWRLDGEKFYSTGALYADWIDVFARRSDTASDVIALVSTQQTGVVREDDWDGFGQRLTGSGTTRFTGARVETEHVYDFAQRFRYQTAFYQHVLLATLAGIGLAVERDAAQGVKHRSRMYSHGNAAVPRDDAQVLQVVGQISSWAWATRAAVLQAAESLQQAYVAHVSDDEALIARCNQLAEVEAAQAQVIASDWIPRAATELFNALGASDTRTRLALDRHWRNARTVASHNPVIYKARNIGNWLVNGEAPTFIWQIGNGEKTAG

SEQ ID NO: 10134 - protein, 61 aa, Klebsiella pneumoniae
VFQLYHYFFPTLCLLTRTDNGGEIYGSKTEMYIHLRKALSIIAYLVHKISSAANIFVRMIT

SEQ ID NO: 10135 - protein, 163 aa, Klebsiella pneumoniae
KMLRACISCYGETDMTIWEISEKADYIADRHRQQQEQWHIYCNSLVQGITLSKARLHHAMSCAPDKELCFVLFGHFQVFVALAEGFNSHTIEYYVENKNGGDKYLIAQATLAMDGTVDGRISNRSRDQVLEHYLAIIATVYDRLYDAMEQDQPVDLSHLALTH

SEQ ID NO: 10136 - protein, 292 aa, Klebsiella pneumoniae
QMNSGYLHFPEFDPVIFSLGPVSLHWYGLMYLVGFVFAMWLATRRANRPGSGWTKNEVENLLYAGFLGVFLGGRIGYVLFYNLPVFLADPLYLFRVWDGGMSFHGGLIGVILVMIIFARRTKRTFFQVSDFIAPLIPFGLGAGRLGNFINGELWGRVDPSFHYTMIFPGSRAEDLALLPTHPEWQSLFDTYGALPRHASQLYELALEGVVLFLILNLFIRKPRPTGSVSGLFLIGYGLFRIIVEFFRQPDAQFTGGWVQYISMGQILSIPMVLAGIIMMVWAYRHRPQPQNS

SEQ ID NO: 10137 - protein, 881 aa, Klebsiella pneumoniae
LDFRIIMSKSTAEIRQAFLDFFHSKGHQVVASSSLVPHNDPTLLFTNAGMNQFKDVFLGLDKRNYSRATTAQRCVRAGGKHNDLENVGYTARHHTFFEMLGNFSFGDYFKQDAIKYAWELLTGENWFALPKEKLWVTVYETDDEAFDIWANEVGVPRERIIRIGDNKGAPFASDNFWQMGDTGPCGPCTEIFFDHGDHIWGGPPGSPEEDGDRYIEIWNIVFMQFNRQADGTMEPLPKPSVDTGMGLERIAAVLQHVNSNYDIDLFRDLIASVAKVTGATDLTNKSLRVIADHIRSCAFLVADGVIPSNENRGYVLRRIIRRAIRHGNMLGAKDTFFWKLVAPLIDVMGSAGDELKQQQAQVEQVLKTEEEQFARTLERGLALLDEELSKLKGDTLDGETAFRLYDTYGFPVDLTADVCRERNIKVDEAGFEAAMEEQRRRARESSGFGADYNAMIRVDGASEFKGYDHLELNGKVTALFIDGKAVDSVSAGQEAVVILDQTPFYAESGGQVGDKGELKGAGFSFAVSDTQKYGQAIGHIGKVASGTLKVGDAVQADVDEARRQRIRLNHSATHLMHAALRQVLGTHVAQKGSLVNDKALRFDFSHFEAMKPEEIRAVEDLVNAQIRRNLAIETNIMDIDAARASGAMALFGEKYDDRVRVLRMGDFSTELCGGTHAARTGDIGLFRITSESGTAAGVRRIEAVTGEGAMAILHAQSDQLNDIAQLLKGDSHNLGEKVRAALERTRQLEKELQQLKEQAAAQESANLSSKAEEINGVKLLVSELTGVEPKMLRTMVDDLKNQLGSTIVVLATVADGKVSLIAGVSKDVTDRVKAGELVGMVAQQVGGKGGGRPDMAQAGGTDASALPAALASVKGWVSAKL

SEQ ID NO: 10138 - protein, 74 aa, Klebsiella pneumoniae
MTFSTSPTSSGSSAEVGSSNSIMSGFSASARAIATRCCWPPESCPGYLWAWASRPTRSSSARACSRATGWSSSW

SEQ ID NO: 10139 - protein, 124 aa, Klebsiella pneumoniae
RGISMYLRPDEVARVLEKAGFTMDVVTQKAYGYRRGDNYVYVNREARMGRTALVIHPALKERSNMLAEPASDIKTCDHYEQFPLYLAGDAQQHYGIPHGFSSRMALERFLNGLFGEAQPAMSTN

SEQ ID NO: 10140 - protein, 612 aa, Klebsiella pneumoniae
TKWLQYCNTATSTQRCPVAGNPFLLAPEVNANPLLSDSWSRCQRYGLDPATEDFPRLGAGELADRLASHRGLQQLAQPVVEALSRQVADLQSVVILSDPDGLVLHTLGDTQALQKAQRVALAPGNLWSESGRGTNAIGTALAIDDGCEIDGRQHFLTRNQNLYCAAMPLQRPDGSIAGVLDISGPANFPHQHTFGWVKAAAKQIEYLWVKQSLHPEQWLMSLHRQVDKLDSVEELLLVFSDNVLTAGNRLAMREFGLSAAQFGQLTFASLFPTLTQTAVSVPLPLTTPQGRYHYRLREPTRRRVAVSAPPAMHLPFTSPREGEKLLRLLNAGIALCIEGETGSGKEYVSRTLHRHSRWRSGKFVAINCAAIPESLIESELFGYQPGAFTGASKNGYIGKIREADGGVLFLDEIGDMPLALQTRLLRVLQEKEVAPLGASRSVPVNFALICATHRNLTQRVSAGEFREDLLWRLREYALALPPLREWPALETFIATLWHDLGGASRRVTLSNALLVHLSQLPWPGNVRQLQSVLKVMLALADEGDTLTPDALPEAYRAAPAPLPRGGLQAHDEQLIVDTLARVNGNVSRAAQMLGIARSTLYRRAARAGRPRR

SEQ ID NO: 10141 - protein, 67 aa, Klebsiella pneumoniae
SSASARLNGLRQNIIVGTVASATARPAVTGNKAYSRTLAVVILFMLAPSGKLIKKGNYCWAKSLTPP

SEQ ID NO: 10142 - protein, 820 aa, Klebsiella pneumoniae
MPRSLWFKVFVVLAALWAPFSQADTGWQPIQETIRKSEKDTRQYQAIRLDNDMVVLLVSDPQAVKSLSALVVPVGSLQDPADHQGLAHFLEHMTLMGSQKYPQPDSLAEFLKLHGGSHNASTAPYRTAFYLEVENDALDGAVYRLADAIAAPLLDKKYADRERNAVNAELTMARTRDGMRMAQVSAETINPAHPAAHFSGGNLETLSDKPGSPVLDALHTFRDSWYSANLMKAVIYSNKPLPALARMAADTFGRVPNRQISRPEITVPVVTDAQKGIIIHYVPAMPRKVLRVEFRIDNNSDRFRSKTDELVTYLIGNRSPGTLSDWLQKQGLAEGIRADSDPVVNGNSGVLAISATLTDKGLAHRDEVTAAIFSYLGLLRTQGIDKRYFDELAHVLALDFRYPSINRDMDYVEWLADTMIRVPVEHALDVVNIADQYDPQAIKDRLAMMTPQNARIWYISPQEPHNKTAYFVDAPYQVDKISEQTFADWQHKSQAIQLQLPALNPYIPDDFTLIKSDKAWPHPQLILDEPTLRVVYAPSQYFASEPKADISLVLRNPQAMDSARRQVMFALNDYLAGIALDQLSNQAAVGGISFSTGANNGLMVNANGYTQHLPALFSDLLQGYFSYTPTEEQLEQAKSWYAQMMDSAEKGKAYDQAIMPIQMVSQVPYFQREVRRALLPSITLKEVLDYRANLKTRGRPELMVIGNMTADAATTLARQIQQQLGADGNEWCRNKDVVVNRQQLAIFNKAGNSTDSALAAVFAPPNVDEFSSTAASTLLGQIIQPWFYKQLRTEEQLGYAVFAFPDERGAPVGHGFPAAE

SEQ ID NO: 10143 - protein, 97 aa, Klebsiella pneumoniae
LTRLTKNNHENSPLNIQVDDEDHYSPYPTVADDISVALPLMDDESPKEERNGKKQTGPADYRYLPGNDPPGVKSGDRRQCQRALSGRNADHPYRYPI

SEQ ID NO: 10144 - protein, 222 aa, Klebsiella pneumoniae
TGSSWRSSTKRAIAPTPRWPRCSRRPMLMSSAAPPPAPCWDRLFSRGSTNSCVPKSNSATRSLPSPMNVGRQWGMGFLLQSSDKQPAFIWQRFQAFFPTAEAKLRAMKPEEFAQLQQAVISQMLQAPQTLGDEASKLSKDFDRGNMRFDSRDKVVAQIKLLTPQKLADFFHQTVVDPQGMTILSQISGSQNGKADYAQPKGGKVWENVSALQQSLPLMRENE

SEQ ID NO: 10145 - protein, 271 aa, Klebsiella pneumoniae
PMSSNELVEQIMAQVIARVATPEQQALPDTPHPTGETAMAEKSCSLTEFVGTAIGDTLGLVIANVDAALLEAMKLEKRYRSIGILGARTGAGPHIMAADEAVKATNTEVVSIELPRDTKGGAGHGSLIVLGGNDVSDVKRGIEVALKELDRTFGDVYGNEAGHIELQYTARASYALEKAFGAPLGRACGIIVGAPASVGVLMADTALKSANVEVVAYCSPAHGTSFSNEAILVISGDSGAVRQAVISAREIGKTVLATLGAEPKNDRPSYI

SEQ ID NO: 10146 - protein, 90 aa, Klebsiella pneumoniae
LVGLITRRSSVQIRPPQPIKFDKVKQYGDAGWSSLVARRAHNPKVVGSNPAPATNITNTLKGVFLFLPPAKPLPKTGTAIAAPISCLPLR

SEQ ID NO: 10147 - protein, 175 aa, Klebsiella pneumoniae
RCASLGNAGDEAMNHAMLQRIVEEVAARLLRRALSTATLSVAQLGEADIRSLLCQHASLRIVQVDLPLLEQLAGQRALAAAGCALHEAMAWGVRVQLTLLPALLPALAVKKLARLPLTFSDPLGQPVRLHAASVLTYADVARFSGGYLVLRRRPIITALAREAAVARHVQLIKQE

SEQ ID NO: 10148 - protein, 534 aa, Klebsiella pneumoniae
PLQSEKRSAANLKNQYAAASQPYRRRFAMRYAHPGQPGAEVSFKSAYGNFIDGRFVEPLSGEFFMNTSPVDGSNIAQFPRSDARDIDFALDAAHRAAPAWGKTSVQQRSRLLLQVADRIEQHLEYLAVAESWDNGKPIRETLNADLPLAVDHFRYFAGCLRAQEGSTAEIDETTVAYHFHEPLGVVGQIIPWNFPLLMAAWKLAPALAAGNCVVLKPAEQTPLSITLLLELIGDLFPAGVLNVVQGFGKEAGEALATSKRIAKLAFTGSTPVGRHILACAAENIIPCTVELGGKSPNIYFADVMDGEEEFIEKAVEGLVLGFFNQGEVCTCPSRALIHESIYEPFMARVMEKVAQIRRGDPLDTDTMIGAQASRQQFDKILSYIQIAREEGGQILTGGERAAIAPALDNGFYIQPTLIKGRNDMRSFQEEIFGPVIGVTTFKDEAEALAIANETQFGLGAGVWTRDTNLAYRMGRGIKAGRVWTNCYHVYPAHAAFGGYKQSGVGRETHKMALDAYQQTKNLLVSYGTAPLGLF

SEQ ID NO: 10149 - protein, 337 aa, Klebsiella pneumoniae
SMKSVQLAHGSGGQAMQQLIGDLFMQAFANPWLAEQEDQARLDLAALAAQGDRLAFSTDSYVIDPLFFPGGNIGKLAVCGTANDVAVSGAIPRYLSCGFILEEGLEMATLEAVVASMADTARAAGIAIVTGDTKVVPRGAADKLFINTAGIGAIPADIRWGTQQISAGDVLLVSGTLGDHGATILNLREQMGLDGALSSDCAVLTPLIQTLRPLSGVKALRDATRGGVNAVAHEFAAASGCGIELQEATLPVNDTVRGVCELLGLDALNFANEGKLVLAVARDEAENVLAHLRSHALGRDAAIIGEVVARPGVRSVGLYGVKRTLALPHAEPLPRIC

SEQ ID NO: 10150 - protein, 573 aa, Klebsiella pneumoniae
ESLSMSEEKIGQHYLAALHQAFPGVVLDEAWQTKDQLTITVKVNYLPEVVEFLYYQQGGWLSVLFGNDERKLNGHYAVYYVLSMEQGTKCWITVRVEVDANKPEYPSVTPRVPAAVWGEREVRDMYGLVPVGLPDERRLVLPDDWPDELYPLRKDSMDYRQRPAPTTDAETYEFINELGSKKNNVVPIGPLHVTSDEPGHFRLFVDGENIIDADYRLFYVHRGMEKLAETRMGYNEVTFLSDRVCGICGFAHSTAYTTSVENAMGIVVPERAQMIRAILLEVERLHSHLLNLGLACHFTGFDSGFMQFFRVRETSMKMAEILTGARKTYGLNLIGGIRRDLLKEDMIQTRQLAQQMRRDVQELVDMLLSTPNMEQRTVGIGRLDPEIARDFSNVGPMVRASGHARDTRADHPFVGYGLLPMEVHSEQGCDVISRLKVRINEVYTALNMIDFGLDNLPGGPLMVEGFTYIPHRFALGFSEAPRGDDIHWSMTGDNQKLYRWRCRAATYANWPTLRYMLRGNTVSDAPLIIGSLDPCYSCTDRMTVVDVRKKKSKVVPYKELERYSIERKNSPLK

SEQ ID NO: 10151 - protein, 855 aa, Klebsiella pneumoniae
HPMSTIDNLDAHTPMMQQYLKLKAQHPDILLFYRMGDFYELFYDDAKRASQLLDISLTKRGASAGEPIPMAGIPHHAVENYLAKLVNQGESVAICEQIGDPATTKGPVERKVVRIVTPGTISDEALLQERQDNLLAAIWQDSKGFGYATLDISSGRFRLSEPADRETMAAELQRTNPAELLYAEDFAESSLIEGRRGLRRRPLWEFEIDTARQQLNLQFGTRDLVGFGVENAPRGLCAAGCLLQYVKDTQRTSLPHIRSITMERQQDSIIMDAATRRNLEITQNLAGGTDNTLASVLDCTVTPMGSRMLKRWLHMPVRDTAVLVERQQTIGALQERYTELQPVLRQVGDLERILARLALRTARPRDLARMRHALQQLPLLRELLADVDSQPVQKLREKMGEFTELRELLERAVIDAPPVLVRDGGVIAPGYSEELDEWRALADGATDYLDKLEIRERERLGLDTLKVGYNAVHGYYIQISRGQSHLAPIHYVRRQTLKNAERYIIPELKEYEDKVLTSKGKALALEKQLYDELFDLLLPHLADLQTSASALAELDVLVNLAERAETLNYCCPTFSDKPGIRISEGRHPVVEQVLKEPFIANPLQLAPQRRMLIITGPNMGGKSTYMRQTALIALLAYIGSYVPAQKVEIGPIDRIFTRVGAADDLASGRSTFMVEMTETANILHNATEHSLVLMDEIGRGTSTYDGLSLAWACAENLANKIKALTLFATHYFELTQLPEKMEGVANVHLDALEHGDTIAFMHSVQDGAASKSYGLAVAALAGVPKEVIKRARQKLRELESISPNAAATQVDGTQMSLLAAPEETSPAVEALENLDPDSLTPRQALEWIYRLKSLV

SEQ ID NO: 10152 - protein, 225 aa, Klebsiella pneumoniae
WMMSHQKRNAMERNRLARQIIDTCLEMTRLGLNQGTAGNVSVRYQGGMLITPTGIPYEKLTEDKIVFIDADGQHEQGKLPSSEWRFHQAAYQTRPDAQAVVHNHAVHCTAVSILNRPIPAIHYMIAAAGGNSIPCAPYATFGTRELSEHVAVALKHRKATLLQHHGLIACEASLEKALWLAHEVEVLAQLYLSTLAITDPVPVLDDEAIAIVLEKFKTYGLRIEE

SEQ ID NO: 10153 - protein, 517 aa, Klebsiella pneumoniae
FGVSVMQQQKPLEGAQLVIMTIALSLATFMQVLDSTIANVAIPTIAGNLGSSLSQGTWVITSFGVANAISIPITGWLAKRVGEVKLFLWSTTAFAIASWACGVSNSLTMLIFFRVIQGIVAGPLIPLSQSLLLSNYPPAKRSIALALWSMTVIVAPICGPILGGYISDNYHWGWIFFINVPIGVAVVLMTLQTLRNRETKTEQRRIDGVGLALLIIGIGSLQVMLDRGKELDWFSSNEIIILTIVAVVAISFLIVWELTDDNPIVDLSLFKSRNFTIGCLCISLAYMLYFGAIVLLPQLLQEVYGYTATWAGLASAPVGVIPVILSPIIGRFAHKLDMRRLVTFSFIMYAVCFYWRAWTFEPGMDFGASAWPQFIQGFAVACFFMPLTTITLSGLPPERLAAASSLSNFTRTLAGSIGTSITTTLWTNREALHHAQLTESVTPFNPNAQQIYDQLQGMGMTQQQASGWIAQQITNQGLIISANEIFWISAAIFILLLGLVWFARPPFSAGGGGGGAH

SEQ ID NO: 10154 - protein, 475 aa, Klebsiella pneumoniae
CMASFPQGFLWGGALAANQSEGAYLEGGKGLTTVDTLPHGAHRLPVKLGLEKRFTLREDEFYPSHQAIDFYHRYKEDIALMAEMGFSVFRTSIAWSRLFPRGDEQQPNPQGIAFYRSLFEECKKHGIEPLVTLCHFDVPMHLVMEYGSWRNRKMVDFFSHYARTCFEAFDGLVKYWLTFNEINIMLHSPYSGAGLVFEEGENQEQVKYQAAHHELVASALATKIAHEINPQNQVGCMLAGGNFYPYSCKPEDVWMALEKDRENLFFIDVQARGAYPVWAARVFREKGVTIAKQPGDDEILKNTVDFVSFSYYASRCASAEMNASNTNAANIVKSLKNPHIPASEWGWGIDPLGLRITMNMMYDRYQKPLFLVENGLGARDEIDANGDINDDYRISYLREHIRAMRDAIGDGIPVLGYTSWGCIDLVSASTGEMSKRYGFVYVDRDDAGNGTLARKRKKSFFWYQKVIASNGADLD

SEQ ID NO: 10155 - protein, 96 aa, Klebsiella pneumoniae
SPRRDINMKKPLILLAMVAALMILPFFINHGGEFGGSDGEAESQIQVVAPDYQPWFQPLYEPASGEIESLLFTPAGLAGRGGDFLHSRICEGQTAP

SEQ ID NO: 10156 - protein, 155 aa, Klebsiella pneumoniae
CYFGCRLREENTMNQLRQPFSELSPEVYKGLVQASIALEKSELGNALVELVYLRVSQINGCAFCLEKHSQALRKGGMAQSKLDALAGWRVSAHFTPAERAALAWAESVTDIATSHAEDEVYLPLREHFTPRQISDLTFAVSLMNAFNRLAVAMRL

SEQ ID NO: 10157 - protein, 218 aa, Klebsiella pneumoniae
PGTGQQPSAGGNCPGADMLTVVGMGPAGLQWLTPAAREAIAAAEALVGGSRHLQQFPDFAGERFALGADMPALLAWIEARTGRRVVVLASGDPLFYGIGTRLIAHFGRERVQVIPGISAVQYLCARAGIDMNDMWLTSSHGRAVSFDALAAHRKVAMVTDGRCGPREIAAQLMARGKGHRWMVIGENLAMENERIHWLPVSAVEDEYEMNAVVILDER

SEQ ID NO: 10158 - protein, 327 aa, Klebsiella pneumoniae
CFAGAIPLLRKGDGEGRVTTNQVRKDTMKYIILLIIVIAVLYVHYRGRVRYRFWRQLSDHSTFTAPLNGFMYLFSRVPNTPYLRPEMFPELAILQQNWQVIRDEGLHLQQLEQIKAADKYNDAGFNSFFKTGWKRFYLKWYEDAHPSASQLCPQTTALLRDIPSVKAAMFATLPDGSRLPRHRDPYAGSLRFHLGLATPNDDRCFIEVDGQRYSWRDGEGVLFDETYIHYAENTSGENRLILFCDIERPMRYRWAQKVNHWLGRHLMSAASAPNDIGDRTGGINRAFRYIYQIRIVGKRLKKWNKTVYYIVKWLLFGGIAWLIWSAF

SEQ ID NO: 10159 - protein, 385 aa, Klebsiella pneumoniae
PPAGGAIDLLSGGFYSAVCTAVAGRRRRNRLWSGGDRRRPRAGSRNTTMIMTVLRQQPRAAGLVLGLIAANLLAWCWALQAFGDSGALMAASLLAWGYGLRHAVDADHIAAIDNVTRKMMQQGRRPFAVGAWFSLGHSSIVVLASAAIAATATAFSTQMSWLHDTGSVIGTAVSALFLLAMAFINLVILRSVWRSFRAWKRGEPVSDEIVSGGGVMSWLFGKTFRLISRSWQMYLVGFLFGLGFDTATEIGVLGISAAGASSGISVWSIMVFPALFASGMALVDTLDNVLMVGAYGWAFSKPQRKLYYNMTITGTSVVVALFIGGLEALGLLMDKFALSGGIWRWVGALNDNLGDAGFVVVGLFVACWALSVLNYRWRGYDNLAR

SEQ ID NO: 10160 - protein, 74 aa, Klebsiella pneumoniae
TVAGVGSAGAGLSGHAAAGGNSTGYVGQRRRSAARAAGGCGRAGGAGAERLADSPRGRGGIIDEFYQYTFAGDG

SEQ ID NO: 10161 - protein, 279 aa, Klebsiella pneumoniae
WSAGRSPAGRSALSGRTPVARATAGPAGAARHNGGDPRQRAVAQGGGMKPTVISQDTPWGEIPSLLLPAYGETWLMVAIVMLFVVTLGGLVGVVLFNASPRGLFPHALLYRLLNWVVNMGRSLPFLVLMAAIIPFTYWLTGTTIGIPAAVVPMIAAGVPFFGRLVENALRELPAEVTAVGVVCGGSRWQIIASAQLSEAMPALVAAVTLNLVSMIEYSAIAGTIGAGGIGYLAVVYGYQRFDNHIMIATIVALIATIQLIQFLGDRLVNRLRHTQGNLV

SEQ ID NO: 10162 - protein, 323 aa, Klebsiella pneumoniae
HSNGYKRWEINHTIARDPMLHLTPLKSLLLASALALLAATPASAQEKFRVITTFTVIADMAQNVAGDAAVVSSITKPGAEIHDYQPTPGDIKRAQGAQLILSNGLNLERWFARFYQHLQGVPEVVVSERIQPMGISAGPYSGKPNPHAWMSADNALIYVDNIRDALVKYDPPHADTYRRNAEAYKEKIRQTMAPLQARLAQLPADKRWLVTSEGAFSYLARDYGLRELYLWPINADQQGTPQQVRKVIDTMKKERIPTIFSESTISDKPARQVAREAGAHYGGVLYVDSLSAADGPVPTWLDLLRVTTETIVNGIQDGMRKQP

SEQ ID NO: 10163 - protein, 62 aa, Klebsiella pneumoniae
GIDGNGRLGLKSQSAYDHCQQRFHILPLIRVVPSLARRYCCIMVNLAVALPSPASALSLSQV

SEQ ID NO: 10164 - protein, 323 aa, Klebsiella pneumoniae
PAGGRLFPRDAAADSPARLLGRYPGGAPGLQSCEVGMIWHTFFQPFIEFGFMRRALVVCLALSLSTTMLGVFLLLRRMSLMGDALSHAILPGVAVGYLLSGMSLLAMTLGGFIAGIVVALVAGWVSRRTPLKEDASFAGFYLGSLALGVTLVSLRGSSVDLLHLLFGSILAVDRDAALFVSGVASLTLLCIALCYRGLVSEAFDSAWLQVNHRRLPALLHGLFLALLVLNLVAGFQVLGTLMAVGVMMLPAVAARCWARTLPGILLLAAGMGALCAWLGLSLSWAISLPAGPAIVLTASALFFVSLFFGTRSRLLVGWRTLMG

SEQ ID NO: 10165 - protein, 255 aa, Klebsiella pneumoniae
LRLGDILHAAPALAGDHAGWRYAWSGVLWSAQHRLGGESAAAERGRQLEHCDLTLGADSFMPQRQRRRVSVSRRGFSLAEALIAMAIGSLLLMGACRFLPALQRHILRQGEQLALENELWQRVHAVGKHLQRAGYCRGACGGAGLELAAGGECLIVRWDANSNGRWETSPAAAAESTGFRLRDGALETLRGASDCRGGGWEKITNPAAIVVTRFSVQRQVTPGFAPELSVTLAARSAQQTGLTSEVEQRVTGYNL

SEQ ID NO: 10166 - protein, 167 aa, Klebsiella pneumoniae
LWPGVSGCSAIHTTSMLALCTAGSEACASTSRSPRLMSISSFSTRVMASPAAASCRSPSKVTIRATLDSTPDGSTFRRWPTCTVPEATVPEKPRKSRFGRLTYCTGKRSGWLSTTRWISTVSRTSSSVGPLYHGIFALWLATLSPSSADNGTKRISRLPGSCSAKVR

SEQ ID NO: 10167 - protein, 485 aa, Klebsiella pneumoniae
SAAGRRAQRRGPDAVPDPRLDIRPQTSRFRPPLIKKDDAMTTFSSTPVVTTMQVIPVAGHDSMLMNLSGAHAPYFTRNIVIIKDNAGHTGVGEIPGGEKIRQTLEDAIPLVVGKTLGEYKNVLGAVRNQFADRDAGGRGLQTFDLRTTIHVVTGIEAALLDLLGQHLGVNVASLLGDGQQRSEVEMLGYLFFVGNRHATPLAYQSQPDEQCEWYRLRHEEAMTPDAVVRLAEAAYEKYGFNDFKLKGGVLAGFEEAEAISALAKRFPNARVTLDPNGAWLLEEAIQIGKQLKGVLAYAEDPCGAEQGFSGREVMAEFRRATGLPTATNMIATDWRQMGHTLSLQSVDIPLADPHFWTMQGSVRVAQMCHEFGLTWGSHSNNHFDVSLAMFTHVAAAAPGKITAIDTHWIWQEGNQRLTKQPFEIKGGMVQVPSTPGLGVELDMDRVMQANELYKKHGLGARDDAMAMQYLIPGWTFDNKRPCMVR

SEQ ID NO: 10168 - protein, 388 aa, Klebsiella pneumoniae
RGAGRRRAAVRRGAIMRYVDEYRAPEQVMQLVAHLQQRARLLPHTAARPLRIMEVCGGHTHAIFKFGLDQLLPENIEFIHGPGCPVCVLPMGRIDACIEIASRPGVIFCTFGDAMRVPGKNGSLLQAKARGADVRIVYSPMDALRLAQQNPQREVVFFGLGFETTMPATALTLRQARERNVDNFYFFCQHITLLPTLRSLLDQPDNSIDAFLAPGHVSMVIGTEAYGFIASDYHRPLVVAGFEPLDLLQGAVMLVEQTIAQRSDVENQYRRVVPDEGNPLAQAAMADVFRLDGDSEWRGLGVISDSGVQLTPAYQRFDAEAHFRPAPQRVCDDPRARCGEVLTGRCKPHQCPLFASTCNPQSAFGALMVSSEGACAAWYQYRSQENEV

SEQ ID NO: 10169 - protein, 386 aa, Klebsiella pneumoniae
SAGGDAGPHLAAGRQRRLLIARIITHLPPARRSGIFIVEKDMIMPNAHPDLWQRYQATKAASTAKYARDIAAEMGISEAELTAARLGHDAVRLSDDARALIAALERVGETKCICRNEYAVHEQVGQFTHQHLSGHAGLVLNPRALDLRLFLSQWASAFHLNDNGRQSIQFFDHHGDALLKVYATTQTDMAAWETLIAEYRVAAPAPLTLRPLEPVKYADTADGAALENDWRAMTDVHQFFGLLRKYQLSRQQAFRLVSDDLACRVDRHALPSLLETVRQEGNEIMIFVGNRGCVQIFTGALEKLAPMRGWLNIFNTTFTLHLREESVDEVWVTRKPTSDGHVTSVELFAKDGTQIAQLYGQRSEGHPEQTQWRQQVDRLTREGQPA

SEQ ID NO: 10170 - protein, 528 aa, Klebsiella pneumoniae
NRGGVFSADAQQRDRRDKGGVMTLAVMLQGTASDVGKSVLVAGLCRIFHQDGLRTAPFKSQNMALNSGITPDGKEMGRAQIFQAEAAGIAPDVRMNPILLKPTSDRQAQVVLMGQVATSMDAVSYHQYKPRLREQILAVYQSLAGEYEALVLEGAGSPAEINLRDRDIVNMGMAEMAQCPVILVADIDRGGVFAAIYGTLALLQPQERARVKGVIINKFRGDVALLRSGIEQIEALTGVPVLGVMPWLDVDLEDEDGVALQAGKYHRTDRRDIDIAVVHLPHIANFTDFNALAAQPDVRVRYVRDPQALADADLVILPGSKNTLGDLCWLRESGMAHAVEQARQRKVPLLGICGGYQMLGETIIDEVESGLGTQPGLGVLKTVTHFAQHKTTTQVQATLGSALPDWLADAAGLRVSGYEIHMGETRREAGCPPLLLLHKAGQAVDDGAISDDGLAFGTYLHGLFDSDAFTRALLNGLRQRKGLAPLDSALEYARYKTRQFDRLAEAMREHIAIDKIYAIMRQHQEPLC

SEQ ID NO: 10171 - protein, 510 aa, Klebsiella pneumoniae
ALTGWFRPEAQAYLAYRRARSVGRISAAPSGNVVSGVTMKQDVILVLDCGATNVRAMAVDRQGNIIARAATANASDIAAEKSDWHQWSLEAIMQRFADCCRQIHDQLASCTVRGITVTTFGVDGALVDEKGALLYPIISWKCPRTAAVMEKISQYMPARQLQQIAGVGAFAFNTLYKLVWLKENHPQLLAQAHAWLFISSLINHRLTGEFTTDLTMAGTSQMLDLRQRDFSAPILQATGLPRRLFPRLVEAGQPIGALLPEAAALLGLPVGIPVISAGHDTQFALFGAGAGQDEPVLSSGTWEILMVRSAQVDTSLLCDYSGSTCELDSQPGRYNPGMQWLASGVLEWVRKLLWSADTPWQTLIDEAQAIPPGAQGVRMQCDLLASQHAGWQGVTLNTTRGHFYRAALEGLSDQLAQHLQTLEKIGGFRAKELLLVGGGSRNALWNQIKANRLGIPIKVLDDAETTVAGAAMFGWYGVGEFSSPEQARAQVAYRYRYFWPQTEPELIEEA

SEQ ID NO: 10172 - protein, 338 aa, Klebsiella pneumoniae
TIRGTTMRHSTMLATAAFATLLATSAFAADLPGKGITVKPAQSTISEESFQTLLVSRALEKLGYTVEKPSEVDYNVAYTSIAAGDTTFIATNWQPLHDDMYAAAGGDNKFYRKGVYVSGAAQGYLIDKKTAEQYHITSIDQLKDPQIAKLFDTNNDGKADLTGCTPGWGCEAVINHQIDAYGLSKTVTHNQGNYAAMMADTIARYKEGKPVLYYTWTPYWVSDVLKPGKDVVWLQVPFSSLPGEQKNIDTKLANGANYGFPVNTMHIVANKAWAEKNPAAATLFSVMKLPIADINAENAMMHEGHASEADINGHVDGWIKAHQPLFDSWVKTALAAQQ

SEQ ID NO: 10173 - protein, 252 aa, Klebsiella pneumoniae
QTVGGGVMNQVKSLKQLSYGGLAAAVLLIIVPQEAFAMHIMEGFLPPMWALAWWLLFLPCLWYGLVRLRRIVQEESNQKVLLALCGAFIFVLSALKIPSVTGSCSHPTGVGLAVILFGPGVVAVLGAIVLLFQALLLAHGGLTTLGANGMSMAVIGPMVGYLVWKLACRAGIRRDVGVFLCAMLADLMTYFVTSVQLGVAFPDPATGAGGSIAKFMGIFCLTQIPIAIAEGLLTVMIYDQLTKRRLIAAEGH

SEQ ID NO: 10174 - protein, 135 aa, Klebsiella pneumoniae
VWSGMDIKVYDKCILKKTKGREMGKRIEREKMTIQRMIALYQRRCPEAQADNAHYQALNAYADKRLDKCVFGENKPACKQCPVHCYQPAKREEMKQIMRWAGPRMLWRHPILTVRHLLDDRRPVPPLPEKYRPKK

SEQ ID NO: 10175 - protein, 378 aa, Klebsiella pneumoniae
MSAGSTKFTVSRIAALSLVSLWLAGCTNTNNPPAPVSSAGGAASSSTNSGMLITPPPSGVKSAPQAQPIQPMQTQTIQPQPAPVAQEPVQTVNGRIVYNRKYGDIPKGSYTGGSTYTVKRGDTLFYIAWVTGNDFRDLAQRNNIPAPYALNVGQVLQVGNASGQPITGENAVSQASARASGGATTSTTSAQKSTAVVASQPTITYSESSGEQSATKMLPNNKPATTTTTVVAPVTAPTTVSTTQPTASSTSTSSPISAWRWPTDGKVIENFSGAEGGNKGIDIAGSKGQAIVATADGRVVYAGNALRGYGNLIIIKHNDDYLSAYAHNDTMLVREQQEVKAGQKIATMGSTGTSSTRLHFEIRYKGKSVNPLQYLPQR

SEQ ID NO: 10176 - protein, 95 aa, Klebsiella pneumoniae
IKKGPVQGFIKTSLRLLLPGDRIGLADRPDNSLFHVSVCTLLYFKVFYFGSWTFYFILNDRNNIFCYIFPPARQNAIYFNSYHANKLSQKKRLLF

SEQ ID NO: 10177 - protein, 264 aa, Klebsiella pneumoniae
RVRGESGGAGDVCRPSAAGAERHDGESSMSGKLYALSSGPGAADLITVRAARILGQLDVLYAPAGRKGGDSLALSIVREYLGAHTEVRCCHFPMSADSAEKEAVWNDVAAALAQEVAAGRQVGFITLGDAMLFSTWVFLLQRIGCPEWLEIVPGVTSFAAIAARAKTPLAMEQQSLAVISCTAPEADIAAALRQHDSLVLMKVYGRFARIKALLAQAGLLDAALMMSEATLPGEQCWRRLREVSDDQPLPYFSTILVNKQWEEA

SEQ ID NO: 10178 - protein, 106 aa, Klebsiella pneumoniae
RRRGNLAWRLSAGQPAPAPAPDPPRRRVCGAAGPELAGGAGCGSSAGATDLAGAQRRRSPAFSAPSAPLLGCPPLPRGAAGRRGAGGAPAHGQSAGAGGQATVDKR

SEQ ID NO: 10179 - protein, 863 aa, Klebsiella pneumoniae
FPFLMSLPDGASMKRITTARVREYALLPVTAGRAVALATVPTMMFCLSPLSRALADDYFDPAALEFADPQQQTSDLHYFAKPGGQQPGTYHVTVVVNDQELGQADITFVDDGGQLRPVLTPGQLAEYGVNVSAFPAFQALHEGETFTRIEKFIPDASSRFSFANQRLTLSIPQVAMNVQSRGYVDPSRWDDGVPAAFVDYYFSGAQIKNADEGESSRSNYLNLRSGLNLGAWRLRNISSMQYDQQRRHWDTQSTWLQRDVRSLKSLLRIGDTYTTGDVFDSIQFRGVQLMSDDEMLPDSQRGFAPTIRGVAHRNAKVTVSQHGYVIYETFVSPGAFAISDLYPTSQSGDLEVKVTESNGAVRTFTQPYSAVPYMLREGRGKFSLSAGRYHSGGESVRSPEFLQGTLFYGLTAGFTLYGGTQLARDYQAWALGLGRGFGEFGSLGGDVTQAVTRTPSGKRYTGHSLRAQYQKNFVSSGTAFSLASYRYSSSGYYDFAEASALESAQGQVDNRRRREELSVSQSLGGLGSLAVSAWSQEYWHRQSRDETVHLGFYSAWKGISWGVGYYYTRASGQQKNDRSWSFNINIPLGGPLSDSAVSYNTTSDSNGYTSQQMSLYGAVPTRPNLFYSVQQGYGNQGRGSNSSASLDYHGGFGNAQIGYRHDAASNQLTWGGAGSVVAHPHGVTFGQTVGESFAIVRAPGAAGVAVQNGNNVHTDWRGYAVVPSLTAYRKNVITLDTESMADDTDVDQQGQTVIPGGGAVVMANYQTHIGNRVLFTLRNAQGPLPFGASARLVEEEESGNPPGGMVADGGQVYLSGVPQEGTLAVSWIVNNQSQSCTLHFHLPDNPQQSLNTVKTVSGLCQTR

SEQ ID NO: 10180 - protein, 537 aa, Klebsiella pneumoniae
FAFIAHLAAGLRIERGLVKDHHRFLASANAIHRFAVDKQGGNLAVQLQMIVAFKFRGAVNADHRIIVGAETAGLARAAALLFHCGFKTSFINLDVALAAHIGGQVDREAVGVVQTEGGFAVQGVAFQLRQLLIQQRQAALEGAGKLLFFGFQHLLNLSLLLLQLVAGGAHHIDQRGNQFPEEGVLRAQHVAVTDRAANDTTQHVAAVFIRRDHAVGNQEGAGANVVGDNAQRLVRQIGRAGDFRHAGDQIAEQVDVIVGVNVLQHRGNTLQTHTGVDGRLRQRLHGTVSLTVELHEDDVPNLNVTVAIFFRASRRAAPDVIAVVKEDFGARAARTGVAHLPEVVRSKRRAFVVAYADNTLARNAYFIGPDVESFVIGLVNGNPQFFFRQREPVLTGQQFPRVFDGILLEVIAKAEVAQHFKEGVVTRGVTDVFQIVVFTTRTHATLCGGRTRIITFVETKEDILELVHPCIGKQQGRIVVRHQGAAGNYLMSLAMEKVEKRLTDLSGALAHNYPEIKLHVILQVASVLAALALPAPN

SEQ ID NO: 10181 - protein, 366 aa, Klebsiella pneumoniae
GPLMFSALCRRLLPLALGTGFVFAAAPAFSALGDTASSQARHIATVFPGRMTGTPPEMLSADYLRQQFALMGYQSDVRSFNTRYIYTDSNQRKNWHNATGSTVIAAHEGKVRQQIIIMAHLDTYAPQSDKDVENNLGGLTLQGIDDNAMGLGVLLELAEHLKNVPTRYGIRFIATSGEEEGRLGAQNLLQRMSEAEKKNTLLVINLDNLVVGDKLYFNSGRSTPASVRKLTRDRALAIARSKGIAAYTNPGLNPAYPKGTSCCNDASVFDNAGIPVLSVEATNWSLGKKDGYQQRSKSASFPQGTSWHDVQLDNQQYIDHALPGAHRTPRTRGSESHAAAGERAGESGEEKLIRTKERAVSPACSF

SEQ ID NO: 10182 - protein, 65 aa, Klebsiella pneumoniae
RKLILFPLYSVGPLVVTVQAAAWAIIPLHKIIQAASGRQERLSFATHVSSVPEEQAQPGQRRLEG

SEQ ID NO: 10183 - protein, 163 aa, Klebsiella pneumoniae
FLVIFYRTLTLPYSLRTVLSENSRNHNSKHNSKSCPTLTHSMELREITMANHVNRNNFDENAEDIHNDVSQLADTLEEVLKSWGSDAKEEAEAARVKAQSLLKETRARLNGHNRVQQAALDARQAACDALGCADTYVRNKPWHSVGAAAAVGVFIGVLLNLRR

SEQ ID NO: 10184 - protein, 305 aa, Klebsiella pneumoniae
GTVMDQKRLTHLRQLEAESIHIIREVAAEFSNPVMMYSIGKDSSVMLHLARKAFYPGTLPFPLLHVDTGWKFREMYEFRDRTAKAYGCELLVHKNPEGVAMGINPFVHGSAKHTDIMKTEGLKQALNKYGFDAAFGGARRDEEKSRAKERIYSFRDRFHRWDPKNQRPELWHNYNGQINKGESIRVFPLSNWTELDIWQYIYLENIEIVPLYLAAERPVLERDGMLMMIDDDRIDLQPGEVIEKRMVRFRTLGCWPLTGAVESEAQTLPEIIEEMLVSTTSERQGRVIDRDQAGSMELKKRQGYF

SEQ ID NO: 10185 - protein, 190 aa, Klebsiella pneumoniae
KRSIAREDPMTIATLTPAEAQAQIAQGARLIDIRDADEYAREHIPDAELVPLATLTSGAPLNARAGETVIFHCQAGSRTQNNAIRLAAAAAPAQACLLAGGIQAWKAAGLPVVEDSSQPLPLMRQVQIAAGVLILLGVLLGYTVNGGFFLLSGAVGAGLTFAGVTGFCGMARLLATMPWNRRQGVKTRSR

SEQ ID NO: 10186 - protein, 284 aa, Klebsiella pneumoniae
SPAISPLLRLIGDPQPEGRNMKIDLAGKVALVTASTAGIGFAIAKGLAESGAEVILNGRSEQSVNAAIARLQNEVPGAKARPAIADLSDADGAAQLLRAVTGVDILVNNAGIYGPQDFYATDDATWDNYWQTNVMSGVRLSRGLLPAMVSKGWGRVVFISSESARNIPADMIHYGVTKTAQLSLARGLAKYVAGSGVTVNSVLPGPTISDGFAEMLKDEVAKTGQSLEELAKAFVMTHRPSSVIQRAASVEEVANMVVYVCSPQASATSGAALRVDGGVVDDIL

SEQ ID NO: 10187 - protein, 251 aa, Klebsiella pneumoniae
VIHMENPAPLTCALPERVATVGEGVKDSLPIVISYLPVAFAFGLNATRLGFTPLESLFFSCIIYAGASQFVITAMLAAGSSLWVAALTVMAMDVRHVLYGPSLRSRIRSALDKKKTALWAFGLTDEVFAAATARLVRDNRRWSENWMLGLAFTSWASWVCGTLAGAWSGNGLLVDYPAVEAALGFMLPALFMSFLLASFQRQQSLCVTAALAGALGGILLFSIPAAILAGIVCGCLTALLQAMLKGMPDEQ

SEQ ID NO: 10188 - protein, 298 aa, Klebsiella pneumoniae
VNIMPMKFKQIQAFITVAREGNMTLAAEKMGITQSGLSRLLLSLEADLSASLFERHKHGMALSEYGSAFLPYALTMLNTEQKAREEIELIRGAGKGILRIGCVSSLLTSHFIDKLAAFHQRHPQIHLRIVDRIDSELYKLLLMHDIDIALCGPLPHDEKIVVRGKINWQDRICIVARQHHPLHQAADVTLEAMLDYPWIMPPPSSTPMNILADIFRARQLPCPQPVIECASSSAIKAFLCESDLLTSMPAPVYRHEEALGLLRPFELEGSVFIRDFYAYSHFGVLSGAALQLIQHLKQ

SEQ ID NO: 10189 - protein, 443 aa, Klebsiella pneumoniae
GKIMSSLYAKLIDVIERQITPLAGAIGQQKYVTSIRDGFITALPFMIVGSFLLVFIFPPFSPDTTWGFARAWLQFSLDHRDALMLPFNFSMGVMTLFIAVGIAASLAKHHHLDSLTAGMLSLMSFLLVAAPLKDGQISTAYFSGQGIFTAILVAIYSTELYAFLKRHNITIRLPPEVPAGVARSFEILIPVLAIILTLHPLNLFIEAQLGMIIPEAIMSLVKPLVAASDTLPAILLSVLVCQVLWFAGIHGALIVTGIMNPFWMANLSVNQAAMAAGTAIPHIYVQGFWDHYLLIGGVGSTLPLALMLLRSKAVHLRTIGRMGVVPGVFNINEPILFGAPIIMNPLFFLPFVLVPMVNATLAYFALKLDLVSRVVSMTPWTTPAPIGASWAANWGFSPVILCLICMATAMVMYLPFLKAYEKQLGAQERENAVGQADNAAQTA

SEQ ID NO: 10190 - protein, 446 aa, Klebsiella pneumoniae
GFVMVKERRTELVEGFRHSVPYINAHRGKTFVIMLGGEAIEHENFSNIVNDIGLLHSLGIRLVVVYGARPQIDANLAEHHHEPVYHKQTRVTDAKTLELVKQAAGMLQLEITARLSMSLNNTPLQGAHINVVSGNFIIAQPLGVDDGVDYCHSGRIRRIDEEAIHRQLDSGAIVLMGPVAVSVTGESFNLTSEEIATQLAIKLKAEKMIGFCSSQGVYNQAGEIVSELFPNEAQARVEELEADEDYNSGTVRFLRGAVKACRSGVRRCHLISYQENGALLQELFSRDGIGTQIVMESAEQIRRATINDIGGILELISPLEQQGILVRRSREQLEMEIDKFTIIQRDNTTIACAALYPFPEEKIGEMACVAVHPDYRSSSRGEVLLERIAAQARQMGLSKLFVLTTRSIHWFQERGFTPVDIDLLPESKKQMYNYQRRSKVLMADLA

SEQ ID NO: 10191 - protein, 354 aa, Klebsiella pneumoniae
RLTIKENTMLSHPAEKYRPYPPFALPDRRWPDRQISHAPRWLSTDLRDGNQALAEPMDSARKLQFWDLLLECGFKEIEVAFPSASQTDFNFVRQLIDEQRIPEDVTIQVLTQARDPLILRTFEALRGARRATVHLYNATAPLFRELVFGMDKAEVIALATRATRLIRQQCEQQPETRWQYEYSPETFCFTEPEFALEICEAVADVWQPCAERPMIVNLPATVEVNTPNVYADQIEYFCRHFSRRGEVCISVHPHNDRGTGVASAELAVMAGADRVEGCLFGNGERTGNVCLVTLAMNLYSQGIDPELRFEQMNRVVEVVENCNQIPVHPRHPWAGSLAYTAFLRLPSGCDQKRV

SEQ ID NO: 10192 - protein, 227 aa, Klebsiella pneumoniae
TEMNMQYPINEMFQTLQGEGYFTGVPAIFIRLQGCPVGCAWCDTKHTWDKLADREVSLFSILAKTKESDKWGPASSEDLLAIIGRQGWTARHVVITGGEPCIHDLTPLTSLLEQNGFSCQIETSGTHEVRCSPNTWVTVSPKVNMRGGYDVLSQALQRADEIKHPVGRVRDIEALDELLETLSDDKPRIIALQPISQKEDATRLCIDTCIARNWRLSMQTHKYLNIA

SEQ ID NO: 10193 - protein, 183 aa, Klebsiella pneumoniae
GIAMFTFIKKVIKTGTTTHAYPLEPMPVDKNFRGKPEHTPQQCIGCAACVNACPSNALTVEIDLATNQLAWQFNLGRCIFCGRCEEVCPTAAIKLSPEYELAVWKKEDFLQQSRFAICHCRECQRPFAVQKEIDYAIALLKHNGDTRAELHRESFETCPECKRQKCLVPSDRIELTRHMREAS

SEQ ID NO: 10194 - protein, 478 aa, Klebsiella pneumoniae
GAAMNTTIAQQIANEGGVEAYLHAQQHKSLLRFLTCGSVDDGKSTLIGRLLHDTRQIYEDQLSSLHNDSKRHGTQGEKLDLALLVDGLQAEREQGITIDVAYRYFSTEKRKFIIADTPGHEQYTRNMATGASTCDLAILLIDARKGVLDQTRRHSFISTLLGIKHLVVAVNKMDLVEFSEARFNEIREDYLTFAEQLPGNLDIRFVPLSALEGDNVASQSANMPWYSGPTLLEVLETVEIQRVVESQPLRFPVQYVNRPNLDFRGFSGTVASGTVQVGQRLKVLPSGVESSVARIVTFDGDLQEAAAGEAITLVLKDEIDISRGDLLVDAQASLPAVQSASIDVVWMAEQPLTPGQSYDIKIAGKKTRARVDAIRYQVDINNLTQREVESLPLNGIGLVELTFDEPLVLDPYQQNPVTGGFIFIDRLTNVTVGAGMVNEPHLQASTSASQYSAFELELNQLIRKHFPHWDARDLLGGK

SEQ ID NO: 10195 - protein, 752 aa, Klebsiella pneumoniae
ATHIMLTRLREIVEKVASAPRLNEALDILVTDVCQAMETEVCSVYLADNDRRCYYLMATRGLKKPRGRTVALAFDEGLVGLVGRLAEPINLADAQKHPSFKYIPAVKEDRFRAFLGVPIIQRRQLLGVLVVQQRELRQFDESEESFLVTLATQMAAILSQSQLNALFGQYRQTRIRALPASSGVAIAEGWMDVSLPLMEQVYEASTLDTASERERLTGALEEAANEFRRYSKRYAAGAQKETAAIFDLYSHLLSDARLRRELFAEVDKGAVAEWAVKKIIEKFAEQFAALSDGYLKERAGDLRTLGQRLLFHLDDSIQGPNTWPARIILVADELSATTLAEVPQDRLAGVVVRDGAANSHAAIMVRALGIPTVMGADIQPSLLHGHTLIVDGYRGELLVDPEPVLLQEYQRLISEENELSRLAEDDLQRASELKSGERVKVMLNAGLSPEHEEKLGSFVDGIGLYRTEIPFMLQSGFPSEEEQVAQYQGMLQMFNSKPVTLRTLDIGADKQLPYMPISEENPCLGWRGIRITLDQPEIFLIQVRAMLRANAATGNLSILLPMVTSLEEVDEARRLIDRASREVEEMIGYAIPRPRLGVMLEVPSMVFMLPQLASRIDFISVGTNDLTQYLLAVDRNNTRVASMYDSLHPAVLRALAMIAHDAERFGIDLRLCGEMAGDPMCVTILIGLGYRHLSMNGRSVARVKYLLRRIDIEEAQELSRRSLDAQMTAEVRHQVAAFMERRGLGGLIRGGR

SEQ ID NO: 10196 - protein, 134 aa, Klebsiella pneumoniae
GNNMTSRFMLIFAAISGFIFVALGAFGAHVLSQSLGAAEMAWIHTGLEYQAFHTLAIFGLAVAMQRRISIWFYWSSVFLALGTVLFSGSLYCLALSHLRLWAFVTPVGGVSFLAGWVLMLIGAIRLKRKGVVHE

SEQ ID NO: 10197 - protein, 68 aa, Klebsiella pneumoniae
RMNIDNSDVSLFFAGRQDMLTKYALVAIIVLCITVLGFTLLVHSSLCELSIKERNIEFKAVLAYESKK

SEQ ID NO: 10198 - protein, 66 aa, Klebsiella pneumoniae
RLCIQNGCGDNFAAYATTSSLLLRRIWCIREDESATPRPSGRCIRNVIPLVLAMISQTIKQRRRCY

SEQ ID NO: 10199 - protein, 919 aa, Klebsiella pneumoniae
WNRMTNYSLRARMMILILAPTVLIGLLLSIFFVAHRYNDLQRQLEDAGASIIEPLAVSSEYGMNLQNRESIGQLISVLHRRHSEIVRAISVYDSHNRLFVTSNYQLNPSELQIPKGEAFPRHLSVIRDGDMMILRTPIVSESYSPDESPESDAKMPGNMLGYVALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNVDQATSDLRETLEQMEIQNVELDLAKKRAQEAARIKSEFLANMSHELRTPLNGVIGFTRLTLKTDLNATQRDHLTTIERSANNLLAIINDVLDFSKLEAGKLILESIPFLLRTSLDEVVTLLAHSAHDKGLELTLNIKNNVPDNVIGDPLRLQQIVTNLVGNAIKFTEHGNIDVLVEQRAISNSRVQIEIQIHDTGIGIPERDQSRLFQAFRQADASISRRHGGTGLGLVITQRLVKEMGGDISFHSQPNRGSTFWFHISLDLNPNAIPDTLNTDGLVGKRLAYVEANATAAQCTLEMLAATPLEVIYSPTFSSLAEAQYDILLVGIPVSMRDLSPHREKLAKACAMSDNVLLALPCHAQVSAEALKRDGVAACLLKPLTTTRLLPALVATSHALASAPLMQIDSHKLPMTVMAVDDNPANLKLIGALLDDLVQQVILCDSGQQAVDKAKQLQMDLILMDIQMPDMDGIRACELIHHLSHHQQTPVIAVTAHALEGQREKLLSAGMNDYLAKPIEEEKLHALLLRYQPGLHSVVPASLPPAEPIVDHNQTLDWQLALRQAAMKPDLAREMLQMLIAFMPEVRNKVEEQLVGEQPEGLVDLIHKLHGSCSYSGVPRLKKLCHTLESQLRAGTAAEDLEPELLELLDEMDNVAREACRMGV

SEQ ID NO: 10200 - protein, 1129 aa, Klebsiella pneumoniae
SGAIMLRVYHSNRLDVLEALMEFIVERQRLDDPFQAEMVLVQSTGMAQWLQMTLAARFGIAANIEFPLPASFIWDMFVRVLKDIPGESAFSKQSMSWKLMTLLPQHLEEDDFILLRQYLSDDGDKRKLFQLAARVADLYDQYLVYRPEWLMRWEAGQRVEGLGDAQQWQAPLWQALVSYTAELGQPQWHRANLYQRFISTLEKADEPPAGLPSRVFICGISALPPVYLQALQALGKHVDVYVLFTNPCRYYWGDIKDPAFLAKLLSRQRRHHREARALPLFRDTEQAPGLFNDAGEQDVGNPLLASWGKLGRDYIYLLAGLERYEELDAFVDIAPDNLLHNLQSDILELRNAAVAGQSAEAFAHSRDKRPLTLDDRSLSIHVCHSPQREVEVLHDRLLAMLEADPTLTPRDIIVMVADIDSYSPYIHAVFGAASGDRWLPWAISDRRARESHPVLQAFITLLSLPDSRFASEDVLALLDVPVLAARFNITEEGLRYLRQWVNESGVRWGMDDDNVRELDLPATGQHTWRFGLTRMLLGYAMDSREGEWQSVLPYDESSGLIAELVGNLASLLMQLNLWRRGLAQQRPLAEWLPVCRDLLNDFFLPDSETEAALALIEQQWLAVIDSGLEAQYGEQVPLTLLRDELAQRLDQQRISQRFLAGPVNICTLMPMRSIPFKVVCLLGMNDGVYPRTLPPLGFDLMSQKPQRGDRSRRDDDRYLFLEALMSAEQTLYISYIGRSIQDNSERFPSVLVQELVDYIGQSHCLAGDEELDCDASEARVKAHITHLHTRMPFDVANFQEDENKSYAREWLAAAGQQGEAHSDFIQPLTAPPIDSLPFDQLLRFWQHPVRAFFQQRLRVNFRAEEDDIPDDEPFTLEGLSRYQLNQQLLNTLIEEQDVSAMFRRFRAAGELPYGAFGELVWETQRLEMQALAERVMAERQQAQSMEIDLQCGGVNLTGWLQQVQPDGLLRWRPSLLSVSQGMQLWLEHLVYCASGGTGESRLFVRKEGEWRFPALAPAEAQAYLNELVDGYLLGMSQPLLLLPESGGAWLKACYDAEKDVILMDEETQQKARSKFLQTYEGNMVVSGEGADIWYQRLWRSLEPAHYEEIIAQTQRYLLPLYRYHRSTQI

SEQ ID NO: 10201 - protein, 198 aa, Klebsiella pneumoniae
RDQIRGDGQKPAGTARGALTKDIPMNTDAIESMVRDVLSRMNSLQDGITPAPAAPTNDTVRQPKVSDYPLATRHPEWVKTATNKTLDDLTLENVLSDRVTAQDMRITPETLRMQAAIAQDAGRDRLAMNFERAAELTAVPDDRILEIYNALRPYRSTQAELLAIADDLEHRYQARLCAAFVREAAGLYIERKKLKGDD

SEQ ID NO: 10202 - protein, 352 aa, Klebsiella pneumoniae
GRQMIAFDQLTWLHGKPQSSGLLKANPEDFLVVEDLGFAPDGEGEHVLVRILKNGCNTRFVADALAKFLKIHAREVSFAGQKDKHAVTEQWLCARVPGKEMPDLSKFQLEGCQVLEYARHKRKLRLGALKGNQFTVILREISDRQDVETRLQAIAERGVPNYFGAQRFGIGGSNLQGALRWAESGAPVRERNKRSFWLSAARSALFNQQVSIRLKKTEFNQVVDGDALQLAGRGSWFVVTPEELEVSQARVHNRELMITATLPGSGDWGSQRDALAFEQAAIAEETALQALLVREKVEAARRAMLLYPQRLSWNWWDDVTVELRFWLPAGSFATSVVRELINTTGDYANIAE

SEQ ID NO: 10203 - protein, 476 aa, Klebsiella pneumoniae
GEKMSTLPVDNPGIASVPVSSVGDVARLINSGKEQAKYARMIVFLALGGVFLDAYDLTTLSYGIDDVVREFQLSPLLTGLVTSSIMVGTIVGNIIGGWLTDKYGRYSVFMADMFFFVISAIAAGLAPNVWVLIGARFLMGIGVGIDLPVAMSYLAEFSRFAGKGNKAARLAAWCPMWYAASTVCFLIIFGLYFLLPQEHLDWLWRASLLFGAVPALLIIAVRSRFMNESPLWAANQGDLTSAVRILRDSWGIHAHEVPAAKPAPAPKVSFRVLFEKPYRERTIVAGVMNICISFEYTAIAFFLPSILAQFLGAGVFETISASLGLNALFAFTGGLLGMHLAWKYPSRHVAIAGFALQFVALIVLALVGQPHATAGIVLAIAMLGLWLFAEGFGPGAQLMIYPALSYPTAIRATGVGFSRALSGIGSALALFILPLLQASLGTQMFWVVSLAAIIPIFFLLAVRHEPTREDIDALHE

SEQ ID NO: 10204 - protein, 230 aa, Klebsiella pneumoniae
KMEINETLLRQIIEEVLSEMKSGADKPVSFSASAASVASAAPVAVAPVSGDSFLTEIGEAKPGTQQDEVIIAVGPAFGLAQTANIVGIPHKNILREVIAGIEEEGIKARVIRCFKSSDVAFVAVEGNRLSGSGISIGIQSKGTTVIHQRGLPPLSNLELFPQAPLLTLETYRQIGKNAARYAKRESPQPVPTLNDQMARPKYQAKSAILHIKETKYVVTGKNPQELRVAL

SEQ ID NO: 10205 - protein, 103 aa, Klebsiella pneumoniae
PRGIRPGQRVWPGKALGVKRLRAVNRNQFGNQLFRQNGCHQVILSMDHYQRHFGFSLAFVSFDKLGLYKVSFAGIVRRFLHFGVGGGEITRFSGVQRFVAQAT

SEQ ID NO: 10206 - protein, 267 aa, Klebsiella pneumoniae
AGLMLEIIYQDDWLVAVNKPSGWLVHRSWLDRDEKVVVMQTVRDQIGQHVFTAHRLDRPTSGVLLMGLSSEAGRLLAQQFEQHQIRKRYHAIVRGWLMEEALLDYPLVEELDRIADKFAREDKGPQPAVTHYRGLATVEMPVATGRYPTSRYGLVELEPKTGRKHQLRRHLAHLRHPILGDSKHGDLRQNRSAAEHFGCQRLMLHASELSLTHPFTGEPLTLRAGFDDVWMRALSQFGWRGLLPLNERVEFADDSGQDEENKVNPGR

SEQ ID NO: 10207 - protein, 270 aa, Klebsiella pneumoniae
GTMMTSTLKKISRRVALTLAVSACFSPVTQAAELLTEGVFKVGMEVTYPPFESYDSNNNIVGLDPEFAALIAQHLQAKPQLIDTKFTSLILGIGKKYDAVISGMYVTPERQKQADAIPYALSGASIIALKGGAVQPKTEDELCGVKVGLQAGTTWVTSLKKHSDEWCLKNGKPAITIQEFPTAPEASQALLSKNIGAQLEIAPAAQIIVDKSRGRLAISSTRLVYPLPLGIYVAKGNTELAEAIKATLATLKANGQYAALIKKYNLESID

SEQ ID NO: 10208 - protein, 123 aa, Klebsiella pneumoniae
ESMMSTTLFKDFTFEAAHHLPHVPEGHKCGRLHGHSFMVRLEITGEVDPHTGWIMDFAELKAAFKPTYDRLDHYYLNDIPGLENPTSEVLAKWIWDEMKPRVPLLSAVMVKETCTAGCVYRGE

SEQ ID NO: 10209 - protein, 619 aa, Klebsiella pneumoniae
KATINRGVSMRYIAGIDIGNSSTEVALATVDDAGVLNIRHSALAETTGIKGTLRNVFGIQEALTQAAKAAGIQLSDISLIRINEATPVIGDVAMETITETIITESTMIGHNPKTPGGVGLGVGITITPEALLSCSADTPYILVVSSAFDFADVAAMVNAATAAGYQITGIILQQDDGVLVNNRLQQPLPVIDEVQHIDRIPLGMLAAVEVALPGKIIETLSNPYGIATVFDLNAEETKNIVPMARALIGNRSAVVVKTPSGDVKARAIPAGNLLLIAQGRSVQVDVAAGAEAIMKAVDGCGKLDNVAGEAGTNIGGMLEHVRQTMAELTNKPAQEIRIQDLLAVDTAVPVSVTGGLAGEFSLEQAVGIASMVKSDRLQMALIAREIEHKLQIAVQVGGAEAEAAILGALTTPGTTRPLATLDLGAGSTDASIINAQGEISATHLAGAGDMVTMIIARELGLEDRYLAEEIKKYPLAKVESLFHLRHEDGSVQFFPSALPPAVFARVCVVKPDELVPLPGDLPLEKVRAIRRSAKSRVFVTNALRALRQVSPTGNIRDIPFVVLVGGSSLDFEIPQLVTDALAHYRLVAGRGNIRGCEGPRNAVASGLLLSWQKGGTHGE

SEQ ID NO: 10210 - protein, 441 aa, Klebsiella pneumoniae
TAAIVRFHSDHQRVARRVAFAPYRIDDALRGMRLQFCQLIAVRAMHGDPAPLGDKADDLVARDWLAAAGNMVHQVAYPFHHYPAIVLGAILRRVGFLLQLLQRGRILLGGARFIELRLQEVDHLVETDIATADGGQQFIELVEVIARQQVLFRILQADAQMLQLVVEDLPTGENVLVAILLTEPGVDLRASAAGGHIAEVRVQPVTARVRLLLGNNFDLIAHLQLVGERHDAAANFGADAAMADIAVNMIGKVQRRRPRRQVHHVAFRRKDIHPVVEDLAAHFVEHLAGVGHLFLPGNQLTQPGDTVFIAAAAAGAGSRALFVLPVRGHAQLGVFMHLPGADLNLHRLAARPQHHGMDRLVTVGFRVGHVVVEFIRQMAVVSMDDPQRGIAILQTLSHNTHRANVKQLVESEVFFLHFAPDTVDMLRPAIDFRLDAFGFHL

SEQ ID NO: 10211 - protein, 414 aa, Klebsiella pneumoniae
ICALLISRVVAVSGEEQGQRQPLVDVARRLGVSVNDLLRPYLIRILVEGQIVVIHKWRGVVHPPGFPLFADLNLRDDRVNAGGGMVDVRDRAGGRHRLQIAIVDAIAHDIVAQLAPAFPVGQRDAGAGEQRAHPFGFRLPLLLQIFVEVRPAGVARLLEAGEALAALAGQLHRGVQRVPGHGVEVDIGEVQPLRAAVGNALPRQVTVQIHLPQADGVGGRVAGRHRGNRLNVAHVGHGGQGAHRGGDCAAEIRRVHGMGDVQRAEVAGDIFPDMRIAEVFIIGGRRTDLQDLRTQIAHGDPPGHRTGAVHGVFKHDVRVAGFKLDLRQALEQVAGADPALADPLVGHQLRIEVADGAIGERFAVQPFDVIRREQGHLRIFFRQLEGDIRDHHPQRQGFDADFLIGIFTPGIKKA

SEQ ID NO: 10212 - protein, 382 aa, Klebsiella pneumoniae
GQQMKIVIAPDSWKESLSALEVASAIEQGFREIYPDAEYVKLPVADGGEGTVEAMVAATGGLLVPLTVTGPLGEPVEAFYGLSGDSQCAFIEMAAASGLESVPPAQRNPLLTTSWGTGELIRHALDAGVRQIIIGIGGSATNDGGAGMAQALGAKLLTAEGQQIASGGGALETLARIDLSELDSRLADCRIDVACDVTNPLTGPQGASAVFGPQKGATAQMIDRLDSGLRHYARIIARDLDIDVLSLEGGGAAGGMGAALYAFCGAQLRPGIEIVTDALQLAERVADADLVITGEGRIDSQTIHGKVPVGVARVAKRFNVPVIGIAGSLTADVGVVHQHGLDAVFSVLYTICTLDEALANAAANLRMTARNVAAVLQMGDRR

SEQ ID NO: 10213 - protein, 398 aa, Klebsiella pneumoniae
NNKIVENNMSANAESQTPQQPGSKKGKRKGALLLLTLLFIIIAVAYGIYWFLVLRHYEETDDAYVAGNQVQIMAQVAGSVTKVWADNTDYVQKGDPLVTLDRTDAQQAFEKAKTQLAASVRQTRQQMINSKQLQANIDVKKTALAQAQADLNRRIPLGAANLIGREELQHARDTVASAQAELDVAIQQYNANQAIVLGTRLEQQPAVLQAATEVRNAWLALQRTQIVSPISGYVSRRSVQPGAQIGTTTPLMAVVPATNLWIDANFKETQLAHMRIGQPATVISDIYGDDVKYTGKVVGLDMGTGSAFSLLPAQNATGNWIKVVQRLPVRIELDEKQLAEHPLRIGLSTLVEVNTTDRDGEMLASQVRSSPVYESNAREIALDPVNKLIDEIIQANAG

SEQ ID NO: 10214 - protein, 469 aa, Klebsiella pneumoniae
SKWMHYGKRFPVVDLLVVTMITYGRLSLSGVVGDHPGETTIRKGRSMNIQLMNVAVDIIEQRLAPLANVLTRNNHITAMRDSFALAMPFVIVGSLLVPILFPPVSIDGASRFGQVYLLLRPILLPTFQLTIGLVALIVAFGASASLAKQYRLPERLCGLTGCLAFLLFIGFRETAVSNVYLGGMGIFTALISSTYSIEIIRFFYKKGWCIRLPDEVPLMTRNGFQLLIPLLVVMLSISVMNAILLQTTGRIVPELISEAVRPLVLASDTLMAVLISLFICNLLWFIGIHGALIITGIMNPFWMTYLFENQQALAAGSPTLPHIYLQGFWDFYLLIGGIGSTLPLVLMAMRSRSRQLKSVAKIGLLPSLFNINEPILFGFPVIMNPVFLLPFLFVPLINACIAWYLTQLGILDRAVAMLPWSMPSPLGAAWSANGSWKNLCMSLFAMFNAWMLYRPFFKVYERQLAETER

SEQ ID NO: 10215 - protein, 458 aa, Klebsiella pneumoniae
GVHLITHVSPLGSMDMLSQLEVDMLKRTASSDLYQLFRNCSLAVLNSGSLTDNSKELLSRFENFEINVLRRERGVKLELINPPEDAFVDGRIIRSLQANLFAVLRDILFVYGQIHNTVRFPNLDLESSVHITNLVFSILRNARALHVGEAPNMIVCWGGHSINENEYLYARRVGTQLGLRELNICTGCGLGAMEAPMKGAAVGHAQQRYKDSRFIGMTEPSIIAAEPPNPLVNELIIMPDIEKRLEAFVRIAHGIIIFPGGVGTAEELLYLLGILMHPDNKAQVLPLILTGPKESADYFRVLDEFITHTLGESARRHYRIIIDDPAEVARQMKKAMPLVKESRRETDDAYSFNWSIRISPDLQMPFDPTHENMANLKLSPDQPVEVLAADLRRAFSGIVAGNVKEVGIQVIEQYGPYKLHGDPEMMRRMDDLLQGFVAQHRMKLPGGTAYIPCYEIIA

SEQ ID NO: 10216 - protein, 70 aa, Klebsiella pneumoniae
IVYVHSLASVDRNISWGFRLSGVLVMLKARQPQAPAAILHSSGREIYLQGINQKDFIIIWMQARKVIPVY

SEQ ID NO: 10217 - protein, 64 aa, Klebsiella pneumoniae
RIFVIKRDLCDFINNKRLIYVKNISPKASIFSFRYVVETPCSLPLRVVRVATQVQLEERRGGEE

SEQ ID NO: 10218 - protein, 123 aa, Klebsiella pneumoniae
RRCFRPCSRGCRMNSEVLLLGVIVGGVNYLFRYLPLRLRAGHARPARRGPVSVLLDTIGIASICALLVVSSVPEILADAHRLAPTLTGFLVLGAAFWKTRSIIVPTLLSAFAYGLAWKITNGL

SEQ ID NO: 10219 - protein, 296 aa, Klebsiella pneumoniae
RAAVYQPARGGRPTMSWLLEPFGYHYMLNAMWVSALVGGVCAFLSCYLMLKGWSLIGDALSHSIVPGVAGAYMLGLPFALGAFLSGGLAAGSMLFLQQRSRLKEYAIIGLIFSSFFGIGLFMVSLNPTSVNIQTIILGNILAIAPEDIIQLAAIGFISMAILLLKWKDLMVTFFDEHHARSIGLNTRGLKLLFFTLLAACTVAALQTVGAFLVICLVVTPGATAWLLTDRFPRLLAIAVSIGSLTSFFGAWLSYYLDGATGGIIVVAQTLLFLITFIFAPKHGLLASRRRAREAAC

SEQ ID NO: 10220 - protein, 159 aa, Klebsiella pneumoniae
GDYVTDVLLCVGNSMMGDDGAGPLLAEMCAANPAGQWVVIDGGSAPENDIVAIRELRPERLLIVDATDMGLNPGDIRIIDPDDIAEMFMMTTHNMPLNYLVDQLKEDVGEVIFLGIQPDIVGFYYPMTQPVKEAVARVYQQLAGWQGKGGFTQLEAADD

SEQ ID NO: 10221 - protein, 657 aa, Klebsiella pneumoniae
VQSVNDRRPAMLNPESPSTAPALIDPASKAFQSLLDKLAPTEATVLIVGETGTGKEVVARYLHHHSARRQQPFLAVNCGALTESLAEAELFGHEKGAFTGAQQGQPGWFEAAEGGTLLLDEIGELSLPLQVKLLRVLQEREITRVGSRKAIKVNVRVIAATHVDLAQAIRERRFREDLYYRLNIAVVPLPPLRQRRQDIPLLAHHFLSLYARRLGRPTLRLAPESLARLMDYSWPGNIRELENTLHNAVLLSKEEEISPAQLRLATLNDAPGPASDHELDDFIRHQLALPGEPLWQRVTSALIRHAMAHCDDNQSQAAALLGISRHTLRTQLANLGLIKSRRRPPAPPRAFANAAGADRELRIGYQRFGSLGILKARQSLETAFASLGVNVLWSEFPAGPQLLHALACNEIDFGTTGEAPPVFAQASNSELMYVAWEPPAPRSVAMVVPQESDIRQLSDLRGKRIALNKGSNVHWLLLQILEDAGLGLNDVRVVYTPPKYPLTASDYLAVDAWMMWDPLLSDAEHTGELRVVASGEGRVNNHQFYLSRRDYLAQHGDIMRRLLTELTHTGQFIDSHRGEAARLLSAELGIDARSLSMALARRSHRPRPMDLSVIRAQQTIADRFYALGLIAKPVPVREAVWYGEPAPDVIRPLMAVS

SEQ ID NO: 10222 - protein, 754 aa, Klebsiella pneumoniae
SSSVARPSCWRWIHPPSSAREYRFHRAGQVKCSSAGLPHVAGQFNTIGRHQAFLALAFRAGFEAFAVQLGAGIAVMLEQRDGVVDLLLHRERTLALPAVADSEARLLEEILFLPHRQLILRRQLNRRRRAHLFTATAEDAAPEVKLPRQLVSGQIDLDRQGVRRAGVHAGRAADTLLWRMLRLAAKVFVYRHRLQRVGVRRGAGLNNFFNKGKHGDSLFQRRVFTLDAVALQLFVWHHFALLLAYIDHGHAVSTGVARVEAADDQRRIGNGVAAQHIAQGRPVGVSRRPAAPAIQFLVVAGHAPVDIVAARRLGEAQREAVRNIGEPLHHQRAARQVIETEINHIQRGVNLVDPHLEARYHVAALFAVNFHRQQAVTDKRVVGAGVAGVAAGAHHRAYVAEVAGDFRVQTANTDGTLFHIRRAEQHIHQLLHVATHLLRQLTGLDHVLFQQVAADPADQVQAVGFTRAGKDLCHLHRGFAHAEELHKAGVKAGKVAGQTEVQQVRVQAFHLQQNGADHLRPLRHHDAHRVLHRGGVSGAVGEAADAAHPVRQEGHFVITHAGFRQLFHSAMDVEQAVVGVDNVLAVNEQAEVARFIRGDVQRANRHHVVFLAAELVNKLVGFGVGGRRRTLAIIHAVFAQRIEFVRPVVRQHQPAFVRQADRHQAVHITHFALAPYRRRDARRHRRVFRFVGVHFHAHGDPAFGALLHRQHVIDRVVAVELTFIVAEQHRQPAALLVVEKLHHFRQVIDLHGDG

SEQ ID NO: 10223 - protein, 94 aa, Klebsiella pneumoniae; identical to SEQ ID NO: 9277

SEQ ID NO: 10224 - protein, 61 aa, Klebsiella pneumoniae
FGKVRISEASANRRQGGVYVPLAERAGEIVQASFVDVPWKVLCSGITGRSHLYESEYAESS

SEQ ID NO: 10225 - protein, 849 aa, Klebsiella pneumoniae
GDRVMDDSKLRYFASAWLISITLPADSAERYNAQFVNGIDPLAFNQFVASDGDVMPGTYDVNIYINDLLVDSRPVRFSEDSAHGGLAPCLSAAEYIRYGVKIDDDHQPCFALSQTIRQAEQQLDIANHRLIIHIPQQYIEHYPRDYVSPMRFDEGINAAFVNYSYSTDANNGDGGSHQYQYLSLNSGINIASWRFRNNAYWNKFSGQADKWQSIASWAETNIIPWRSRLVVGQTSTDNSVFDSVQFRGVQLGTDVEMRPSSQTGFAPVIRGVANSNARVEVRQNNYLIYSENVPAGPFELNDISAVNRSGDFYVTVIEADGSQTTFTVAYTTLPQLVRAGQWNYQLSAGKYHDGADGYAPALMQSSLSYGLNNTFTLYGGALAAENYRAGAFGVGSNLGEIGALSADYTLAGTTLANGQRKQGGSVRFLYAKSFLSSKTDFQIAGYRYSTAGYYSLSDAVNERRRWHNGLYENDYWPSDEDESWQASAPQHYYTSWFYNKKHRFDISARQTLGKNSAFFLNFSQQNYWNSSGSDISLQAGFNSTIHNVNYGLYYQNTRSHFTHDDNSITLRVSIPFTLQENRRINTAFTLAHSKSSGTSGQAGVNGTLLDDGRLSWAVTSAYDDTSHSTNSASLGYLGQYGNLYTGYAYSKSHRQASLNLSGGVVAHRGGVTLSQPLGSTFALVEAKDAQGVGIENQTGVRIDPFGYAVVPQSVPYRVNSVALNPQDFDTFLDVPNAVADTVPTRGAITRVRFDTFRGYSVLIHTTLADGSYPPLGAELYRASGISNGLVGPGGDVYVSGVDSGEKLQIKWGETHQQSCEITLPELRQEPQQATAWRELSLICTVTPSR

SEQ ID NO: 10226 - protein, 231 aa, Klebsiella pneumoniae
IRLVIRPNVWGRLRAPLSSAPLAATTAGFCVTVIIPKPVGEKTMYEGYAGLIFDMDGTILDTEPTHRQAWNEVLGRYGMRFDEQAMVALNGSPTWRIAQAIIELNQADLDPHRLAQEKTQAVKAMLLDSVRPLPLIEVVKAWHGRRPMSVGTGSESAVAEALLAHLGLRHYFSAVVAADHVVNHKPAPDTFLLCAERMGVAPEKCVVFEDADFGLQAAKRAGMDAVDVRLL

SEQ ID NO: 10227 - protein, 210 aa, Klebsiella pneumoniae
QAMVSKRVESLLNQLRTQGIVDERVLEAIALVPREKFVDEAFEHKAWENTALPIGQGQTISQPYMVARMTELLTLTPESRVLEIGTGSGYQTAILAHLVHHVCSVERIKSLQWQARRRLKQLDLHNVSTRHGDGWQGWQARAPFDAIIVTAAPPEIPTALLAQLDDDGVLVLPVGEEHQFLKRIRRRGNEFIIDTVEAVRFVPLVKGELA

SEQ ID NO: 10228 - protein, 179 aa, Klebsiella pneumoniae
GSPVIDDDGYRPNVGIVICNRQGQVMWARRYGQHSWQFPQGGINPGESAEQAMYRELFEEVGLSRKDVRILASTRNWLRYKLPKRLVRWDTKPVCIGQKQKWFLLQLIGNDADINMQTSSTPEFDGWRWVSYWYPVRQVVSFKRDVYRRVMKEFASVTMSLAESAPKPQNAPAYRRKRG

SEQ ID NO: 10229 - protein, 309 aa, Klebsiella pneumoniae
FPEVTMLHLGIDIGGTKMEAVLLDPAGECVQRLRRPTHKESYDAFMRQLLTLIADIRAVSPQPFTLGIGLPGAIDPRSGRIKNCNCLVLNGHDLRRDIMQQLGQPVWMANDADCFTLSEAVDGAGAGATTVFGVIIGTGCGGGIAVHQQLLSGPNAIAGEWGHNPLPGYTPERDGPPQPCYCGKTNCIESFLSGTGFARRYGEQARAEAIVAAAQNGDPRALAHWRHFIDAFARSLASVINILDPQVIVLGGGLSNVSQIYRDLPAAIVPWIFSDTCRTQIKPARFGDASGVRGAAWLPRLPGAAQGQR

SEQ ID NO: 10230 - protein, 151 aa, Klebsiella pneumoniae
TMLFAWITDPNAWLALGTLTLLEIVLGIDNIIFLSLVVAKLPTAQRAHARRIGLMGAMVMRLALLASIAWVVKLTNPLFTVFGQEISFRDLILLLGGLFLIWKASKEIHESIEGEKDGLKTNVHSFLGAIVQIMLLDIIFSLDSVITAVGL

SEQ ID NO: 10231 - protein, 465 aa, Klebsiella pneumoniae
SYVFPCCRKARRRKAARGEALNELAEQRVEDRGDGNQAHNHHEDVADMAAVFTHRRDFLNRVHRHQEQDHRDNRAAKGLDHTEDARVQGCHNPGGDQHEQRGQLVQFVDFNRFAFTAQGFNHHAVKAFASAQIVAKEGFGDGDHRDDRRHPGNDWRVKVVRQVRQNRDVLLFRRRQVCRREAQNAAEDEEHHGQHHHDVGASEDTGAFLLSAFAVLFTFGYREGRDDRRVVEGEDHHRDRQPQGHQQAVAGNGSAAQGERLQRRAVPLRDQIQGEHHQRDNEWENQHAHRFHNHLLAETHNGHHADNQDQRQNGARRRRHVQLVRHEGFDGVSDRHAINQQDRVDSEEIKQGNQLTCAYAEVFFHYFGDVFARVFPGEHEAGHAAVGEESHREGQNRHDDQGDHAANAGVDRQEQDARANRCTVQAQHPHGVGFTPSAAGFARNDGAGLSGFHLYLLEESTKSNE

SEQ ID NO: 10232 - protein, 356 aa, Klebsiella pneumoniae
CIVFSSPINELSIYARRCKVQRGLRTISPVTFHPSDSGADMDNLFHQPQGGNEMPRFAGRATMMRLPFIEDLQGLDAAFVGIPLDIGTSQRSGTRYGPRYIRAESVMIRPYNMATGAAPFDSLSVADIGDVPINTYSLLKSVQIIEDYYTGLNSYPLIPLTLGGDHTITLPILRALTKKHGPVGLIHVDAHTDTNDEMFGEKIAHGTTFRRAVEEGLLDLKRVVQIGQRAQGYAAGDFQWGVDQGFRLVQAEQCWHTSLAPLMAEVRQQMGDGPVYLSFDIDSLDPIWAPGTGTPEVGGLTSIQALEIVRGCRGLNLIGADLVEVSPPYDVSGNTSQLAANLLYEMLCVLPGVKYA

SEQ ID NO: 10233 - protein, 239 aa, Klebsiella pneumoniae
FFTFSDMRGADSAVMTGFDRLSYQSRWLQVAPERKFLLWLLLMALAFTLPAWGQALTLALTAALTCWLLRVSFWRWCRWMALPFGFLLVGVLTIVFSVSRDPQMLLASFRLGAFSIGISAPGLAVAGETFWRSLAAMAATLWLVLNLPFPQLIILLKRGRVPRLLTEQILLTWRFIFILLDEAMAIHRAQTLRFGYGSVPQGYRSLAMLVGLLFTRVLLRYQQMSTALDIKLYQGDFHL

SEQ ID NO: 10234 - protein, 74 aa, Klebsiella pneumoniae
KMALTRWPCRWRHTTKRCNTTSTRRPPIYGKRLSRWRSRTSSWTWRKSAPRRRRALSLSSWPICLTSCAPRSMG

SEQ ID NO: 10235 - protein, 315 aa, Klebsiella pneumoniae
HYFSLLYPVRNQSVRDDLNAIPVFVTVVESGNFASAAAILHVTRSAVGKTIARLEARLGVALFQRTTRRQLLTEEGEQFYLQCREALERIREAEETLQRGKDEVQGRLRVSLPVLFGQRCVAPLLFRLSQRYPLLKLELHYSDRQVNLLEEGFDLAVRIGSLADTGSLRARALGEHGMVLCAAAEYLRQQPAPQTIAGLNEHRTLGYLHNGQLQKWQLYDPQQGEVRFSPQTWLIQDDFAAIAAAVQQGMGIAWLPDWLVAQALADGTLQQVLAPSAQVRFAIHAVWPEGPWLPQKTRAAIDALREGLPLTATPG

SEQ ID NO: 10236 - protein, 112 aa, Klebsiella pneumoniae
CRFSGGRMGKLTLLLLALLVWLQYSLWFGKNGLHDYTRVNDDVTAQQATNAKLKARNDQLFAEIDDLNGGQEAIEERARNELSMTRPGETFYRLVPDASKRNQASGQQQNNR

SEQ ID NO: 10237 - protein, 155 aa, Klebsiella pneumoniae
INVSITLAALYLLICYLEFFNFMSSMLHKLNNIRSLRALSREFSIDVLEEMLEKLRIVTEEKRTQQQQAAQQQAEYQEKVNTWLELMRADGISPDELVADIQPPKAGGKKRQPRPAKYRYTDHTGAEKTWTGQGRMPKPIAEAVAQGKSLDSFLI

SEQ ID NO: 10238 - protein, 363 aa, Klebsiella pneumoniae
SGVSCWAGSTPPPLKRMAIYSSPDACRRSASCRRSATVNGTRASIPQQPTRCSSSSVCGQGVVTPQRVRKHFSSMAASSGVLHAGQDAEHLVQQVGRQLGGITAHVVGGRDLDQIGANQIQAAAAADDLQRLNGGQTANFRRPGSRRPDGIEAVDIKAEIHRPVAHLLTDFGHQRRQRGMPALLRLHQAKALVNAPLEVAGGIALGALANLHHPFEVEQPLLYGAAEGGAVGDFLSEHLIIGVGMGVDVDEAHRTMFFGQRPQDRQGNGVVPAEGQRDQRITIQTGVVIFDNLHRFEQAVGIDRHIADISHRQRVERRGAGRHIVRTDHHRFGANIAWSVARARALRGADIQRNADKCRVKSL

SEQ ID NO: 10239 - protein, 282 aa, Klebsiella pneumoniae
NMSSYDNHQALAGLTLGKSTDYRDTYDASLLQSVPRSLNRDPLGLHADNLPFHGADIWTLYELSWLNGKGLPQVAVGHVELPDTSLNLVESKSFKLYLNSFNQTRFASWQDVAETLTRDLSACAQGKVKVSLYRLDELEGQPIARLHGTCIDDQDIEIDNYHFSADYLQGAASGKIVEETLVSHLLKSNCLITHQPDWGSVQIQYRGAKIDREQLLRYLVSFRHHNEFHEQCVERIFNDILRFCQPESLSVYARYTRRGGLDINPWRSNGDFSPATGRLARQ

SEQ ID NO: 10240 - protein, 494 aa, Klebsiella pneumoniae
SATSNVSSTLTPAPPSNLSLKDIMMTTHHDRHYKAGGDPRTLADFMALRAEMNKLSHPARPDINWPYAEQLARGLLEHHGADLQTVAWYTLARARLGGVAGINEGLTLMESLLVRQGKNLWPQALPARTEIFRTLSKRLRQVIRTLNLTPEDVESLEQAERSLQSFDAVLQRLEIAPENQLSDLRALLHSTATRFESLDPAPALPTAPPVAVSDAELPGTLVSEEDAAKVEPVPDLKRRPKAEPLAPPSPAKRPAPVAASTPAAAPRWKPFIAGMVTMLAVTGIAVGGWLALRQSDLPPISVTQNAGPIPGLPATTPPGPVDLPQTQRQLGELARLAPDWAVSYGDQLVRQALIRWPDQAQPLEQQWRQQLSAGALPAENLTGWSEGMQQLQRLADQLNALDEQKGKYLTVSELKTAVFAITQSFNRAVPLEEQLRQLAALPVDQPWPAARGSLAELHLQQLIVEYALLKRKQPASPTAALPATGEPSVSEAVK

SEQ ID NO: 10241 - protein, 501 aa, Klebsiella pneumoniae
CVNSSHIVIQKDFTSMTTFYTVVNWLVILGYWLLIAGVTLRILMKRRAVPSAMAWLLIIYILPLVGIIAYLSFGELHLGKRRAERARAMWPSTAKWLNDLKACKHIFAEDNSPVAESLFKLCERRQGIGGVKGNQLQLLTESDDVMQALIRDIQLARHNIEMVFYIWQPGGMADSVAESLMAAARRGVHCRLMLDSAGSVAFFRSPWAAMMRNAGIEVVEALKVNLMRVFLRRMDLRQHRKMVMIDNYIAYTGSMNMVDPRYFKQDSGVGQWIDLMARMEGPVATSMGIVYSCDWEIETGKRILPPPPDVNIMPFEDASGHTIHTIASGPGFPEDLIHQALLTAAYAAKEHLIMTTPYFVPSDDLLHAICTAAQRGVDVSIILPRKNDSLLVGWASRAFFTELLAAGVKIYQFEGGLLHTKSVLVDGELSLVGTVNLDMRSLWLNFEITLVIDDAGFGSDLAAVQDDYISRSRLLDARLWLKRPLWQRIAERLFYFFSPLL

SEQ ID NO: 10242 - protein, 396 aa, Klebsiella pneumoniae
NICSITAGQSWWRTSFSLRCCFRFWCDERPQTRRRFSSASTFGREVFLFSPRQPTVKSASCSPCVMESMLTLAHLQQRRSRRWLFGLTLLLLVTLLISLCAGEQWIPPGEWLSAKGQLFIWQIRLPRTLAVLLVGAALALSGAIMQALFENPLAEPGLLGVSNGAGVGLIAAVLLGKGVLPGWALGLCAIFGALLITFILLRFARRHLSTSRLLLAGVALGIICSALMTWAVYFSTSFDLRQLMYWMMGGFGGVDWQQLWLMIALLPVLCWVCLQSQPLNLLALGEVSARQLGLPLWLWRKLLVVATGWMVGVSVALAGAIGFIGLVIPHILRLCGLSDHRVLLPACMLAGASALLGADIIARLALSAAELPIGVVTATLGAPVFIWLLLRSRGRG

SEQ ID NO: 10243 - protein, 114 aa, Klebsiella pneumoniae
IILSFSKQRTTWPMASVSRMLVRNWLPRPSPLDAPFTRPAISTNSMVVGRMRCGLTISASLSRRGSGIGTTPVFGSMVQKGKLAASIPALVSALNRVDLPTLGKPTIPHLNPMI

SEQ ID NO: 10244 - protein, 466 aa, Klebsiella pneumoniae
SEVSMSQSSLPEKANRSVITDWRPEDPEFWQQRGHRVASRNLWISVPCLLLAFCVWMLFSAVAVNLNKVGFQFTTDQLFMLTALPALSGALLRVPYAFMVPLFGGRRWTAFSTGIMIVPCVWLGFAVQDTSTPFSIFVIISLLCGFAGANFASSMANISFFFPKAKQGGALGVNGGLGNMGVSVMQLVAPLVVSISIFAVFGGNGSEQPDGSMLYLENAAWIWVPFLIIFTLAAWFFMNDLSASKASLSEQLPVLKRLHLWIMALLYLATFGSFIGFSAGFAMLSKTQFPDVQILHYAFFGPFIGALARSMGGAISDRLGGTRVTLVNFVVMAVFCALLFLTLPTNGQGGNFIAFFAVFMVLFLTAGLGSASTFQMISVIFRKLTMDRVKAQGGSEAQAMREAATDTAAALGFISAIGAIGGFFIPKAFGISLDLTGSPAGAMKVFLVFYIACVVITWAVYGRKRQ

SEQ ID NO: 10245 - protein, 364 aa, Klebsiella pneumoniae
IMGFKCGIVGLPNVGKSTLFNALTKAGIEAANFPFCTIEPNTGVVPMPDPRLDKLAEIVKPQRILPTTMEFVDIAGLVKGASKGEGLGNQFLTNIRETEAIGHVVRCFENDNIIHVAGKVNPAEDIDVINTELALSDLDTCERAIHRVSKKAKGGDKDAKVELAALEKCLPQLENAGMLRALDLTKEEKEAIRYLSFLTLKPTMYIANVNEDGFENNPYLDQVRAIAEQEGSVVVPVCAAVEADIAELDDEERDEFMAELGLEEPGLNRVIRAGYALLNLQTYFTAGVIEVRAWTIPVGATAPQAAGKIHTDFEKGFIRAQTIAYEDFIAYKGEQGAKEAGKMRAEGKDYIVKDGDVMNFLFNV

SEQ ID NO: 10246 - protein, 443 aa, Klebsiella pneumoniae
RGLSRCYRCWLSGFFRFFLSLYRSNFGFRTGFAFDEFAAVVGIQQDLFQFGDQRVARVSAGALVIECIFRQFINVGQEVSFLNASFADRFRNTQLSFNAFQPCQQFLDFRCGAVAWCGEAQVIGDFSVTTTSLRTVVLAERGLLGRVVIRVIADNVADQQGVGQTVWNMELGAQFVRHRVTHAEEGVSERDTGDSRGTVYALTGNRVLGTFVIGSRQVLFQQFQRLQRLAVRELRSQYGNVSFQGVSHRIQTTERTQRFRHIHHQVGIDNGHIRGQRVVCQRVFLTGRVIGHHGERRHFRTGTGSGSDRHHLGFDAHFRELVDTFTDIHKAQRQFFEVGFRMFVHDPHDFRRIHRGTAAQGDDHVWFKGVRQVGTFTYDGQRRVSFNFEEDFRLNTRSFQYGSDLIGIAVVEQEAVSHDQRAFVTIGNHFIQCDWQGAHDGSR

SEQ ID NO: 10247 - protein, 85 aa, Klebsiella pneumoniae
RLPSKTTLLIMIIIVALIFILRAMTRMDNTATAEKPKDNAPYPVATDREISSRVLLGSEGRVVIEHGGQRYLLRQTHAGKLILTK

SEQ ID NO: 10248 - protein, 271 aa, Klebsiella pneumoniae
VMGSLADFEFNKAPLCDGMVLISEQVRDDFPSRFVEEELQRLLRLAQEEIAPSWDQERQIERLLELFYDEWGFGASQGVYRLSDALWLDKVLVNRQGSAVSLGAILLWIAQRLALPVVPVIFPTQMLLRADPETSEEMWLINPFNGETLDEHTLEVWLKGNIGPVAELFNEDLDEADNAEVIRKLLDTLKSALMEERQMELALRASEALLQFNPEDPYEIRDRGLIYAQLDCDHVALLDLSYFVEQCPEDPISEMIRAQINTISHKQITLH

SEQ ID NO: 10249 - protein, 120 aa, Klebsiella pneumoniae
SAVPGTTLERRGTMTLSFTTHWRDEMPDFYTSLSPTPLDNARLIWDNAPLGQQLGVPNALFALKPGPCLGRPSAVSGHVAAGPGIQRPSVWRLGGQIGRRTRDPVRRAAAAGWPAVTTGI

SEQ ID NO: 10250 - protein, 236 aa, Klebsiella pneumoniae
PRSPTCWGRKTRWAALIALAHQHGAKVLVDGAQAVMHHPVDVQALGCDFYVFSAHKLYGPTGIGVLYARSELLQTMAPWEGGGSMIATVSLTEGTTWNQAPWRFEAGTPNTGGIIGLGAALTYVSQLGLTQIAEYEQTLMRYALDALRAVPDLILYGPAQRKGVIAFNLGQHHAYDVGSFLDNYGIAVRTGHHCAMPLMARYQVPAMCRASLAMYNTTEEVDRLVAGLQRIRKLLG

SEQ ID NO: 10251 - protein, 301 aa, Klebsiella pneumoniae
ADCPGTSGRSAGGAVRAGMMTFQAWLQQAIARLAESDSPRRDAEILLGHVTGRARTWILAFGETTLSADEAARLEALLVRRQRGEPIAHLVGQREFWSLPLFVSPATLIPRPDTECLVEQALARLPTAPCRILDLGTGTGAIALALASERPDCEVTAVDVMPDAVALALRNAEHLGIANVTISQSDWFSALDGQRFAMIVSNPPYIDAADPHLAEGDVRFEPLTALVAGDQGLADLAHIIREGRQYLQPGGWMLLEHGWTQGEAVRALFREAGYLDVATCRDYGDNERLTLGRLPDMENVG

SEQ ID NO: 10252 - protein, 161 aa, Klebsiella pneumoniae
SRRPLLREWPRRCAPSDSPAPPDRKFYCPTGRIRLSPARPGQRYGTGRRCEFPRVRPPAARSRGPARPAGGSPPRRPPCRSATRRRRQSSAAGRRPRARWRWSLCWYAPPRRGRRSSPGASPPRRYPAGRPSGSGQTPPPASPAPAVSGRWPPQARAARRR

SEQ ID NO: 10253 - protein, 145 aa, Klebsiella pneumoniae
ASDPRTFTRHGECWLMNLFTAVLYLHIATVAVSVGLFVLRYWWMYHQSPLLNQRWVRIAPHCSDTLLFLSGAGLMAITHYLPFTEDGAWLTEKLFGVIIYIALGFIALGRRRPRSQQSRFIAFLLALVVLFIIIQLAITRIPILG

SEQ ID NO: 10254 - protein, 177 aa, Klebsiella pneumoniae
LSSPGKSALIPVTINSMPRAISNRPIIRVMTLIPVCPSKRTSHGAIRKIPQQQRANTAIASENPTRCTQEWYRVPQTIVELIAPGPAINGSARGTTPMLSRTAVSDFSCLFCLSSPSLPLIIDIAMVTTRMPPAIRKESMEIPKICRMPSPRNSDVRRMIATDRLAVRLVLLRTAAG

SEQ ID NO: 10255 - protein, 133 aa, Klebsiella pneumoniae
WRQPGGLSMEVQAGTFNPADFSWQGLTMTPAAAAHIRDLMRKQPDKKGLRLGIKTSGCAGFGYVLEMIAEPAPDDLLFESDGAKLFAPLQAMPFIDGTELDYVREGLNEIFKFHNPKAQHECGCGESFGVQAE

SEQ ID NO: 10256 - protein, 103 aa, Klebsiella pneumoniae
GIEPMALTKAEMSEYLFDKLGLSKRDAKELVELFFEEIRRALENGEQVKLSGFGNFDLRDKNQRPGRNPKTGEDIPITARRVVTFRPGQKLKSRVENASPKDK

SEQ ID NO: 10257 - protein, 349 aa, Klebsiella pneumoniae
CPRPERPLRSAAMTMIETAKAPQAQSHSGLLLDVKDLRVTFKTPDGDVTAVNDLNFTLQAGETLGIVGESGSGKSQTAFALMGLLAANGRIGGSATFNGRQILNLPERELNKLRAEQISMIFQDPMTSLNPYMRVGEQLMEVLMLHKGLSKAEAFEESVKMLDAVKMPEARKRMKMFPHEFSGGMRQRVMIAMALLCRPRLLIADEPTTALDVTVQAQIMTLLNELKREFNTAIIMITHDLGVVAGICDKVLVMYAGRTMEYGQARDVFYQPSHPYSIGLLNAVPRLDAEGDALLTIPGNPPNLLRLPKGCPFQPRCPHAMEQCSSAPPLESFAPGRLRACFKPVGDLL

SEQ ID NO: 10258 - protein, 92 aa, Klebsiella pneumoniae
SASPSGHCLRQRSLASLESNLGRSFSSFPVGQNIEYRRVIGLRCFLRRWWWGKDNSSLSLLALRAVACGNVLSLRSSRTLVEASHPSPWGRI

SEQ ID NO: 10259 - protein, 356 aa, Klebsiella pneumoniae
FRALLNPYKRLMTMKTWLPTSTAGSLPKPSWLAQPESLWSPWKLSSEELLAGKRDALRLSLDDQLRAGIDIVSDGEQTRQHFVTTFIEHLSGVDFAKREIVKIRNRYEASVPTVVGAVERQKPVFVEDARYLRQLTSQPIKWALPGPMTMIDTLYDNHYKSREKLAWEFAKILNQEAKELEAAGVDIIQFDEPAFNVFFDEVNDWGIAALERATEGLKCETAVHICYGYGIKANTDWKKTLGSEWRQYEEAFPQLQKSSLDIISLECHNSRVPMDLLELIRGKKVMVGAIDVASHAIETPEEVAGTLRKALAFVDADKLYPSTNCGMAPLPRHVATGKLHALSAGAEIIRRELAAK

SEQ ID NO: 10260 - protein, 357 aa, Klebsiella pneumoniae
RTWPQRGAVMLIQVGELAKRAGLTVRTLHHYEQTGLLTPSARSEAGYRLYNLSAVQRLHMIKALAQAGLTLATIKDCLDRQTLSLPELLTQQIDMLNAQLRDVGRLRDRLLVLREALASGNEPDLESWLQTLELMKMYDRWFSQQELAALPFAAQDEQRAQAWRELTEEVQTLMASGCPTDSPQAMRLATRWMERLEQDTAGRPEFLTRLNEMHAAEPQMVEQTGVTPAIIAYITEAFAESKLAIWARYLDEEEMAFTRQHYFDRLQEWPALVAKLHQACREGVAPDSASGQALARAWLELFQSYAGTRPQTLQKFRRAMEQEPHLMKGTWMTPAVLSWLQQATGSLMRQAQGPAAG

SEQ ID NO: 10261 - protein, 125 aa, Klebsiella pneumoniae
HSRPVAGPSAAHGDSKNVRNGRSGHGSRPPASASRRAPRARGRPGYRWSPSPGRASSGSPEHASPPTPDFPGSASAARRGRSPSANKESGRRLSDASRNGGPSGSCCSPNRIPRPSPNLAAQAPN

SEQ ID NO: 10262 - protein, 896 aa, Klebsiella pneumoniae
TGGTRLAGESRKRQSVGGQPAAAGPRGGLLMKTIRTTCPYCGVGCGVLASVDDAGQVSVRGDDQHPANLGRLCVKGAALGETTGLAGRLLTPEVDGQQVAWPQALAETAARLRQIIDQHGPQAVAFYASGQLLTEDYYAANKLMKGFIGAANIDTNSRLCMSSAVTGYKRAFGADVVPCSYDDVENSDLVVLVGSNAAWAHPVLFQRLAQAKRDNPRLRIVAIDPRRTATCEIADRHLALAPGSDGGLFAGLLNALAEAGACVDGFRDGPQALAAARGWDVAMVAAFCGLPADEVAGFYREFIAAPRAITLYTMGINQSASGSDKCNAIINVHLASGKYGRRGCGPFSLTGQPNAMGGREVGGLATMLAAHMDFVPDDLQRLARFWGTERLAQTPGLTAVELFAAIGRGEVKAVWIMGTNPVVSLPDSHAVSQALAACPLVIVSDVAAQTDTGRFAHIRFPALAWGEKNGTVTNSERRISRQRSFLPPPGEAKADWWIIARVGQALGYREAFAWQHPHDVFREHAALSGFENDGQRAFDIGALADLSREAWDAMPPVRWPVSRSEAAWDITRGWHGDGRLRMVPVTPQPTRATTDAFYPLILNSGRIRDQWHTMTRTGAVPRLMQHIAEPMVEVAPQDAVRYQLPADGLARIWSRHGVMVAKVAISEGQRPGSLFVPMHWNNQFARQGRVNNLLAAVTDPYSGQPESKQAAVAIAAWQPAWHSELFCREPLPFPAAWHWRRRATPGVLHYSLAGEASARQWLSAWCARRGWQLQVADGGAVWNLLAWHQGRLMLGWWSDAREPAVDCAWISAAFAAPPSDAAQRHALLSGRPGAAVAPRGRIVCSCFGVGEWSINEAIASGCASVGALGGKLKCGTNCGSCVPELNALLAAQRTRA

SEQ ID NO: 10263 - protein, 103 aa, Klebsiella pneumoniae
PVITRRQVPAPAASRIRSPAAASSAPPASSRCPSSNAAPAPLPDETSATSAAGYRRRTETVQATPGPAPDPTPSPALRPPGTPDAASPPAQATPVAGQNSAGG

SEQ ID NO: 10264 - protein, 443 aa, Klebsiella pneumoniae
KKSTPLRGFFMTWWRRKRQLAGSDVEQEVHHIAIFHDVVFTFSTHFTGFFRALFAFVGNEVFISDGLRADKAFFEVGMDLTGCLRRGRSDRDGPCANFYHARGEVGLQVQQSVTGPDHAVQARLFEAQLSHELVTLFIVQLGDVRFNGGAHRHHHRPFLLGDGANLIEVRVVLETVFIDVRDVHGRLQGQEAQIADGLFLFFGQIQRAQHTGVFQLRQAFFQRGQLNLRVFIAAFGFFGDAVNRAFAGIKVRQRQFGVDNVDIFRRVHFPRDVNNIIVFKTANHMADGFGFTDVGQKLVAKTFTFGRAFHQARDIHELHGGRQDALRFDDFSQLVQTRIGHRYDTGVRLNGTEGEVGRFNTRFGERIEQGGFADVGQTDDTAFESHDLNHLNLWIINLLQGTDCRKLNSFAYYTRCAAKMPHDNGLLRLKGVQTVGRFGQPVL

SEQ ID NO: 10265 - protein, 227 aa, Klebsiella pneumoniae
TVLTRDFLMNADCKTAFGAIEESLLWSAEQRAASLAATLACRPDDGSVWIFGYGSLIWNPALNYRESCTGTLPGWHRAFCLRLTAGRGSACQPGRMLALKEGGRTTGVAYRLPDDTLEEELTLLWKREMITGCYLPTWCKLELDDGRTVNALVFIMDPRHPLFEPDTSAQVIAPLIARASGPLGTNAQYLFSLEQALRKLGMHDASLDDLVASVRALLGESPTPGLA

SEQ ID NO: 10266 - protein, 1036 aa, Klebsiella pneumoniae
LAPTQYFQTQHSQAGSSVMIPQISQAPGVVQLVLNFLQVLEQQGFTGDTATSYADRLTMATDNSVYQLLPDAVIFPRSTADVALLARVAAEPRFKSLIFTPRGGGTGTNGQALNGGIIVDMSRYMNRIIEINPEEGWVRVEAGVIKDQLNQFLKPYGYFFAPELSTSNRATLGGMINTDASGQGSLVYGKTSDHVLGLRAVLMGGDILDTQAVPVALAETLGNTPSTVGRIYNTVYQRCKAQRDLIIDKFPKLNRFLTGYDLRHVFNDEMSEFDLTRILTGSEGTLAFITEARLDITRLPKVRRLVNVKYDSFDSALRNAPFMVEAKALSVETVDSKVLNLAREDIVWHSVSELITDVPDKEMLGLNIVEFAGDDAALIDQQVTTLCQRLDELMAASEAGVIGWQVCHDLEGVERIYAMRKKAVGLLGNAKGAAKPIPFAEDTCVPPEHLADYIVEFRALLDSHGLSYGMFGHVDAGVLHVRPALDMCDPQQEILMKQISDEVVALTAKYGGLLWGEHGKGFRAEYSPAFFGETLYAELRKIKAVFDPDNRLNPGKICPPEGIDAPMMKVDAAKRGTWDRQIPIAVRSSWRGAMECNGNGLCFNFDVKSPMCPSMKVSNQRIHSPKGRATLVREWLRMLADRGVDPNQLEKALPEQGVSLRSLVARTRNSWHARKGEYDFSHEVKEAMSGCLACKACSTQCPIKIDVPEFRSRFLQLYHSRYLRPVRDHLVASVESYAPLMAQAPKTFNFFINQPWLKKLSEKHIGMVDLPLLSAPSLKQQMAGHRSANMTLEQLEALSAEQKAKMVLVVQDPFTSYYDAQVVADFIRLVEALGYQPVLLPFSPNGKAQHIKGFLTRFARTAQKTADFLNRVAQLGMPLVGVDPALVLCYRDEYKQTLGDKRGDFQVLLVHEWLPKALTSDARPDLGGEPWYLFGHCTEVTALPAATKQWADIFAHFGAKLENVSVGCCGMAGTYGHEVKNHANSLAIYALSWQQAMQRLPRNRCLVTGYSCRSQVKRIEGSGVRHPLQALLEIIG

SEQ ID NO: 10267 - protein, 160 aa, Klebsiella pneumoniae
IPGFSCQRPRRAPARYAYSRDLSVRTAGTRARRWRGSPPLQSSRPTRWIRCTGSRRGRRRGPPGLRRGGRTSRWRRRAPAPRASPMGHQGSWSPASVRRPRTVRAGEELPRQARRRWRSWCFPPPRHRQYNRKGSGADDDERLRDNRWGLKQSLLCPYVF

SEQ ID NO: 10268 - protein, 567 aa, Klebsiella pneumoniae
RFATKKLAVPGRLPGGDRHRRLFTFRLAGIRVRDGGQQVIHPPLTGKLVVPVHRNKQRAGALPFADRHFRHHHPMPRPDPRQPVSGKLIANGILRRHLHHWLRDMLHQPRHCAGTGHGVPLIADPPAVEDQRIKGIGCRPGRLRRHRHHPQPAIAMPAARDIPGGLAAADRPAHRRHGVPRLTAEIRQRADIKRPLAVVFETGQRRMLAEDVMRMLPGKRLAIPQRLAHSGDDPPVRFRLPRRRQKAALTGDPPLRVGDRAILLAPGQRRKADVGETSGIGLGGDIRDDHQRTGGQRLAHRVAVRERHHRVGTHDPDRFDLAAANGGKQLHGGQPGGLRQPFRPPEAGQPLQIVWHKIHVRRQHRRQPADFAAAHGVGLTGQRKGAAAAAAILPAGQMDVDDGVTFVAAAGGLIDSHGVEGDRPRGGDELAIESRHLIGRQTAKGRHHRHVPAAGGGQRLRAVAKAIDAGSCLSQGVKQPRKQPAVASRGQRQMAVGDLAGSGASGVDRHDPQSGIIPLRLRQPLEQHRMRPGGVRADQHHQIAVFHIIVAAGHHVGAKGPLVASDR

SEQ ID NO: 10269 - protein, 75 aa, Klebsiella pneumoniae
NPVAPVPAKNSAPVELPLAPEKFVGSSRLTLPDYVVFENIVLVLTKRLRSAFNFLSHFFHMRPRVFCAKSARQNY

SEQ ID NO: 10270 - protein, 107 aa, Klebsiella pneumoniae
PAPAKTSYFRRAGQKNRPPGQSTPGRRAARNPPAPAPSPPGWRLCGSPAVVRPLQQSAERHSVHSCRPCRAGLQAPAAVRQPAGCCAAWAVPVAASAGSPADSPHGR

SEQ ID NO: 10271 - protein, 228 aa, Klebsiella pneumoniae
QSTANFDDAAEPNVTQSLFDFSAYFKFFIGLFALVNPVGIIPVFISMTSYQPAAVRNKTNLTANLSVAIILLTSLFLGDGILQIFGISIDSFRIAGGILVVTIAMSMISGKLGEDKQNKQEKSETAVRESIGVVPLALPLMAGPGAISSTIVWGTRYHSWVHLVGFSLAIAVFALCCWGIFRMAPWLVRLLGQTGINVITRIMGLLLMALGIEFIVTGIKALFPGLLS

SEQ ID NO: 10272 - protein, 65 aa, Klebsiella pneumoniae
RYGAPRQLRSCSFRFATTVMESASRGFGGGARWLLQPAKINAAANMNQKRISDDPSVPSLFIAII

SEQ ID NO: 10273 - protein, 119 aa, Klebsiella pneumoniae
SKSASRPAPFGVMHRAKCEQYHARTGWAGCCSGTETGYKMAMVKASLTLFGGDTLVVRCSERCHIHLMSAKVPGDSHADILSVQDRDSAYLTVPYSGTWNVLIDSHSQSLEHSISYVPA

SEQ ID NO: 10274 - protein, 289 aa, Klebsiella pneumoniae
RRSALFFCEVNEVGMLSAARLRLYHLLFDQNRRSGRRFEGLCGLFALLSVLVIFIESGLGTQYHLTLDEWHIFVWLELLVTAVFTLEYLLRIATWPNPLHYIFSFWGLIDLATILPLYVMWLWPEISLNYVFAWRAMRAIRALRILKLLRFMPSLNVFWRAIVSARHQLILFYSFIAIVMVIFGSLMYLIEGPEYGFTTLNASVYWAIVTITTVGYGDITPHTPLGRILASILILIGYSIIAIPTGLITTHMTSALNRRRQQRLCPQCQQGDHDDNARFCHACGHALPK

SEQ ID NO: 10275 - protein, 230 aa, Klebsiella pneumoniae
RRTAIMHFLNMFFFDIYPYIAGSVFLIGSWLRYDYGQYTWRAASSQMLDRKGMNLASNLFHIGILGIFAGHFLGMLTPHWMYESFLPIDVKQKMAMIAGGACGVMTLVGGLLLLKRRLLSPRVRATTTGADILILSLLMVQCALGLLTIPFSAQHMDGSEMMKLVGWAQSVVTFHGGASQHLDGVAFIFRVHLVLGMTLFLLFPFSRLVHIWSAPVEYLTRKYQIVRARR

SEQ ID NO: 10276 - protein, 329 aa, Klebsiella pneumoniae
RRAAVLSALARYRTAGGAADDPLRLRRRAHRGYPQRRAQRAGAGAYWTAFAGRHSMTFSVEQVRADFPVLNREVNGQPLVYLDSAASAQKPEAVIGAEAEFYRHGYAAVHRGIHTLSAEATARMEAVRQQAATFLNAGSAEEVVFVRGTTEGINLVANSWGNANVGAGDNIIISEMEHHANIVPWQMLCARVGAELRVIPLNPDGTLQLDVVPGLFDPRTRLLAITEVSNVLGTENPLGGADCSCASAWRESAGGWRPGGDAPPGGRPGAGLRFLCFLRPQAVWADRDRRALRPVRAAADDGALGRGRVDDRHRQPDGGHHLESGAVAL

SEQ ID NO: 10277 - protein, 161 aa, Klebsiella pneumoniae
IITAKKGTPTRAVTTPTGRLCGAISRRDAMSASTINIAPASALAISNVRCSGPKKKRITCGTTRPTKPIEPAMLTMVAVISAAVVKRIRRTRGTAIPSEAAASSPKVNASSARAYHRQTARPASTTTMTSWNSGQRTPLKLPSSQNITSRACCALAEVLMV

SEQ ID NO: 10278 - protein, 479 aa, Klebsiella pneumoniae
RRQAFLLMQSGLLAGIQLVEAFHQIVNRFHLFEERLQFIQRQRGRAVAFRVVRIRMRFYKQTGDTYRHTGAGQLAHLRTTTAGGCAKRVAALQRVGDVENDRRVVGGFLHHAEAEHIHDQVVVTEVRAAVAEDYFVVTPFDKLIDDVAHLTRADKLRLLDVDHRPGLRHRFHQVSLAREESRKLDHVHHVSYRLRLAGFMNVGDDFHAKGLLQLLENLHPFFQTRPTIGVDGGTVGFIKGGFEDVGNTKLLRNGDIMFADTHRQVARLQHVHPAEQHERQVVRYVDITNANHFLFHKFALSGCNRNGSRLMQCNLFMRNRVDLRADHLADRILRALLNEIAQIQQRHVIAVQLGVYQPAVADLIRIFRIKLQQRFAGAQGQLHLPLFHQRRLQGVQQLADHLGVIRFVEIFIKQFRHRPDVALQPYLQGMLVEGLAVKRINQPHLFAGFRVRTQQHLGREDHRHHRQRQALGDPQQDRA

SEQ ID NO: 10279 - protein, 585 aa, Klebsiella pneumoniae
RPWALCPMDLRSPPPGQYASNVFWIVGIALIASWIVAVIFTPWLGVHLLPDRKPAAAGHAALYDTPRYQRFRRLLTRVIAHKWRVAAGVMALFIVAILGMSVVNKQFFPTSDRPEVLVEVQLPYGSSISQTSAAAAKIEHWLHLQPEAKIVTSYIGQGAPRFYLAMAPELPDPSFAKLVVLTDGQGAREALKRRLREAVANGLAPEARVRVTQLVFGPYSPYPVAWRVMGPDPHALLDIAERVKSVLQASPLMRTVNTDWGSRVPVMHFSLNQDRLQASGLSSQSVAQQLQFLLSGIPITTVREDIRAVQVIGRAAGDIRLDPAKIADFTLVGSGGQRVPLSQIGDVSIRMEDPLLRRRDRTPTITVRGDVAENLQPPDVSTALMKPLQPIIDSLPPGYRIETAGSIEESGKATRAMVPLFPIMIALTLLIIILQVRSLSAMVMVFLTAPLGLIGVVPTLLLFNQPFGINALVGLIALSGILMRNTLILIGQIHHNQQAGLDPFHAVVEATVQRARPVLLTALAAILAFIPLTHSVFWGTLAYTLIGGTLGGTIMTLIFLPAMYAIWFRIRPENTVQQTELHLQR

SEQ ID NO: 10280 - protein, 153 aa, Klebsiella pneumoniae
RTFLLFSGQGEFTPMKSSIVAKLEALYERHEEVQALLGDAATIADQDKFRALSREYAQLSDVARCYTDWRQVQEDIETAQMMLDDPEMREMAQEELRDAKEKGDQLEQQLQVLLLPKDPDDERNAFVEVRAGTGGDEAALFAGDLFRMYTRYP

SEQ ID NO: 10281 - protein, 393 aa, Klebsiella pneumoniae
KFVYAITRGLYRIMPCSCNKQGLVYRDAHHFPAFSPRKKQIFETPMNKTDELRTARIESLVTPAELAQRHPVTADVAAHVSASRRRIEKILNGEDRRLLVIIGPCSIHDTDAALEYARRLLGMRERYQPQLEIVMRTYFEKPRTVVGWKGLISDPDLNGSYRVNHGIELARRLLLQVNELGVPTATEFLDMVTGQFIADLISWGAIGARTTESQIHREMASALSCPVGFKNGTDGNTRIAVDAIRASRASHMFLSPDKQGQMTIYQTSGNPYGHIIMRGGKRPNYHAEDIAAAGEALREFDLPEQLVVDFSHGNCQKQHRRQLEVCADICQQIRAGSTAIAGIMAESFLQEGTQKVVPGQPLTWGQSITDPCLSWEDSERLLSELAAATATRL

SEQ ID NO: 10282 - protein, 111 aa, Klebsiella pneumoniae
YLYYYRSTLVIYATLFNTKCLKVTRGRLTMGILSWIIFGLIAGILAKWIMPGKDGGGFIVTVILGIIGAVVGGWISTLFGFGKVDGFNFGSFVVAVIGALVVLFIYRKVRS

SEQ ID NO: 10283 - protein, 410 aa, Klebsiella pneumoniae
RHGYCFRQYKALTRRRGMNNTTGHAHDATAWLQLARRLQKQQLQQLSQLGELASQLSALVHMLQCERGASNIYLCSGGLLYTAECRAGGALVDERLALFYASLERARAVAGSALCWRIARAVDELAQLPALRAQIGRRQIAAEAATEQFSRVIRHLLNIAPQLNDSIDDPPVAGRMVALYSFMQGKELVGQERALGALGFTRGEFSDSLRQQLVDRIDGQQPCFDSFQALGSPATVQLFRTQCHAGLDIEQLRRIACTRQPAADGGETALRWFGLQTQRLEQLREVEEQLIDDLLDATDALLADDAPGWQAGEEDDSVTPRLDKQLLPLVRQQAYELQQLSSQLASLKDALEERKLIEKAKSLLMTHQGMQEEQAWQTLRKMAMDKNQRMVEIARALLMVKAIWPLTPKE

SEQ ID NO: 10284 - protein, 454 aa, Klebsiella pneumoniae
PGLYHGIRVQGQAINPLFHQPGGEILMVRRPLAADADVFTLFLRRADGHRQQGFHRVVAFIKQLRNHTGIAIQTERQLGHVVRTDGEAVEVLEELLRQQGVRRDLAHHNDLQPVLAALQPLTLQLFDHRFRLGDGTDERDHHFNVGQSHIVTYALHRFALKGEAVAEAFGNVASGAAEAEHRVLFFRLIALAAHQVGVFVRFEVRQTHDHPFRIESGAEGGDPFGQAANVELSRRIVAFHQLADFVLQARLLVVKLQQRARMNANHAVDDKFQPRQTDAFVRQAGEVERAIRVADVHHHLQRQIRHVADAGALDAEVEQLGVDIAGVAFGAGDGDILIFLNAIGSITAADHRRDPQLTGDNRRVTGTPAAVGDNRRGFFHDRFPVRVGHVGNQYVAWLNAIHLADIVDHLDRTGANTVADGAPLGDDLPLSVEGITLHHLAAGTHGFRTRLDDK

SEQ ID NO: 10285 - protein, 365 aa, Klebsiella pneumoniae
REMYPVERESQSAPARLMAQLRPQLPYMNFYRFCQLLEKNHPKAPIIGSGWLLGDEPIRFRPHPGMGFPAGEIRGMDDPEPPRPPAVRVTFMGLYGVESPLPTHYSDDIAQRREGVEATEDFLDIFNHRLIAQYYRIWRKYSYPATFRAGGTDNISQYLLGLAGLGIPGCAAVAAAPLSRFLALLPVMMLPGRSGEGMEALVALLAPGTRATVYHHDPCRIPLSQPLTMSVRQPVSLQHRPVMGTHATDVNGQVLLQLATEKPDEVRGWLPGGELFSDLMALLHVWLGSHLDVRLQLCVARHLLPDAQLCCQQEHAVQLGRTAVLRPLDAQKQADDRVTIYLGRYQRVRENIHRRESDEDGDYRS

SEQ ID NO: 10286 - protein, 426 aa, Klebsiella pneumoniae
QRWYYSLTMTLLALGINHKTAPVALRERVTFSPETLDKALESLLAQPMVQGGVVLSTCNRTELYLSVEEQDNLQEALIRWLCNYHGLNEEDLRKSLYWHQDNDAVSHLMRVASGLDSLVLGEPQILGQVKKAFADSSRGHLNVSELERMFQKSFSVAKRVRTETDIGASAVSVAFAACTLARQIFESLSSVTVLLVGAGETIELVARHLREHHVRKMVIANRTRERAQALAEEVGAEVIALSDIDERLKEADIIISSTASPLPIIGKGMVERALKARRNQPMLLVDIAVPRDVEPEVGKLANAYLYSVDDLQNIIQHNLAQRKAAAVQAESIVEQETSEFMAWLRAQSASETIREYRSQSEQVREELTAKALAALEQGGDAQEIMQDLARKLTNRLIHAPTKSLQQAARDGDDERLHILRNSLGLE

SEQ ID NO: 10287 - protein, 146 aa, Klebsiella pneumoniae
QSVQPVQQPSHRRHRRDQQNGAARMIELVIVSRLLEYPDAALWQHQQEMFEALASSEKLSKEDAHALGVFLRDLVAQDPLDAQAAYSELFDRGRATSLLLFEHVHGESRDRGQAMVDLMAQYERHGLLLDSHELPDHLPLYLEYLA

SEQ ID NO: 10288 - protein, 453 aa, Klebsiella pneumoniae
RPTHLGQRPVGATTWGAQRPVCPKTGPVFGPAKRCFRACCRGPRYPTAISLAPGRPNWATDAGSCSASSSCRMARRYDWHLKGAGLTPYSRMGNGRAVLRSPIRESLASEAMHALGIPTTRALAMVTSDTPVYRERVEPGAMLMRVAESHVRFGHFEHFYYRREPQKVQQLADYVIRHHWPQLQDEADKYLLWFRDIVMRTAQTIASWQTVGFAHGVMNTDNMSILGLTIDYGPYGFLDDFQPDFICNHSDYQGRYSFENQPAVGLWNLQRLAQSLSPFISAEALNAALDEYQHALLTAYGQRMRDKLGLFSQQKGDNDLLDGLFALMIREKSDYTRTFRLLSHSEQLSAASPLRDEFIDRAAFDSWFAGYRARLRDEQVDDAQRQQRMQGVNPALVLRNWLAQRAIEQAEAGDMGELERLHAALADPFTDREDDYVRRPPDWGKRLEVSCSS

SEQ ID NO: 10289 - protein, 631 aa, Klebsiella pneumoniae
KINQFIVAQAYRQTPEIVHLDHFAQGGVEGRRQLHQPPGKGLHYRPAAIAGDHPLDRLTHFAAVRVPVALHMKAGERLKLMPAGQQRGNGGGDVGQPGPLMPDADRPRVANDAGKLTRLDQPLRKPVISGARAKKIARPDNQRPAAALHVILQRQLHRHPDGAFAGHRLLCGLFSNQRKGIRSIVVDRAGQDYKRPLPFGSLQGVVQHGQYLLPPVPVARRIHRMDDDVATGSRRRDLAAIQRVAGYPLYAIFGITHPGAALQRPNLPVVCHQPARHFPADAPACSQNKYLAAAVHPLSPFANGCLTAYLRLISNEIAYHRRAAIHICMNTSIPWEWYRTFLAVLQEGSLSGASRTLNITQPTAGRHIAGLENALGQALFTRSQTGLLATDAALALRVHAEAMDNTARALERTAANFSRDRAELRGVVRVAASEVVGAEVLPPLVARLRQACPNIVIELMLSNRFQDLLHREADIAVRMVAPQQEQLIARRLGRIELGLHATAAYLTRQGLPATLDDLASHALIGFDSATPLVRRALQAYPRFQREAFAMRTDSDLAQLSLIRAGAGIGICQAPLADGIIPLQRVLAADFSLYLDTWLVMHEDLRHSPACKRVFDFFAQGLQAYIRGPLAS

SEQ ID NO: 10290 - protein, 553 aa, Klebsiella pneumoniae
GLDQTDKVGHHLGVVVAGEGILHHQHHLRFLLGAQRFELLKGHIGGTVAGHLLLQRRRRKQRQIDHPDMLLRQLFQPRLVNEEVKGLRRLGHQRRIGLHRRHQMIPHRTQIAAVVQLQETRAELGNIDFDRALGRTGFTGQTAGHRLFDLMREVILAFTRMPAVARARHQRAQADALLRQRLLQLVGIDAAVGQHAQPFPHQRRPPFRRVDALVADFHRRTHRALDVKVEAQPVAITLHRPTPAAAHRDGDLPIPGAALRRIDFHHRRVDTFRWTDFPRIQAVIGIEDRFDLAQLGIQRLAKEGRAVLRAETFAMFAPQQAAILRRQRYHLVGDLLHQYLLLRIAHVQRRAHVQHPGINVAKHAVAQAVAVEQRAELNDVIRQMFGRYAGVLGERNRLGGAFGIAQQADGLLAHGIDALHAFKIVTDLPANDARLAGGHQLVQPLAQGSNLLVNQRRVIAGEFDDIEPEHLFIRYVGDQFAYRVPDDILARQIENFRIDGLHRQGFRFDHKGRIAQRRVEGVIFDVDQTAHLRQAGDIQPRFGNKRQRPFRTG

SEQ ID NO: 10291 - protein, 228 aa, Klebsiella pneumoniae
PATQIGPLFPAAVFPCRHQGFVIIMNRLFRLLPLASLVLTACSLHTPQGPGKSPDSPQWRQHQQAVRSLNQFQTRGAVAYLSDEQKVYARFFWQQTGQDRLSPAADQPAGQHRAVADRATRAGVQLIDNKGQTYTATDAEEMNGRLTGMPIPLNSLRQWIIGLPGDATDYSLDDRYRLRELNYTQNRKTWHVTYGGYTSDTQPALPSNVELNNGAQRIKLKMDNWIVK

SEQ ID NO: 10292 - protein, 132 aa, Klebsiella pneumoniae
RHAHQHHHDVVLRRVAQQIDDFMRLAHIPCHHQQQGGHRRQWQPGEQWGEDQQRQDHQQGVDHGGNRRCGAGADVRRRAGNRRGGSDPAEERRDNVAQPLANQLAIGFVLGAGHAIKHHRAQQRFNGAEHRH

SEQ ID NO: 10293 - protein, 320 aa, Klebsiella pneumoniae
YTRHVICNEKFKKQTVQEISMAALNSKVRKAVIPVAGLGTRMLPATKAIPKEMLPLVDKPLIQYVVNECIAAGITEIVLVTHSSKNSIENHFDTSFELEAMLEKRVKRQLLEEVQSICPPHVTIMQVRQGLAKGLGHAVLCAHPVVGDEPVAVILPDVILDEYESDLSRDNLAEMISRFDETGASQIMVEPVEDVTAYGVVDCKGESLKPGESVPMVGVVEKPKADVAPSNLAVVGRYVLSADIWPLLAKTPPGAGDEIQLTDAIDMLIEKETVEAYHMKGKSHDCGNKLGYMQAFVEYGIRHKTLGDDFKAWLETAVAK

SEQ ID NO: 10294 - protein, 348 aa, Klebsiella pneumoniae
YEPQVGCQASISERGKRMNSSGKVLILGASGGIGGEVARRLVADNWQVRALKRGARMRDPEDGIQWITGDALDGGQVAAAAAGCDVIVHAVNPPGYRHWRQQVLPMLHNTLQAAERQRALVVLPGTVYNYGPNAFPLIAEEAAQQPVTRKGAIRVAMELALEDYVQRGGRALIVRAGDFFGPRAGNNWFSQGLVKPGQLPRIISYPGTIGVGHQWAWLPDVAATIAALLARRHELEPFARFHMQGHWDPDGSEMSQAIQRVVARYGGRAVVKSFPWWLVKLAAPFNATLREMVEMHYLWRLPVRLRNDKLVDFLGAEPHTPLDSAVYQTLQGLGCLPAGAINQEAGEA

SEQ ID NO: 10295 - protein, 143 aa, Klebsiella pneumoniae
DFTQLIINRPKSLKNNFKTHKSVNCSLVLCHCNQPLSLFFSCQVPCRRLCVRRKEGEFEIEQMVSFASLSEEDRRSDTMKDKDEQTALIGMAIGAAVISLVATQKQINQGSIVDELVRLGRQKGDGVEDEVFVQAARLVSKGT

SEQ ID NO: 10296 - protein, 95 aa, Klebsiella pneumoniae
AIQQNEWWWGKDNSSLSLLALRAVACGNVLSLALESNLSRRFLPFPLSANIVYACRGNHITVVNNGGGGRIRTFEVDDGRFTVCSLWPLGNPTTG

SEQ ID NO: 10297 - protein, 172 aa, Klebsiella pneumoniae
RQEQQRDPEMHQTKKGNQWHFGMKAHIGVDAKSGLTHSLVTTAANEHDLNQLGNLLHGEEQFVSADAGYQGAPQREELAEVDVDWLIAERPGKVKTLKQHPRKNKTAINIEYMKASIRARVEHPFRIIKRQFGFVKARYKGLLKNDNQLAMLFTLANLFRVDQMIRQWERSQ

SEQ ID NO: 10298 - protein, 1171 aa, Klebsiella pneumoniae
PRWQPIWSASVNSPCWRYFPANRNILSVPSPQGVKMNIPGNGLGRFGLAGLTLAGMAAIWWGITRYGGMLNINTRGEQVLAFVLVCLALVFVFYLPAMSRRVKESLYRRQSQQASVLPGEEGRVALTPPHHITVGEIRQTLRYQYGRAWSRKVRILLIIGSVRDVEQLTPKLTQELWQEDQGTLLLWGGDPGAAVDNAWFTALRKLRYRPADGMVWVTSGFDGVLTTMNRTKPRLTPDEMDSVSHSLKLRLEALGWKLPLYVWSLYEGGNEKNGRITQPVGCLLPAGCTPQIVAEQFTALASLLIEQGIHQICGQPQHNFLLALADQLTREAEAVVEPLSILLNPYRPLPLAGVVFSEASVEAGRSVRHHWGRDNRWETIPDSVLRLPAGLRPRKQGVNWMRGMSVAAAALMLLWAASMTVSFIANRHLVAIAQEQVRLASAEKQPLAVRLHALSALQKTLSQLEYRSQHGAPWYLRAGLSQNDDLLAALFPHYGERAQPLLRDAAAHHLEEQLTAFVQLPPDSPLREKMTKTAYGQLKQYLMLTRPEKMDAAWFATTLMQDWPQRSGIADAVWQGSGPSLLAFYAASLASHPQWRLPVDDGLVSQVRTRLIRQLGQRNSESTLYQKMLAQVANQYADMRLADMTADTDASRLFSTDEVVPGMFTRQAWEQAVQPAIEKVVAERRDEMDWVLSDTKQTAAQSTSPEALRARLAERYFADFSGAWLDFLNSLRWQRAATLSDAIDQLTLMADVRQSPLVALMNTLSVQGRTGQTGEAIADSLVKSARQLFNRDNSPVIDQRSGARGPLDATFGPVLALLDNRDGGTPTSRLSLQTFLTRVTQVRLRLQQVTNATDPQAMTRLLAQTVFQGKAVDLTETRDYGSLVAAGLGQEWSGFGQTLFVRPMEQAWQQVLTPAAESLNAQWRSAVVEDWNSAFGGRYPFKNTSSEVSLPLLAKYLNSETGRIARFLQTRLNGVLHKEGSRWMADSINAQGLTFNPAFLQAMNTLSHLSDVAFANGEAGLHFALRPGTADGVMQTELVIDSQKLVYMNQMPVWRRFSWPADTEAPGASLSWVSTRAGTRQYGDFPGAWGWIRLLDKAVVSAYPGTSSSWSLSWKAPDGLLLNYTLRTEAGEGPLALLALRNFTLPETIFSVRASAERVPLTDDIPGEEGY

SEQ ID NO: 10299 - protein, 413 aa, Klebsiella pneumoniae
TLRQREVQLYGTALPCTIEAVIQGKFNFRAVERPFTQLIFKWDVIFFQRHRQIRFRAIPGLVATDTFFRASRQFDDDLLEAKGAIHIVDHTNTGVHFIANLIFSTEDMRIILGKAAHAHQTMQRARRFVTVAATEFRHTQRQVAVGFQPLVEDLHVTRAVHRLDTVFTVLRRGGEHRIFVVVPVAGFFPQHTVHHERTFYFLILVLFQFRTNKRFQFTEDGPAVIVPEHHPRRLFLHVIQVELLTDFTVVTLGGFFQTLQVGIQRFFICPRGAVDTLQHFIVAVAAPVGSGGFHQLKVMAEAHVRYVRTAAHIDIFFMMIQARLVIMGNVFIKNRNFIAFAAFHEGFTRFMPAHFLLDNVVVFLGELMHTFFERVDIFLGQGVVEVYVIVETIIDNRTDSHFGVGPQLFDGMA

SEQ ID NO: 10300 - protein, 374 aa, Klebsiella pneumoniae
HLHKWRWFMTHAHEAVKTRHKESSLVFPVLALAVLFFWGSSQSLPVVIAINILALVGILSSAFSVVRHADVLAHRLGEPYGSLILSLSVVILEVSLISALMATGDAAPTLMRDTLYSIIMIVTGGLVGFSLLLGGRKFATQYMNLFGIKQYLIALFPLAIIVLVFPMALPGANFSTGQSLLVAVISAAMYGVFLLIQTKTHQSLFVYEHEDDSDDDDPHHGKPSAHSSGWHTAWLLVHLVAVIAVTKMNANPLETLLTSMNAPVAFTGFLVALLILSPEGLGALKAVLNNQVQRAMNLFFGSVLATISLTVPVVTLIAFLTGNELRFGLGAPEMVVMVASLVLCHISFSTGRTNVLNGAAHMALFAAYLMTIFA

SEQ ID NO: 10301 - protein, 556 aa, Klebsiella pneumoniae
KTSNYNDWSYNTMTIITKKRLIAAGVLSALIAGNMAMAADVPAGVQLAEKQTLVRNSGAEPQSLDPNKIEGVPEANISRDLFEGLLNTSPKDGHPIPGVAESWDNKDFKVWTFHLRKDAKWSNGEPVTAQDFVYSWQRLVDPKTASPYASYPQYGHIVNVDEIIDGKKAPSELGVKAIDDHTLEVTLSEPVPYFYKLLVNPAMSPVYKPAIEKFGEKWTQPGNIVTNGAYTLKDWVVNERIVMERNPHYWDNAKTVINTVTWLPTSSEVTYVNRYRSGELDMTYNQLPIELFQKLKKEIPNELHVDPYLCTYYYEINNQKAPFTDVRVRTALKLGLDRDIIANKVKGQGDLPAYGYTPPYTDGAKLSEPEWFTWSQEKRNEEAKKLLAEAGYSADKPLTFNLLYNTSDLHKKLAIAAASLWRKNLGIDVKLVNQEWKTFLDTRHQGTYDVARAGWCADYNEPTSFLNTMLSDSSMNTAHYKSPAFDKIMAESVKASDEAQRTAAYAKAEQQLDKDSAIVPVYYYVNARLVKPWVGGYTGKDPMDNVYTKDLYVIKH

SEQ ID NO: 10302 - protein, 318 aa, Klebsiella pneumoniae
EQCKGTRQKVRAMLKFILRRCLEAIPTLFILITISFFMMRLAPGSPFTGERTLPPEVMANIEAKYHLNDPIMTQYFNYLKQLAHGDFGPSFKYKDYSVNDLVAASFPVSAKLGFAAFLLAVVIGVAAGVIAALKQNTRWDYAVMGVAMTGVVIPSFVVAPLLVMIFAITLHWLPGGGWNGGALKFMILPMVALSLAYIASIARITRGSMIEVLHSNFIRTARAKGLPMRRIILRHALKPALLPVLSYMGPAFVGIITGSMVIETIYGLPGIGQLFVNGALNRDYSLVLSLTILVGALTILFNAIVDVLYAVIDPKIRY

SEQ ID NO: 10303 - protein, 304 aa, Klebsiella pneumoniae
QETNQTGICLNLISAFRQLNSLYRMVKMESAVDRHVFYISDGTAITAEVLGHAVMSQFPVAISSVTLPFVENISRARAVKEQIDAIYQQTGIRPLVFYSIVIPEIRDIILQSEGFCQDIVQALVAPLQQELNLDPTPVAHRTHGLNPGNLIKYDARIAAIDYTLAHDDGISLRNLDQAQVILLGVSRCGKTPTSLYLAMQYGIRAANYPFIADDMDNLVLPASLKPLQHKMFGLTINPERLAAIREERRENSRYASLRQCRMEVTEVEALYRKNKIPCLNSTNYSVEEIATKIMDIMGLNRRMY

SEQ ID NO: 10304 - protein, 114 aa, Klebsiella pneumoniae
IGGKGMATARSGYTLQVIKAGQQGHVEMRWGHLADVDTRAAAAAIMQHIGRSSSSRGQQEISLSLTNAASGISVELHHPASGESATPAFIEAELKKIVQIVDGYEAAEDTHIVE

SEQ ID NO: 10305 - protein, 159 aa, Klebsiella pneumoniae
KGGNAFYNYVKYMNDVLDEIDRAILSCLTQDARVSLKVLSARVGLTSPSTAERVKRLEERGVIQGYGARVNLAALGYSLQALVRVRPLPGLLQKVDKYIQAMPECIESDKVTGEDCFVMRLVVRDIAQLDTLLDGLAEYAQCNTSVVKSSPVKRRLPPL

SEQ ID NO: 10306 - protein, 306 aa, Klebsiella pneumoniae
LFMKLRHLEIFYAVMTCGSLSRAAEALNISQPAASKALKSAEMKLGFTLFQRVRGKLLPTSEAITLFEKAQSIYQDLDNLRLLADNLARDPRAKITLGCLPSLGLSLVPELVTDFYQQNSNLVMTLTTEHTETLVKKLDLREIDLALTLQPVQQGEILTTLIAEVPLVYIDRHYRQGAVEIDQIDQQRWISPGPHSLSAAIATRRDFSTTRLNVQTYYMATEFVKRGMGCSITDIFSAQHNLAPEMIHPITPPMAINLCLLRRADVSLSPMAQKFVDFLCQRLRQQLKEINLRLYPDHKKSIAPLG

SEQ ID NO: 10307 - protein, 334 aa, Klebsiella pneumoniae
RLMKKVLCALGLMFTAVSSALATTYPLTIENCGYQETFTRPPERVVALGQNTVEILLLLGLQKQVVASAFWPTSVLPQLAEQNAKIKTLTVEIPSLESVLAQNPDFVPAQLPLLLGPESKVARREDLATVGVNSYVSPGMCATKKATGDMYGSRQKLWDMTWLYQEISDFARIFNVEDRGQALIADFKKREADLRQEFGKSKKDLSFVFWFSSASPSADAYVGGKNSASGFIASVLGGHNAITSETEWPTVSWESIIAANPDVIVVASLDRNRWALDKAEEKIKFLKSDPAVSQLEAVKKGHIVVMDGQAMNPTIRTLYGAEQVGEQLRKMGLN

SEQ ID NO: 10308 - protein, 151 aa, Klebsiella pneumoniae
GEVKMPRPSLYDILYGNFAGGLDLNTVSETDQVILSVLDNMQRILNCRAGTLAHLPDYGLPDMTAILQGMPASAHQLMSTLSAVLLKYEPRLQRIAVVMLDQHAPGELRYAIDAELKDIGLVRYGTEFMPEGRVLIRHLKRQQYLDARSAL

SEQ ID NO: 10309 - protein, 170 aa, Klebsiella pneumoniae
HNALWRRSAVTLSSMEAVLSQLCPCGSALEYSSCCQRYLSGAELAPGPSQLMRSRYSAFVMKDADYLIKTWHPSCQAQQFRAELEKGFSQTEWLGLTLFASDEGRAPNEGFVSFVARFNDNNRPGAIIERSRFLKENGQWYYIDGTRPLIGRNDPCPCGSGKKFKKCCGQ

SEQ ID NO: 10310 - protein, 108 aa, Klebsiella pneumoniae
PSADRPVLPYLAQIFLPGNLSGGRHGQHLAVSAGPGGAGHTGMCRRCRSAAVAISGAAAGDDAAGEIRGRHGGAGGAPGPGDPGDGVPPRSLPDPLVAAVNDERPSAG

SEQ ID NO: 10311 - protein, 287 aa, Klebsiella pneumoniae
LDREMMTRWPSPAKLNLFLYITGQRADGYHTLQTLFQFLDYGDTLTIEPRTDGQLRLLTPVAGVPDEENLIVRAARLLMHAASESDRLPAGSGADISIDKRLPMGGGLGGGSSNAATVLVALNHLWGCGLSEDELATLGLQLGADVPVFVRGHAAFAEGVGEILTPVEPEEKWYLVAHPGVSIPTPIIFRDPELPRNTPRRSINTLLNCEFSNDCELIARKRFREVDAALSWLLEYAPSRLTGTGACVFAEFNTESAARQVLDTAPAWLNGFVARGVNLSPLKQALL

SEQ ID NO: 10312 - protein, 60 aa, Klebsiella pneumoniae
SSSDVPTITLREVYATKLIGFKNDAQQLNAGSVVNIPLCQAGKPLYAGVLFPSAFKRLRP

SEQ ID NO: 10313 - protein, 233 aa, Klebsiella pneumoniae
SSRLSRKKRFPSNKETLMSQQERATILLIDDHPMLRTGVKQLISMAPDIQVIGEASNGAQGIELAESLDPDLILLDLNMPGMNGLETLDKLREKSLSGRVVVFSVSNHEEDVVTALKRGADGYLLKDMEPEDLLKALQQAAAGEMVLSEALTPVLAASLRANRATSDRDISQLTPRERDILKLIAQGLPNKMIARRLDITESTVKVHVKHMLKKMKLKSRVEAAVWVHQERIF

SEQ ID NO: 10314 - protein, 267 aa, Klebsiella pneumoniae
QDAEIADATHAGFGAHRRHPGFNTRVAEDAFLGFPALPVEIDLLVRTAGDTHPPAAALVLVDQYDAVFFTLIDGAARAGRDAGRVQAVLAQARQIHHEGVFELAVHRLLHVVEVLIFGAFFKLAAEDLFPVRTAGDLVHPLAGDQRARTGDRLMFALRRVMQILVVIIKRLVVIIDARQMRVGEDFTQQHRAIAHARLQFTVDFADPAALPFFLVFPVVRETDARLTFHVVEPGVFHPFPAGPDVFTGHRAGVAADALIEIQHHADL

SEQ ID NO: 10315 - protein, 472 aa, Klebsiella pneumoniae
PCRDVLRFADRDAAGADPRQRDAGGDFVRSAAVGRFPGENQNRDLPLPRQKAHSFHRLGWADMPLFSLRPAATLWPPVLLGSQFVFNIGFYAVVPFLALFLRDDMLLSGGLIGLILGLRTFSQQGMFILGGTLADRYGAKAIILAGCVVRVAGFLLLACGASLWPIILGACLTGVGGALFSPSIEALLARAGTLSQANGKRSRAEWFALFAVCGELGAVIGPVAGGVLSGIGFRHIALAGAGIFLLALAVLFFCLPADGHTTTTRRRVPWWTPLRQPRFVAFILAYSSWLLSYNQLYLALPVEIQRSGGREQDLAPLFMLASLLIITLQLPLARFARRMGAVRILPVGFLLLSASFASVALFAAAPPAEGWLRLMPAAGFVTLLTLGQMLLVPAAKDLIPLFAEESTLGAHYGALATAGGCAVLAGNLLLGHLLDQALIPSPQAVYPWLLLALFPLCSAVALRAICRPLAAT

SEQ ID NO: 10316 - protein, 94 aa, Klebsiella pneumoniae
PEGDIARSDFRNKRINIMKNNRYTIAALALCVLSFGASAATPVPPSGHQDHTQVGIAKATDVEAGSNIAPGAPTTGKSMSDAFNVHTLVAGEWS

SEQ ID NO: 10317 - protein, 63 aa, Klebsiella pneumoniae
GHQETFPVGFGSLVLFAFVSFINNAKWKLLKCQKLRPYAVLLSASKKPVKVVLSTSTLTCVTF

SEQ ID NO: 10318 - protein, 113 aa, Klebsiella pneumoniae
LPEEEALGGLRDVAPILGLLSARLQQRESRYAVLFELLLKLANTQVDSQKVAEKIADEARDDTPQALDAVWEEEQVKFFADQGCGESEISAHQRRFAGAVAPQYLNISNGGQQ

SEQ ID NO: 10319 - protein, 446 aa, Klebsiella pneumoniae
TVREHGVQERGWLVIIGAPARTRHVIGALMTGIEERFPLLVDQLHVNAQVFTPQRGGGNRQLLVQIRGVIQQVEGQRFIGAIAGFGQQFFRFFVAFFLRPGKPFRLAQLRAIGIRWGVAVGRQIALSFHLISNNITIQTQLQRGTHAHVGERGLLVVDFVIIGTQIGVNVQLVGDLFFQLLEEFDRQLVISHVQFTAAVAVNIGHFGRGRQPGNGVNDGFSIIPIVRVTLHHDPLVDHPVFQSIRAVGNDIARLRPLFAKFFDGRFVDGRHRRVNQQFIKIGYRFAEGDFQRVVVNGFYAQLARRFLAVNDFVDVNDMTILRIAGIRRRGFRIHQTLPAVYEVLGGNRLAVRPFCIFTQMEGPDFKIFIIPALRHARDRVAIFRRSIQQTFEQVAANIGLWHPFDFIWVQRLRLGAAITYQGLLLCQLHTSRDIRCHCHIAGDQCG

SEQ ID NO: 10320 - protein, 137 aa, Klebsiella pneumoniae
GLREVIGSWKIIEICSARSLFSSRSGKLRICRPLKVAEPPMRPLAASSPIRAKAVCDLPEPDSPTMPSVSPACRVKFRSLTAVTSPSGVLKVTRRSFTSSSSPLWLCACGAFAVSIMVMAALLSGLSGRGHHADHRR

SEQ ID NO: 10321 - protein, 402 aa, Klebsiella pneumoniae
GRGEDQIPQKRSRRQPAGGGEKRPYRGHGRSGDESDHSHALRRGTGGRTAEKNGAELMSVAAIETRRSILLTGWCVLAAIVLALVIAVGVSVGELAIPLQNVFYAISNRTGLTAEPLNRIYESVIWDFRLSRALVAACCGAGLAICGVVLQSLLKNALAEPYVLGVSAGASTGAVSIVVLGLGAGAISLSAGAFAGAFAAFAFVALLTNGARGGNERTILAGVAASQLFNAITAYTISTSASAQQARDVMFWLLGSFSGVRWPEFQLVIVVVLAGLAVCLWYARALDAFTFGDDAAASLGIAVPRVRLILFTTAALITATIVSMAGSIGFVGLVVPHVMRFFFGPLHRTLLIASALAGAILMVLADIASRLLIAPQSLPVGVVTALVGVPFFAVIIYRSRNK

SEQ ID NO: 10322 - protein, 898 aa, Klebsiella pneumoniae
HYQESIMAVTNIAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKEATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFASHGGYLLQGKELKAVQDIILKNGALNAAIVGQPAAKIAELAGFTVPATTKILIGEVTNVDESEPFAHEKLSPTLAMYRAKDFEDAVAKAEKLVAMGGIGHTSCLYTDQDNQPARVAYFGQMMKTARILINTPASQGGIGDLYNFKLAPSLTLGCGSWGGNSISENVGPKHLINKKTVAKRAENMLWHKLPKILSTSVVGSLPIALDEVITDGHKRALIVTDRFLFNNGYADQITSVLKAAGVETEVFFEVEADPTLTIVRKGADLANSFKPDVIIALGGGSPMDAAKIMWVMYEHPETHFEELALRFMDIRKRIYKFPKMGVKAKMVAITTTSGTGSEVTPFAVVTDDATGQKYPLADYALTPDMAIVDANLVMDMPKSLCAFGGLDAVTHALEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLESIKAELGIPKSIREAGVQEADFLAHVDKLSEDAFDDQCTGANPRYPLISELKQILLDTYYGREFVEGEAGAKAEVAPVKAEKKAKKSA

SEQ ID NO: 10323 - protein, 481 aa, Klebsiella pneumoniae
CRREPAMSAGRFNLSALAVRERSVTLFLIILISVAGLVAFFGLGRAEDPPFTVKQMTVITVWPGATAQEMQDQVAEPLEKRLQELKWYDRTETYTRPGMALITLSLQDQTPPSEVPEQFYQARKKLGDEAKNLPAGVSGPMMNDEFADVTFALFALKARGEPPRQLVRDAEALRQQLLHVSGVKKVNILGEQAERIYLSFSHDRLATLGLSPEAIFAALNSQNVLTAAGAIETRGGQIFIRLDGAFDRLQQIRDTPIIAGGRTLKLADVATVERRYEDPATFLIRHQGEPALLLGVVMREGWNGLALGKALDAETASINQNLPLGMSLTKVTDQSVNISAAVDEFMIKFFVALLVVMAVCFVSMGWRVGVVVAAAVPLTLAVVFVVMEATGKNFDRITLGSLILALGLLVDDAIIAIEMMVVKMEEGYDRLKASAYAWSPYRRAHAGRYPGDGRGLYAQWICAVHRRGSTPAMCSGSSVSR

SEQ ID NO: 10324 - protein, 304 aa, Klebsiella pneumoniae
LLVLMRKLKIGLALGAGAARGWSHIGVINALQRAGIEIDIVAGCSIGSLVGAAYACNRLPALESWVCSFSNWDVLKLMDLSWRRGGLLRGEKVFNHYRRIMPVTEIERCERRFAAVATNLSTGRELWFTEGDLHLAIRASCSMPGLMSPVRHNGYWLVDGAVVNPVPVSLTRAMGADIVIAVDLQHDAHLMQQDLFSLETPRQEAEEKEGPWHTRLRARLTRMSSRRTAVTPTAMEIMTTSIQVLENRLKRNRMAGDPPDILLQPYCPQVSTLDFHRAGEAIAAGQLAVEKKMDELLPLVRTAV

SEQ ID NO: 10325 - protein, 299 aa, Klebsiella pneumoniae
KMQLTRGVWQMSLAMIISGSIGAFVLLSGLPVTDVVFWRCLIGALTLLVFIVLSRQPFSRLTRFTLALAVIGGAALVVNWLLLFAAYSRISIGMATVVYNTQPFMLVLMGMVLGERVSAVKWGWLLLAFGGVVILLSSELTPAHEEGLTTGVLLALGAAFFYALTAIIARKLHPLPAQHIAFIQVLVGVVMLLPLVHTPELTASFPWRYLLILGIVHTGIMYQLLYSAIQKLPTPVTGSLSFIYPLVAMVVDYLVFHHALSAVQLLGGMLILFAAAGNNLGWGEKKPRRGGVSEQSRAS

SEQ ID NO: 10326 - protein, 218 aa, Klebsiella pneumoniae
PEFCQARPQTVHYAAENAPCRIENVTIKLIVGLANPGAEYAATRHNAGAWYVDLLADRHRAPLREESKFFGYTSRINLAGEDVRLLVPTTFMNLSGKAVAAMATFYRINPDEILVAHDELDLPPGVAKFKLGGGHGGHNGLKDIISKLGNNPNFHRLRVGIGHPGDKNKVVGFVLGKPPASEQKLIDDAVDEAARCTEIWLKDGLTKATNRLHAFKAQ

SEQ ID NO: 10327 - protein, 121 aa, Klebsiella pneumoniae
EGVCMQRIVIIANGAAYGSESLFNSLRLAIALREQQSDLDLKLFLMSDAVTAGLRGQKPAEGYNVQQMLEILTAQQVPVKLCKTCADGRGVSALPLVDGVEVGTLVELAQWTLAADKVLTF

SEQ ID NO: 10328 - protein, 258 aa, Klebsiella pneumoniae
WRFCTSGSDLILTCGCSFASPAIYCRMRNFAASRSMPSSSAVPLCCVRWMRRSRLTTESRFIWGAISASGKISTAGRAMKMAITAVKPSARLLAFLMVTVLTGCGLTQTVKDGAVSVTQSIFYPQVKTLHLDLRAREGVNNNAKGASLATVVRIYQLKDRQAFDNTDYPSLFAGDGQALQTDRVAEKDVRLRPGESVTVDMPMETSAQFVAVAAMFIDPDLTQNSWRLVLTRDELDPARPRIIEASQNQLTLHPFKEK

SEQ ID NO: 10329 - protein, 63 aa, Klebsiella pneumoniae
IIPCRRPADLVTTSLALAGRLSLITLKKGRLFASRHAAYITAVVSRDEQHNRDCSSKISICQT

SEQ ID NO: 10330 - protein, 343 aa, Klebsiella pneumoniae
IHRLDRMAPSRTLLAHSSTTGRMPEVLLVPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVMVDDMIDTGGTLCKAAEALKERGAKRVFAYATHPIFSGNAIQNIKNSVIDEFVVCDTIPLAPEIKALDKVRTLTLSGMLAEAIRRISNEESISAMFEH

SEQ ID NO: 10331 - protein, 93 aa, Klebsiella pneumoniae
PADCVPDLNLMLKQEVSMPYRSKQELPDSVQHVLPAHAQEIYKEAFNSAWDQYKDKDERRDDASREETAHKVAWAAVKNSYEKGDDDKWHKKK

SEQ ID NO: 10332 - protein, 98 aa, Klebsiella pneumoniae
KMDWVTETAPSFTVCVRPQPVKTVTMRNASNLAEGLTAVIAIFIALPAVDIFPDALIAPQINRDSVVSLLLRIQRTQHSGTAELDGMLLLAAKLRIRQ

SEQ ID NO: 10333 - protein, 220 aa, Klebsiella pneumoniae
SRRWQVKILSANEGEHGGFKEVIAKISGDGVYGRLKFESGGHRVQRVPATESQGRIHTSACTVAVMPELPEAEMPDINPADLRIDTFRSSGAGGQHVNTTDSAIRITHLPTGIVVECQDERSQHKNKAKALSVLGARIRAAEVAKRQQAEASTRRNLLGSGDRSDRNRTYNFPQGRVTDHRINLTLYRLDEAMEGKLDMLIEPIVQEHQADQLAALSEQE

SEQ ID NO: 10334 - protein, 386 aa, Klebsiella pneumoniae
KMGWVRTKALTMEQPSAPSLTRWLFAGVLMAIIGVLLFILHASGTVKIISVINIWWVSLMPAGCWLLIFCLRCYLWDRDLKAHQFLLKEAEYGQQRWEDWAGRWLAVPSSAVLLPDHISAAHWGSERPQQYGLARRINYLPAEEPVQLSAMHALLTSIEERVQCLPEELPLYVTLITDNPSPELTSSFSNLWKEHIPGRAVPDDITVTGSFSLSEVEERLKQPVLTVNLLLVIQLNGGTAYSDGLAVLLLTSDDVAQKYHLPHSSRLLRPMPLDMTNFEDDITLFLETQTVACHTPSVIGDAKKWTERSAALITQGGKMHTPWKAEDIALLEKWCGIPGPAAPWLLTALAADLVSLRKQPLLALFSSEQEHFISTITPGSEDEYTG

SEQ ID NO: 10335 - protein, 64 aa, Klebsiella pneumoniae
CAGWRHSIQSVYLKSTMQRLEQGDVVTVTQFPRLTHYQCAITAQDSEQGLLERRKVNSARHKAI

SEQ ID NO: 10336 - protein, 196 aa, Klebsiella pneumoniae
LRDRRAHRTPLRDAVDGPVSGTGYVSGIAGDVQYHGRGGPPGGRPPADPQTVRVKDGTMAALPDKDKLLRNFSRCANWEEKYLYIIELGQRLAPLSPEEHSVQNIIQGCQSQVWIVMDQDPTGVITLRGDSDAAIVKGLIAVVFILYDRMTAQDITEFDVRPWFEKMALTQHLTPSRSQGLEAMIRAIRAKAANIS

SEQ ID NO: 10337 - protein, 83 aa, Klebsiella pneumoniae
IFFFPRECGGQMRASVIAFGSLLIQQYAHNQQYGHAHRHNTDINNHSVRQKLQLNGYGGQVKAHLIVVKECTLPTSIEQTFID

SEQ ID NO: 10338 - protein, 1409 aa, Klebsiella pneumoniae
PTVRRQRSARSSRSICRVRATAFSWRTTAGITICASRSSISCMKNSRKRRKEAVMTRRLVVIGNGMAATRLVQRLVERDPARFAITVVGDEPHPAYNRIQLSPLLAGEKTAAQIPLLPAEWYTRHGVCLRSGEAVDEVDIQQRRLRIAETWLPWDELVFATGSRPFIPPLPGIDRPQVMPFRTLADVERILAIPGPAVVIGGGVLGVEAAAALRRHGGEVTLLHRGSGLMAPLTDAFAADELRQQLEARGIRCVLACRIAAIDADGVRLADGRVFRAARVVLATGVQPDSRLAAQSGVLCQRGIVVDRQMAASLPGISAIGECCEIDGQTWGLVAPCLRQAEVLADRLCGAPGEGFVWQDAGTRLKVTGIELFSAGEQQAGEQDDIYTSWDPIDRHYRRLLLRDGRLRGVLLMGDCTAAAALTARLESDEPVTVDWLFDPSSTQPQAAGMMTMTKPVLVLVGHGMVGHHFLEQCVSRNLHQQYRIVVFGEERYPAYDRVHLSEYFAGRSAESLSLAAGDFFIEHGIELRLGEAVATIDRDARLVRDAEGHEIHWDKLVLATGSYPFVPPIPGNDLAGCFVYRTLDDLDRIAAHAAAAKSGVVIGGGLLGLEAANALKQLGLETQVVEFAPNLMAVQLDNGGAAMLREKIVALGVGVHTSKATTAIVREADGLRLNFADGGALRTDMVVFSAGIRPQDALARGCALQVGERGGIHIDGQCRTSDPDVLAIGECALWDNKIYGLVAPGYQMARIAAATLAGEDACFSGADMSTKLKLLGVDVASFGDAQGRTPGCQSYQWTDGPQQIYKKIVVSQDGKALLGGVLVGDASDYATLLQMMLNGMALPPRPESLILPALEGAAPKALGVAALPDSAPICSCHNVSKGDICQAVNNGAGDMSAIKSCTRAATGCGGCSALVKQVMEYQLAEQGVEVKKDVCEHFPWSRQEIYHLVRVNHIHTFEQLISRYGQGHGCDVCKPLVASVLASCWNEYLLKPAHLPLQDTNDRYFANIQKDGSYSVVPRMAAGEVTPDGLIAIGQIAKRYQLYSKVTGGQRIDLFGARLEQLPAIWRELADAGFETGHAYGKSLRTVKSCVGSTWCRYGVQDSTGLAVRLEHRYKGLRAPHKIKMAVSGCTRECAEAQGKDIGVIATDKGWNLYVCGNGGMKPRHADLFASDLDEATLIRSIDRLLMFYIRTADRLQRTSTWMDNLEGGVAYLRQVVLEDSLGIGEELEQEMARIVDSYQCEWQTTLNDPQRLALFRSFVNSDQPDEAVQRRDLRGQPQPLLTETLPEGELPSRPWQAVCDLDAIPAQAGIGARLGERQIALFRFGERVYALDNREPGSTANVLSRGLLGDVGGEPVVISPLYKQRIRLRDGWPCDGSEQAVRAWPVKVENGKVWVGNQQLLARAEAS

SEQ ID NO: 10339 - protein, 139 aa, Klebsiella pneumoniae
NRARVWAGQALFPGMLPRAQVSNGHQFGAWAAKLGDGRGILFGEQQLPDGPPLRLASERRRPDSLFADGERPRRAALADPGKSGVGGDACSGDPDDARPGDGDQRYPGLPRARGARRDADAGGREPCPLRPFRTFLLSP

SEQ ID NO: 10340 - protein, 229 aa, Klebsiella pneumoniae
THYRGRRINYERAVCRLSAMSETPRQKGRPKDPLKTQAILQAARKLFLEQGLEVTTAEIARVAGVAKATLYANFSDKEHLIEAVLRQESDLTISDHDFAQRHHLPLIEVLTAFGYRFVRFINQRELTGWDRLIASAAVRHPDLPGRFYAAGPGRAQQMLEAIIAEAIEAGTLRACDPQEAADELAGLWLGMTSLAIKLGARPPLSDDEIKQRVERALDVFLRAYSLTPG

SEQ ID NO: 10341 - protein, 826 aa, Klebsiella pneumoniae
TIHRFFQLHKYVRIILQSIVKFFSLVLNHKRIVSMSNNGSSPLVLWYNQLGMNDVDRVGGKNASLGEMITNLSGMGVSVPNGFATTADAFNQFLDQSGVNQRIYALLDETDIDDVSALAKAGAQIRQWIIDTPFQSELENAIRDAYDLLSADDAEASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAAGRPAIVRRTMGSKKIRMVYAPTQEHGKQVRIEDVPQAQRDIFSLSNEEVQELAKQAVQIEKHYGRPMDIEWAKDGHTGKLFIVQARPETVRSRGQVMERYTLHAQGQIIAEGRAIGHRIGAGPVKVIHDISEMNRIEPGDVLVTDMTDPDWEPIMKKASAIVTNRGGRTCHAAIIARELGIPAVVGCGDATDRIQENQNVTVSCAEGDTGYVYAELLDFSVKSSSVGDMPDLPLKVMMNVGNPDRAFDFACLPNEGVGLARLEFIINRMIGVHPRALLEFDDQEPGLQNEIRELMKGYDSPREFYVGRLTEGIATLGAAFYPKRVIVRLSDFKSNEYANLVGGERYEPEEENPMLGFRGAGRYVSESFRDCFALECEAMKRVRNDMGLTNVEVMVPFVRTVAQAKAVVEELERQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLGLAELKK

SEQ ID NO: 10342 - protein, 346 aa, Klebsiella pneumoniae
PCRRSVSWRFISERRNLSMKRKTMITLALLSALGASSAAWAVDYPLPPANSRLIGQNQYWTVQEGDRNLQAIARHFDTAAMLILEANDTIAPVQPKPGTQVLIPSQMLLPDVPREGIVVNLAELRLYYFPPGENQVQVYPLGIGQLGLETPEMTTRVGQKIPNPTWTPTAGIRARSLEKGVTLPAVVPAGPNNPLGRYALRLAYGNGEYLIHGTNAPDSVGLRVSSGCMRMNADDIKALFSQVKTGTPVRIINQPVKFAVEPDGKRYVEVHRPLSQTEGENTRTIAYTLPAAFHAFAEDKAVDDLQLKKAMSRRAGYPVVVSAGAGSTATSLSAQNSSSDNGLLTQ

SEQ ID NO: 10343 - protein, 320 aa, Klebsiella pneumoniae
RAVRRYRSEDSLLKPEFAMMLSKKNSEALENFSEKLEVEGRSLWQDARRRFMHNRAAVTSLIMLVLIALFVTFAPMVSSFSYFDTDWGMMSNAPDMASGHYFGTDSSGRDLLVRVAIGGRISLMVGVAAALVAVILGTLYGSLSGYLGGKVDSVMMRLLEILNSFPFMFFVILLVTFFGQNILLIFVAIGMVSWLDMARIVRGQTLSLKRKEFIEAAQVGGVSTASIVLRHIVPNVLGVVVVYASLLVPSMILFESFLSFLGLGTQEPLSSWGALLSDGANSMEVSPWLLLFPAGFLVVTLFCFNFIGDGLRDALDPKDR

SEQ ID NO: 10344 - protein, 92 aa, Klebsiella pneumoniae
HMKRKNASLLGNVLMGLGLVVMVVGVGYSILNQLPQLNLPQFFAHGAILSIFVGAVLWLAGARIGGHEQVSDRYWWVRHYDKRCRRNQHRHS

SEQ ID NO: 10345 - protein, 63 aa, Klebsiella pneumoniae
CAPLPEKEAGQYQALPRGGVPERPKGADCKSAVIDFEGSNPSPTTIIHYSDMVSPTSVNDVCT

SEQ ID NO: 10346 - protein, 366 aa, Klebsiella pneumoniae
KKKRKTAPESLPCGGFFRIWIRNINFTITGVCTDIMRKTMSHLAELVASAKAAINEASDVAALDNVRVEYLGKKGHLTLQMTTLRELPPEERPAAGAVINEAKEQVQQALNARKAELEGAALNARLAAETIDVSLPGRRIENGGLHPVTRTIDRIESFFGELGFTVATGPEIEDDYHNFDALNIPGHHPARADHDTFWFDATRLLRTQTSGVQIRTMENQQPPIRIIAPGRVYRNDYDQTHTPMFHQMEGLIVDKNISFTNLKGTLHDFLNNFFEEDLQVRFRPSYFPFTEPSAEVDVMGKNGKWLEVLGCGMVHPNVLRNVGIDPEVYSGFAFGMGMERLTMLRYGVTDLRAFFENDLRFLKQFK

SEQ ID NO: 10347 - protein, 526 aa, Klebsiella pneumoniae
LVRRRRQRPGTGERKMKIRSQVGMVLNLDKCIGCHTCSVTCKNVWTSREGMEYAWFNNVESKPGVGFPNDWENQEKWKGGWIRKINGKLQPRMGNRAMLLGKIFANPHLPGIDDYYEPFDYDYQNLHNAPESKHQPIARPRSLITGQRMDKITSGPNWEEILGGEFEKRAKDQNFDNMQKAMYGQFENTFMMYLPRLCEHCLNPACVATCPSGAIYKREEDGIVLIDQDKCRGWRMCITGCPYKKIYFNWKSGKSEKCIFCYPRIESGMPTVCSETCVGRIRYLGVLLYDADAIENAASTENEKDLYQRQLDVFLDPNDPKVIEQALKDGVPQGVIEAAQQSPVYKMAMDWKLALPLHPEYRTLPMVWYVPPLSPIQSAADAGELGSNGILPDVESLRIPVQYLANLLTAGDTQPVLLALKRMLAMRHYKRAETVDGVVDTRALEEVGLSEAQAQEMYRYLAIANYEDRFVVPSSHREQAREAFPEKNGCGFSFGDGCHGSDSQFNLFNSRRIDAIDVTSKTEPHA

SEQ ID NO: 10348 - protein, 67 aa, Klebsiella pneumoniae
ITGRFPDLISVDRYKKSRCGGIFFALRADIKKPGVADALPVCAFNRAADYFATAVSSQALKSSPSVL

SEQ ID NO: 10349 - protein, 320 aa, Klebsiella pneumoniae
WTGRSGTGPTRKATPVISLFNVRGHEMKQAQRKQPVVSVDNAPGEVIILPPVQVRRTTPTVTRWLRELTQRLLPPLLGLGVLLLAWQLAAMHSKGFPTPLSTLDSALTLFADPFYQDGPNDMGIGWNVLASLQRVAVGFGLAALAGIPLGFLIGRSLFFARMFNPLIALLRPVSPLAWLPIGLLLFQKAEPASSWTIFICSIWPMVINTAEGVRRIPQDYLNVARVLQLSEWTVMRKILFPAVLPAVLTGVRLSIGIAWLVIVAAEMLTGGLGIGFWIWNEWNNLNVENIIIAIVIIGVVGLLLEQGLMLLARRFSWQEK

SEQ ID NO: 10350 - protein, 509 aa, Klebsiella pneumoniae
VRLRRKFWGAGGVTMSRNTEATDDVKTWTGGPLNYKEGFFTRLQTDELAKGINEEVVRAISARRNEPQWMLEFRLNAYRAWLEMEEPHWLKAHYDKLNYQDYSYYSAPSCGNCDETCASEPGAVQQTGANTFLTSEVEEAFNQLGVPVREGREVAVDAIFDSVSVATTYREKLAEQGIIFCSFGEAIHDHPELVKKYLGTVVPGNDNFFAALNAAVASDGTFIYVPKGVRCPMELSTYFRINAEKTGQFERTILVADEGSYVSYIEGCSAPVRDSYQLHAAVVEVIIHKDAEVKYSTVQNWFPGDNNTGGILNFVTKRALCEGENSKMSWTQSETGSAITWKYPSCILRGDNSIGEFFSVALTSGHQQADTGTKMIHIGKNTRSTIISKGISAGHSQNSYRGLVKIMPTATNARNYTQCDSMLIGPDCGAHTFPYVECRNNSAQLEHEATTSRIGEDQLFYCLQRGISEDDAISMIVNGFCKDVFSELPLEFAVEAQKLLAISLEHSVG

SEQ ID NO: 10351 - protein, 426 aa, Klebsiella pneumoniae
IYQRWIYRVMNKRIVIIGGGVVGLATAWELIKRGHQVQLLERNAEPGSATSFANGGQLSYRYVAPLADSGVPLQGMKWMGKADSPLNMRIRMSLQQWRWLLQFLRACNNQTNKMNGDHILRLSLLSRQVMQAWRDEDNLADFHWRRSGKLIIHRREYDFNKAAKGIDPQYQQALNAEACLQLEPALKHISPSLQGGIYSPGDETADCHQFCLALLDKLNASSDFSLLTQCEVRRLNKRGGRISSLETSQGPLPGDEYVVAAGNGSGSLLGHLGVRVPLCALKGYSLTLPYPEKAGIAPDISVTDYGHKIVYARLGQQLRIAAMVDIGYDGDELRESRIQALKNIVARSFPELEGLDEAEVWTGMRPSTPAGPPMLGRAGYPNLWMNLGQGSLGFTLAAGSAVVLGALIDNQMPDISLEGLTWKQTA

SEQ ID NO: 10352 - protein, 105 aa, Klebsiella pneumoniae
TRWRGRGRSTARISPTVAAGPLVIISTRSESSTASSTSWVIMTMVVLSSCWICITVSWRWARVSASRAPKGSSSSSTFGFIASARAIPTRCFMPPEISPGRLCSA

SEQ ID NO: 10353 - protein, 152 aa, Klebsiella pneumoniae
RQRRSPPAAGVTGDNRMIWKRQATLEQLNRLGEGNMVGLLDIRFETVTDDTLEATMPVDSRTQQPFGLLHGGASVVLAETLGSVAGYLCSEGEQKVVGLEVNANHIRSARGGRVRGVCKALHVGTRHQVWQIEIFDEQSRLCCSSRLTTAVI

SEQ ID NO: 10354 - protein, 370 aa, Klebsiella pneumoniae
PMLRLNAVHLAVCLLPLALAGCGEPADHDDPRIRPPLVRVATVERAEAGSRAFTGVVVARTQSDLGFRVAGKVLERRVETGQSVKRDQLLLRLDPADLALQAQSQQRAVDAARARAKKAANDLARYRGLVASGAISAAEFDQINAAAEAARADLSAAQAQANVAQNATGYAGLLADADGVVVETLAEPGQVVSAGQVVIRLARAGQREARVQLPETLRPAVGSEALATRYGSESQPVTASLRLLSDAADATTRTFEARYVLNGALANAPLGSTVTLRIGNDQAPGQVLAVPLASVYDPGNGPGVWRIASRPATVSWQPVTVLGLDDETARVTGPLKPGEPIVALGAHLLHQGEAVRLAERREHNAAGSQP

SEQ ID NO: 10355 - protein, 66 aa, Klebsiella pneumoniae
VVASAELTAVNIKPNAQRTFFIKRYPCKQASGWPANGSNANETHYWGGVLYNAIFTVSMSDYFRRQ

SEQ ID NO: 10356 - protein, 133 aa, Klebsiella pneumoniae
SDARHFFRRSHMETNRMTIIRNNPQPRLAASVAYGDLLFLSGQTPKSNEDDIVLQTREVLEKIDALLAAAGSDKQHVLSAQIWLKNIERDFAAFNEVWVQWMPEGYSPARAAVQAEMARPEILVEIMLTAVKA

SEQ ID NO: 10357 - protein, 125 aa, Klebsiella pneumoniae
NRYRRAHMARVKRGVIARARHKKILKQAKGYYGARSRVYRVAFQAVIKAGQYAYRDRRQRKRQFRQLWIARINAAARQNGISYSKFINGLKKASVEIDRKILADIAVFDKVAFTALVEKAKAALA

SEQ ID NO: 10358 - protein, 800 aa, Klebsiella pneumoniae
GQDRTMKFSELWLREWVNPAIDSEALSDQITMAGLEVDGVEPVAGSFNGVVVGEVVECGQHPNADKLRVTKVNVGGERLLDIVCGAPNCRQGLKVAVATIGAVLPGDFKIKAAKLRGEPSEGMLCSFSELGISDDHSGIIELPADAPIGTDIREYLKLDDNTIEISVTPNRADCLGIIGVARDVAVLNKAPLNAPEITPVAATIDDVLPIQVDAPQACPRYLGRVVKGINVKAPTPLWMKEKLRRCGIRSIDAVVDVTNYVLLELGQPMHAFDRDRIEGGIVVRMAKEGETLVLLDGSEAKLDSDTLVIADHNKALAMGGIFGGEHTGVNDETQNVLLECAFFSPLSITGRARRHGLHTDASHRYERGVDPALQYKALERATRLLIDLCGGEAGPVIDVTSKENLPTRATITLRRSKLDRLIGHHIDDAQVTDILQRLGCEVTVGEGEWQAVAPSWRFDMEIEEDLVEEVARVYGYNNIPDEPVQAGLIMGTHREADLSLKRVKTLLNDKGYQEVITYSFVDPKVQQLIHAGEEALILPSPISSEMSAMRLSLWTGLLGTVVYNQNRQQSRVRIFESGLRFVPDTNAPLGIRQDVMLAGAICGNRYEEHWTLAKETVDFYDLKGDLEAVLDLTGKLADIEFRAEATTALHPGQSAAIYLKGERIGFIGVVHPELERKLDLNGRTLVFELEWNKLADRVVPQARDISRFPANRRDIAVLVAENVAAADVLAECKKVGVNQVVGVNLFDVYRGKGVAEGYKSLAISLILQDTSRTLEEEEIAATVARCVEALKERFQASLRD

SEQ ID NO: 10359 - protein, 294 aa, Klebsiella pneumoniae
RWRSACKHYRIFLAMHSLQRKVLRTICPDQKGLIARITNICYKHELNIVQNNEFVDHRTGRFFMRTELEGIFNDATLLADLDSALPEGSIRELNPAGRRRVVILVTKEAHCLGDLLMKANYGGLDVDIAAVIGNHDTLRSLVERFGIPFELVSHEGLSREEHDQRMGDAIAAHEPDYVVLAKYMRVLTPEFVARFPNKIINIHHSFLPAFIGARPYHQAYERGVKIIGATAHYVNDNLDEGPIIMQDVIHVDHTYTAEDMMRAGRDVEKNVLSRALYQVLAQRVFVYGNRTIIL

SEQ ID NO: 10360 - protein, 483 aa, Klebsiella pneumoniae
LALRSVMSDSTLTGNAPVRQNITRKNVIIGLLLLLFVLIALWCHGRPGSELGLLGFTPLVALAILSLIGVDIVLAVISSIIIAMIMTSTGLPEMGTMLAKSTGSFIATVGLIIMLGAGVGEVATRTGAAVELVKFVVHRIGLSSQTRVKFGIVASSILICGSLGTMAGGNAIIVAVIIPVAAAVRLTPPTVAALMMTAGSVGLFTAPFTPSTVTILSLGGLSYPDYLLYVGLPMSAVTLLAGWVMAGRIQKMTEGKLRYDVDLAEKPQEDLSAAQQRRRKLSALAFAATIIVMAIVGVVIKAGFSFAIIVMLLVALMTGLVGGLRPTQILQALYHGCGRLVWMFILYWLYNPILELMDGLHAYQGLLEYTQPLLEGISPAWLCFSIFAFNIIGHVPGAAVAQMTFTHKIFGPMLMAAGVPPQGTTAVLLASSQVDWFGPFPSSDMFGQMGLAQSTHLKYMLYNGWAIVVANIILFALLFQILV

SEQ ID NO: 10361 - protein, 274 aa, Klebsiella pneumoniae
LRLRRLIEYDCYLHLKSEHHFSTETTMSAMTLDLPRRFPWPTLLSVAIHGAVVAGLLYTSVHQVIEQPSPTQPIEITMVAPADLEPPPAAQPVVEPVVEPEPEPEPEVVPEPPKEAPVVIHKPEPKPKPKPKPKPKPEKKVEQPKREVKPAAEPRPASPFENNNTAPARTAPSTSTAAAKPTVTAPSGPRAISRVQPSYPARAQALRIEGTVRVKFDVSPDGRIDNLQILSAQPANMFEREVKSAMRRWRYQQGRPGTGVTMTIKFRLNGVEIN

SEQ ID NO: 10362 - protein, 105 aa, Klebsiella pneumoniae
LLIRSFAVLYVIYAEDIADSLEKRLSVRPAHLARLQLLHDEGRLLTAGPMPAVDSNEPGAAGFSGSTVIAEFESLEAAQAWANDDPYIAAGVYRQVSVKPYKKVF

SEQ ID NO: 10363 - protein, 456 aa, Klebsiella pneumoniae
VNKSPGNEPMAVRGPVDKGVLQCVCTVGRFFFAHGGADMGDKFSISRRRLLQAGAALGGAMLLPGVMQAAWAGGSDKPEQTRVRVGFIPLTDCAPLAIAAAKGFDQKYGITLVASKEASWAAVRDKLVAGELDAAHILYGLLYGLELGIASKPQAMANLMTLNRNGQAITLSSELQEKGVTDLGGLKRLIDRSAPGSYTFAHTFPTGTHAMWLYYWLASAGIDPFNDVRTVVVPPPQMVMNMRIGNMSGFCVGEPWNARAINDRIGFTAATSQDIWPEHPEKVLGTRRDWVERNPNTARALVAALMEAQRWIAASPENTRETARLLARRGWLNTKEQYLTGRMLGEYDNGLGRRWQDAHPIRFWAGGEVSFPWLSDGMWFLTQFRRWGLLKQAPDYLAVASRINRIDVWQAAAQAVGGISAPAARMRSSTLMDGTVWNGSDPEGYARHFSIQRKGA

SEQ ID NO: 10364 - protein, 85 aa, Klebsiella pneumoniae
PPVRKNHAFSLLVSNRTPGHAGRFLLRALRPGPASDSRPTARGRWPPGHRDWHRACPACAAPAQAKTDTGRWCRAARWPGRSAGR

SEQ ID NO: 10365 - protein, 60 aa, Klebsiella pneumoniae
PGASGRAGGDGATRNPGGDHAHRRQSVKIDRKEKGRNAAFLISSDYLSFGDAFSTRLFSF

SEQ ID NO: 10366 - protein, 89 aa, Klebsiella pneumoniae
RWARVSIDSITQGEQEADFTVGCRGEKRKTSRPNVDAEENLLRVCGRSSHQNLKQQRKENDVRHHDCPAVIEHIFQMSRLRQPHLAEHI

SEQ ID NO: 10367 - protein, 127 aa, Klebsiella pneumoniae
APAGYASPCPGGGRGSAHPGRRRAHQAAALSASSPAPGRYPPAASCRRRSPRDVCAAHDPSVRAPGCVRSTPGAHSCSWCDGTPDPPPAPHCRNSSATAAASGSGKPPPAPARDRRFPGYHTVVRPR

SEQ ID NO: 10368 - protein, 255 aa, Klebsiella pneumoniae
RSAGAIMSFLMQLQDVEAAGRLAPFSAAFRAGEIVHLVGPNGAGKSTLLTRMAGLSDGPGTVHFNGRLLDEWPARELARRRGYLSQHQTPPFAMPVWHYLALHMQQQGDSARLSDIAARLGLDNKLGRPVNQLSGGEWQRVRLAAVILQIDPLSNSAGQLLLLDEPMNSLDVAQQAALDRLLHELSAAGIAVVMSSHDLNHTLRHAGQSWLLCQGEAIACGETAEVLNEENLTAAYAIPFQRVEVAGHIMLIASQ

SEQ ID NO: 10369 - protein, 594 aa, Klebsiella pneumoniae
TNNGIFIMDDLTLRYFDAEMRYLREAAKAFAQAHPDRAAMLDLDKAGTPDPYVERLFEGFAFSVGRLREKIDDDLPELTEGLVSMLWPHYLRTIPSLSIVALTPTLPAMKMAETVPAGFEISSRPLGPKNTVCRYRTTRDLTLNPLAIEEAVMTAEPDGRSALRLRFACSELADWSQTDLRRLALYLGEDAVTGSALHLWLTRRQAALYLRLPGQTERVSLDGYFSPGGFSEEDRLWPKGESAFSGYQLLLEYFTFREKFMFVQLNGLENITLPAGISHFTLEVVFSEVWQSDLPVSASSLRLHCVPVINLFTLEADPLTISGLESEYLLRPKRLQDGHTEIYSVDSVTGSGRTGEARYVPFTRFRHQGGMMRRHAPERYYHTRVKRGVTGMHDTWLILGGQQWEADRELARETVSLRITGTNGQLPRRALQSTLLDRCESISATPLTVRNLCKPTLPAYPPAEDRYHWRVMSHLGTRFLNMMSSAEVLRGTLSLYNWREDELNNRRLDAILAVSHHRIQRFEQGFLLRGLDIEVTLDGSGFTGAGDVHLFGDMLNRFFALYADMNQFNQLTLIVQPEGKCIRWKENHSLRLPG

SEQ ID NO: 10370 - protein, 430 aa, Klebsiella pneumoniae
GNSGNANISFPRRFLEAYSFFTCRTSTKVKKHKDIIMIVSAPSDYREAARRRLPRFLFDYIDGGAVAENTMNANAAELASVALRQRVLCGAGEPTLATTILDAPWAMPVALGPVGATGMYARRGEVQAARAASRAGIPYTLSTVSVCSIEEVASHASGALWSQLYVLKDRGYMRNALERAWAAGMKTLVFTVDMPIPGSRYRDNRSGMSGPHATLRQYLQACTHPRWAMNVGLAGRPLSFGNIEAYTGHKMTMDDYMGFISNNFDPSIAWHDLEWIRDSWQGKLIIKGILDADDARNAVRLGADGIVVSNHGGRQLDGAIPTARALPRVVDAVGDDLTVLADSGVRSGVDVIRLLALGAKGVLLGRAYIYALAAAGEAGVAHLLRLFAEDMKVTMTLTGATSPSAISLDCLDRLEQDQHRTHAVPVSLPA

SEQ ID NO: 10371 - protein, 60 aa, Klebsiella pneumoniae
DSSGNNLYFIMKIEASLQNCQELDFPSPSHRAMLKLTTVAVLRRRRNDQNLHAHAGPLAG

SEQ ID NO: 10372 - protein, 82 aa, Klebsiella pneumoniae
VFPGGGAAHLSGLPDGTTCSLAKRSASDETAEQVAESATVVGEGLLGAKAPRLRAIACGNVLSLRSSRTLVEASHPSPWGRI

SEQ ID NO: 10373 - protein, 356 aa, Klebsiella pneumoniae
SAPGLTPRRQAGGEYSAGFALCPPSGWTIAMNNKFTYTIKRTRFDENYNPAENTRITTNFANLARGVNREENLRNTLIMMNNRFNSLAHWDNPHNDRYAVELDIISVEMNIAQDSASFPVIEILQTHIVDKKSGERHAGIVGNNFSSYVRDYDFSVLLLEHNKDQSRFSVPENFGELHGNIFKDFVQSSAWRANFSKAPVICLSVSSKDVYHRTGNEHPVLGIEYAQEGVSLTERYFSKMGLQVRYFMPKNSVAPLAFYFTGDLLSDYTSLELIATISTMETFQKIYRPEIYNANSPAGQYYQPNLSHLDHSLTKIVYDREERSLLAIEQGKFTQQHFINPHKTLLEQWSANFALC

SEQ ID NO: 10374 - protein, 635 aa, Klebsiella pneumoniae
ADAGFHRAQRLAVGVAGFKPGVGQLAPDSRQLFQPRAKQVDALAAGHFAVELVTFGDLPDGDQSVRRHFPCRHPRHHRIAPVLLDIGEIAVVGILQRQVRRLQQVLVPAGGQHRGHQRFADIAAVPLAVAANQLLEGMDMVNPYQVVDLLARPREMFADVFFHFDALLRQLILHHLFHQRAAAAAAGSRSGAAFYRRHIPRPIVHRLADIAFADVMAGADRRAVRQRRDAERLRRGSLQRGQDQTLRTRRQRHAVQHHLQQRGIVAGIPHQHAAKQGFAVLTDDDFFVNLLRTVGPLIALTARRAPLRIAKRGHVDPQQLQFGAHVGAAKAGVLSCESGRGDARHLIARRHQTVNFIVPQGAFAYRQHVRVRGTALAVDVNSPAFAHLQRAAAGQRVLRADPRREDHHVGPQRAAVGKVQPQAVGLAHDGGGRFAGMHPHAEGDDLLPEHRRPAVIQLDGHQVRGKLHHLRLQPQLFQGVGRLKPEQPAADNHPALRRGGMGGDTVEIVKSAVDKAPREIVTGDWRNKGIRAGRQHQFIPVDFMPLGVPYQPCVAVDGRHRLAEAEFNTVFNKEIPGRQRQRLGAASGKILGEMYPVVGGVTLFAKHHDSILLMQIAAHALFEKMVADHAMSHQH

SEQ ID NO: 10375 - protein, 181 aa, Klebsiella pneumoniae
GIKGGKRVQTARPNRINGEIRAQEVRLTGLEGEQLGIVSLREAIEKAEEAGVDLVEISPNAEPPVCRIMDYGKFLYEKSKSSKEQKKKQKVIQVKEIKFRPGTDEGDYQVKLRSLIRFLEDGDKAKITLRFRGREMAHQQIGMEVLNRVKDDLVELAVVESFPTKIEGRQMIMVLAPKKKQ

SEQ ID NO: 10376 - protein, 94 aa, Klebsiella pneumoniae
YIKGNSMSKGFVLLGDKTTHGGAVISASSTMIVNGKPVALVGDKVSCPIPGHGTNAIIEGAPEWSSDGKAIVVDGCKCQCGCQVISGAPECAIG

SEQ ID NO: 10377 - protein, 314 aa, Klebsiella pneumoniae
GGEGMTKIYTLTLAPSLDSATQTPQIYPEGKLRCSAPVFEPGGGGINVARAVTFLGGKATAIFPVGGATGEHLAALLADEQVPVETVETRDWTRQNLHVHVAASGEQYRFVMPGAALTDDEFRRLEEKVLTIEPGSLLVISGSLPPGISVDNLMQLVKNAQQQGLRCIIDSSGDALAAALDVGNIELVKPNQKELSALVQRDLSQPDDVRLAAQSLIQSGKVRRVVVSLGPQGALGVDASGSVQVVPPPMKSQSTVGAGDSMVGAMTLRLAENASLEDMVRFGVAAGSAATINQGTRLCSRANTQKIYDYLCGR

SEQ ID NO: 10378 - protein, 621 aa, Klebsiella pneumoniae
LFRGMGILQGIVENKRHSRRHDRSGATHSMLKRLFTPLTLVNQLALIVLLATIIGVAGMAISARLVNGVQGSAHAINKAGSLRMQSYRLLAAIPLNENDQKLVADMTATVFSPELQNSARRDGQEIQLKALQQYWQLALAPGMQRAVNQAEVAQDVADFVDRIDQLVTAFDHTTEQRIERGVWIHRILAIGMALLLIFTIIWLRARLLRPWKQLLSMARAVSQRDFTQRAHISGRNEMATLGMALNNMSEELAESYAVLERRVQEKTAGLEQKNEILAFLWQANRRLHSSAPLCERISPVLNGLQGLTLLRDIEVRVYDLEDEDNHQEFTCHSDDDCDDKGCYLCPRNLPPLPDGGTTLKWRLSDAHSQYGILLATLPVGRHLSHDQQQLVDTLVEQLTSTLALDRHQEKQQQLIVMEERATIARELHDSIAQSLSCMKMQVSCLQMQGDALPTESRQLLGQIRNELNTSWAQLRELLTTFRLQLTEPGLRPALEASCQEYSAHFGFTVQLDYQLPPRFVPSHQAIHLLQIAREALSNALKHASATEVTVTVSQRDNQVRLVVADNGRGVPDHAERSNHYGLIIMRDRAQSLRGDCQVRRRETGGTEVIVTFIPEKTFSIQ

SEQ ID NO: 10379 - protein, 340 aa, Klebsiella pneumoniae
TGGGSAMNAVTEQRKVLLEIADLKVHFDIKDGKQWFWQPSKTLKAVDGVTLRLYEGETLGVVGESGCGKSTFARAIIGLVKATDGKVAWLGKDLLGMKQEEWRDVRSDIQMIFQDPLASLNPRMTIGEIIAEPLRTYHPKMPRQEVRDRVKAMMMKVGLLPNLINRYPHEFSGGQCQRIGIARALILEPKLIICDEPVSALDVSIQAQVVNLLQQLQREMGLSLIFIAHDLAVVKHISDRVLVMYLGHAVELGTYDEVYHNPLHPYTKALMSAVPIPDPDLEKTKTIQLLEGELPSPINPPSGCVFRTRCPLAGPECAKTRPVLEGSFRHAVSCLKVDPL

SEQ ID NO: 10380 - protein, 287 aa, Klebsiella pneumoniae
GELMKQKVVSIGDINVANDLPFVLFGGMNVLESRDLAMRICEHYVTVTQKLGIPYVFKASFDKANRSSIHSYRGPGLEEGMKIFQELKQTFGVKIITDVHEASQAQPVADVVDVIQLPAFLARQTDLVEAMAKTGAVINVKKPQFVSPGQMGNIVDKFIEGGNDKVILCDRGANFGYDNLVVDMLGFGVMKKASNNSPVIFDVTHALQCRDPFGAASGGRRAQVSELARAGMAVGIAGLFIEAHPDPDHAKCDGPSALPLDKLEPFLKQMKAIDDLVKSFDELDTSK

SEQ ID NO: 10381 - protein, 77 aa, Klebsiella pneumoniae
RRVILPPPPFILLNSLQCDFTPGGVPERPKGADCKSAVIDFEGSNPSPTTIFLKNTSIQLFYDILYSAPWGRMRSFD

SEQ ID NO: 10382 - protein, 373 aa, Klebsiella pneumoniae
NFSMINPHQPRDIPQILLSVLFLALIIISCLWVVQPFILSFAWAGTVVIATWPVLLRLQRVLFGKRLLAVLAMTLLLFLLFVIPIALLVNSLVDNSVPLIKLISSGNVTLPDFAWLNSVPLVGDKLYSAWHGLLDMGGSAIMAKVRPYIGTTTSWFVGQAAHIGKLLVYCGLMLLFSALLYWRGEQVAYGFRYFATRLAAKRGDAAVLLAGQAVRAVALGVVVTALTQAVLGGIGLAVSGVPYAALLTVVMIFTCLVQLGPLLVLVPSIIWLYWSGDTTWGTVLLVWSCVVGTMDNVIRPVLIRMGADLPMILILTGVIGGLIAFGMIGLFIGPVLLAVSWRLYDAWVHEVPPPPKDPDVVLEELSELEAGRK

SEQ ID NO: 10383 - protein, 307 aa, Klebsiella pneumoniae
GHTMKHCKIILLVGLLASSASALAEKIGVSMAYFDQNFLTIIRQSIEKEAQARHVDVQFEDARGDTGRQADQVQSFIASGVDAIIVDPVDSASTPQLTKMAQQAKMPLVYVNRTPGDKTLPPGVVFVGSDERESGTLQMEALAKLANYKGNVAIMIGNLTDAGALQRTKDVEQVVAKYPAMKVVQKQPANYSRSEGMDLMQNWTGNGEAIDIVAANNDEMAIGAAMALEKSQKKLLIGGIDATPDGLKALASDKIQVTVFQDAVGQGKTALAVALKLIKGEKVESHVWIPFELVTKENMQTYVEKSH

SEQ ID NO: 10384 - protein, 350 aa, Klebsiella pneumoniae
RATIELSSARGDIMTQPLAGKQILIVEDEPVFRSLLHGWLTSLGATTFQAEDGKDALHKMTEVHPDLMICDISMPRMNGLELVETLRNRGEQLPILMISATENMADIAKALRLGVQDVLLKPVKDFDRLRETVYACLYPAMFSSRVEEEERLFEDWDALVSNPIAASRLLQELQPPVQQEMSHCRIHYRQLVSADKPGLVLDIAPLSENDLAFYCLDVTRAGDNGVLAALLLRALFNGLLQEQLAHQGQRLPEMGSLLKQVNQLLRQANLPGQFPLLVGYYHSGLKNLILVSAGLNGTLNTGEHQIQISNGVPLGTLGDAYLNQISQRCTSWQCQIWGAGGRLRLMLSAE

SEQ ID NO: 10385 - protein, 96 aa, Klebsiella pneumoniae
LVAIAPRPSGRCLRQRSLASLESNLGRSFSSFPVGQNIEYRRVIGLRCFLRRWWWGKDNSSLSLLALRAVACGNVLSLRSSRTLVEASHPSPWGRI

SEQ ID NO: 10386 - protein, 186 aa, Klebsiella pneumoniae
GQAMQHDILNTEVTTIDGEKTTLASFAGKVLLIVNVASKCGLTPQYEQLEDLQKQFAAEGFSVLGFPCNQFLGQEPGSEEEIKTFCSTTYGVTFPLFSKIDVNGEHRAPLYQKLIAAAPKAVAPEGSGFYERMASKGRAPLYVDDILWNFEKFLIDRQGNVIQRFSPDMTPDDPQLVAAIKGALAQ

SEQ ID NO: 10387 - protein, 358 aa, Klebsiella pneumoniae
LNLFASFTVALFEVPFAFVAPAESEGTVRYGHVALLVKGDGFPFRIILLTKGIHEVGCAQRTAGGIITVALLEHHQHRHVGIAAHIVGEILARLIEVEFTQHHMAHRQRHRGISTLLRRQPQIAEFGDFGVVRSDGYGFGPFIADFGKEVRIRGAGLRHVGAPGDDIAGVIPVGGFRHIGLLAPGHRRSRRQVAVPVVEAQAGAADQRQITGAGRVGDHRHRRDRREASHAVRTVGFDGINVGGGNQLIHFLPGGTYKTAATAGLFEAFGFVGVFDNRRPCLNRIAMLNFRFPPHLHQAFTHQRVFQAVSAVQVPGVAGAARAAAWFVVRQVRAGARVVSLLRFPGHQTVFDINLPAA

SEQ ID NO: 10388 - protein, 302 aa, Klebsiella pneumoniae
PYDMVENMGRDSMWQAISTLLRDWHTEDAEIELKTELPGGEIHSAWHLRFGGKDYFVKCDERELLPIFTAESDQLELLSRSKTVRVPQVFAVGSDRDYSFVVMEYLPPRPLDAHNAFLLGQQLAHLHQWSDQPQFGLDFDNDLSTTPQPNAWQRRWSVFFAEQRIGWQLELAAEKGLHFGDIDTLVDMVQQRLANHQPQPSLLHGDLWSGNCALGPDGPYIFDPACYWGDRECDLAMLPMHPEQPPQIYDGYQSVSPLPSGFLDRQPIYQLYTLLNRAILFGGQHLVTAQQALDDVLMEKMR

SEQ ID NO: 10389 - protein, 254 aa, Klebsiella pneumoniae
VMSICAENITWKAGKKVIVNNVSLRVPRGETVGLLGPNGCGKSSLLRVLAGLRRPDAGRVTLDGQDIARMAKKQLARRVAFVEQHGMTEANMRVRDVVRLGRIPHHSPFSNWSAQDDEAIAAALQRVAMLEKSEQGWLSLSGGERQRVHIARALAQSPSEILLDEPTNHLDIHHQMQLMQLISELPVTSIVAIHDLNHAAMFCDSLIVMQQGQILASGTPEEILSEALLWDVFRVKTKIEISPYHGKKHIHFIV

SEQ ID NO: 10390 - protein, 112 aa, Klebsiella pneumoniae
VAIMDMDLNNRLTEDETLEQAYDIFLELAADNLDPADIILFNLQFEERGGAELFDPSADWEEHVDYDLNPDFFAEVVIGLADTDGGEINDIFARVLLCREKDHKLCHILWRE

SEQ ID NO: 10391 - protein, 76 aa, Klebsiella pneumoniae
PYSMVRPAYITSTLSQIPATTPRSWVIMIMAVLNSRLSSFNSVMICACTVTSRAVVGSSAISSRGRHSSAMAIITR

SEQ ID NO: 10392 - protein, 166 aa, Klebsiella pneumoniae
IPYIPPYCTTHFIALLLVQQTTPQYKFEITTMSEALKILNNIRTLRAQARECTLETLEEMLEKLEVVVNERREEENAAAAEIEERTRKLQQYREMLIADGIDPNELLSTMAAVKAGTKTKRAARPAKYSYVDENGETKTWTGQGRTPAVIKKAMDEQGKSLDDFLI

SEQ ID NO: 10393 - protein, 265 aa, Klebsiella pneumoniae
GANMKPLIQVQAVSQRFNTASGEFLALQNVSFDIVEGETISLIGHSGCGKSTLLNLIAGITTPTEGGLLCDNREIAGPGPERAVVFQNHSLLPWLSCFDNVALAVDQVFRRTMSKSERREWIEHNLARVQMGHALHKRPGEISGGMKQRVGIARALAMKPKVLLLDEPFGALDALTRAHLQDTVMHIQQELNTTIVMITHDVDEAVLLSDRVLMMTNGPAATVGEILAVDLPRPRHRVQLADDSRYHHLRQQILHFLYEKQPKAA

SEQ ID NO: 10394 - protein, 82 aa, Klebsiella pneumoniae
RVLIMNRTKLVLGAVILGSTLLAGCSSNAKIDQLSSDVQTLNAKVDQLSNDVNAMRSDVQAAKDDAARANQRLDNQAHSYRK

SEQ ID NO: 10395 - protein, 255 aa, Klebsiella pneumoniae
RVIMKLLKTVPAAVMLAGGLFASVGAMADDSVFTVMDDPSAAKKPFEGVVNAGYLAQSGNTKSSSMTADSTLTWYGNTTAWSLWGNASNTSSNDERSSEKYAVGGRSRYNLTDMNYVFGQGSWLTDRYNGYQQRDVVTAGYGRQILNGPVHSLRFEFGPGVRYDEYTDGDTDTQPLGYASGTWAWQMTDNAKFSQGVSVFGAEDTTVNSESALNVAINAHFALKVAYNVTWNSEPPASAPEHTDRRTSLSLGYKM

SEQ ID NO: 10396 - protein, 1281 aa, Klebsiella pneumoniae
SLSILALFHSVTFAANPAMSIYQRAVRLHIRRNPMSKFLDRFRYFKQKGETFADGHGQLLNTNRDWEDGYRQRWQHDKIVRSTHGVNCTGSCSWKIYVKNGLVTWETQQTDYPRTRPDLPNHEPRGCPRGASYSWYLYSANRLKYPLMRKRLMKMWREAKVQHSDPVEAWASIIEDADKAKSFKQARGRGGFVRSSWQEVNELIAASNVYTVKTYGPDRVAGFSPIPAMSMVSYASGARYLSLIGGTCLSFYDWYCDLPPASPMTWGEQTDVPESADWYNSSYIIAWGSNVPQTRTPDAHFFTEVRYKGTKTVAITPDYAEIAKLCDLWLAPKQGTDAAMALAMGHVMLREFHLDKPSQYFTDYVRRYTDMPMLVMLEERDGYYAAGRTLRASDLVDSLGQENNPEWKTVAFDEKGDMTVPNGSLGFRWGDKGKWNLEQRDGKTGEEIELRLSLLGSHDEVANVGFPYFGGEGSEHFNKVDLENILLHKLPAKRLQLADGSTALVTTVYDLTMANYGLERGLNDDNCAAGYDEVKAYTPAWAEKITGVSRAHIIRTAREFADNADKTHGRSMIIVGAGLNHWFHLDMNYRGLINMLIFCGCVGQSGGGWAHYVGQEKLRPQTGWQPLAFALDWQRPARHMNSTSYFYNHSSQWRYETVTAQELLSPMADKSRYSGHLIDFNVRAERMGWLPSAPQLGVNPLRIADEAKKAGMTPVDYTVKSLKEGSIRFAAEQPENGKNHPRNLFIWRSNLLGSSGKGHEYMLKYLLGTENGIQGKDLGKQGGVKPEEVEWRDNGLDGKLDLVVTLDFRLSSTCLYSDIVLPTATWYEKDDMNTSDMHPFIHPLSAAVDPAWESKSDWEIYKGIAKKFSEVCVGHLGKETDVVTLPIQHDSAAEMAQPLDVKDWKKGECDLIPGKTAPHIIPVERDYPATYERFTSIGPLLETIGNGGKGIAWNTQSEMDLLRKLNYTKAEGPAKGQPKLETAIDAAEMILTLAPETNGQVAVKAWQALSEITGREHTHLALNKEDEKIRFRDIQAQPRKIISSPTWSGLEDEHVSYNAGYTNVHELIPWRTLSGRQSLYQDHQWMRDFGESLLVYRPPIDTRSVKAVMGEKSNGNPEKALNFLTPHQKWGIHSTYSDNLLMLTLSRGGPIVWMSEADAKDLGIEDNDWIEVFNANGALTARAVVSQRVPAGMTMMYHAQERIVNLPGSEITGQRGGIHNSVTRITPKPTHMIGGYGHLAYGFNYYGTVGSNRDEFVVVRKMKNINWLDGEGNDQVQESVK

SEQ ID NO: 10397 - protein, 645 aa, Klebsiella pneumoniae
GHKMPVITLPDGSQRHFDHAVSPMDVALDIGPGLAKATIAGRVNGELVDACDPIESDSTLSIITAKDEEGLEIIRHSCAHLLGHAIKQLWPNTKMAIGPVVDNGFYYDVDLDHTLTQEDIDALEKRMHELAEKNYDVIKKKVSWHEARETFVKRGESYKVSILDENIAHDDKPGLYHHEEYIDMCRGPHVPNMRFCHHFKLMKTAGAYWRGDSNNKMLQRIYGTAWADKKALNAYLQRLEEAAKRDHRKIGKQLDLYHMQEEAPGMVFWHNDGWTIFRELETFVRSKLKEYQYQEVKGPFMMDRVLWEKTGHWDNYKDAMFTTSSENREYCIKPMNCPGHVQIFNQGLKSYRDLPLRMAEFGSCHRNEPSGALHGLMRVRGFTQDDAHIFCTEDQVRDEVNACIRMVYDMYSTFGFEKIVVKLSTRPEKRIGSDETWDRAEADLAVALEENNIPFEYQLGEGAFYGPKIEFTLYDCLDRAWQCGTVQLDFSLPQRLSASYVGENNERQVPVMIHRAILGSLERFIGILTEEFAGFFPTWIAPVQVVVMNITDSQAEYVNELTRKLQNAGIRVKADLRNEKIGFKIREHTLRRVPYMLVCGDKEVEAGKVAVRTRRGKDLGSMDVNEVIEKLQQEIRSRSLQQLEE

SEQ ID NO: 10398 - protein, 214 aa, Klebsiella pneumoniae
NTLIGVTQPMAQLYFYYSAMNAGKSTALLQSSYNYQERGMRTVVYTAEIDDRFGAGKVSSRIGLSSPARLYNPQTSLFDDIAAEHQLKPIHCVLVDESQFLTREQVHELSEVVDTLDIPVLCYGLRTDFRGELFTGSQYLLAWSDKLVELKTICFCGRKASMVLRLDQEGRPYNEGEQVVIGGNERYVSVCRKHYKEALSVGSLTKVQNQHRPC

SEQ ID NO: 10399 - protein, 132 aa, Klebsiella pneumoniae
TRLIARGPLGAVTVGLAAAVEVLGAVRAGAVLLFSNGEAGRGSAAGFTSRFGCSTFFSGLGLGLGLGFGLGSGLWITTGASFGGSGTTSGSGSGSGSTTGSTTGCAAGGGSRSAGATIVISIGCVGEGCSIT

SEQ ID NO: 10400 - protein, 97 aa, Klebsiella pneumoniae
RYVMSLRISIFLANKNAAKAVVSCWQRFIMGAVFTRRVVAMKRSRTEVGRWRMLRQVNRRKARWLEAQSRRNMRILAIRKGLVKRQRHALLFIFPDS

SEQ ID NO: 10401 - protein, 168 aa, Klebsiella pneumoniae
IIAIKRLGTEGSSEMRFWFMLAAALILAGCSSHRAPPPNPRLADSITVVANLNEQLRSWRGAPYRYGGMTPRGVDCSGFVVRTFRDKFALQLPRETREQAEIGTRIDKRDLLPGDLVFFKTGSGESGLHVGIYDTDNQFIHASTSQGVTRSSLDNVYWNKKFWQARRI

SEQ ID NO: 10402 - protein, 439 aa, Klebsiella pneumoniae
SRAISLWSNSWRSRAMAGLPNSSNALQQWHHLFEAQGGPRTPEASQHLQQLLRLGLPTRKHEDWKYTPLDALLNGRFVADEGASLSAEQRDALALPLDAWRLVFIDGRYHPQLSDDLAASGVEVSVDNQRQHLPDALQPEVFLHLTESLAQTVTRIRVPRNRRLDKPLLLMHITSGLAGDALNTAHYRHHLALESGAEATIVEHYLSLNEQPHFTGGRLTMTVADNAHLQHIKLAFENARSYHFAHNDLLLGRDASAFSSSFLLGGQVLRHQTSTRLGGENSNLRLNSLAMPVKNEVCDSRTWLDHQVGYCTSRQLHKTIVSDKGRAVFNGLINVAPLALKTDGQMTNNNLLLGRLAEVDTKPQLEIYADDVKCSHGATVGRIDEEQLFYLRSRGIEQQAAQQMILYAFAAELTEAIRSDALREQVLARIGQRLPGGTV

SEQ ID NO: 10403 - protein, 251 aa, Klebsiella pneumoniae
GKKMLSIQDLHVAVEDKAILRGLNLEVRPGEVHAIMGPNGSGKSTLSATLAGREDYEVTGGRVEFKGKNLLELAAEDRAGEGIFMAFQYPVEIPGVSNQFFLQTALNAVRNYRGQEALDRFDFQDLMEEKIKLLQMPEDLLTRSVNVGFSGGEKKRNDILQMAVLEPELCILDESDSGLDIDALKIVSQGVNALRDGKRAFIIVTHYQRILDYIKPDYVHVLYQGRIVKSGDFSLVKQLEEQGYGWLTEQQ

SEQ ID NO: 10404 - protein, 207 aa, Klebsiella pneumoniae
AKRMTKNTPTPASRGPHDHSVRDQILDAAMAHFSRYGYEKTTVTDLAKAIGFSKAYIYKFFDSKQAIGEAICASRLEKIMVAVSEAIADAPSASEKLRRLFRALTEAGSELFFEDRKLYDIAAVAARDKWPSTEQYAGHLQQLIGQILVEGRQAGEFERKTPLDEATLAVYMVMCPFINPVQLQYNLDTAPTAAVLLASLILRSLSP

SEQ ID NO: 10405 - protein, 562 aa, Klebsiella pneumoniae
NIIVNRLFSSHVMPFRALIDACWKEKYTTARFTRDLIAGITVGIIAIPLAMALAIGSGVPPQYGLYTSAVAGIVIALTGGSRFSVSGPTAAFVVILYPVSQQFGLAGLLVATLMSGIFLILFGLARFGRLIEYIPLSVTLGFTSGIGITIGTMQIKDFLGLQMPHVPEHYLQKVAALAMALPTINVGDAAIGVVTLGILILWPRLGIRLPGHLPALLGGCAVMLVVNLLGGDVATIGSQFHYQLADGTQGNGIPQLLPQLVLPWDMPGSNFTLSWASLQALLPAAFSMAMLGAIESLLCAVVLDGMTGTKHKANSELIGQGLGNIVAPFFGGITATAAIARSAANVRAGATSPVAAVIHALLVILALLILAPLLSWLPLSAMAALLLMVAWNMSEAHKVINLLRHAPKDDIVVMLMCMSLTVLFDMVIAISVGIVLASLLFMRRIARMTHLAPVNVEVPDDVLVLRVIGPLFFAAAEGLFNDLETRIAGKRIVVLKWDAVPVLDAGGLDAFQRFVNKLPEGCELRVSNLEFQPLRTLARAGVKPLPGRLSFYPDRQAALADL

SEQ ID NO: 10406 - protein, 83 aa, Klebsiella pneumoniae
RRSVQPSAARRHASRSGGSETPDARPYPAPGAPSSASPDASPADCPSGSRSPSASAPPPLARATPAPAVHPVPQTAARLTPVD

SEQ ID NO: 10407 - protein, 817 aa, Klebsiella pneumoniae
PVNVLHLTYHHKLIAVGTDGAVVVKAIGQVAVAADHVGRFRRNTGDGVMDPPALTGDFRARQVHDTFLRVIHHGHPGWNALTHHRTRRQGAVGVEDFDPVVIFDTQIFRIRFAHPDNRPTARQGQHQQVIAVGRVDTPFLVRGQEVQRLLRVAVGLLAHHRFHRTGVNRRPIDQQAFAKVAHPLMILIQRLTAGQRAPRDQLVNVGVTGVIGDMLIFQARPGRAGDNLPRLRLNIAEADLLVFFVQREVRMLATGDLAQRLPRFHRHLPVGFRGQGEDHFRGVDGRFQLRLAFRRAFRLGVVELTQQIHLALGVPGDAFPAVADGFQQRADRGETLVGRRVITLNRNNMRRGFPGDEIAFAFFPVFDIQRLRHFRGGVVLDRQGHHVGFFTEVAHAHFREFLRDTFIDLPVALRFPGWINGGRQRVNKRMHIRGIHVVFFVPGGGRQHDVGVETGARQTEIEGHHQIQFAVEAVIPPFDFFRLHAALLAQVFALNAVLGTQQVLEHVFMAFTGGAQQVGTPDKQVTRVVFAIFRLLGRKANRALFQRLHGVIHRGHAGFFRFVRDTQRVDAKLRRRRQPAHPLCAHVKVDQVAAVTGFIRHRRQQFLRGHRFIAPLAGVVIEVRGTIHVTCRTLPVKGERQRLPAGLRTQFFLAHIVRPTAAALTNAAAEDQHIDQAAVVHVEVEPVVEARPDDNHRTTVSFIGVIGKFTGGTDDMRAGDAGDLLRPRRGVGFHFIVAGGAVVIVQTALQAVVSHGQVIHGGDQGGRAVGQLQAFGRQFVQQNVFQIDFVKVLRPFAAEVREADVRHFIMAAQQAQT

SEQ ID NO: 10408 - protein, 99 aa, Klebsiella pneumoniae
QRGVEMSNEITAWVVSVTFHEQALTEINEVSNHFTRAGFVLTLNDEEGTPHELGTNTFGLLSGQTAEEVKALSAGLAEAALGRPAEIAVATFAEWLKAQ

SEQ ID NO: 10409 - protein, 76 aa, Klebsiella pneumoniae
QCEVEVIKMPKIKTVRGAAKRFKKTGKGGFKHKHANLRHILTKKATKRKRHLRPKAMVSKGDLGLVYRVPAVRISR

SEQ ID NO: 10410 - protein, 272 aa, Klebsiella pneumoniae
FKRVLVMKKLFSLALIATSVALLSACSPDEDNKVKVAINTGPDEAIWKVVEQVAKDKYHLDVEVVSFNDYVLPNEALNNKDVDANAFQTLPYLEAQSKERGYKFAVVGKTFVFPIAAYSHRIKNISELPEGATVTISNETTTLGRSLLLLQAQGLLKLKPGVGYLPTTLDIIDNPKQLKIVEVDTPQLTRTLDDPNVSLSIINTNFSAQAGLSAARDGLFMEGPDSPYVNAIVAREDNKDSKKIQELKAAFQTSEVAEKAKEVYKGDAIKGW

SEQ ID NO: 10411 - protein, 60 aa, Klebsiella pneumoniae
PAILRPLAGHQRMHIKGVAHGFSGGRSAGRNIRTSLNVSGFGDTYLGMILMTRWRNGRGG

SEQ ID NO: 10412 - protein, 216 aa, Klebsiella pneumoniae
QMFSISPVFFWANIYVPADFEDYCVNTLKKTALLSVLALYIPVSQAAAKEYSLDPQHTSVVISWNHFGFSNPTAYISDVSGKLAFDKENPEKSSVNVTLPVKTIDAHVKALTDEFLGKEYFDVKTFPDATFQSTKVESKGDNKYDVEGNLTIKGITKPVVLHAVLNKQDMHPMVKKEAIGFDATGVIKRSDFKLDKYVPAVSDNVTITLSTEAYAK

SEQ ID NO: 10413 - protein, 61 aa, Klebsiella pneumoniae
EDELNFQGHYLYAPLRYWRGNHCLFVLIDRLPMGYKQGCRLFYIKPCNQKCANTDEGYLPM

SEQ ID NO: 10414 - protein, 475 aa, Klebsiella pneumoniae
TNTSIHFCELAQTLLMPVSFRLLPTLTFLLLLPGVPVWALTASDTTRPAQAQDPLPDMGIAPQVDDDARHFAEVAKKFGEASMSDNGLTAGEQAQLFAISKIGNEVSHQLESWLSPWGNANVDLLVNKEGKFTGSKGSWFVPLQDNDRYLTWNQYSVTRREHDLVGNIGLGQRWRVGGWLLGYNSFYDKVLSESLARGSVGAEAWGEYLRLSANYYHPLGDWQLRDNQTQEQRMAAGYDVTAQARLPFYQHINTSVSVEQYFGDSVDLFHSGTGYHNPVAVSVGLNYTPVPLVTVTAKHKQGENGVSQNNVGLKLNYRFGVPLKQQLAADEVAISNSLRGSRFDSPERDNLPVVEYRQRKNLTVYLATPPWDLQSGETVQLKLQIHSLHGIKALHWQGDTQALSLTPPVDASSPDGWSIIMPVWNSEPGAANRWRLSVVVEDKQGQRVSSNEIALALTEPLVKFTTPGVSWTDSP

SEQ ID NO: 10415 - protein, 143 aa, Klebsiella pneumoniae
PPHSRGKKKIQRIRAAWDCSACRHPLLFWDLLIEESRMKKALLALFAIATVTAASAFAADKTDVPAPVIDNGVRPPMERDRGPLPPFPPQLPPHRPVLFSATVATDTPAETINKLTALIPAGQAKHYEVHVEVVPVGEGTDRQ

SEQ ID NO: 10416 - protein, 205 aa, Klebsiella pneumoniae
QGQSHNERGDIHMQSEAITGVVLAGGRATRMGGIDKGLQALNGRPLWRHVAEALAPQVDELVISANRHLEQWRASGFPVFRDIQEGYQGPLAGMLAVMQQVASPWFVFCPCDTPFIPSFLVERFIQQRGDAPVVWAHDGERDHPAVALVHRQIIPELEAYLAHGERRVMVFMRQMGGRPVNFSDVKTAFINVNTLEDLQQMQEPS

SEQ ID NO: 10417 - protein, 182 aa, Klebsiella pneumoniae
CKYARRFAADAGAIMIPLLAIAAWSGTGKTTLLKRLIPELCALGLRPGLIKHTHHDMDVDKPGKDSYELRKAGAAQTIVASEQRWALMTETPEKPELDLTWLVSRMDASKLDLVLVEGFKHEPVPKILLFRQNSGHRVEELVIDEHTIAVASDVSIATSLPLLDLNDVPQIATFIVSWLERQ

SEQ ID NO: 10418 - protein, 320 aa, Klebsiella pneumoniae
NQPLAQLKGALCQPNFLNKLTMSRLLAAITLPLSIALTILVTIICSVPIIVAGLIKLLVPIPAVWRSISVFCNFMMYCWCERLALLLHLNPWLKWDVQGLEGLNKKNWYLLISNHHSWADIVVLCVLFRKHIPMNKYFLKQQLAWVPFIGLACWALDMPFMRRYSRSYLIRHPERRGKDVETTRRSCEKFRAHPTTIVNFVEGSRFTEEKKRETRSPYHNLLPPKAAGIAMALNVLGSQFDKLLNVTLCYPDNHTRPFYDMLSGRLTRIVVRINLVPIGEELHGDYVNDKNFKRSFQRWLNGLWEEKDRQLTDIMRDKER

SEQ ID NO: 10419 - protein, 162 aa, Klebsiella pneumoniae
LTHLPAGLMLPQRVAREGDHLAPVILYQCRPSAWPCRPPARRRLSPRFAYEYRLFHCGIDPVNLSLSRVRSMTMKCKRLNEVIELLQPAWQKEPELNLMQFLQKLAKEAGYDGELSDLSDDILIYHLKMRDSSKDAVIPGIQKDYEEDFKTALLRARGVIKE

SEQ ID NO: 10420 - protein, 128 aa, Klebsiella pneumoniae
VDKQWSVAPEDITGMAVTVQAQRVPAAVPLLHDGSNEFIGRLQEIGLQARGDQRRLLKHLTRFQQVLLHANFRAGSKALFAARLVQAPQIAANPFHLIKVIRFELTTAKAWENGKVESLMLMKRAVIK

SEQ ID NO: 10421 - protein, 66 aa, Klebsiella pneumoniae
KGPKVGNFPVELVSALPEWRNYCPACLHPKPQEFEPPGKMQVYPRQADKTPVTLYYSLTLTFGPDV

SEQ ID NO: 10422 - protein, 105 aa, Klebsiella pneumoniae
RLLLSLSGVSCVSAAELTAQGSPPGLMTGVLNMLRSLILQYQPTHAVVVFDAKGKTFRDELFEHYKSHRPPMPDDLRAQIEPLHKMVKAMGLPLMAVPGVEADDV

SEQ ID NO: 10423 - protein, 208 aa, Klebsiella pneumoniae
IMKKVWLALAGMILAFSASAAQITDGKQYITLDKPIAGEPQVLEFFSFYCPHCYQFEEVLHVSDNVRQKLPEGTKMTKYHVEFLGPLGKDLTQAWAVAIALGVEDKITAPMFEAVQKNQTVQSVADIRKVFVDAGVKGEDYDAAWNSFVVKSLVAQQEKAAADLQLQGVPAMYVNGKYQLNPQGMDTSNMDVFVAQYADTVKQLVEKK

SEQ ID NO: 10424 - protein, 340 aa, Klebsiella pneumoniae
YPELFVRLSDVRMHDKAFTFQTLRPDTIIDGLFDLGMRVDSGLTPLNSYENRVYQFQDEERHRYVVKFYRPERWSAEQILEEHQFALQLVEDEVPVAAPLLFNDSTLHQHQGFYFAVFPSLGGRQFEADNLDQMEWVGRYLGRLHQTGCKQRFTARPEIGVQEYLLEPRQVFEQATLIPSGLKADFLKATDKLIAAVMEQWHGRGNTLRLHGDCHAGNILWRDGPLFVDLDDARTGPAIQDLWMLLNGDKAEQRMQLETIVEAYEEFSPFNSDEIALIEPLRAMRLVYYLAWLLRRWDDPAFPVNFPWLTGEDYWRGQTSTFLEQVKVLQEPPLQLTPMY

SEQ ID NO: 10425 - protein, 86 aa, Klebsiella pneumoniae
CNGRMIPFAVMGPNDRCVPSLLDKALHQKGRNERRVAGAKNKPWARDLLHHSKHSGQRPLITLLYVSKDRKSAGTPLFKMTIGAND

SEQ ID NO: 10426 - protein, 194 aa, Klebsiella pneumoniae
RPFFRRSNFTALIVLYNNAWHFRHHPTTVIAPRFTRCRKTMANKQPVPLPAQVTDGDWVVVRGGGEHNLKNVNVAIPRNALAVFSSVSGSGKSSLAFGTIYAEAQRPYFESVAPYARGLSIMPACSTLTAAGGCASAAERCQQRVLVGGQRDHAFKPGTDDVLAGGPLSVGQPLLNAEDFSANTPQVTCPSSTA

SEQ ID NO: 10427 - protein, 151 aa, Klebsiella pneumoniae
PGASFCTKNNRIMERVKDDRGGTVMTVDRLYRHLLQKLINANIDIDAYLQLRKAKGYMSVSENDHLRDNLFELCREMRAQAPRLQNAISPEERDVLRLAGESVAAAALCLMSGHHDCPLYIAVNVEKLERCLTGLTSNIHKLNKLAPITHA

SEQ ID NO: 10428 - protein, 414 aa, Klebsiella pneumoniae
NMTSGKRNYLLLSLFDFLYLFAWSSTMAFFVIWTTQHLGISATKTGLLYSVNAFIALLMQPFFGFISDKFGLKKRLIWLLVALLLPVGPFFIYVYAPLLVHNFWFGALLGGIYLGIIFNSGCGVIDSYIDKISRRYQFEYGRVRMWGSLGWAAAAWIVGKYIDSNPNLAFWLASLAIVIATICFMLTKIELTDADVARSESLKVSHALELAKNGQFWMLLLFTLFVTQIYDTYDQQFAQYFSLQFPTPEEGNRWYGILASIQVCGETLFLCLMPWFVNRTGAKWALIIAGLIMSVRIVGSAVPLGPVWIGAVKMMHALEKPLILVSVFKFIAANFDHKLSSTVYLLVLFVASIATAIYSPLAGYLYDTIGFANTYLILGSVAGLFTLISIFTLQDKREPKKTGATPSAAINPAQ

SEQ ID NO: 10429 - protein, 63 aa, Klebsiella pneumoniae
SLRSFFHLTKRHIAMRKTRYTEEQIAFALKQAETGTRVEEVCRKMGISEATFYMYGLPPFCKY

SEQ ID NO: 10430 - protein, 263 aa, Klebsiella pneumoniae
KHFPGPVTQECPWLKGVSIKTFNNSQIKKLAGFLTLSQHDRRSRCNSSETNSGAKMITLWGRNNSTNVKKVRWVLEELDLPYQQILAGLEFGLNHDPEYLAMNPNGLVPLLKDDATGVVLWESNTIIRYLAAQYGVDRLWLAAPAQRAQGEKWMDWSNGTLSPAHRPVLMGLVRTPPEQRDPAAIAAGISACEALFAMLDDELAKMPWLSGEQFGLGDIAVAPFVYNLLSILDSWQPRPHLQRWYQQISQRPAWREVVQIPVT

SEQ ID NO: 10431 - protein, 117 aa, Klebsiella pneumoniae
SGNPLLSPAARSPPPPHCRPPGSGYRTLSLRQCIPAPEYERSVRERRRSRSPPPGGSPPAPRRSPGCLPPASPPAARRPPWRSDRWCHPGSERCRSMADRCPGAPAAAASAAYRERG

SEQ ID NO: 10432 - protein, 474 aa, Klebsiella pneumoniae
VSDPSGTFAQVAILRCVTAWMPCAAMVSSVACRMRSRRCGSFGLRAMIFLFRFMYKCTHTCYCCLHSSPLRRLRMTTQFSRRALQLRLWALFMFFFIPGLLMASWATRTPAIRDLLALSTAEMGVVLFGLSVGSMSGILCSAWLVKRFGTRKVIRTTMSFAVLGMLVLSLALWVTSAPLFAFGLAIFGASFGSAEVAINVEGAAIEREMNKTVLPMMHGFYSFGTLFGAGVGMAVTGFGLPAAPHILAAALVAILPIAIAIRAIPDGTGKNAAEVAHGEAKGLPVWRDAQLLLIGVIVLAMAFAEGSANDWLPLLMVDGHGFSPTSGSLIYAGFTLGMTLGRFTGGWFIDRYSRVAVVRGSAVMGALGIGLIIFVDNPWVAGISVLLWGIGASLGFPLTISAASDTGPDAPKRVSVVAITGYLAFLVGPPLLGFLGEHFGLRSAMMVVLGLVMVAALVARAVAKPQSEPVMENS

SEQ ID NO: 10433 - protein, 162 aa, Klebsiella pneumoniae
RSSPGPAWHFITMYGLYPVFPHDFGDPVSAAHFTNFTKIAVNSAITINPTTQRIGVADERQQSLVILFSGRYRVMEPDIKSGTGNLENPTHCNDRPDFTVIVDKAVLQSGSLAKYRAAFFRISRSSSVRLSCAFSLRISVLASSKSCACCPLLSGLTARSHL

SEQ ID NO: 10434 - protein, 67 aa, Klebsiella pneumoniae
RTCPCCFRISRAQLHAMFSRSKYWQDRRRRRMSDDTEALARIHTVIGALPTYGYRRVWALLRKQSET

SEQ ID NO: 10435 - protein, 108 aa, Klebsiella pneumoniae
AAPLSVSHSTGDAGRLLPKRRSTATSITSCTVSLSYPPVLAALYSASRSQQSRANVTCSFSPLSQLNPKPSEHHRWLLFPCMRPLRWRYCRFTLKQQRILMHDEVFWH

SEQ ID NO: 10436 - protein, 211 aa, Klebsiella pneumoniae
LIRPQEFFKMITLENEAQPRSIQTQESIFIEEKAFRSRMVLVFGNITDTIASETVRRLLTLDAESSAPITMIISSPGGHLESGDVIHDVSRFVSSPVNMVGTGWVGSAATHLYLGAPRERRFCLPQTRFLIHQPSGGTGGAASDIALQAAEIIKARERIARVIARESGQPLERVLEDIEHDLWMSASEAVEYGLVSRIITRREELLHIDDR

SEQ ID NO: 10437 - protein, 279 aa, Klebsiella pneumoniae
VLRPAQKRQAVHFLRQAYRISVRRGCGLLMQSRTVYHWQSRRDDRAITLRIREIAETRIRYGCPRIHIQLRREGWPVNHKKTHRIYCLENLNMRRKRPRRHVSAAHRQQRPVLTGVDQCWSMDFVSDNLFNGRRFRALTVVDNFSRECVAIHAGKSLKGEDMVGVMERLRVLGKRLPVRIQTDNGSEFISKSLDKWAYEHGVTMDFSRPGKPTDNPFIESFNGSLRDECLNIHWFLSLEDAQDKLDNWRREYNHERTHSSLNDMTPAEFIRSLRKDEDL

SEQ ID NO: 10438 - protein, 109 aa, Klebsiella pneumoniae
SWVTITQVTPTRSRISTTSSCMRSRSFLSSAPIGSSSSSSLGRFARLRANATRCRWPPESWCGLRLANSCICTRASISCTRAVISALGRRSCFRPKAIFCSTVIWGNRA

SEQ ID NO: 10439 - protein, 442 aa, Klebsiella pneumoniae
TLKTLPTRCFFQVICTLYSPVAAARSEWRGIFLFGKDTWVALMMHDAFSLRGLAAGCALLFLVAPAVQAAEQLPDAPSIDARAWILMDYASGKVLSEGNADEKLDPASLTKIMTSYVVGQAIKAGKIKLTDMVTVGRDAWATGNPALRGSSVMFLKPGMQVSVEDLNKGVIIQSGNDASIAIADYVAGSQDAFVSLMNGYAKKMGLTNTTFMTVHGLDAPGQFSTARDMALLTKAMIHDVPEEYAVHKEKEFTFNKIRQPNRNRLLWSSNLNADGVKTGTTAGAGYNLVSSATQGDMRLIAVVLGTKTDRIRFNESEKLLTWGFRFFETVTPIKPDATFVTQRVWFGDSNEAKLGAGEAGSITLPKGQLKNLKASYTLNQPQLTAPLEKGQVVGTIDFKLNDKTIEQRPLIVMESVKEGGFFSRMIDFVLMKLHGWFGSWFS

SEQ ID NO: 10440 - protein, 60 aa, Klebsiella pneumoniae
VSSACLVWGNKNISTQQCCYARILNKIIVPANENTNTHPPRRIKNSKIISTGNVWMLKSM

SEQ ID NO: 10441 - protein, 90 aa, Klebsiella pneumoniae
CRQAVTEATLYCNQHHVLYGFTVISTGTCRPVQCFTIAAVQGERDLQFFAIITAESEAVRAPPLVTLSLYAPASMAVLPVYAQAAAHSDA

SEQ ID NO: 10442 - protein, 211 aa, Klebsiella pneumoniae
TIVLWLLVGGYFMSTEILIAFIIYAFVTSITPGPNNTMLLASGLNYGFKRSLPHVLGISIGFALMVIAVGTGLGRVFENWPQVYIALRICGATYLIYLAWNIATALPMSKISESSARPFSFWEAAGFQWVNPKAWIMATGAITTYLPQGENVRSVIFLSILFASINAPSVSIWVTFGATLRHWLNDIKYLRIFNVCMAMLLLASLYPLLFL

SEQ ID NO: 10443 - protein, 337 aa, Klebsiella pneumoniae
MRKYMMEKCIRAATVQFCHRADDKQYNLSVIENFIIQAHRENVQLLVFPEMCITGYWHVPNLTTETLNDLAERVEDSPSLSRIVTNAVNYHMAIGVGFIEKGSDDILYNSYAVCMPDGKIHIHRKLHAFEHPNISSGNNFTVFDTPWGVRIGILICWDNNLVENARITALLGADILVAPHQTGGTDSRSPFGMKPIEVSLWENRHNDPEKLMAAFRGDSGRGWLMRWLPSRAHDNGFFILFSNGVGLDNGEIRTGNAMIIDPYGRIVSEAFSYEDTIVYAELDLGLLTMSTGRRWIHGRRPELYGIMCESQGYERDARTARFSDEDPSFCAENGRLF

SEQ ID NO: 10444 - protein, 134 aa, Klebsiella pneumoniae
RQHQEDTVKSERSWAGIICGFVLFIVVCLSLLLHMKGAFRASGNPELGLLFFLLPGAAASCLSPGRRVLRPLLGAILAAPVCMVTMRLFFVTHRTFWQEMAWVLSAVFWCALGALCFLFICAWLDTWRSHSSSK

SEQ ID NO: 10445 - protein, 255 aa, Klebsiella pneumoniae
RTLQSLNPCLTEKNVMTPTIELLRSHRSIRHFTDAPVSDEQRAEIIASAQAASTSSFLQCTSIIRITDPALRERLVPLTGGQQHVAQAAEFWVFCADFNRHLQICPQAQLGLAEQLLIGVVDTALLAQNALTAAESLGLGGVYIGGLRNSIEAVTELLELPQHVLPLFGLCLGWPADNPDIKPRMPAAMLVHENRYQPLDNALLAEYDEQLAHYYLSRGSNARRDTWSDHIRRTIVKESRPFILDYLHKQGWATR

SEQ ID NO: 10446 - protein, 62 aa, Klebsiella pneumoniae
LNIHGLAPIFPYTFYHLTHYWSAAADIPVANDTSVYYADAIRCNVRRPPQGSLPMLTHRVSA

SEQ ID NO: 10447 - protein, 169 aa, Klebsiella pneumoniae
LFAQQCPYTTITIGGQSPDNSMDTGQRFSIIRHAPASTILPVLRPTEHGMQLRTRDPEATRARALFTFLVAIFNGLFQQLVFHCLLAQQTLQLFDLLHRRSQLRRGYNLFSCDNGGEAAFLILLTPQEQLTGSNTMLTGDQRHGHSGLKALLNNGDFFLNAAPSALFWT

SEQ ID NO: 10448 - protein, 60 aa, Klebsiella pneumoniae
KSGKLFYLAVIKGFYAYSLQPGALLGHRARKVFLLFYRSNIYRVLRYEGKGVIMVYLIDN

SEQ ID NO: 10449 - protein, 431 aa, Klebsiella pneumoniae
CEGKFMSNSVSVLALSLEQKQYVGDFLDCIVGSLDLSETQYSLIKRAYESVGAYLAGGDDPILVGAEIYSQGSVRLNTTVKPKGSEQYDVDLLCYLPNASVASGWAEVLEAVRARLASHGTYSEMLTPLPRGHRIMYAGEYHLDITPGIDFGYNSSEHSHPLLIPDSRLQDWKESNPAGYATWFDNITEKLPIFVRLEVASESFIKSAAVRPLPDHTRKKLLNRIVQIFKRHRDVWAAEGGKERIDLKPISAIITTLAGQAYSKICDEGRSYSTDFDVLLDVLELMPDYIRYSYGLYFVPNPSMPEENFAEKWNVEESRKGEKLRKNFELWHKTITDNITEIASSVGEDQLLDNLSKYFGERPVKAVREAMVVGVNAARDSNDLRVLALTGALSAGAANVPAMARTVPENTFYGGNALSSAPVKKNTFFGD

SEQ ID NO: 10450 - protein, 163 aa, Klebsiella pneumoniae
LTMNVFLPNRRLTLAEQYHGLRARFPNSHCYLTGNNKKLVWEGKLSPGPYSRSYLVRIEYAPPETPDCYVISPNLKELAKSKRIPHTYATDSESNKTQLCLFLPKQRHPEKHAEWRPQLQLSDTILPWASLWLFYFEQWLFSGKWEGGGAHPNEDDAGIYYED

SEQ ID NO: 10451 - protein, 374 aa, Klebsiella pneumoniae
RKENAMRPIPLLLILSALALPALSQAAVRVEVLQNRLAQPWGMAFLPDDQGILITLRGGELKRWQPGKGLSAPIAGVPQVWANGQGGLLDVALAPDFAQSRRVWLSYAESDASGKAGTAVGYGRLSEDATQLTNFTVVFRQQPKLSVGNHFGGRLVFDGKGYLFIGLGENNQRATAQDLSKLQGKVVRLTETGGVPPDNPFVGRADARPEIWAYGIRNPQGMAMNPWSEALWLNEHGPRGGDEINIPQAGKNYGWPLATHGINYSGLPIPEAKGKTVPGTEPPLYVWPVSPGVSGMAFYSAPTFPQWQHKLFIGALKETSLIVLAVDGNQVREEGRLLEARGKRIRDVRVGPDGYLYVLTDESNGELLRLSPEA

SEQ ID NO: 10452 - protein, 256 aa, Klebsiella pneumoniae
RRGNMETRRDERISQLIQALKRSDKLHLKEAASLLGVSEMTIRRDLNGHSGPVVLLGGYIVLEPRSATHYLLSDQKTRLVEEKRRAARHAAALLEAHQMAFFDCGTTTPWIIDAIDDALPFTGVCYSLNTFLALQEKPQCRAVLCGGEFHASNAIFMPLSLEDTLSHLSPDIAFYSAAGIDCEQGATCYNLEELPVKHWAMRHARYHVLVVDHSKFGKVRPARMGALAKFDVIASDICPDDELVALAKAQQISLLY

SEQ ID NO: 10453 - protein, 100 aa, Klebsiella pneumoniae
LDFDITKLLTSHVSIKQTAIGPFVLSLAIRDESIRKGKRLCEGSDNFMGDSKYICRGCSLEYDTLSDIFISNNSDNGPTIFRQQLLIVLHPLETVDTIFL

SEQ ID NO: 10454 - protein, 264 aa, Klebsiella pneumoniae
TKCEGFAPLKSGKLDAACFVIGRGNLMAKTILLVEDDEDIATLLRLNLQDEGYQIVHEADGGRALARLETQVWDAVILDLMLPGVDGLEICRRIRQMTRYLPVIIISARTSEMHRVLGLEMGADDYLAKPFSLLELIARVKALFRRQEAMGQNLLMDAGRLSCHGLSIDPLSREVKLRGETVDLTPREFDLLYYFARHPGEVFSRLALLEQVWGYQHEGYEHTVNTHINRLRSKIERDPAEPDIILTVWGKGYKFAPVTQEAAP

SEQ ID NO: 10455 - protein, 74 aa, Klebsiella pneumoniae
IVGDTAQYYEPCAIVPHLPCYSACVYIPFMFQQCDKRYTDVFQAVSRRLYGSGFHNNLIFKTMPPLTPHRFYLG

SEQ ID NO: 10456 - protein, 582 aa, Klebsiella pneumoniae
ATLDQITISFNNLLVNEKLAFVNINVADLLNGNYILLLFVVLALGLCLGKLRLGSVQLGNSIGVLVVSLLLGQQHFAINTDALNLGFMLFIFCVGVEAGPNFFSIFFRDGKNYLMLALVMVGSAMLIAMALGKVFGWDIGLTAGMLAGAMTSTPVLVGAGDTLRHFGLPSDQLAQSLDHLSLGYALTYLVGLVSLIVGARYMPKLQHQDLQTSAQQIARERGLDTDSKRKVYLPVIRAYRVGPELVAWADGKNLRELGIYRQTGCYIERIRRNGILANPDGDAVLQMGDDIALVGYPDAHARLDPSFRNGKEVFDRDLLDMRIVTEEIVVKNHNAVGRRLAQLKLTDHGCFLNRVIRSQIEMPIDDNVVLNKGDVLQVSGDARRVKTVADRIGFISIHSQVTDLLAFCAFFIVGLMIGMITFQFSSFSFGIGNAAGLLFAGIMLGFLRANHPTFGYIPQGALNMVKEFGLMVFMAGVGLSAGAGINNGLGAVGGQMLAAGLIVSLVPVVICFLFGAYVLRMNRAMLFGAMMGARTCAPAMEIISDTARSNIPALGYAGTYAIANVLLTLAGTLIVIIWPGLQ

SEQ ID NO: 10457 - protein, 415 aa, Klebsiella pneumoniae
YIIDFMQNYSLSGRRLGRQALLFPLCLVLYEFSTYIGNDMIQPGMLAVVQEFQVGNEWVPTSMTAYLAGGMFLQWLLGPLSDRIGRRPVMLTGVVWFIVTCLATLLAQTIEQFTLLRFLQGISLCFIGAVGYAAIQESFEEAVCIKITALMANVALIAPLLGPLVGAAWVHILPWEMMFVLFAVLAAISFFGLQRAMPETATRLGEKLSVKELGRDYRLVLKNLRFVAGALATGFVSLPLLAWIAQSPVIIISGEQATSYEYGMLQVPIFGALIAGNLVLARLTARRTVRSLIIMGGWPIMFGLILSAAATVVSSHAYLWMTAGLSFYAFGIGLANAGLVRLTLFASEMSKGTVSAAMGMLQMLIFTVGIELSKHAYELGGNGLFSLFNLLGGVLWLGLMIYFLKDKSVGNSQQG

SEQ ID NO: 10458 - protein, 142 aa, Klebsiella pneumoniae
NPGLWYNVNIMNKYTAGLRFHDISAFPACVFIPERIYSGYGAKWGKELLYLFSFKKPFTLVFINAFNESKEDRIYRFEWMKHNQQLLSEYCRSIITIITDKDIRESIILQGAASTYIFTIPHEVVGSFTEALTLTDTLIPDS

SEQ ID NO: 10459 - protein, 312 aa, Klebsiella pneumoniae
GPPERVFSQRCRMKIAILSRDGTLYSCRRLREAAQQRGHQIEILDPLSCYMNVSPVASSIHYKGRQLPHFDAVIPRIGSAITYYGTAALRQFELLGSYPLNESVAITRARDKLRSLQLLARQGIDLPLTGIAHSPDDTSDLIAMVGGAPLVVKLVEGTQGIGVVLAETRQAAESVIDAFRGLNAHILVQEYIAEAKGCDIRCLVVGNEVVAAIERRAKEGDFRSNLHRGGMATVAQISDEERAIAIKATQTLGLDAAGVDILRAARGPLVMEVNASPGLEGVETTTGVDVAGKMIAWIERQATPEFCLKIGG

SEQ ID NO: 10460 - protein, 68 aa, Klebsiella pneumoniae
SPAEGQKFDLIIDERALRSPFIYEDMGILAPAGECFYHANSSFYIRVNCIILAAVFSAVQLHRSHSPL

SEQ ID NO: 10461 - protein, 142 aa, Klebsiella pneumoniae
KIGEIKVLKRVELIIEHNGIWIIARILLAMVFLSSGAAKMIDFQGGMSEMRAAGLHPDWLFNIVTALLLLISSLFIILDKALWVGTVALSIFLLLTIVVVHHFWDMPQPDSTQAMFWAVEHVSLVGGLLSAAIASRSRRKLI

SEQ ID NO: 10462 - protein, 207 aa, Klebsiella pneumoniae
LLSDQRAWKPMLEKINYALFALLNATPASPQWAIEMAIFIAKDLILIVPLLVVTLWLWGPAQRQMVFKLMLALTISLTVSWAIGHLYPHDRPFVAGVGYNFLHHAADDSFPSDHGTVSFTFALAFLFWHRLWSGALLMAIAAAIAWSRVYLGVHWPLDMVGGLLAGMCGCLGAALIWHTFGPALYHQLQRLYRLCFSLPIRKGWVRG

SEQ ID NO: 10463 - protein, 252 aa, Klebsiella pneumoniae
RTKEGIKMKFEKSFKIMAILAFSVSVSATASNATVYALPDAKSFGIASEDQKGLMFLGMDRNADLKGVCFAMLKQAESSIPYADVIATTNNKDFRMHGLRPNIRDNTKEVVCSFGSDAFDYLDNLSKSSMSLVSIRFNGEQRNFSFNTSSFSKLLTPSGAKIAEQAADDYKRGIRAPVFYNKAPSSVTENEDRYALSDQKLNEIWNKLPSETRRKLLPSQREWIKQKDTCRRDTECLTDMTNRRIKILEVAR

SEQ ID NO: 10464 - protein, 323 aa, Klebsiella pneumoniae
RCEERAMNTVESPSGAKKPGGFALWAARLQMAHGRKLVIALPYLWLILLFMLPFLIVFKISLAEMARAIPPYTELMEWADGQLTLTLNFANFLQLTDDPLYFEAYLQSLQVAGISTICCLLLGYPLAWAVAHSKPSTRNILLLLVILPSWTSFLIRVYAWMGLLKSNGVLNNFLLWLGVIDQPLEILHTNLAVYIGIVYAYLPFMVLPIYTALTRIDYSLVEASLDLGARPLKTFFQVIVPLTKGGIIAGSMLVFIPAVGEFVIPELLGGPDSIMIGRVLWQEFFNNRDWPVASAVAIVMLLLLIVPIMWFHKHQQKQMGEQG

SEQ ID NO: 10465 - protein, 99 aa, Klebsiella pneumoniae
PQREEVVHPINWKKKFAGLGVTELRRLRQLEDENQRLKKLADLSLDKEMLQEVIKISSEAGSEASGGAFSAAGLPYQCPTGMRTADAEQNRIPLAEPAG

SEQ ID NO: 10466 - protein, 191 aa, Klebsiella pneumoniae
QTVCMVERKYNHMKDKEIFISVDIESSGPIPGEYSLLSIGACLLSDPKESFYTELRPDSQKHDPEAVAITGLDLASLTLSGLPPLEAMEQFNSWINSVSKPKQQTIFVGFNAPFDWSFINYYFHKYLGFNPFGFTAIDIKAYYMGLNKCSWEDTKSSKIVEKLRPHLRNNHNALEDAKFQAELFSLMLATD

SEQ ID NO: 10467 - protein, 318 aa, Klebsiella pneumoniae
QPRLAGRLGGGDCHAAVADRADHVVPQAPAKTDGRAGMNDLPVVRSPWRILILVLGFTFLYAPMLMLVIYSFNSSKLVTVWAGWSTRWYSELFHDDAMMSAVGLSLTIAACAATAAAILGTIAAVVMVRFGRFRGSNGFAFMITAPLVMPDVITGLSLLLLFVALGHAIGWPSDRGMLTIWLAHVTFCTAYVAVVISSRLRELDHSIEEAAMDLGAAPLKVFFVITLPMIMPAVISGWLLAFTLSLDDLVIASFVSGPGATTLPMLVFSSVRMGVNPEINALATLILGVVGIVGFIAWYLMARAEKQRVRDIQRARQG

SEQ ID NO: 10468 - protein, 453 aa, Klebsiella pneumoniae
CTKCTTIKLLSWIHSMKNKYKMIVDKYVDLIRSGELTAGTRLPTHRDLAASKRISLATATRVYAELETMGLVSGEIGRGTFVREISLPPGHGIDQHDVAAGIIDLNFNYPSLPGQGELFREALRQISGSGDIESHLRCQPHAGRLSDRQIIAGHLSRGDFEPKADNVIIVNGAQHGLTVTVMGLLRPGDVVAVDALTYSGFKVLGALYHLELIPIPVKNNGPDLEALRQICRLRHVRAIYVMPTLHNPLGWVLSHEQRKEIVNIARSNDLLIIEDAAYHYLVKTQPPAVAFFAPERTIYVTGFSKNVATGLRIGVIICPEVYRPALERAVRATTWNTPSLIVSLVCNWIQDGTVSRFETLKRRDARERQRILKETLGHMTCLSHPDSYFAWFPLPEDMRADNVVKVLMENNISVSTAEPFCISQNVPQAIRLALGSVSYENLHKALQKVRNLI

SEQ ID NO: 10469 - protein, 419 aa, Klebsiella pneumoniae
ASFRKQSQRNVFHENGATGWRRPEAAVPILGGSALSCTLDIAHSLLFCAGHQIPGDKTNNTDHAEDERRQGVDLRVDPHAHAGEDQHRQGRGPGTGDKAGDHQVIQRQREGQQPAGDHRRHNHRQRDDEEDLQRRGAKIHRRLFNGVVQLAQARGDHHRHVGGTEGDMRQPDGQHAAVRRPADGMSQRHEQQQQRETGDHVRHDQRRGDHKREAVGAAKTPKAHHHHRGDGTEDRRRCRRAGGDGQAQSYRAHHRIIVEQFAIPARRPSGPDRYQLRAVERVDHQHQHRGVEEGEPEHEDQNAPRRAYYRQVVHPCSPICFCWCLWNHMIGTISNSSMTIATAEATGQSRLLKNSCHSTRPIMMLSGPPSSSGITNSPTAGINTSMEPAIMPPLVSGTITWKKVFSGRAPRSSEASTSE

SEQ ID NO: 10470 - protein, 147 aa, Klebsiella pneumoniae
CLQRAGRERRFCLLLRWFTAMFDKCRTVKTRILARRRGGIGWRAAFINRRGVMRKFAPLPKSILLVEILGMGLLTLAWLSLNQYVQLPAPIASPTAALVMLFAGIVLMIPAALVVMWRMAQIVAPQLTHSPKPESLSDREKRNDADH

SEQ ID NO: 10471 - protein, 209 aa, Klebsiella pneumoniae
WKSRMQKTHKHLTKIVTISLSLAFAVLVVHGVLTSLPNHDTETPNLKATVTQVPLKPAEPEMVNVVNRIHTPEEVYRRFQDNEFRATNHFRTCRLMVTGRVKNIGTATFTKDPLVTIAIPGSDEGMKFIFENTSSNWNEVAALEIDDILTISGMDTRKGQFGGLFLSNAEIMNTLHSRNSREMMVERNGFYDRILCEKRAIQADISDYN

SEQ ID NO: 10472 - protein, 334 aa, Klebsiella pneumoniae
AGLRTYFDNFLQHLLVQTQVCQFLKPLIFILQLPQTPQFGHAQTGEFLLPVNGMDYLFPLRLTVRNVLTRRITMNIVFLGIDLAKNVFQLCGLNQAGKPVFTKRTGRKELLQTLANIPACLIGIEASSGAFYWQREFEKLGHKVKVISPQYVKPFVRGQKNDGNDAQAIAVALMQPTMQFVPPKSPEQQDIQALHRARQRIVNHRTATVCQIRGLLLDRGIPIGSAVSRARRAIPLILEDAENGLSSRMSRTIAELYDLFNDLERRIHFFDKEIETVFRQSEACQRIARVKGIGPKTATAVVAAIGKGTVRMAATLLHGWVWFHASIRVATDRC

SEQ ID NO: 10473 - protein, 66 aa, Klebsiella pneumoniae
LHPSLSLGFFFKATLDGDKFYKYIHNSASTAVAFTEVLLSKPRAALILLPVINHAGLMKRLTSLPG

SEQ ID NO: 10474 - protein, 68 aa, Klebsiella pneumoniae
DFYSSKSDVVIVSSEVELGLMECNRADILSFVKGISSNNHPRFSGEGGRGEATGYHWPGFRLPNTAPP

SEQ ID NO: 10475 - protein, 178 aa, Klebsiella pneumoniae
NRYSSLRSAPPCGAVFMEDITLGLFTKTRSSHARLNVPALVQVAAFAIILIRGLDLLMILNLLGLQGLNEFIHRSVQTWNLTLVFLGSLALVFIEIWCAFSLVKGRNWARWIYLLTQIIAAGYLWAASLGYGYPELFSIPGESKREIFHSLVMQKLPDLLVLTLLFVPANCRRFFRLQ

SEQ ID NO: 10476 - protein, 202 aa, Klebsiella pneumoniae
VIKSVWKYRSQPVDIKLLRAFVTLSQLKRYHSAAEKLCVTQPALTKQIQTLESLSGITLFQRGRHGARLTVAGELLLQRASEVLASYDNFRTDVSSIQQGLVGKLTVGFGISSFRVAPEKVAIFRALYPDVQVSLNDMSSAVQFQKLAEGQLQTGFVRLPAPERLESKILAEEKLVLAVAHEHDTELSSAAELLGSRKLLQS

SEQ ID NO: 10477 - protein, 378 aa, Klebsiella pneumoniae
RALRRKRDMTAFGKKWLTGLVTGALMAVSAGSLAAEQKTLHVYNWSDYIAPDTVANFEKETGIKVVYDVFDSNEVLEGKLMAGSTGFDLVVPSASFLERQLAAGVFQPLDKSKLPNWKNLDPEVLKLVAKHDPENKYAMPYLWATTGIGYNVDKVKAVLGKDAPVDSWDLVLKPENLEKLKSCGVSFLDAPEEIFATVLNYLGKDPNSSKADDYTGPATDLLLKLRPNIRYFHSSQYINDLANGDICVAIGWAGDVWQAANRAKEAKNGVNVSYFIPKEGALAFFDVFAMPADAKNKDEAYQFLNYLMRPDVIAKISDQVFYANGNKASTPLVSETIRNNPAIYPPADVFAKLFTLKVQDPKIDRVRTRAWTKVKSGK

SEQ ID NO: 10478 - protein, 104 aa, Klebsiella pneumoniae
FNMRCFVKRVFGRLSSINVRKVLWTCSELGLLFQHEECDIDLTASAPMQSGFVFTELNPNAIVPILLDNKFVLWESNIIIRYLANRYEGTGPFLGRFLEPWPLV

SEQ ID NO: 10479 - protein, 93 aa, Klebsiella pneumoniae
GLRREAMFTVIFGRPGCPYCVRAKELAEKLTNERDDFNYRYVDIHAEGISKADLEKTVGKPVETVPQIFVDQKHIGGCTDFEAWAKENLGLFA

SEQ ID NO: 10480 - protein, 62 aa, Klebsiella pneumoniae
QVSGNIGANPLETDDDLAAFFTWREPRRVSKSLTVQYDKVLYLIEDNELSRRALGKYIEVWH

SEQ ID NO: 10481 - protein, 277 aa, Klebsiella pneumoniae
TRYGEQLMSIKLIAVDMDGTFLSDAKTYNRPRFLAQYQRMREQNIRFVVASGNQYYQLISFFPEIAHQIAFVAENGGWVVSGNEDVFNCQLPVHHFNAVVDHLQTLPNIEIIACGKRSAYTLNRYNDALKTVAAKYYHRLELVDDFNHLDDTILKFGLNVPDSLIPEIQPKLHVALGDMVTAVATGYGSIDLIIPGVHKANGLRILQQRWGIEDHEVVAFGDSGNDIEMLQHAGFGFAMANAREDVKAVARYQAPHNNEEGVLQIIDKVLDREAPFA

SEQ ID NO: 10482 - protein, 500 aa, Klebsiella pneumoniae
VRPGDARGRPVIRRLSLSQRLALVVVSLLMLCAVAVCAVQLHSSAQYGNAMVQRLSSGLAQQIVAREPLLDAHGEVNRQTLKSLFDRLMTFNPSVELYLLSPDGDLLADAAPPGHIQRQRIDMAPVQAFLTGSASPVYGDDPRSPDGRKVFSAAPLRVDGQLRGYLYIILQGETFNQLAADAWQKTLWSIVLWTLLLVALFGLLAGGLAWFWVTRPVRLLTAQVAASGQDSISAIKTLAARRPEPRPGNEVAVLENRFIDLARQIADQWDRLADSDRQRREFVANISHDLRTPLTSLLGYLETLTLKDEWLTAEERRQYLTIALRQGNKVRHLSQQLFELARLEHGGIKPQRERFAMGELISDVAQKFELTARTREVNLHIDVPGPLPLINADVSMIERVVTNLLDNAMRHTPVGGEIRLAVWQENQQLQVEVADNGAGVDAALRDDLFQRPSALSTQASREDRGGLGLLIVKRMLELHGGDIRLVESVSGARFRFFVPL

SEQ ID NO: 10483 - protein, 95 aa, Klebsiella pneumoniae
WRYGPPWSSPLPDRGSPSRRSRQRAQEYPPPRAACDRAAFYPAPPSVHQAAAAWAVSPGCAPTRRAAAGRLRVGAAYVWQTPAYVPGPASPAPGR

SEQ ID NO: 10484 - protein, 114 aa, Klebsiella pneumoniae
NGHGRCCCYWQRNCKNGRHFAAWLGLVPRQHSSGDRQVLMNMTKKGDKHLRTLFIHGAGAVVRVATSNNDVFMNQWVNQLKEQRGFNKTTVAVANKNARIIWSMLRNETEYQVV

SEQ ID NO: 10485 - protein, 86 aa, Klebsiella pneumoniae
CTRGRAPIRRPAVAECRGLFGQYAPGDLPVQHGLGQMYDLIVPTPTLSIRDKAIASWPPAWRGQNLRDIQVSLGYDVDTPWQALPE

SEQ ID NO: 10486 - protein, 213 aa, Klebsiella pneumoniae
RHGGDQCQNTSSCIRMRCCLSVNRQYRHRSGRIQGKSNQRWCSDGFGFSCDNGEKLQVTFALDCCDREALYRAASTGGYDSETVQDVMLVAVERRFGNSLPASPVEWLTDNGAAYRSHQTRQFARIVGLEPEHTAVRSPESNGMTESFVKTVKRDYISIMPKPDGLTSVKNLAEAFEHYNEWHPHSTPRYRSPREYLRRRTSNGLSDKKCMEI

SEQ ID NO: 10487 - protein, 164 aa, Klebsiella pneumoniae
EVTGTMDSLVVPGLDTLRRWLDEIGISFFECDSCQALHLPHMQNFDGIFDAKIDLVDNVVLFSALAEVKPSALLALSADLSAINASSLTVKAFIDIQDDNLPKLVVCQSLSIGPGVTMEQFAWFFRQSEEQISMVILEAGANQLLYKGEEEEPAAENVQYHFLH

SEQ ID NO: 10488 - protein, 302 aa, Klebsiella pneumoniae
GRTGYSEKGSAVLCKGARLKYRFINDHREIWSIVTMCRVLKVARAGFYVWLHNPVSAGEKDNQRLLALIRDSYTLSGGVYGYRRIHGDLREIGEVCSRNRVAKIMRKNRIQAIHGYKVPRGTRGRPSLIAPNRVQREFTVVKPNQVWVTDITYIRTWQGWLYLAVVIDLFARNVVGWSMKPTLSRELALDALLMAVWRGKPSEDVIVHSDQGSQYGSDDWQRFCRANNLAPSMSRRGNCWDNAVAESFFSSLKKERIRKRIYKTRDMARADIFDYIEVFYNRNRRHSHLGGVSPEAFEKASP

SEQ ID NO: 10489 - protein, 378 aa, Klebsiella pneumoniae
RSIMHCALYDAGRCRSCQWLERPVPQQLADKMADLRTLLAAIPVAAWGEPVSGPEAAFRNKAKMVVSGSVERPLLGMLHRDGTPVDLTDCPLYPAEFAPVFAALKPFIARAGLTPYNVARKRGELKYLLLTASQQGEMMLRFVLRSEAKVAQLRAALPWLQAQLPQLSVITANIQPVHMAIMEGEQEIFFTEQQALGEVFNGVPLWIRPQSFFQTNPAVASRLYATARDWVRALPVQHMWDLFCGVGGFGLHCATPTMRLTGIEIAPEAIACARQSAAQLGLSNLHFQALDSTQFATHEADAPQLVLVNPPRRGIGAELCDYLSRMAPPYIIYSSCNARTMATDIARLSGYRVERVQLFDMFPHTAHYEVLTLLVREV

SEQ ID NO: 10490 - protein, 97 aa, Klebsiella pneumoniae
EESMGTPRFTPEFKEEAVRQITERGYSISEVSERLGVSAHSLYKWLRAVKPDNNGQQAQDLLDARTEILRLKAQLKRTEEERDILKKAARYFAREPD

SEQ ID NO: 10491 - protein, 396 aa, Klebsiella pneumoniae
ARSMAPDHMVIVFLPESTRLNDVMPRPQAKAPKALTPLLEIRNLTKSFDGQHAVDDVSLTIYKGEIFALLGASGCGKSTLLRMLAGFEQPTAGQIMLDGVDLARVPPYQRPINMMFQSYALFPHMTVEQNIAFGLKQDRLPKAEITARVQEMLALVHMQEFAKRKPHQLSGGQRQRVALARSLAKRPKLLLLDEPMGALDKKLRDRMQLEVVDILERVGVTCVMVTHDQEEAMTMAGRIAIMNRGKFVQIGEPEEIYEHPTTRYSAEFIGSVNVFEGLVKERLEDGLVLSSPGLMHPLKVDPDASVVDNVPVWVALRPEKIMLCDEPPADGYNFAVGEVIHIAYLGDLSIYHVRLQSGQMISAQLQNEHRHRKGTPTWGDEVRLCWDADSCVVLTV

SEQ ID NO: 10492 - protein, 198 aa, Klebsiella pneumoniae
NYAIRIVAHRIKTIQEGLMSSVLQHSFILTGGPGSGKSTIIDTIIKRGFWCSQEAGRGVIQDQVNIGGDALPWANKNAFAELMLSWEMRSWHEAEGQTQPCFFDRGVPDVAGYLRLSELTIPRHLENAIKKFRYNRIVFIAPPWRDIYVQDTERKQSFDVAVATYHAMVKTYRMYDYQLIELPCTSVGERVDFILSRM

SEQ ID NO: 10493 - protein, 124 aa, Klebsiella pneumoniae
VIVLILVFRLVAGVRMIDVLGPEKRRRGSVQEKIAIVQQSFEPGMTVSLVARQHGVAASQLFLWRKQYQEGSLTAVVAGEQVVPASELASAMKQIKQLQRLLGKKTMENELLKEAVEYGHQKSE

SEQ ID NO: 10494 - protein, 64 aa, Klebsiella pneumoniae
LTSILIIHPYRDRESYFVKLSDKYLVLAILNRTCGANRMPGGYLTGKLLQGIFRAVILSQKRTT

SEQ ID NO: 10495 - protein, 134 aa, Klebsiella pneumoniae
GHRMPYRHDQQTHQDTRGGKIMASATLIRLNKDEWQKLPAGHFYNGKYQVGPFTITYEFIVKYMALIHKTEIPESWLTDNGTSLDERRVLYMEASDILTKDIVREIRKTVKSPQDQLQVYRINDQIITLEMMEK

SEQ ID NO: 10496 - protein, 289 aa, Klebsiella pneumoniae
LDGMDIKLLRAFVTLSQLKRYHSAAEKLCVTQPALTKQIQTLESLSGITLFQRGRHGARLTVAGELLLQRASEVLASYDNFRTDVSSIQQGLVGKLTVGFGISSFRVAPEKVAIFRALYPDVQVSLNDMSSAVQFQKLAEGQLQTGFVRLPAPERLESKILAEEKLVLAVAHEHDTELSSAAELLGSRKLLQLSRDRGEGLSEQILRFLSLRQLTPQTVFPADDIQTLLALVATKNGVALLPAGVFHILPCGVRLIPLEGEHTTWQTGIAWNPQIKDPVRDNFINIVTP

SEQ ID NO: 10497 - protein, 184 aa, Klebsiella pneumoniae
SPEIFTGHENFRTQGGGKKVEKNVADKRTASLWCQAIREAATPYTSSEILLDVDKEFGTNTKSLWGKIFDLLPIYAIFKADRESSDGDSEAKNSLQQAVKDAQAALQDKITALEKDIQDSVLDVAQRTLDKLREMAPELASELTPRFKEWSDHAPVDSFCPHGEAFSKASGLTPPRWLWRRLRL

SEQ ID NO: 10498 - protein, 373 aa, Klebsiella pneumoniae
WTRMAEMHISSYWKHQFSKILDYLTRQKKPAVVLMTVGGTILGGQKVLNFVLTGKFSWGSLTVGTNDGNFISDYIVPIVAIILIVMGGILMVLNEYLAFKQNSHKRIILVAGNGLRTTSETGLDKKVTSILKGTIYPVDIDITQQYRDGYVFEPELTFIRKILPSKDNLAQLLAKGSAESIQVGYGGFLPVPFTFFIGNVLDDKSNVSVFDWDRENERWEHISEKHIDDGESFISETIRTGELDEIVLVVSCSYRVKMPQVGECFKGLGIEHLTLETIAFDNHWSLVKQRRLSIQFAEKIKSLSDMGIRTIHLILAAQSSVVLNLGRRYDSRNMSELIVYQYEQTNKNPYPWGIYALSHGHENGGFIPRSEEQ

SEQ ID NO: 10499 - protein, 201 aa, Klebsiella pneumoniae
QVCVHLYINRKRKIMARRPNDPQRRERILQATLDTIAAHGIHAVTHRKIATCANVPLGSLTYYFSGIEALIEEAFSLFTAEMSAQYQQGFVGVTNREQACDAIADLIFSAQVTTARNMELMYQLYAFCSSQPALKAVMQNWMRRSQQTLEQWFAPDTARGLDAFIEGMTLHFVTDRAPLSKAAIRMMVGQLAGERAQEEGR

SEQ ID NO: 10500 - protein, 63 aa, Klebsiella pneumoniae
TGVVLPYFTYDRLQEIDQGAIVNNKRLGRTLEFIKIVQDKRDNNRSQALPAGDGPPAETEKTN

SEQ ID NO: 10501 - protein, 73 aa, Klebsiella pneumoniae
KTTVANLYTFSAALGKELGQIILRGQYFSYESQFGLKDIPISVLLSYININWIDGTFQYGSNLLIQPCFRCRS

SEQ ID NO: 10502 - protein, 91 aa, Klebsiella pneumoniae
CLLFNMAPHGVEHLSGNLMGKNQHVVPHNGEWAVRGEGNERVTSTHRTQQEAIDAARSISRNQESELVIHRPNGQIRDRDSHGKDPFPPKG

SEQ ID NO: 10503 - protein, 170 aa, Klebsiella pneumoniae
KSLSSTQGRFEIACEFDGLPDFIMIDNRVQTILPSEHLLNKDGNFEIIKSFKATTTGKTEQTCISCIHPDDNPLRYLLGMKISELKAVGKKLKKTWLINAPHLYGVRPSGKPQLPIPLRKFYWMSIKSLEPTQNHYGVRSSICCPYMRFSKPTGKVAMGIPKLKTPYSRP

SEQ ID NO: 10504 - protein, 654 aa, Klebsiella pneumoniae
QQTSGFKPARYAKQKKGCFMSSDIKIKVQSFGRFLSNMVMPNIGAFIAWGIITALFIPTGWLPNETLAKLVGPMITYLLPLLIGYTGGKLVGGERGGVVGAITTMGVIVGADMPMFLGSMIAGPLGGYCIKKFDNWVDGKIKSGFEMLVNNFSAGIIGMILAILAFLGIGPAVEVLSKILAAGVNFMVAHDMLPLASIFVEPAKILFLNNAINHGIFSPLGIQQSHELGKSIFFLIEANPGPGMGVLLAYMFFGRGSAKQSAGGAAIIHFLGGIHEIYFPYVLMNPRLILAVILGGMTGVFTLTILNGGLVSPASPGSILAVLAMTPKGAYFANIAAIIAAMAVSFVVSAVLLKTSKVKEEDDIEAATRRMHDMKAESKGASPLAAGNVTNDLSHVRKIIVACDAGMGSSAMGAGVLRKKVQDAGLSNISVTNSAINNLPPDVDLVITHRDLTERAMRQVPQAQHISLTNFLDSGLYTSLTERLVAAQRHIDNEVKVTDSLKDSFDDTNNNLFQLGADNIFLGRKAATKEEAIRFAGEQLVKGGYVEPEYVQAMLDREKLTSTYLGESIAVPHGTIEAKDRVLKTGVVFCQYPEGVRFGEEEDEVARLVIGIAARNNEHIQVITSLTNALDDETVIERLAKTTSVDEVLALLNK

SEQ ID NO: 10505 - protein, 357 aa, Klebsiella pneumoniae
KCRFKLERDYRLMPGGGFALPGLQNSYAAAPDYHFLPRRPARAHAMIPLCHISLEEKMGSSKKGMLNVLIAAVLWGSSGVCAQFIMQESQMSSPFLTMTRLLFAGLILLMLGFVHGDRIFRVLQNRRDALSLLFFSLFGALTVQFTFLMTIEKSNAATATVLQFLSPTIIVAWFALARKARPTPLVLGAICTSLAGTFLLVTHGNPTTLSISPAALFWGIASAFAAAFYTTYPSTLIARYGTLPIVGWSMLFGGAMLLPFYGGQGTDFVVNGSLLLAFFYLVVIGTSLTFSLYLNGAQKIGGAKAGILSCAEPLSSALLSLLLLGITFTLPDWLGTLLILASVVLIAIDSRRRVRAA

SEQ ID NO: 10506 - protein, 333 aa, Klebsiella pneumoniae
LKRFRFTGFWRDAAPAQGKMMSTINDVSRLAGVSKATVSRVLSGSRGVKEASRQAVLQAAEALNYRPNMIAQSLLSQSTGCIGVICAQDNINQTTSYLYALEKQLSQHQKHLLLRFANTSHGVMNSLEELTCGLCDNVLIIGARFPLNINRPDVVLVDCLDSEGDNSIQFDHAFAAETACHYLISQGRRQIALIHPQSSGFADQVLLGYKHALEKNFLPFNRNLVFLDNTSPSVAVQELVNNATTLNFNALLVSDEQQAQRVVPQLQAFNRAVPQNVMVFSLAGSLQLPGIPTIPAIEYSMDAMASRIVNWLTEKTDNPGGSPLRGDLIIPKH

SEQ ID NO: 10507 - protein, 421 aa, Klebsiella pneumoniae
YGRFLHRLRDVPVTYSSFLFTHKVFIDMKRHKNFNLLLMLVLLVAVGQMAQTIYIPAIADMAVALNVREGAVQSVMAAYLLTYGISQLFYGPLSDRVGRRPVILVGMSIFMLATLVAITTHSLPVLIAASAMQGMGTGVGGVMARTLPRDLYEGAQLRHANSLLNMGILVSPLIAPLLGGILDTLWSWRACYAFLLVLCAGVTFSMAKWMPETRPEGAPRTKLLASYKTLFGNGAFNCYLLMLIGGLAGIAVFEACSGVLMGAVLGLSSMAVSILFILPIPAAFFGAWFAGRPNKRFPTLMWQSVICCLLAGLMMWIPGLLGIMTVWTLLVPAALFFFGAGMLFPLATSGAMEPFPFLAGTAGALVGGLQNIGSGVLAWLSAMMPQTGQGSLGLLMMLMGLLILLCWLPLASRFTHHQQPV

SEQ ID NO: 10508 - protein, 358 aa, Klebsiella pneumoniae
VHSSRRGFAMLINAIGTYSASQPLESMAITRRDPGPQDVQIAIAYCGVCHSDLHQARSEWAGTLYPCVPGHEIVGRVTAVGNAVSRYAVGDLVGVGCMVDSCQQCEECAEGLENYCDHMVLTYNGPTQDAPGHTLGGYSQQIVVNERYVLRITHPEAQLAAVAPLLCAGITTYSPLRHWHVGPGKKVGVVGIGGLGHMGIKLAHAMGAHVVAFTTSESKRNAARALGADDVVVSRNEDEMAAHVKSFDFILNTVAAPHNLDAFTTLLKRDGTMTLVGAPATPHPSPEVFNLIFRRRSIAGSMIGGIPETQEMLDFCAEHGIVADIELIRGDEINEAWERMVKGDVKYRFVIDSATLAG

SEQ ID NO: 10509 - protein, 157 aa, Klebsiella pneumoniae
VRSSGILMLFSTFASLLLQIVHEQRVEVHWRKVKLREGTAGNQAGDALARVREQNVRAVCAEAVRHLGAFDAVDGENTALLYFTEERGFFAQRSGHGHTQHHFINAFSQLGGGGIQIKFNFRLPVFLENLRRVRRFKRDIFGIDTLDLEGHFGAVLF

SEQ ID NO: 10510 - protein, 357 aa, Klebsiella pneumoniae
LRSSAGLPSGAGSTDYRPGRRLSPWRENCRCSPGLLFRTAPAGAVQLETRCVAGHHRRLGEKVSGHSVHAGSGASVGILHPRGAAARGAGQAQYRHHGRARYRSRRSLPEHLPPRNGEPGMNLLNKKGLVIRHLPRHDEAVLRRCEAAGVATLHEAWDRQGLMGPAIRPIQQGVSRAGNAVTVLVTPGDNWMFHVAVEQCRAGDILVVAPTSPCGDGFFGDLLATSLQSRGVVGLVGDIGIRDSQTLREMGFAVWSRQVYAQGTVKESLGSVNVPVICAGQLVQPGDVVVADDDGVVVLPHARVRDVLHKAEARMSNELAKRERMRNGELGLDIYAMRPRLAEKGLRYYDRADEVEE

SEQ ID NO: 10511 - protein, 108 aa, Klebsiella pneumoniae
GWSSMYKIMLCCSAGMSTSLLVRKMVEAANERDLPVQIDAYGVSEFDMQFPQYQVVLLGPQVKYMLKTLSDKAASLNIPVQPIDTMDYGMQRGDNVLNYALSLIPAAH

SEQ ID NO: 10512 - protein, 112 aa, Klebsiella pneumoniae
KRPSASRRRCCSPAPPRWARSSSRCTGAATATPTTNRWRKACAAGCRSACPASVSGVTISAVSKTPRRPTSTSAGAPSACSPATAACTAANPIGCHGPTMTSPATWCATSRS

SEQ ID NO: 10513 - protein, 408 aa, Klebsiella pneumoniae
LIFPQKALCRILSSKRLRLMSTLKVSNFARQGYSIVFPLFLFFSAIFCMSTRTNNLLHLSILLLLLSLVRQENRQALAGVLREQWQTWTLLAAFFIYYALSNVWGHTPQHIDSPITHGVYLTGYLLLMTMLLRDGRTRRLAMLAVVGGITVLSLWTLIIDHTLVLTERAVSPENPGPTNVIDLAGYCGIGILICGMLLKEKASHWLYLPVVIMLVMLLLTQSRGPIIALVLAVGCTLHLHVFTRRNLLIAAALAVLVALLLVMTPVGDMLLARFEELGTQSGLRLSIWHHTLSEMASQPWLGRGFSYELDFINYSGEHITTTHSVYMGALLKGGIVGLLLLLAIIACGLWQAWRKRHTDSRYSLAILFYALVFMASQGMFIISNPRETWVLFWLPLGIALSKGLAEKR

SEQ ID NO: 10514 - protein, 425 aa, Klebsiella pneumoniae
LAFPARKRALSKWQLVLRRVPHYAERHSHREDPMTRFLLCSFALVLLYPSGIDMYLVGLPRIAQDLGASEAQLHIAFSVYLAGMASAMLFAGRIADRSGRKPVAIVGAAIFVIASLLCAQAHTSSHFLIGRFIQGIGAGSCYVVAFAILRDTLDDRRRAKVLSLLNGITCIIPVLAPVLGHLIMLKYPWQSLFYTMTGMGVMVAVLSVFILRETRPTAPPQAASPQHDAGESLLNRFFLSRLLITTLSVTVILTYVNVSPVLMMEEMGFDRGTYSMAMALMAMISMAVSFSTPFVLSLFNPRTLMLTSQVLFLAAGVTLSLATRQAVTLIGLGMICAGFSVGFGVAMSQALGPFTLRAGVASSVLGIAQVCGSSLWIWLAAIIGLSAMNMLIGILIACSIVSLVLLLVVTPPRVAQYDEEAAVES

SEQ ID NO: 10515 - protein, 481 aa, Klebsiella pneumoniae
LLTPSPVGRGENNLPPGPFMTTEIRALYTRLPAIDRLLRDPAFSPLLAQHGHSQVVAQLRQMLDEAREQIRQYQTLPDWSHDWPSACAQRLTAGQRSALRPVFNLTGTVLHTNLGRAIQAESAVEAVASAMRAPVTLEYDLDDAGRGHRDRAIADLLCQITGAEDACIVNNNAAAVLLMLAATASGREVVVSRGELVEIGGAFRIPDVMRQAGCQLQEVGTTNRTHAKDYRQAVNDNTALLMKVHTSNYSIEGFTKAVDEAELAAIGRELDVPVVADLGSGSLVDLSQYGLPKEPMPQEMIAAGVSLVSFSGDKLLGGPQAGIIVGKRALIAQLQSHPLKRALRADKMTLAALEATLRLYQHPEALREKLPTLRLLTRPAEEIRRLAERLQPDLAAHYADFAVSVAACQSQIGSGSLPVDRLPSAALTFTPHDGRGSRLEALAARWRALPCPVIGRIYDGRLWLDLRCLEDETRFMEMLLR

SEQ ID NO: 10516 - protein, 533 aa, Klebsiella pneumoniae
KTAPCTYKNIKGSIMPEIRQRILENMQKFSRAMIGAVLFLPVIGLILALSSVLTNPTLIAETSFLHQLGQMLGDTFWPLFGNLGLLFCVGISYGLAKDKKTEVALVSVMCFIMFLGANHSWLEHTHGLAEKINGEYYGTGQTQLLGFVVVDMGVFLGIILGCTIAWVHNKVSAIELPGALSMYGGAKLTLVAMTPVVIFYAIAFTWIWPFMTHGISALTGFMKNAGVAGVFVYGFFEKFLIPTGLHHFVWSPFQLTQIGGTLNVDGQVVSGTQAIFLAYMRHPDLTPVMNDALRFSQQGMTTIFGLAGASLAFYHTAKPEKKAMAKAILLPAIITSMLTGITEPIEFTFLFVSPLLWVIHATLTAASQAICDIFTVRPWGASGLIEFLIYNLPLPVSLTRWPGYVLIGIGQFAVYYVIFRTLVVKLNLKTPGREDDENVKLYSKAEYRQKVAQPQSVTDDIIRGLGGKENILSVDNCFTRLRVAVRDMARVDDTQLKNTGANGVVRNRNEVQVIYGVKVGQVRSRVDNWLAEN

SEQ ID NO: 10517 - protein, 335 aa, Klebsiella pneumoniae
RLLLSGAIMDCTVKNDNTGKVAIIFPQNGRIMDRLSAMALLVKVTELGSMSAAARALNMPLTTVSRHIGELESALGVRLLARTTRKLTLTDAGVDYVAAARRILEEVENAERQATGEYQEPKGELVISAPTMFGRQHVLPVISEFIARYPLIRVRLLLSDRNADLVSDHVDLAVRIGDLADSSMVATRLGTMRIVACAHPALLAKYGEPQRPRDLAALPIIRIESPMPYRGWRFRAAEREDQLINLPPVLSVTTPESAADAARLGVGVARLLHYQALDGLRHGELRLLLENVEPDSAPVHLLYTARDLAPLKLRKFIDFAAPALRQALLRIAGAA

SEQ ID NO: 10518 - protein, 127 aa, Klebsiella pneumoniae
KRDPAPGETAAAAGGGAPQAAADGCAVPQYRCFPPPRWERKRRRQSPARPGSARPQPEPPPPWRPPRGPFWSAPRSASAFRSTAGSPGVRGFAPSPRHRRPPPAAHGQYPPPPPACWTKTFRARERQ

SEQ ID NO: 10519 - protein, 460 aa, Klebsiella pneumoniae
GSHPMNHTNVVDVKAWIDTRPVSRFQWNVLLLCFIIIMLDGYDAAVMGFVAPALIEDWGISRAEMGPILGAAMFGVAIGALVAGPLSDRYGRKRILLWSVALFALFSLAGAVAQSPTQLALMRFLTGLGLGAVMPNCVTLVAEYMPERRKGVMITLMYSGFNVGSGLGGFIAAGLLSHYSWHSALVFGGVLPLVVLPFMIVMLPESAMNMVARRLPGEQIARALNRLGGQFTAETVFQLNAPPITRSSKVAQLFRHGYARGTIALWLTYFMGLFVIYLLNGWLPTILRSGGLSLQQAAMMTGLFQLGGPLGGILVGMLMDRASAKAVIAATYFLGCLCLLSQGVMDFGSAALSVLIFISGMCINGAQNGLQAYSPAYYQTEIRATGVSWMHGIGRTGAILSSTLGGMLMLAVPGHSSIFLVLALPACLAGICILLHRMNHAKPRLTEAELDALSSPLEHR

SEQ ID NO: 10520 - protein, 816 aa, Klebsiella pneumoniae
RINPRLNERETLMSNSYDSSSIKVLKGLDAVRKRPGMHIGDTDDGTGLHHMVFEVVDNAIDEALAGYCKDIVVTIHSDNSVSVQDDGRGIPTGIHPEEGVSAAEVIMTVLHAGGKFDDNSYKVSGGLHGVGVSVVNALSQKLELVIQRDNKVHKQMYEHGVPQAPLAVTGETDKTGTMVRFWPSLETFTNVTEFEYDILAKRLRELSFLNSGVSIRLRDKRDGKEDHFHYEGGIKAFVEYLNKNKTPIHPNIFYFSTEKDGIGVEVALQWNDGFQENIYCFTNNIPQRDGGTHLAGFRAAMTRTLNAYMDKEGYSKKAKVSATGDDAREGLIAVVSVKVPDPKFSSQTKDKLVSSEVKSAVEQQMNELLSEYLLENPSDAKIVVGKIIDAARAREAARRAREMTRRKGALDLAGLPGKLADCQERDPALSELYLVEGDSAGGSAKQGRNRKNQAILPLKGKILNVEKARFDKMLSSQEVATLITALGCGIGRDEYNPDKLRYHSIIIMTDADVDGSHIRTLLLTFFYRQMPEIVERGHVYIAQPPLYKVKKGKQEQYIKDDEAMDQYQISIALDGATLHTNANAPALAGEPLEKLVAEFNATQKMIGRMERRFPKALLKELIYQPTLTEADLADEQKVTRWVNTLVSELNEKEQHGSQWKFDLHENKELQHFEPVIRVRTHGVDTDYPLDNEFIMGPEYRRICALGEKLRGLMEEDAYIERGERRQPVASFEQALDWLVKESRRGLSIQRYKGLGEMNPDQLWETTMDPDSRRMLRVTVKDAIAADQLFTTLMGDAVEPRRAFIEENALKAANIDI

SEQ ID NO: 10521 - protein, 365 aa, Klebsiella pneumoniae
RPGPKNADMSLTRLLIKDFRNIESADLALSPGFNFLVGANGSGKTSVLEAIYTLGHGRAFRSLQIGRVIRHEQDAFVLHGRLQGEERETAIGLTKDKQGDSKVRIDGTDGHKVAELAHLMPMQLITPEGFTLLNGGPKYRRAFLDWGCFHNEAGFFTAWSNLKRLVKQRNAALRQVSRYAQLRPWDLELIPLAEQISRWRAEYSAAIVEDMADTCQQFLPEFTLTFSFQRGWEKETDYAEVLERNFERDRMLTYTAHGPHKADFRIRADGAPVEDTLSRGQLKLLMCALRLAQGEFLTRVSGRRCLYLIDDFASELDDARRGLLSSRLKATQSQVFVSAISAEHVMDMSDKNSKMFRVEKGKITD

SEQ ID NO: 10522 - protein, 239 aa, Klebsiella pneumoniae
LKSPVTETSFMNSKRYERICEMLARRQPDLTVCMEQVHKPHNVSAVIRTADAVGVHEVHAVWPSSRMRTMASAAAGSNSWVQVKTHRTIADAVGHLKGQGMQILATHLSDKAIDFREIDYTRPTCVLMGQEKTGITHEALALADQDIIIPMIGMVQSLNVSVASALILYEAQRQRQNAGMYQRANSMLPPQEQQRLLFEGGYPVLARVARQKGLPYPHVNEQGEVEADAAWWATMQAAR

SEQ ID NO: 10523 - protein, 302 aa, Klebsiella pneumoniae
RQPPPSFTHCSPLLHHLAESLRQNAASRDGSFFALRSAFQDLRLIAATAGEFRKTAGKMKETAAKSVTMTASRRGDVYNRLVCRTSFDNHIQKTLMAQGTLYIVSAPSGAGKSSLIQALLKTQPLYDTQVSVSHTTRAPRPGEVHGEHYFFVNHDEFRSMIGENAFLEHAEVFGNYYGTSRKAIEQVLATGVDVFLDIDWQGAQQIRKSMPGARSIFILPPSKDELDRRLRGRGQDSEEVIAKRMAQAVAEMSHYAEYDYLIVNDDFDTALSDLKNIIRAERLRMSRQKQRHGALITKLLAD

SEQ ID NO: 10524 - protein, 83 aa, Klebsiella pneumoniae
KSPPPIPGRPPKPWRTASPRSSSSSSPASTICSTSAPPAAPTARSASPSPLSRGPTRTPPRCRYKTKCSRRNRGCRAKSSSPA

SEQ ID NO: 10525 - protein, 402 aa, Klebsiella pneumoniae
TYPPGDRARPLQGIVMARVSLSWALILGLLSGIGPLCTDFYLPALPEITQQLQATSTQTQLSLTAALIGLGLGQLFFGPLSDRIGRLKPLALSLLLFIFSSAMCAQTRDINMLIVWRFLQGFAGAGGSVLSRSIARDKYQGTLLTQFFALLMTVNGIAPVLSPVLGGYVITAFDWRILFWTMAAIGGVLLVMSLAILRETRPATAAHASRQRPGQPVLKNRRFLRFCLIQAFMMAGLFSYIGSSSFVMQSEYGMSAMQFSLLFGLNGIGLIIAAMIFSRLARRFSAESLLRGGLTLAVSCAAIMLLFAWLHLPMLALVGLFFTVSLMSGISTVAGAEAMSAVDAAQSGTASALMGTLMFVFGGIAAPLAGLGGETMLKMSLAMAICYLLALLLGLSKPRDAR

SEQ ID NO: 10526 - protein, 174 aa, Klebsiella pneumoniae
SQPPPGRSTPGRRRASSRSPIARGPPPAATPDVSRRGSSAAAAPGRAVDAACRETASKSAPPAPPLSASQAPAYAAVNREHNSDGYRTSLPPRHSSPDSARWRAKSSPTAERCRTPPPAPGRTSRGYRRQCPRGGPSPPRSASAARCAPCWRASRTPGRSSGVPRWRPSAARSR

SEQ ID NO: 10527 - protein, 206 aa, Klebsiella pneumoniae
SPQPLPTNLSPPNSSSQPIIFIQTLRYFVSRKPVTLARWPRAVTNRNRRAIMTPELRHCFSITIQVDKPIIVSRSPQTGKRQLIPIVGGSVSGQLRGHVLPGGVDSQIIEPDGTCRLSARYALQVAEGTVYVENNGIRRVPAQYHDQLFADDMRFFSDIPPEAIYFRTVPTFEVDAPALSWLTTSLFICAGGRTQDGVMLDFYQVG

SEQ ID NO: 10528 - protein, 495 aa, Klebsiella pneumoniae
RLRPAAGVESAGVRPDRHARARDRPGRHTDDLLHPRYPGVRQSTAALRLRGSPMFAFLKAPPDAAPISDKRELDARYRYWRRHILLTIWLGYALFYFTRKSFNAAVPEILASNVLTRSDIGLLATLFYITYGLSKFFSGIVSDRSDARYFMGLGLIATGVVNILFGFSSSLWAFALLWALNAFFQGWGSPVCARLLTAWYSRTERGGWWALWNTAHNVGGALIPMVVGAAALHYGWRAGMTIAGCLAILAGLYLCWRLRDRPQAVGLPAVGDWRHDALEIAQQQEGAGMSRKAILTRYVLANPYIWLLSLCYVLVYVVRAAINDWGNLYMSETLSVDLVTANSAVTMFELGGFIGALVAGWGSDKLFNGNRGPVNLIFAAGILLSVGGLWLMPFASYVMQAACFFTTGFFVFGPQMLIGMAAAECSHKEAAGAATGFVGLFAYLGASLSGWPLAQVMDIWHWTGFFVVIAIAAGISALLLLPFLNAQAPRTASEA

SEQ ID NO: 10529 - protein, 473 aa, Klebsiella pneumoniae
RFEFIKLVSVTGDFNHVRHDADFAHDIRQMHAVARGQADKGAVYAAIFLFRIQALDIGRRGVDRRRQVSQRALVVKHVHLDFGDELLSGLFIPLNRHKFLRLFLVAANVTTGFMVDNQPFTRADVGDNRVTWNWTTALGEGDQHAIGAFDWQMTVVRRVSRYRRRSGFALLQVFCHHDAHGVAQTDFRQQIVKRGQLHAIEFALDILRWDLGEFAASAQRVIEQTTAKADRIVALKVFQQLTDLGARFRADDKVQPGGVRASARRGDNFDSLTAGERLRQRIGLTVDARADAGMTDIGMHRVGEVHRRGAGRQFDNAPFRGENVNLIGEQIGFYALDKFKRATGALLQLQQALHPALSADLRGGAAFAAVLFISPVRRYPHLRHLVHVFGTNLYLDRDAVGADHRGVQRLIAVSFRNGDVVFKTTRTRFVEAVHLAEHAIADVGIMDDNAEGVDIHDRVKTLLFEHHFTVDGV

SEQ ID NO: 10530 - protein, 183 aa, Klebsiella pneumoniae
QQELTMSRLADIREQDATGKAADIFAGIKKAMGKVPNAYLTIGGHSPAALQQALAHNAMLHKGSLSAQQLEAINLSVSEATGCDYCLAAHTLMAKKAGFSSEQIHALRRGEYAEEAQLDALVKFAQTLVTTTGTLPEADVAALRNAGFSDQQVIEIISAISAILFTNMVNRVNDTVVDFPKAD

SEQ ID NO: 10531 - protein, 108 aa, Klebsiella pneumoniae
IINTSGIHMIELEDAVMEIIVNAGQSRSLCFEALHAARIGNIDEARLLLNEADGYARRAHQMQTQLIGQDAGEARQPMTLIMVHAQDHLMNSLLAREFSEELIHLYQR

SEQ ID NO: 10532 - protein, 75 aa, Klebsiella pneumoniae
RRCTVLTSPSRSSLRPGQYHPRVDGTRSLEQGLSALPDGIYAQVAVYSDHFAHVSVMRKVLLRMTSWMHYLYLDH

SEQ ID NO: 10533 - protein, 123 aa, Klebsiella pneumoniae
FCTTIASPRLYGGNWVTSVSPIRIRPPAGCTKPAIARSTVVFPEPEGPISASTSPGSMVNDSGFKTTLPWYETRSESRVIPDVPASDGEEVTVVFINIRLTRYRSLYASGQCQPTAIRRHRPS

SEQ ID NO: 10534 - protein, 140 aa, Klebsiella pneumoniae
STTTLSKPPLANTTAPSPPPICRKRIASWKPDAPSARSCWRGFKMISLIAVLKAKPGQTDALRQALQALLLPTRQEPGNLDYALFQLRDAPDTFYMREAWQGQDALDAHVAMPYFQAFMTQMESLLAEPLRLDFLTPVEP

SEQ ID NO: 10535 - protein, 475 aa, Klebsiella pneumoniae
MDRTRCSPAKRSASRERSFNNAIASEPRLKHPADVQRIQLLVFGVVDLRGMLVVHLAAGDVEAQHRAELRPHADGDVLRQRQLPAVVIPALVVVHALVARFQPGGVHVVPEVHRPHDGTVVFTVVGVVLAVVVVVEGQQIFHLRLLGELMAALEAGVDRGQVVGFVVDAVIRVVGVAQDHLVHPAVVGVAQHQAALPGFEARVAVHRLRVKAVVGVHLDVDRPGLDVVGFGGQRVVAVVAGVGAAGTGDARRVGFIGHHFRATGFHLRHRRHVELHAADIKVLHPGALAVVVHPEVVVDPLLRTLVEVAAGPDIGVGVGFQHVGDPDVGLLQVNFVAPVVEHHVKIPDSPLRAFEGLADLEFAAVAFVAQTADRRGAVIGAVDADIFLVAGLEVGAIAGVAAELEAERNGHIRRGGGGFRVSNHVDLFVGRGVDFCLAVGQRFINGFGDDGIDLFLRKFLRHDRNWAQRGDHRHG

SEQ ID NO: 10536 - protein, 266 aa, Klebsiella pneumoniae
PERFPDYGALRLIRATFLCLAAANGNTSNPIAVLEGVVDAIEMLIHIHRRLVALRLADDTRRYARRGGVRRNRLQYHRTGANLRATPDFNIAEDLRPGANHYAFANFRMTVAAGFTGPAEGDRLQNRDVIFNHRRFADHNAGGMVEHDPAADFRRRVDIHLERDGDLILQENRQRASPLSPQPVADTIGLQGMETLQIEQRRGVFIHRRVARAHRLNIAGGGGDHFRIGGVGLFHHFANGDRRHNRGSQLVGQHIAQRAAEIFMLE

SEQ ID NO: 10537 - protein, 463 aa, Klebsiella pneumoniae
SEITMNTVKKLPLAMAVVAALCPISVMAQEFTQEQIDAIVAKAVDKALADRQAKIDAAANKKVDVITNPETTAASPDMAIPFGLKFSGYARYGAHFQTGDQKYVGVDGSYNGASAIGRLGNESNGGEFQISKAFKSAQGAIWDLNVMFDHWSDEVNLKKAYVGVTNVLESNPNAYIWAGRDFHQRPQQGINDYFWMNHDGQGAGVKNFDIGGVQFDVAAVSQVKSCSPEVMADETNPSRITCTGSSDTGDNGHYALTTKTHNIKAGPIDVEVYANYGFDSKAVDSDARLEAWQGGLVLSHTNDSGVNKVILRYSDNSDNSVYNKTDDLTTVYASFEGSHKFTQQAQVEYLLAFHDYDNGKDNTDNRKNYGAIVRPMYFWNDVHSTWLEAGYQRVDYDQGGDNHGWKLTLSQNIAIGMGPEFRPMLRFYVTGGQVDNEHTAKVNNTKDQQLDSLNVGGMFEAWF

SEQ ID NO: 10538 - protein, 648 aa, Klebsiella pneumoniae
KRKTCVCINSAYFSTQQVPNERNPDRFDPTKNRASRGGRRVCGGRRRQCAVGSGTTRIPNPAGANRAGFFVGEPPGKVGPEEKDWSMASSGTTSNTMRFTGAQLVVHLLERQGITMVSGIPGGSILPIYDALSQSTQIRHILARHEQGAGFIAQGMARTEGKPAVCMACSGPGATNLVTAIADARLDSIPLVCITGQVPASMIGTDAFQEVDTYGISIPITKHNYLVRDIAELPQVISDAFRIAQSGRPGPVWIDIPKDVQSATIELEALPEPGERAPAPAFAPESVREAAAMINAAKRPVLYLGGGVINAPQAIRELAEKANLPTTMTLMALGMLPKAHPLSLGMLGMHGARSTNFILQEADLLIVLGARFDDRAIGKTEQFCPNAKIIHVDIDRAELGKIKQPHVAIQGDVAEVLAQLNPHIEAQPREEWRQLVADLQREFPCAIPQESDPLSHYGLINAVAACVDDEAIITTDVGQHQMWTAQAYPLNRPRQWLTSGGLGTMGFGLPAAIGAALANPQRKVICFSGDGSLMMNIQEMATAAENQLDVKIILLNNEALGLVHQQQSLFYQQGVFAATYPGMINFMQIAAGFGLQTCDLNNEVDPQAALQAIIDRPGPALIHVRIDAQQKVYPMVPPGAANTEMVGE

SEQ ID NO: 10539 - protein, 483 aa, Klebsiella pneumoniae
SGKTPVLSVYAGAWDAVICVLSVIATRDRPKTRCFRQRDSFTRAKCLEFARQNRERINSLELLYTTLLYLIQPLVWLRLLLRSRKAPAYRKRWAERYGFCQNKVEPDGILLHSVSVGETLAAIPLVRALRHRYPSLPITVTTMTPTGSERAMSAFGKDVHHVYLPYDLPGAMNRFLNTVQPKLVIVMETELWPNMVAALHKRKIPLVIANARLSERSAKGYAKLGGFMRRLLSRITLIAAQNEEDGNRFLSLGLKRNQLAVTGSLKFDISVTPELAARAVTLRRQWAPHRKVWIATSTHDGEEQIILQAHKKLLETFPNLLLILVPRHPERFPDAREMVQKAGMSFTLRSTGEIPSSSTQVVIGDTMGELMLLYGIADLAFVGGSLVERGGHNPLEPAAHAIPVLMGPHTFNFKDICAKLQQDDGLITVTDADSLVREVSTLLTDEDYRLWYGRHAVEVLHQNQGALSRLLQLLQPYLPQRSH

SEQ ID NO: 10540 - protein, 369 aa, Klebsiella pneumoniae
QLRTNIILFMNIYHRLMLVTLPFASVQICAAAEPTAPLEPAYAYHGAEPADLPAPESRQPAAAASSSLLPLLGDEARKRGYVLPLPFGVSINYMDMRQNINVDSINFTGLSLDGRNIDCGKDPVCKHAVNNIFANGPVSLDNAFQIGVGHTRESSKTETLKLDAWLLPFMNVYGLVGHTEGHSISQIAVGLKGPNGKVVPLPGMQDLDFRLDFKGTTYGMGTTLVGGVGNWFTVLDANYTQTRFDILDGSIDALTFSPRVGYRFSTPSVDALHLPAGKLNLWVGSMYQDVQQEFKGSLSDLSMPSPMLQNMVNLANQDNNGRFDVKQHLQSPWNVLVGAQYELTQNFNITTEFGFAERNSFFIAGEYRF

SEQ ID NO: 10541 - protein, 554 aa, Klebsiella pneumoniae
YQRTLTMDSQRNLLIIALLFVSFMIWQAWEQDKNPQPQQQTTQTTTTAAGSAADQGVPASGQGKLITVKTDVLELTINTNGGDIEQALLLAYPKTLKSTEPFQLLETTPQFVYQAQNGLTGRDGPDNPANGPRPLYNVDKEAFVLADGQDELVIPLTYTDKAGNVFTKTFTLKRGGYAVNVGYSVQNASEKPLEVSTFGQLKQTAALPTSRDTQTGGLSTMHTFRGAAFSTADSKYEKYKFDTILDNENLNVSTKNGWVAMLQQYFTTAWVPRNNGTNNFYTANLGNGVVAIGYKSQPVLVQPGQTDKLQSTLWVGPAIQDKMAAVAPHLDLTVDYGWLWFISQPLFKLLKFIHSFLGNWGFSIIVITFIVRGIMYPLTKAQYTSMAKMRMLQPKIQAMRERLGDDKQRQSQEMMALYKAEKVNPLGGCFPLIIQMPIFLALYYMLSASVELRHAPFILWIHDLSAQDPYYILPIIMGATMFFIQKMSPTTVTDPMQQKIMTFMPVIFTVFFLWFPSGLVVYYIVSNLVTIIQQQLIYRGLEKRGLHSREKKKS

SEQ ID NO: 10542 - protein, 404 aa, Klebsiella pneumoniae
RGMTGVRAGTLSMFEKRHRITLLFNANKAYDRQVVEGVGEYLQASQLEWDIFIEEDFRARIENIKEWLGDGVIADYDDPEIEKLLADVHVPIVGVGGSYHQPEQYPPVHYIATDNAALVESAFLHLKEKGVHRFAFYGLPASSGKRWAVEREYAFCQLVAKEKYRGVVYQGLETAPENWQHAQNRLADWLQTLPPQTGIIAVTDARARHVLQACELLHIPVPEKLCVIGIDNEELTRYLSRVALSSVAQGTRQMGYQAAKLLHRLLNNEALPLQRQLIPPMRVVERRSTDYRSLNDPSVIQAMHYIRNNACKGIKVEQVLDAVGISRSNLEKRFKEEVGETIHTVIHSEKLEKARSLLVSTSLSINEISQMCGYPSLQYFYSVFKKEYDVTPKEYRDRHSEVML

SEQ ID NO: 10543 - protein, 98 aa, Klebsiella pneumoniae
CPMTLSCSSTDFENDSDFRPSRARCWLRFRWCRSIRCVYRLLITCSFPFRRDSYSGQPSVIHITTSKGDSRLIRRPSVAIVRSPNTCATTVFRSLSYA

SEQ ID NO: 10544 - protein, 116 aa, Klebsiella pneumoniae
PLTTQAGSHGFHVEPVTLGTKLIRQAWRSIALFCVTECFPDDVITDKAELLTPVYLITTLMPDVPATTGNLKYTAHGFDTELSLMFFDENILHFRRFAKYVAAFWRMASSSSRSAS

SEQ ID NO: 10545 - protein, 216 aa, Klebsiella pneumoniae
WRQTTGGAMAATFLDIAITPDVMDVQHEMGSDSLWQTPRSRRQADRFGDSEAGMIATRDSFYLATVSQSGWPYIQHRGGPPGFLHLLDDTTLAMADFGGNRQYITTGNLRGSDRACLFLMDYPRRARLKIYATVEVLAAEDHPQLLAQVTPANYRARIERLFLFHLQAFDWNCPQHITPRYSAQQVAEYSQNLQQRIHDLEQENQRLQQQLARRGE

SEQ ID NO: 10546 - protein, 321 aa, Klebsiella pneumoniae
GEGTMKLTDVAIVAVEGFSPFHYAVPCMLFGDSVSEIKRFNLHICAERPGLLRARDGFALYATGDYAALEQADIVVVPYWGEVDRRPPQALLDSLVRARDNGAEIVGLCLGAFVLGYAGLLDGRRAATHWEFEQDFQRRFPQVQLDINALYVDDQRIITSAGTAAALDCCLYIIRQRFGSLAANQIARRMIVSPHREGGQAQFIAQPVPKNTRDARINCLLDYLQQHIAEPHSLDSLARVVAMSRRTLTRHFARATGMSITDWLTAERLRRSQTLLEAGDLPVEQVAEAVGYLSAVTWRQQFKARFGVSPTEWRRTFRRGA

SEQ ID NO: 10547 - protein, 352 aa, Klebsiella pneumoniae
RAFAALRAIFLHNEWIMKRELAIEFSRVTEAAALAGYKWLGRGDKNTADGAAVNAMRIMLNLVNIDGTIVIGEGEIDEAPMLYIGEKVGTGKGDAVDIAVDPIEGTRMTAMGQANALAVMAVGDKGCFLNAPDMYMEKLIVGPGAKGAIDLNLPLEENLHNIARALNKPLGELTVTVLAKPRHDAVIAQLQQLGVRVFAIPDGDVAASILTCMPDSEVDVLYGIGGAPEGVVSAAVIRALDGDMQGRLLARHHVKGDNEENRRIGENELARCKTMGIEAGKVLRLDEMARSDNVVFSATGITKGDLLDGITRKGNMATTETLLIRGKSRTIRRIQSIHYLDRKDPDIQQHIL

SEQ ID NO: 10548 - protein, 228 aa, Klebsiella pneumoniae
LLSADADRRPGGDCGIRSLLRGADGRGARPEQHGGEYSVYSADPGGVLRGVVCRPPQQAFPDPDVAVGDLLPAGGSDDVDPRAAGHHDRLDPAGACGAVLLRRRDVVPAGHQRRDGAVPVPRRNRRGAGGRLAEYRLRRAGLAVGDDAANRSGQPRPADDADGPIDSAVLAAAGLALHPPSAAGISAAAVPRMAADALSGLPDWSSAGPRMRSAVILPGGGSRLTRPP

SEQ ID NO: 10549 - protein, 226 aa, Klebsiella pneumoniae
IKPAERPGGAAKRRSSPISPVPPATCYASISISTACRCISSIPQGLRDANDEVERIGIERAWQEIAQPDRVLFMVDGTTTSAVDPAEIWPDFIERLPAKLPITVVRNKADVTGEALGISEVNGHSLIRLSARTGEGVEVLRNHLKQSMGFDTNMEGGFLARRRHLQALEEAANHLQQGKAQLLGAWAGELLAEELRLAQQALSEITGEFTSDDLLGRIFSSFCIGK

SEQ ID NO: 10550 - protein, 532 aa, Klebsiella pneumoniae
RPAAGRHFHPAGYHCCGVFMTWLLEMKNITKTFGAVKAVDNVSLRLNAGEVVSLCGENGSGKSTLMKVLCGIYPHGSYEGEIIFAGETLQANHIRDTERKGIAIIHQELALVKHLTVLENIFLGAEISRHGLLDYETMTLRCQKLLAQVNLPISPDTRVGDLGLGQQQLVEIAKALNKQVRLLILDEPTASLTEQETATLLAIVRDLQNHDIACIYISHKLNEVKAISDTICVIRDGQHIGTRDASGMSEDDIITMMVGRELTALYPSEPHAHGEEILRVEHLTAWHPVNRHIKRVNDVSFSLRRGEILGIAGLVGAGRTEAVQCLFGVWPGRWQGEIFIDGQPVSISNCQQAIAHGIAMVPEDRKKDGIVPVMAVGKNITLAALNQFTGAMSSLDDAAEQHCIQQSIQRLKIKTSSPELAIGRLSGGNQQKAILARCLLLNPRILILDEPTRGIDIGAKYEIYKLINQLVQQGIAVIVISSELPEVLGLSDRVLVMHEGRLKANLVNQHLTQEQVMEAALRSERHVEEHVV

SEQ ID NO: 10551 - protein, 320 aa, Klebsiella pneumoniae
SMAATKPAFTPPGKKGDMIFSALVKLAALIVLLMLGGIIVSLIISSWPSIQKFGFAFLWTKEWDAPNEIFGALVPIYGTLVTSFIALLIAVPVSFGIALFLTELSPAWLKRPLGIAIELLAAIPSIVYGMWGLFIFAPLFATYFQEPVGNVLSTIPFVGALFAGPAFGIGILAAGVILAIMIIPYIAAVMRDVFEQTPVMMKESAYGIGCTTWEVIWRIVLPFTKNGVIGGVMLGLGRALGETMAVTFIIGNTYQLDSISLYMPGNSITSALANEFAEAETGLHVAALMELGLILFVITFIVLAASKFMIMRLAKNEGAR

SEQ ID NO: 10552 - protein, 95 aa, Klebsiella pneumoniae
NIDAPNIFPHPAVKDCAEKLSPKRGVAGRQLRNKMDSGEPLLTKLRIERLRLMAMMRLHHDSLKGSVMLLAGGMSERQIRRTSCHDISLMNKTIG

SEQ ID NO: 10553 - protein, 469 aa, Klebsiella pneumoniae
GNSAHMKDHILSVKEKIGYGMGDAASHIIFDNVMLYMMFFYTDIFGIPAGFVGTMFLLARALDAISDPCMGLLADRTRSRWGKFRPWILFGAIPFGLVCVLAYSSPDLSHNGKLIYAAVTYTLLTLLYTVVNIPYCALGGVITDNPTQRISLQSWRFVLATAGGMLSTVLMMPLVNFIGGEDKALGFQGGIAVLSMIAFLMLAFCFFTTKERVEAPPSSTSMREDLRDIWRNDQWRVVGVLTILNILAVCVRGGAMMYYTTWIMGSAALFTAFLTTYCVGNLIGSALAKPLTDWKCKVSVFWWTNALLAVLSVAMFFVPMDAEITMFVFIFVIGVLHQLVTPIQWVMMSDTVDYGEWCNGKRLTGISFAGTLFVLKLGLALGGALIGWMLAGGGYDAAAKTQNSATLTIIIALFTLVPAVCYLLSAVIAKRYYTLKTPFLKKMMAELAEGARRNEQEFTAAPIDKEWQN

SEQ ID NO: 10554 - protein, 485 aa, Klebsiella pneumoniae
SAGALLRHAVGDIALLSNGRWSAAADPLRSVPQRHSRSDGLRSAGDHHHRLRRGGVYRRRPQWLRLRRSGYPGATAGGNGPARARAGLCARRSRPRAHYGLHQRATLNPAAFSLSGSGELTMRILFVIDGLPGGGAEKVVLTLAAQFLRDGDRVSLISLRDVCEYPLPEGLDYQVVADRCRKPWRKLTELSRRARQLDAAVVRAEQQGQFDLVLSNLHKTDRIVARSRALRERNVWFCLHGVFSASYLGHRTGFDRWMKQQKIKRIYQGRNVVTVSDAVGRDLVEEFALRPAQLKTIYNPFDITALRVEAEADSERPDGDYLIHVGRFHPGKRHDRLLEAYAQSGIDAPLVLLGQGKPEQEQRLRQLAKTLHIDDRVWFKGFQKNPLPWIKGARMLVLSSDSEGFGNVVVEALLLHTPVASTRCPGGVTEILTGELARGLADLTSPALAQTMQSIYHNPPAIDDAALEKFSVVSICQQYRQLQRT

SEQ ID NO: 10555 - protein, 244 aa, Klebsiella pneumoniae
EEPAMDVENIFRDVKLSKTEMTVLRFIQNDPEQCIRQGVRAVAEQCYSNPSSLVRLAKKLKFSGWLELVYFIKFNITMPKLDVTNDIDYMSVQPEEALTPLLASLNQQRILIHGSGFSQLIAQYIYNKFLVTGVNASLALWPDYEILEQKNAACFDSIWIISKSGRSSSALNWVKALEGKEINLVCFTGDYQSPLAQAADTAFIIHDPQKFDDDIYWSNPFFGYCILGFERLLKMWFTSLRSNS

SEQ ID NO: 10556 - protein, 101 aa, Klebsiella pneumoniae
GGTAYTKHEFLSTPCKFRRGMTMSLEVFEKLESKVQQAIDTITLLQMEIEELKEKNNTLVQEVQSAQHGREELERENSQLKEQQQGWQERLQALLGRMEEV

SEQ ID NO: 10557 - protein, 212 aa, Klebsiella pneumoniae
GVYAAIRRFQAPGHTMTTIALIDDHLIVRSGFAQLLGLEADFQVVAEFGSGREALTGLPGRGVQVCICDISMPDISGLELLSQLPKGMAIIMLSVHDSPALIEQALNAGARGFLSKRCSPDELIAAVRTVAAGGCYLTPDIAMKLAAGRQDPLTKRERQVAEKLAQGMAVKEIAAELGLSPKTVHVHRANLLEKLGVSNDVELARRMFDSWQ

SEQ ID NO: 10558 - protein, 397 aa, Klebsiella pneumoniae
GANAMSKNTSSEIKLTPTAPAALPALKGLNLQVFVMIAAIVVIMLFFTWVTDGAYLSARNISNLLRQTAITGILAVGMVFVIISAEIDLSVGSMMGLLGGAAAIFDVWLGWPLPLTILVTLVMGLLLGAWNGWWVAYRKVPSFIVTLAGMLAFRGILIGITNGTTVSPTSPAMSQIGQSYLPDGIGFGIGVVGMAVFIVWQWRGRMRRQALGLATSSSTAAVGRQAITAVIVLGAIWLLNDYRGVPTPVLILAALLLAGLFMATRTAFGRRIYAIGGNLEAARLSGINVERTKLAVFAINGLMVAIAGLILSSRLGAGSPSAGNIAELDAIAACVIGGTSLAGGIGSVAGAVMGAFIMSALDNGMSMMDVATFWQYIVKGAILLLAVWMDSATKRRA

SEQ ID NO: 10559 - protein, 581 aa, Klebsiella pneumoniae
LLCARQHTIRLAAVIIPVNNNVIHRDGTMSEIALTVSVLALVAVVGLWIGNVKIRGVGFGIGGVLFGGIIVGHFVDQAGVALSSPMLHFIQEFGLILFVYTIGIQVGPGFFASLRVSGLRLNLFAILIVILGGLVTAVLHKLFNIPLPVVLGIFSGAVTNTPALGAGQQILRDLGVPFEVVDQMGMSYAMAYPFGICGILLTMWLVRLFFRINVEKEAQRFEESSGNGHAHLHTINVRVENPNLNQMAIQDVPMLNSDNIVCSRLKRGELLMVPAPGTLIQAGDLLHLVGRPEDLHNAQLVIGQEVATSLSTRGTDLKVERVVVTNEKVLGKKIRDLHVKQRYDVVISRLNRAGVELVASSSASLQFGDILNLVGRPEAIDAVAAELGNAQQKLQQVQMLPVFIGIGLGVLLGSIPLFIPGFPAALKLGLAGGPLIMALILGRIGSIGKLYWFMPPSANLALRELGIVLFLAVVGLKSGGDFVATLTQGDGLSWIAYGIFITAIPLLTVGILARMLAKMNYLTLCGMLAGSMTDPPALAFANNLHATSGAAALSYATVYPLVMFLRIITPQLLAVLFWGLS

SEQ ID NO: 10560 - protein, 458 aa, Klebsiella pneumoniae
IRCASRPWICRSMCGAKCGSNLSCSPYLVVFIGYLTMYLIRKNFNIAQNDMISTYGLSMTQLGMIGLGFSITYGVGKTLVSYYADGKNTKQFLPFMLILSAICMLGFSASMGAGSTSLFLMIAFYALSGFFQSTGGSCSYSTITKWTPRRKRGTFLGFWNISHNLGGAGAAGVALFGANYLFDGHVIGMFIFPSIIALIVGFIGLRYGSDSPESYGLGTAEELFGEAISEEDKETEENAMTKWQIFVEYVLKNKVIWLLCFSNIFLYVVRIGIDQWSTVYAFQELKLSKEVAIQGFTLFEVGALVGTLLWGWLSDLANGRRALVACIALALIIATLGVYQHASNQYVYLASLFALGFLVFGPQLLIGVAAVGFVPKKAIGAADGIKGTFAYLIGDSFAKLGLGMIADGTPVFGLTGWAGTFAALDAAAVGCICLMAIVAIFEERKIRREKKNRILQTA

SEQ ID NO: 10561 - protein, 400 aa, Klebsiella pneumoniae
TYRAAGSRIRKSVSRGSEMKITNITTYRLPPRWMFLKIETDEGIVGWGEPVIEGRARTVEAAVHEFGDYLIGQDPARINDLWQVMYRGGFYRGGPIMMSAIAGIDQALWDIKGKVLNAPVWQLMGGLVRDKIKAYSWVGGDRPAEVIDGIKKLRGIGFDTFKLNGCEEMGIIDNSRAVDAAVNTVAQIREAFGNEIEFGLDFHGRVSAPMAKVLIKELEPYRPLFIEEPVLAEQAEYYPRLAAQTHIPIAAGERMFSRFEFKRVLEAGGVAILQPDLSHAGGITECYKIAGMAEAYDVGLAPHCPLGPIALAACLHVDFVSHNAVFQEQSMGIHYNKGAELLDFVKNKEDFNMEGGFFKPLMKPGLGVEIDEARVIELSKNAPDWRNPLWRYEDGSVAEW

SEQ ID NO: 10562 - protein, 175 aa, Klebsiella pneumoniae
FLRAFPGGSAYLRTTRKGFTMSEQNSTEMTFQIQRIYTKDISFEAPNAPQVFQKDWQPEVKLDLDTASTQLAEGVYEVVLRVTVTAALGEETAFLCEVQQGGIFSIDGIEGTQMAHCLGAYCPNILFPYARECITSLVSRGTFPQLNLAPVNFDALFMNYLQQQAGEGAEQHQDA

SEQ ID NO: 10563 - protein, 69 aa, Klebsiella pneumoniae
FASASSLISSSSVMTLPVGLVGRETQIIPVSSVTCRCSKSTWYLNWPSGSSSMFGRVATNRSSSRPASA

SEQ ID NO: 10564 - protein, 87 aa, Klebsiella pneumoniae
RRSAASGGTPAPCRWRCSATASASSRGYPRPGRSPRAGSPLPARWSARRSRSTSAARWHRSFYGCRCCPCRCRSRGRPADIPPAPAG

SEQ ID NO: 10565 - protein, 120 aa, Klebsiella pneumoniae; identical to SEQ ID NO: 7255

SEQ ID NO: 10566 - protein, 63 aa, Klebsiella pneumoniae
ISPATRNLHPNAHNAITLPQALVCGRVVDVCLTSAYFQGYFKTWQKSKLRNGIVAKKYFNLWR

SEQ ID NO: 10567 - protein, 190 aa, Klebsiella pneumoniae
QKTALIPFRIKARAGTILAPCGFIPREQRMNQFLIANAQRCIGCRTCEVACAVAHQQAQDVAALSTNHFAPRIRVVKSGDISTAMACRQCEDAPCASVCPQGAIQRDNDVWWVDQRRCIGCKSCMVACPYGAMTVMVMNQQAQALKCDLCAHRAEGPACVAACPTQALRVMVPAELEALCAQKRQRLALA

SEQ ID NO: 10568 - protein, 132 aa, Klebsiella pneumoniae
ANEAPLLTDQITMKEVEKNEIKRLSDRLDAIRHQQAELSLVEAADKYAELEKEKATLETEIERLRSVQSQKLSKEAQKLMSLPFRRAITKKEQADMGKLKKSVRGLVVVHPMTALGREMGLKEMTGFARSEF

SEQ ID NO: 10569 - protein, 193 aa, Klebsiella pneumoniae
SKGAIMSDTLKVVTLLGSLRKGSFNGMVARTLPGIAPAGMDISALPSIGDIPLYDADMQEEEGFPQRVQEIAQQIREADGVVIVTPEYNYSVPGGLKNAIDWLSRLPEQPLSGKPVLIQTSSMGAIGGARCQYHLRQILVFLDAMVMNKPEFMGGVIQNKVDPQAGEVVDQSTLDHLRGQLTAFGDYIRRVKA

SEQ ID NO: 10570 - protein, 477 aa, Klebsiella pneumoniae
FNLAHLKGHLYRLSAHAEFLFNNHTLLTARWGMESQIWVVSTLLISIVLIVLTIVKLKFHPFLALLLASFFVGAMMGMGPLEMVNAIESGIGGTLGFLAAVIGLGTILGKMMEVSGAAERIGLTLQRCRWLSADVIMVLVGLICGITLFVEVGVVLLIPLAFSIAKKTNTSLLKLAIPLCTALMAVHCVVPPHPAALFVANKLGADIGTVIVYGLLVGLIASLVGGPLFLRLLGNRLPFKPVPAEFSNLDVREESTLPSLGATLFTVLLPIGLMLVKTVAELNMAKGGTLYTVLEFIGNPITAMFIAVFVAYYMLGIRRQMGMGVLLTHTENGFGSIANILLIIGAGGALNAILKSSGLADSLAVILSNLDMHPILLAWLVALILHAAVGSATVAMMGATAIVAPMLPLYPGVSPEIIAIAIGSGAIGCTIVTDSLFWLVKQYCGASLSETFKYYTTATFIASLLALAATFLLSFII

SEQ ID NO: 10571 - protein, 479 aa, Klebsiella pneumoniae
RAMAKITKEMIARILAHVGGAANVAQAGNCMTRLRLTLRDESLADSAAIRQIDGVMGVIVSDEQFQVVLGPGKAQTAAEMMNGLLEPAPAAAPTLADVAAEKKQALKGKQTSAVQKFLAKFATIFTPLIPGFIAVGLLLGFATLAEQVFVLENAHPNASLVALIGYMKVFSKGMFTFLSILIGYNAQKAFGGSGVNGAIIASLFVLGYNPEATSGFYAGISTFFGHGIDPRGNIIGVLIAAILGAWVERQVRRVMPANLDMILTSAVTLLIMGAVTFTVIMPIGGWLFTGMSWLFLHLNGNPFGSAVLAGLFLLAVMFGVHQGFVPVYFALVDAQGFNSLFPILAMAGAGQVGAALALFWRAKRDSLLRTQIKGAIIPGFLGIGEPLIYGVTLPRMKPFVTACLGGACGGFFVGLIAWLGLPVGLNTVFGPSGLVALPLMTSGSGIYAGMAVYAGGLAVSYLCGFVLTWLFGSKNVDLS

SEQ ID NO: 10572 - protein, 225 aa, Klebsiella pneumoniae
YGKAMTQPEAVFFDCDGTLVDSEVICSRAYVHMFQEFGITLDLAEIFKRFKGVKLYEIIDTINAEYGVNLQKATLEPIYRAEVARLFDSELEVIPGAQALLDAVSVPMCVVSNGPVSKMQHSLGRTGLLRHFTDRLYSGYDIQRWKPDPALMFHAAEAMQVKAENCILVDDSSAGAQSGIAAGMEVFYFCADPHNQPIDHPKVTTFTDLAELPALWQARGWDITR

SEQ ID NO: 10573 - protein, 119 aa, Klebsiella pneumoniae
MAEAFINILIFLHYVFAYFYLLRTEAVFTFSTLAGSFRVVTIHFFKCAEVWVCAKVLWRKPNVGITKGCALTKTRHIGTQVVYPNILSTVFLLIFVFCGPFSEKQYIGFYAMCVKDTSW

SEQ ID NO: 10574 - protein, 219 aa, Klebsiella pneumoniae
RLRAHYFLKVLTVLNKLSRLLDEAGISLTDHQKNQLVAYVGLLDKWNKAYNLTSVRDPNEMLVRHILDSIIVAPYLQGSRFIDVGTGPGLPGIPLAIVCPESHFTLLDSLGKRVRFLRQVQHELKLDNVTPVQSRVEAFPAEPPFDGVISRAFASLNDMVSWCHHLPAANGHFYALKGLAQKEEMESLPEGYDIVEVIELHVPRLEGERHLVVIKPKSS

SEQ ID NO: 10575 - protein, 477 aa, Klebsiella pneumoniae
YRFYVRVESAVSLSLWQQCLARLQDELPATEFSMWIRPLQAELSDNTLALYAPNRFVLDWVRDKYLNNINGLLNDFCGADAPQLRFEVGAKPASSLQKGAVSPAAAAIPAAQVQTARAAPTIVRPGWDNVPAPAEPTYRSNVNVKHTFDNFVEGKSNQLARAAARQVADNPGGAYNPLFLYGGTGLGKTHLLHAVGNGIVARKPNAKVVYMHSERFVQDMVKALQNNAIEEFKRYYRSVDALLIDDIQFFANKERSQEEFFHTFNALLEGNQQIILTSDRYPKEINGVEDRLKSRFGWGLTVAIEPPELETRVAILMKKADENDIRLPGEVAFFIAKRLRSNVRELEGALNRVIANANFTGRAITIDFVREALRDLLALQEKLVTIDNIQKTVAEYYKIKVADLLSKRRSRSVARPRQMAMALAKELTNHSLPEIGDAFGGRDHTTVLHACRKIEQLREESHDIKEDFSNLIRTLSS

SEQ ID NO: 10576 - protein, 358 aa, Klebsiella pneumoniae
QFLYCRRVSLLSRLFITFLLLMVCPTGSQAEALSREKIDGWLQHLGASDKFDASKGIDWGVMPGPFYTPELGLGIGTAVVGLYRPDPQDTTSQNSTLTLSGYASSTGAFGLNVKNYTFFDRDLWRVFVEGSIANTPTLYRQLIDHVYLGAGWSLAAQNADEMDHDDRPKIENTPQGPSVFSSGASIDINWDDRDFVPNPRRGQYANLRYTHYAPGLGSDTRFEEFQLHYSHYHALSEKSVLAWEADGAFTQGEVPWSMMPLLGSDERMRGYYQGRYRDKNVVSGQLEYRRQLTWRHGIVAWAGAGTMGPSLSSLNNGRWLPSAGVGYRFEFKPRVNVRLDYGIGNGSSGFYFQVGEAF

SEQ ID NO: 10577 - protein, 622 aa, Klebsiella pneumoniae
NPLYGDVVTMIIATAGHVDHGKTTLLQAITGVNADRLPEEKARGMTIDLGYAYWPQPDGRVLGFIDVPGHEKFLSNMLAGVGGIDHALLVVACDDGVMAQTREHLAILQLTGKPTLTVALTKTDRVAAARVAEVQAEVEQTLGELGFDAVAFFPTAAAENIGIAELRSHLLQLAERPRPQQQRFRLALDRAFTVKGAGLVVTGTALSGEVRVGDTLWLTGVNTPMRVRGLHAQNQAVEQAHAGQRIALNIVGDAQKEAVHRGDWLLSSPPPEPAERVIVELQCHTPLSQWQPLHIHHAASHITGRVSLLEGNLAELVLDTPLWLADNDRLVLRDISARLTLAGARVVTLDPPRRGKRKPEYLQWLHALAAVGADDAQALELHLQRDAVRLEHFAWARQLSEAGMAALIQRPDYLQAGQRLLSAPLAARWQRKLLDALARYHEQHRDEPGPGRERLRRIALPMEDEALVLLLIEQMRESGLVHSHHGWLHLPEHKAGFTDEQQAVWQKVETLFGDDPWWVRDLAREVHVEESLMRAVLRQAAQQGMITAIVKDRYYRNDRIVQFAQRVRELDRLRGSTCAADFRDTLNVGRKLAIQILEYFDRIGFTRRRGNDHILRDKALFR

SEQ ID NO: 10578 - protein, 267 aa, Klebsiella pneumoniae
RLYYWPLRLICPCAFRLSPVGQSGDTMDNLNLNKHISGQFNAELEYIRTQVMTMGGLVEQQLSDAITAMHNQDSDLAKRVIDGDKQVNMMEVAIDEACVRIIAKRQPTASDLRLVMAIIKTIAELERIGDVADKICRTALEKFSQQHQPLLVSLESLGRHTVQMLHDVLDAFARMDLDEAVRIYREDKKVDQEYEGIVRQLMTYMMEDSRTIPSVLTALFCARSIERIGDRCQNICEYIFYFVKGQDFRHVGGDELDKLLAGKDPKE

SEQ ID NO: 10579 - protein, 374 aa, Klebsiella pneumoniae
SEHYPRDAMKFTVEREHLLKPLQQVSGPLGGRPTLPILGNLLLQVADGALSLTGTDLEMEMVARVALVQPHEAGATTVPARKFFDICRGLPEGAEIAVQLEGDRMLVRSGRSRFSLSTLPAADFPNLDDWQSEVEFTLPQATMKRLIEATQFSMAHQDVRYYLNGMLFETEGSELRTVATDGHRLAVCSMPLEASLPNHSVIVPRKGVIELMRMLDGGDTPLRVQIGSNNIRAHVGDFIFTSKLVDGRFPDYRRVLPKNPDKHLEAGCDILKQAFARAAILSNEKFRGVRLYVSENQLKITANNPEQEEAEEILDVTYAGTEMEIGFNVSYVLDVLNALKCENVRILLTDSVSSVQIEDAASQSAAYVVMPMRL

SEQ ID NO: 10580 - protein, 312 aa, Klebsiella pneumoniae
DEFYKKDFNMDAIFDRVVREFFPNTTIPFWKKWLFRTAFGNKVFSRLIYNERLVNKNGVEWVNAVVELLELKCESEHHQFNNIPEHGATVVISNHPTVIDGLSLIHTVSRVRSDIKIIANHVLPIIFPQVSELTIGIENMAGKMSHKKFREMNDHLRKGGVLIICPAGKLANWSLSGLQEHKWNPGFLQLAMRNNAALVPIHITGANSKIYYLTATFWRQLSNMMVIREALRHHGKTMKINIGQQIALSSFKEYNKDLSAAANVCLTHLQSIAKNGPAMLDTIAPQELEPGKEELISAIEECEILRQFEDGR

SEQ ID NO: 10581 - protein, 391 aa, Klebsiella pneumoniae
FNSYRRRDRGGEKGTGMSKFRLALVRQKYRPDGGAERFVSRALEALDSSHLQLNVITREWQGPVKPDWQIHICNPRKWGRISRERGFANAARALWQRESFDLVQSHERIPGCDLYRAGDGVHRRWLQQRSRILPAWKSRLLFADRYHRYVMQAEREMYEDSHLRGVICNAEMIKREIIEDFGLPAEKIHVIYNAIDNQRFLPPDEETFAALRAKWQLPLQATCLIYVGSGFERKGLAAAIRAIAPTDRYLLVVGKDKDQPRYQALAKSLNCEARVRFFGMQSETLPFYQMADGLLLPTLYDPFPNVILEAMACGLPVITTTGCGGAEFIVDGHNGYVCDALDIPALQQAVMALPARALGSAQGGHARERIMACTSERLSTQLLSLYQDLVN

SEQ ID NO: 10582 - protein, 309 aa, Klebsiella pneumoniae
HYAYMAIWSSVTTLHTIIITTLQDSIMSQTSTLKGQCIAEFLGTGLLIFFGVGCVAALKVAGASFGQWEISIIWGLGVAMAIYLTAGVSGAHLNPAVTIALWLFACFEGRKVVPFIISQFAGAFCAAALVYGLYYNLFLDYETTHHMIRGSVESLDLAGIFSTYPNPHINFVQAFAVEMVITAILMGVILALTDDGNGIPRGPLAPLLIGLLIAVIGASMGPLTGFAMNPARDIGPKAFAWLAGWGDVAFTGGKDIPYFLVPLCAPVVGAALGAFSYRKLIGRHLPCDTCVEEEQQSPSSSTAQHKASL

SEQ ID NO: 10583 - protein, 120 aa, Klebsiella pneumoniae
TDHYLRVFAPAHIVDGSDYGRRSLMKACWMVCLVTALSATSAWAESPLQSLQFEQQKQQVLKAVKEKCAPASHLSDNDFANKVLATDGNKNAVREATLAKERNNQKSYQAAIDKIVCPAK

SEQ ID NO: 10584 - protein, 262 aa, Klebsiella pneumoniae
LVIYRCNTNRTSPIIDELGRLRERCYHDIGAGTGNDRDNDVFDESYYHIILWDPSDVEILGAYRVMPVGEQLAQHGVTGLYSNSLFKYHDNAYSCLEKCVEIGRGFIQKPYQKSKVLDYLWQGIFDFIKRYPDYKYLLGVLTIPGTFPEKVQKLIISFYNIYFSSTADFCTPIALFTAENVHDDTPFCGEDFRADWSMLNHLLREEGYELPWPFKQSAKWFSPGGSSILAFTKDYSFNSIAGLNLSSIDKLNESYVKHYLRD

SEQ ID NO: 10585 - protein, 95 aa, Klebsiella pneumoniae
PCSLGSVGKIMAPPLSPGSRVLIGLIRVYQRLISPLLGPHCRFTPTCSQYGIEALRRFGVIKGSWLTMKRVLKCHPLHPGGDDPVPPGPFDTREH

SEQ ID NO: 10586 - protein, 334 aa, Klebsiella pneumoniae
KPAYRAAGKQRQHRRYCGQPDSSSPAKSGAALMGSLFKQIYRYTRPRAYRHNENLWPFTRIARAPSGEISALRYKGKTVPLVSLSALKNSMQGEVLLTATGPSTRNIDFSLLSKTIPVMGVNGAWHLADRLHFSLYTIVDMEFFDKKPDIIRAIVSQPDILLFTTMHGIAKIVDRYGDALRCRLALIEDGCYKIYQPKVASEAIKRTYQQNAAMCFHPQRPDICFSTDIRQGIFDAGTVVYWALQILAWLGFNTILVSGLDMTNFNQPRFYETQQEKLPSYLATKVDTLVMPSFAHAAQVLQQRQIRVINFSPESAVPDTIFEKVAFNEYFKSE

SEQ ID NO: 10587 - protein, 430 aa, Klebsiella pneumoniae
NPPLTPHDEKLKTPGISSRVNGSCAHKELFMFHLDTLSTLVAATLVLLLGRKLVQTVPFLKKYTIPEPVAGGLLVALALLALKKSMDIEIDFDMSLKDPLMLAFFATIGLNANLASLRAGGKVLGTFLIVVVGLLLLQNALGIGMATLLGLDPLMGLLAGSITLSGGHGTGAAWSKLFVERYGFANATEVAMACATFGLVLGGLIGGPVARYLVKHSSSPDGTPDDQVAPTAFEKPDVGRVITSLVLIESIALIAICLTLGKVVAQLLAGSVFELPTFVCVLFIGVILSNSLALAGLYRVFDRAVSVLGNVSLSLFLAMALMSLKLWELASLALPMIIILAVQALAMALYAVFVTYRMMGKNYDAAVLAAGHCGFGLGATPTAIANMQAITDRFGPSHMAFLVVPMVGAFFIDIVNALVIKLYLLLPIFG

SEQ ID NO: 10588 - protein, 63 aa, Klebsiella pneumoniae
ARKYLIAKCRPEQPFFPKRYGCIWKKFPYDSVKDSVHIKILFIEFILNDYTSVLSVGQYRIKL

SEQ ID NO: 10589 - protein, 68 aa, Klebsiella pneumoniae
LTEYSVRVNLDNYIKFIILTGGNMSERFEDSPEYDDWIQETGGRDEDYSDYYNQWERRKLIESLRKKN

SEQ ID NO: 10590 - protein, 151 aa, Klebsiella pneumoniae
CLTLRLKGRFIRHATYLKGSRSKNVMSVSLLSRNVARKLLFIQLLAVMASGLLFSLKDPFWGISAVCGGLAVVLPNLMFIIFAWRHQAHTPAKGRVAWTFAFGEAFKVLLTFALLAVALAVLKVVFLPLIVTWVLVLVVQVLAPAVINNKG

SEQ ID NO: 10591 - protein, 312 aa, Klebsiella pneumoniae
IHTYPARNHMQKFDTRTFQGLILTLQDYWARQGCTIVQPLDMEVGAGTSHPMTCLRALGPEPMATAYVQPSRRPTDGRYGENPNRLQHYYQFQVVIKPSPDNIQELYLGSLKELGMDPTIHDIRFVEDNWENPTLGAWGLGWEVWLNGMEVTQFTYFQQVGGLECKPVTGEITYGLERLAMYIQGVDSVYDLVWSDGPLGKTTYGDVFHQNEVEQSTYNFEYADVDFLFTCFEQYEKEAQQLLALETPLPLPAYERILKAAHSFNLLDARKAISVTERQRYILRIRTLTKAVAEAYYASREALGFPMCNKNK

SEQ ID NO: 10592 - protein, 162 aa, Klebsiella pneumoniae
LKRYCAVNMNATILGQAIAFVIFVWFCMKYVWPPLMAAIEKRQKEISDGLASAERAKKDLDLAQANATDQLKKAKAEAQVIIEQANKRRSQILDEAKAEAEQERTKIVAQAQAEIDAERKRAREELRKQVAILAVAGAEKIIERSVDEAANSDIVDKLVAEL

SEQ ID NO: 10593 - protein, 447 aa, Klebsiella pneumoniae
SDGYHYRKHYDYAMFKSRPLFFYFSFLRPEKMSVAAGNKNHLIRLIAVVLTGILAGLSGMVLALILHAIQHLAFGYSYGQIVGSVSFLQGVTESSWPRRIVAIVAGGAVAGFGWWLLGRYGQRRVSIAAAVANPCVPMPAGTTTIHALLQIVTVALGSPLGREVAPREMGALGARMVVRKLRLLEDETRTLIACGAGAGLAAVYNVPLAGALFSLEVMLLSFSWEKTLAAMMTSAIAAWTATLGLGDESQYHFVSSVLPHTFLWWAILAGPILGTGAWLFRKATSAARSRARSNWQMPVFCLLGFSLLAILSLYFPELPGNGKGPMQLALSDGLPLSMVAVLLVLKMVVILAVLRGGAEGGLLTPGLAVGGLVSLLLCALWQLGFPGGDKSSFAVVGAAAFLAASMQMPLTAVALVMEFTHMDHSYLAPALLCAAGAFLTCRVLDKK

SEQ ID NO: 10594 - protein, 396 aa, Klebsiella pneumoniae
RFHLIPLLGDDAQLFADAGKGFHRTLNLFRGMRRRHLGANTRLAFRYHRIEEAGDIDPFFLQLAGKVLRHHRLTQHHRNDGVVGAGQREACRGHFFAEQTRVSPQAIAQVCPLFNHLQHFDGGGHDGRRQRVGEQIRTGALAQPLNHLFARGGVAAGGAAQRFTQRAGDDIDAPHHIAVFVGAAAVFADEADGVGVIDHHQRIVFIRQVANALQVGDHAIHREHAVGGDQHVTRAGLASFFQTRLQLLHIVVGIAEALRFTQTHAVDDRGMVQGVGDNGVFRAEQRFKQAAVGVETGGVEDRVFHTEEIGQLLLQLLMRILGAADEAYRGHPETVAVHAGFRRGNQFRVVRQTQIVIGAEVNHVAVADGNVRLLRRGDDALFFEQPFGPSGLQIAS

SEQ ID NO: 10595 - protein, 682 aa, Klebsiella pneumoniae
RAFHRFLPAAVTIVTLSSFNTRAEFALNHRFLLQFIQILPETDRQTGQIGRAQRRHFAYFRTLDTGAEDIGLELHQEVVSHRAAVYAQGVQTNAGVSLHRFQHVAGLKGDGLQRRTDNVVGVHAAGEAENRAAGIRVPVRCAKTGERGYHVYAVGILHFGGEVLGVEGIADELHLVAQPLNRRAGHKHRPFQSVVHLAARAAGDGGQQTVGGGDRFFAGIHQHKAAGAVGVFRHPFFDAQLAEQGRLLVTGDPGDRNTGPAFTTDVGLAVHFGRLAHFRQHGARNVQRVEHLVVPVEVVDVEQHGTRGVGVVGDVHAALGHLPDKPGVNGAEQQLAALRTLTGTFDMVEDPFHLGAGEVRVHHQACGLADILFHPVTLELLADLRGTAALPDDSVVDGFTGLSLPHHHGLTLIGDADGRDLIGVDIRFGQRFDQRRALGSPDFHRVVFDPAWLRINLFKFSLGDADDIGIMIHHNGPGAGSALVKRNDIFFVGHSRCPVVRLQRSFMLSGGRGGALLLFLHAGVARQVTANQLTIAECAQRRADHRCAQRHQEIRNIFAASEGDVTPPRQPGEGFRADVTRRVHGEAGQRSHGGANHRNQQANQQRGQRAARYAVAIVGQRQDDAHQDSGNHHLYREGLHKIDVRVRVSGENAGQIEAFHAAANHMVGGFIIEEKIVVKPVN

SEQ ID NO: 10596 - protein, 280 aa, Klebsiella pneumoniae
PDLHLHGGADHHAAGLRFNLDDPVIVMPKRLADDVARRVRALIEEQQLEAGMRLPAERQLAAQLGVSRNSLREALAMLVNEGVLLSRRGGGTFVRFQHEPWSEQNIVQPLKTLLADDPDYSFDILEARHAIEASTAWHAAMRATDADKEKIRLCFEATQSEDPDIASQADVRFHLAIAEASHNVVLLQTMRGFFDLLHSSVKQSRQRMYQVPPVFARLTEQHQAVMEAIVAGDAEAARQAMMGHLGFVHATIKRFDEDQARQARITRLPGDHNENSRENS

SEQ ID NO: 10597 - protein, 316 aa, Klebsiella pneumoniae
VLLQFRAIALAVAGSLALAAPAFAGKLSIVIDDFGYRPQTENQVLALPATISVAVLPNAPHAREMATKAHNQGHEVLIHLPMAPLSKQPLEKDTLRPEMSSEEIERIIREAYGKVPYAVGLNNHMGSAMTSNLFGMQKVMQALERYNLYFLDSVTIGNTQAMRAAQGTGVKVIKRKVFLDDTQNEADIRNQFNRAIALARRNGSAIAIGHPHPTTVRVLQQMVYNLPPDITLVRPSSLLNEPQVDNSTPNYAQPPAQQTQQKPRNPFHGVKSCKPKRPLEPVNASRFFTILSDSISQSALIQYYRLKWQGWDNPGN

SEQ ID NO: 10598 - protein, 109 aa, Klebsiella pneumoniae
THIQYHAQSFLHLWSILSMARVTVQDAVEKIGNRFDLVLVAARRARQMQVGGKDPLVPEENDKTTVIALREIEEGLINNQILDVRERQEQQEQEAAELQAVTAIAEGRR

SEQ ID NO: 10599 - protein, 578 aa, Klebsiella pneumoniae
ASPQCLAACPKTDRQTLPGLGCFEGIEDAFQLAFDFVVIATGLVNLLHQRSVITVDVSQQSGFEATDFRQFYISQVTTFCCEQNQRLLRDGHRRILFLFQQLGHFLTVVQLFAGCIVKVGCKLGERRQFTILRQRGTDTTGQFLHDLGLRCTTNTGYGDTRVNRRTNTGVKQVGFQEDLTIGNRDYVGRNECGNVTRLRFDNRQRGQRTGFPFHFTFGEGFNVFGVNTRSTLQQTRVEVEYVARERFTSRRTTEQQGDLAISNSLFRQIIVNDQRIFTAVAEVFAHCATSVWRQVLQCSRFRCSRYHYDGVSQRAVLFQFTHHVRDGGRFLTDSDIDALDAGITLVDDGIDSQRSFTGLTVADDQFTLTTTDWDHGVNGFVTGLYRLIDGLTFDYARCDRFNGGETVIFQRTFTINWRAQGVNHAAQQATAYRNFQDTASTFHLHAFGEVSVRTHYHRTYGVALQVQCDSVTVTRQGDHLALHTFGKAVDADNTVTYRNNSTFVMSFAHNIELSNALLDQFADFGGIQLHAPVPLRLQDVCKALKTAAYAAINDHITRTDDNTCHNRLIDFAIQLNFA

SEQ ID NO: 10600 - protein, 277 aa, Klebsiella pneumoniae
RTPHSPGVSPRGDRVHYHDAEGGVRKLMIKATEKSPFFCALSFITPAKGSAQSDNDEKYQRSESMKPYQRQFIEFALSKQVLKFGEFTLKSGRKSPYFFNAGLFNTGRDLALLGRFYAEALVDSGIEFDLLFGPAYKGIPIATTTAVALAEHHDRDLPYCFNRKEAKTHGEGGNLVGSPLQGRVMLVDDVITAGTAIRESMEIIQAQGAQLAGVLISLDRQERGRGEISAIQEVERDYGCQVISIITLKELITYLEEKPEMAEHLASVRAYREAYGV

SEQ ID NO: 10601 - protein, 415 aa, Klebsiella pneumoniae
VSHQGIVMKQVTFAPRHHQLTNINTWTPDSQWLVFDVRPSGASFTGETIERVNVNSGTVETIYRATQGAHVGVVTVHPTQERYVFIHGPERPDAQWQYDFHHRRGVVAFQGAVENLDAMDITPPYTPGALRGGSHVHVYSPNGQFVSFTYNDHVLHERDPALDLRNVGVAAPYGPVTPQGQHPREYGGSHWCVLVSRTTPAPAPGSDEINRAYEEGWVGNHTLAFIGDTLAENGDKVPELFIVDLPQDEAGWKQPGGAPLAGTATTMPAPPAGVSQRRLTFTHHRRYPGLVNVPRHWVRANPQATAIAFLMRDDAGVVQLWLISPQGGEPRQLTHHASGIQSAFNWHPSGEWLGFALEDRIACCHAGTGDITFLTDTHAHAPSADAIVFSPDGKQIAWMEEVDGYRQLWVTQTGR

SEQ ID NO: 10602 - protein, 94 aa, Klebsiella pneumoniae
GFSHPLGDKPPGLLLRPQAESNVIFHLHMRKQRVVLHHHRQPAFVRRQLGDVSIADQDPPASRLHKTGNRPQHRGFPGTGRANQRQHLTGLNGQ

SEQ ID NO: 10603 - protein, 581 aa, Klebsiella pneumoniae
KIAHCLRHLLDRQIARLKQSLAAAQTFGGQPVGNAHPGCPGEVAGQGTAAHRHHPGQRIETVRLGNMLLQIIQQAVDSRIAGVFRHRLGDKLRLAALAVRRNNHPPGDLVGREAAETLADDVEATVQRRRGARRSNDPLVVDVQGVDIQLHLRKPALEILLELPVSRRSPAVQQPGVAEDERAEAQADNLRAVIPGPHQAIKQRLRRTSIDLAPVRHHHDIRLFQRGIIAGGVQRKTIAGAQQPRPLGANVQIKAFDFRNRIAKQHAGDGVVKRAKALYSDNRHVGEFHRPFPLRMLINDGFSILRDRNHIGNLIIQRILAHLFPAHQTVVDRLEVDSHDFCFRQGEVHVQEIFLAHDNRAKADDVGVAGVEDHHVRAQLQQVGCNVIAPDSIPHQPQRLLLRMAKHHAAGLAQAFSHRRHRVGAVAAVLAGGGFQQTHAGKFAVCRQQAQILKSLAAQQRGVGLMLDEHRQGFRDRGDRCRVPVIVMGVGDDHRVNVDNFIAGKRQLNQRIAQFAARGARKTRPGAFVRQHRIDEKSFPGVVNNLGRITDVGDVHVGVPLGSSDEHRTESPPGSTGAFGQ

SEQ ID NO: 10604 - protein, 259 aa, Klebsiella pneumoniae
AFCHEIRIMRPHIRFKPEISIMRPAGRSANQVRPVTLTRNYTKHAEGSVLVEFGDTKVLCTASIDEGVPRFLKGQGQGWITAEYGMLPRSTHTRNAREAAKGKQGGRTMEIQRLIARALRAAVDLKALGEFTITLDCDVLQADGGTRTASITGACVALADALNKLVAAGKLKTNPMKGMVAAVSVGIVNGEAICDLEYIEDSAAETDMNVVMTEDGRIIEVQGTAEGEPFTHEELLTLLALARGGIESIITTQKAALEN

SEQ ID NO: 10605 - protein, 214 aa, Klebsiella pneumoniae
PARHYLGGSMLLHVLYLIGITAEAMTGALAAGRRRMDTFGVIIIATATALGGGSVRDILLGHYPLGWVKHPEYVIIVAVAAVLTTIAAPVMPHLRRLFLVLDALGLIVFSIIGAQIALNMGEGPVIASIAAVITGVFGGVLRDMFCKRIPLVFQKELYAGISFAAAVLYIALQHYVSSHDVVVLATLLFGFTARMLALRWKLGLPVFHYTHDAH

SEQ ID NO: 10606 - protein, 305 aa, Klebsiella pneumoniae
GTGHSPKGRDILREAPEMKYVFIEKHQAEFSIKAMCRVLQVTRSGWYIWHQRRYQVNRRQQFRLVCDNVVREAFSDAKQRYGAPRLTDELRAQGYRFNVKTVAASLRRQGLRAKASRKFSPVSYREHGLPVSENLLKQDFYASGPNQKWVGDITYLRTGEGWLYLAVVIDLWSRSVIGWSMSSRMTAQLACDALQMALWRRKRPENVIVHTDRGGQYCSTDYRSLLKRHNLRGSMSARGCCYDNACAESFFHTLKVECIHGEDFVSREIMRTAVFNYIECDYNRWRRHSACGGLSPEQFENQNLA

SEQ ID NO: 10607 - protein, 367 aa, Klebsiella pneumoniae
PAGHRRCRAGKIQRRIHLSAVPSAAAHLTPLVNQDRRFMSQTPLLSIVAAVYNGEKFLAQFFECIEQQQLDSYELILVNDGSTDNSLAVIAEWQERLQNVQVLEQENQGVSVARNTGLAAASGKYLAFPDIDDKLYPGMYRTLLEMAEKEHLDIATCNGTYVYEKRRESHPIFPLDRLPSTDVLPGHVWLKQALDSRKFLHVTWLNIYRHDFIRQHHFHFEPGLRHQDIPWTTEALLAAERVQYTSQQFYDYYIHSESVSHKPDNDDTLMRSARHYMKILEMLEAINQRYPDKVRHIAACRWQIAKEGLGIIHTFDSMKDESKKHVIINEFFDRGIWRLIWKNACTFRLRWRLGRRYLRIKRYRHAG

SEQ ID NO: 10608 - protein, 83 aa, Klebsiella pneumoniae
CLIHEVADTLQILNAESRAGNYRFLFCRYEISFNVQIMTAIVFYSCTLLLLHWTVSDKAAQRRLDIIFASWRTFVDSLNGGVK

SEQ ID NO: 10609 - protein, 239 aa, Klebsiella pneumoniae
SSTHRAQGLSMTLNKTDRIVISLGKQIVSGKYVPGSALPAEAELCEEFETSRNIIREVFRSLMAKRLIEMKRYRGAFVAPRNQWNYLDTEVLQWVLENDYDPRLISAMSEVRNLVEPAIARWAAERATSSDLAEIESALNDMIANNQNRDAFNEADIRYHEAVLQSVHNPVLQQLSVAISSLQRAVFERTWMGDEGNMPKTLQEHKALFDAIRHQDSDAAEQAALTMIASSTRRLKEIT

SEQ ID NO: 10610 - protein, 292 aa, Klebsiella pneumoniae
ANTQGEARMVRQRQADLLLIAATVIAACGWIFSREAIAGMPVFAFLGLRFFFAALLLLPFCRGFRPQKQHWPKLIISGLWFALNLCLWIYSVSTTASLGEGAFIMSLSMMFVPLTAWVMMKVRPPRAWWECLPIAVVGLGLLSLHMPIAFHPSQGWFLLTALVQSIWFCYTSRCAREVPLIPLTTVQLAITGIVGLTISAAVERWDQPMTLPTLGWLVASIVIATSLRFGLQMKGQKYAAVASAAIIMVLEPLLTVIAAALWYGEQLPLQKIIGGVLILVAQLWFRWRMLKP

SEQ ID NO: 10611 - protein, 317 aa, Klebsiella pneumoniae
TGGLRLTFLSYRLRRSMDSLSHLLALLAPRCEVNLHCRFGGRWQAGHQQMRSGVVPWHVVLRGEGRLNVGGQTHHLRAGDVVLLPHGSPHLMESLVEWGQVLPVAHRFNGTVTEMRAGPAEGALEMLCGEFYFGPHVSWLFSEASTLIHLHTDAREDCPELDALLNILVRESLAQRPGGSAIVRSLGDTLLVLLLRMLLGEQQPPGGLLRLMSDERLMPAVLAVMATPEQPWTLESMAARAFLSRATFARHFARVYHLTPQAWLSQLRMALAARLLRLERQTNLEVIAERCGFQSLASFSKRFKMRYGVTPGEWRRG

SEQ ID NO: 10612 - protein, 441 aa, Klebsiella pneumoniae
KKRQETGMSLWLTHPLFLPSLIVGVTIVLWATSLLPEFITALLFFAAAMMAKIAPPEVIFGGFASSAFWLVFSGFVLGIAIRKTGLADRAAQALSARLTDSWPRMVASVVLLSYALAFVMPSNMGRIALLMPIVAAMARRAGIADGSRGWFGLALAVGFGTFQLSATILPANVPNLVMSGAAEGSYGIHLNYVPYLLLHTPVLGWLKGAVLVALICWLFPGKPHPPRDLAPLPPMSRDEKRLAWLLAVVLSLWVTESWHGVGPAWTGLAAAVITLLPRVGFINGEEFASGVNMRTCIYVAGILGLAIAVTQTGIGGAVGNALLQVMPLDKDNPFTSFLALTGITSALNFIMTANGVPALYTTFAQSFADATGFPLLSVIMIQVLGYSTPLLPYQASPIVVAMGLGKVPARAGMQLCLALAAVSYLVLLPLDYAWYQLLGKL

SEQ ID NO: 10613 - protein, 398 aa, Klebsiella pneumoniae
LNGHNERGTTMKRHAIYFALALAGAAFTLQAAPLPAMPDPSLPVSHFITQVNADKSITYRLFAPDARRVSIVTGATPDSFVSHDMTKAADGVWTWKSEPMKPNLYEYYFDVDGFRSVDTGSRYQKPQRQVNTSLILVPGSILDDREVAHGDLRTLTYHSKALNAERRLYVWTPPGYSGTGDPLPVLYFYHGFGDSGLSAIDQGRIPQIMDNLLAEGKIKPMLVVVPDTETDIPEAVAENFPPQERRKTFYPLNAQAADKELMQDIIPLIDARFNVRKDADGRALAGLSQGGYQALVSGMNHLESFGWLATFSGVTTTTVPNAGVEAQLKQPDAINKQLRNFTVVVGEKDSVTGKDIAGLKSELEKQQIKFDYHQYPGLNHEMDVWRPAYAEFVQKLFK

SEQ ID NO: 10614 - protein, 145 aa, Klebsiella pneumoniae
PPMQEIMQFIGRHPVLSIAWIALLGAVVFTTFKGLMSKVKVITRGEATRLINKEDAVVVDLRQRDDFRKGHIAGAINLLPSDIKANNVGELEKHKSQPIIVVDGSGMQAQEPASALNKAGFEKVFVLKEGIAGWSGENLPLVRGK

SEQ ID NO: 10615 - protein, 507 aa, Klebsiella pneumoniae
PAPQPGCSVRATLSRGARLRRGSMYIGIDLGTSGVKAILLNEQGEVVASHTEKLTVSRPHPLWSEQDPEQWWLATDTAMKALGAQHSLRDVKALGIAGQMHGATLLDKSLQVLRPAILWNDGRCAEECQLLEDKVSASRQITGNLMMPGFTAPKLLWVQRHEAAVFSQVDKVLLPKDYLRLRMTGELASDMSDAAGTMWLDVARRDWSDEMLAACDLSRDAMPALFEGSDVTGQLRPEVAQAWNMPPALVVGGGGDNAAGAVGVGMADAGQAMLSLGTSGVYFAVSEGFLSKPESAVHSFCHALPGRWHLMSVMLSAASCLDWAAKLTGLASVPALIAAAQTADESAGPVWFLPYLSGERTPHNNPQAKGVFFGLTHQHGPAELARAVLEGVGYALADGMDVVHACGIKPQSITLIGGGARSAYWRQMLADISGLQLDYRTGGDVGPALGAARLAQLAVHDEADRPGLLKPLPLEQAHRPDDRRVAHYAPQRETFRQIYQQLKPLMS

SEQ ID NO: 10616 - protein, 297 aa, Klebsiella pneumoniae
GRPQGIEEKLMAGAKEIRSKIASVQNTQKITKAMEMVAASKMRKSQERMAASRPYADTMRKVIGHLANGNLEYKHPYLEERDVKRVGYLVVSTDRGLCGGLNINLFKKLLAEMKAWSDKGVQCDLAMIGSKGVSFFNSVGGNVVAQVTGMGDNPSLSELIGPVKVMLQAYDEGRLDKLYVVSNKFINTMSQVPTITQLLPLPASEDADLKRKSWDYLYEPDPKALLDTLLRRYVESQVYQGVVENLASEQAARMVAMKAATDNGGSLIKELQLVYNKARQASITQELTEIVSGAAAV

SEQ ID NO: 10617 - protein, 139 aa, Klebsiella pneumoniae
AGTQNGRYPRGERGQRELNDVMAELGMTEGFDVGLEMSGAPPAFRSMLDTMNHGGRIAMLGIPPSDMSIDWTKVIFKGLFIKGIYGREMFETWYKMAALIQSGLDLSPIITHRFGIDDFQKGFDAMRSGQSGKVVLSWE

SEQ ID NO: 10618 - protein, 120 aa, Klebsiella pneumoniae
AMAQAVEMVARLTSSPRSVPSAAQASSLSRPRATFSRWRSSSCSDCCAPGRAFSRTSAWAASITPSASASSWRILRAALGSAGIIGGATPSSSRYWAMTGESNQHSPSSVTSAGTLPSGL

SEQ ID NO: 10619 - protein, 236 aa, Klebsiella pneumoniae
AHQHHQQAEAALTGLRHHRRQPGQHAGADILQAAHQRPGGSGEERERLHRAAGGQREQHPGAEEEQRRRHQQGPDGHDAQQPWDPHHQTRQQAADHRLPHQGRETLVGAAGKPRPEERRRDRQNKQNTHRHAAQAEHRAHQHPGAGFEYRNPRQAADQHQQIAVKGAVAEQRFVAGQKFGARRPFRARFRHPLRHAEGHPGAQDQQESVAGAPAPQGVEDAAEQRGNQRADQNTHI

SEQ ID NO: 10620 - protein, 188 aa, Klebsiella pneumoniae
QAQQILSFNHFAHHCRPDAARGEADNTVHVADGGDDFFVGDDNPAAAARQAQLGQAHTQHDVRIPQRSGVAKDNARERHAVGVINHQRDPVLIRQRIQFDQLFISDDVAGRVGGARDADHPGLFRHLQMLKINMVLKLAFRQQFDVRPGGNEQILFQTGIGVADVFRRQWEQYLTGGAICPTACKQIK

SEQ ID NO: 10621 - protein, 270 aa, Klebsiella pneumoniae
SQFNFVTIMLKLSVCLLTCNSARLLMEVLPPLLKVADECIVVDSGSTDETVAICQQFGLTVHHHAYKAHGAQMNYAIGLASHDWVLCMDSDEILDNDVVTAIQALKAGEEPDPTCAWRLPRYWFVLGKQVRTIYPISSPDYPVRLFNRQQARFNDRPVDDQVVGHASSVRLPGFVRHDTFYSLHEVFNKLNSYTTRLVKYQQIKPSLTRGIVSAIGAFFKWYLFSGAWRYGKVGVVTGLYATFYSFLKYFKAWYAHEDNQAPVAQKRTDP

SEQ ID NO: 10622 - protein, 594 aa, Klebsiella pneumoniae
HLINHSLSSTLIPLIGRANFTFGGIGNERRLSPPLLAARWRPCMNLWQQNYDPAGNIWLSSLIASLPILFFFFALIKLKLKGYIAATWTVAIALVVALLFYKMPVDRALASVVYGFFYGLWPIAWIIIAAVFVYKISVKTGQFDIIRSSILSITPDQRLQMLIVGFSFGAFLEGAAGFGAPVAITAALLVGLGFNPLYAAGLCLIVNTAPVAFGAMGIPILVAGQVTGIDSFAIGQMVGRQLPFLTIIVLFWIMAIMDGWRGIKETWPAVIVAGGSFAIAQYLSSNFLGPELPDIISSLVSLVCLTLFLKRWQPVRIFRFGDLGASQVDMTLARTRYTAGQVIRAWSPFLFLTATVTLWSVPPFKALFAPGGAMYDFVINISVPFLDKMVARMPPVVSAATPYAAVYKFDWLSATGTAILFAALLSIVWLRMKPKDALTTFAGTLKDLALPIYSIGMVLAFAFISNYSGLSSTLALALAHTGHAFTFFSPFLGWLGVFLTGSDTSSNALFAALQATAAQQIGVSDILLVAANTTGGVTGKMISPQSIAIACAAVGLVGKESDLFRFTVKHSLIFTCMVGLITTLQAYVLTWMIP

SEQ ID NO: 10623 - protein, 387 aa, Klebsiella pneumoniae
LKVNTMKALHFGAGNIGRGFIGKLLADAGIELTFADVNQTVLDALNARHSYQVHVVGENEQVDTVSGVNAVSSIGDEVVDLIAEVDLVTTAVGPVVLERIAPAIAKGLAQRKAQGTERPLNIIACENMVRGTTQLKGHVFNALAEEDKAWVEAHIGFVDSAVDRIVPPSASATHDPLEVTVETFSEWIVDKTQFKGALPTIPGMELTDNLMAFVERKLFTLNTGHAITAYLGKLAGHQTIRDAILDEKIRAVVQGAMEESGAVLIKRYAFDPQKHAAYIQKILGRFENPYLKDDVERVGRQPLRKLSAGDRLIKPLLGTLEYGLPHRNLVKGIAAAMHFRSEDDPQAQELAALIADKGPQAALAQISGLDAASDVVAEAVNDYNAEK

SEQ ID NO: 10624 - protein, 110 aa, Klebsiella pneumoniae
QLANKAVEENVVKGVVSVMLVLLLAGCSETVSPPTQKAQRARITPQTTLNMAQLCKDQAAIRYNTQTQLVDVNHFEQFQASYELSGRTGKNERFICSFDPDGQFMHLSMR

SEQ ID NO: 10625 - protein, 63 aa, Klebsiella pneumoniae
HAANTKANAADFDIADPQPNHRHQRQYADRQCYLTHGTVPVNNIIINRDYDRGQADCMLPGAQ

SEQ ID NO: 10626 - protein, 317 aa, Klebsiella pneumoniae
KSANRLMWRLLAMNNLCIDVKNLNKHFGEHHVVKDFSLQVAKGEIYGFLGPNGSGKTTSIRMMCGLITPDSGEGTCLGMDIFTQREKIKKKIGYMTQYFSMWGNLTIRENLLFIARLYSLDRRRERVERALSELGLTARQHQLAKELSGGWKQRMALAACMLHEPVLLFLDEPTAGVDPKARREFWQMLHQLSDRGISLLVSTHYMDEAERCHKVAYLSYGRLLANGTIASIIASQNLITMRTSGAGLTLLESQLQRLPDIEQTVIFGNQLYITSRDEAKLKSALFAFTQQGYEFCKVDTNLEDAFTYLMKNNCEKN

SEQ ID NO: 10627 - protein, 359 aa, Klebsiella pneumoniae
PRNNDLRIPAGDIMNVMRTTVATVVAATLSMSAFSAFAAASLTGAGATFPAPVYAKWADTYQKETGNKVNYQGIGSSGGVKQIIANTVDFGASDAPLADDKLTQEGLFQFPTVIGGVVLAVNLPGVKSGELVLDGKTLGDIYLGKIKKWDDEAIAKLNPGLKLPSQNIAVVRRADGSGTSFVFTSYLSKVNEEWKSKIGAGSTVNWPTGLGGKGNDGIAAFVQRLPGSIGYVEYAYAKQNNLAYTKLVSADGKPVSPTEDNFANAAKGVDWSKSFAQDLTNQKGENAWPITSTTFILVHKATNKPEQTAEVLKFFDWAYKNGGKEANALDYATLPESVVEQVRAAWKTNVKDSSGKALY

SEQ ID NO: 10628 - protein, 221 aa, Klebsiella pneumoniae
LFDKRRASRFNRQQAKKGTTGMKKWTILWLSGLMGLAVGPHALSAESESTTAAAPYLLAGAPSFDQSISQFREKFNADNPKLPLNEFRSIATSRDRANLTRAASKINENLYASTALERGTLKIKSMQITWLPIQGPEQKAARTKALEYMSAMIRAFVPTFSQAQSQQKLQKLLAAGKGKRYFADTEGAVRYVVADHGEKGLTFAIEPIKLALSETLEGNNK

SEQ ID NO: 10629 - protein, 356 aa, Klebsiella pneumoniae
RIRNLMYQTLFSVRLTYPYKKGIVIMKIKNLCLTLCASSLLLASMAGMAKEVKIGMAIDDLRLERWQKDRDIFVNKAESLGAKVFVQSANGNEETQMSQIENMINRGVDVLVIIPYNGQVLSNVIKEAKQEGIKVLAYDRMINNADIDFYISFDNEKVGEMQAQSLVDKVPQGNYFLMGGSPVDNNAKLFRAGQMKVLKPYVDDGKIKIVGDQWVDGWLPENALKIMENALTANNNKIDAVVASNDATAGGAIQALTAQGLAGKVAISGQDADLAGVKRIISGTQTMTVYKPITTLATNAAEIAVELGNDKQPKADTTLNNGLKDVPSRLLTPIEVNKENIDATVIKDGFHKKSEL

SEQ ID NO: 10630 - protein, 459 aa, Klebsiella pneumoniae
LLIKNKNTLCKLPGMVSGFAMPKIWRQIAMDISVTAVKTGRRRYLTLIMIFITVVICYVDRANLAVASAHIQEEFGISKAEMGYVFSAFAWLYTLCQIPGGWFLDRVGSRLTYFIAIFGWSVATLLQGFATGLMSLIGLRAITGIFEAPAFPTNNRMVTSWFPEHERASAVGFYTSGQFVGLAFLTPLLIWIQELLSWHWVFIVTGGIGIIWSLIWFKVYQPPRLTKSISKAELDYIRDGGGLVDGDAPVKKEARQPLSKADWKLVFHRKLVGVYLGQFAVTSTLWFFLTWFPNYLTQEKGITALKAGFMTTVPFLAAFFGVLLSGWLADKLVKKGYSLGVARKTPIICGLLISTCIMGANYTNDPIWIMALMALAFFGNGFASITWSLVSSLAPMRLIGLTGGVFNFVGGLGGITVPLVIGYLAQDYGFGPALVYISVVALIGALSYILLVGDVKRVG

SEQ ID NO: 10631 - protein, 117 aa, Klebsiella pneumoniae
LKVKNWWRFAMTAKNKYKSPAFEAIHSAASGLFSVGAIPQETMRHFDESCLGSVAALQPIEIKALREQLNVSQPVFARYLNTSVSTVQKWETGAKRPSGMSLKLLSVVQKHGLKILL

SEQ ID NO: 10632 - protein, 279 aa, Klebsiella pneumoniae
  UNSURE (70): Identity of amino acid at the above locations are unknown.
LTTKGKGIMASENMTPQDYIGHHLNNLQLDLRTFSLVDPHNHTATFWTLNIDSMFFSVVLGLLFLAMFRXVAKKATSGVPGKFQTFIEMIIGFVHGSVKDMYHGKSKVIAPLALTVFVWVFLMNLMDLLPIDFLPWIGEHILGLPALRVVPSADVNITLSMALGVFILIIFYSIKMKGVGGFVKELTMQPFNHWAFIPVNLILEGVSLLSKPVSLGLRLFGNMYAGELIFILIAGLLPWWSQWVLNVPWAIFHILIITLQAFIFMVLTIVYLSMASEEH

SEQ ID NO: 10633 - protein, 96 aa, Klebsiella pneumoniae
AMQKQCDNVILELTVRNHPGVMTHVCGLFARRAFNVEGILCLPIQGSEHSRIWLLVNDDQRLGQMISQIEKLEDVTKVARNQSDPTMFNKIAVFFE

SEQ ID NO: 10634 - protein, 191 aa, Klebsiella pneumoniae
TAKKIALNPLKSTGRNPFYRCNPLRIRLRGIPDYRGLSTMEGHLILADFQELFTMRNFDLSPLYRSAIGFDRLFNLLENNQSQSNGGYPPYNVELVDENHYRIAIAVAGFAESELEITAQDNLLIVKGAHAAEQKERTYLYQGIAERNFERKFQLAENIHVRGANLVNGLLYIDLERVIPEANKPRRIEIN

SEQ ID NO: 10635 - protein, 515 aa, Klebsiella pneumoniae
VKENMKQETIIQKIWSLCNILRGDGITYYQYVSELSYLLFLKIAQENGSEKLIPKGYRWADLESHEEEGLLGFYQEMLTHLGANVENEVIRAIYAFPTTVFSHSENLKAVIDGISKIEWHQVGKDGFGDLYSGLIDKSAQDTRSGAGQYFTPRSLVNTIVRLIQPSLGELIQDPAIGSGGFLVSADSFIRNKYSHKEYQTNPPKYQGVEIEKNTRRICLMNTFLHRLDANIIYGDALTDDAAELDKADVIVANPPFGNKAGGQRPLRSDIPFPNTNKQLAFLQHIYLGLRAGGRAAVVLPDNVLFESGVGTDVRRDLMNKCNLHTILRLPTGIFYAHGVKTNVLFFTKGTAKNKYQQENCTENVWVYDLRTNMPSFGKRTPFGDADIGFAPQDFGTDPHLGAFEKVYGDNPEGTSKRTEGEYSFGAQEIEVRKDIMQENQDIDERLSHSRWRCFSRKWITDIKGDSLDISWLIDKDSVDAANLPEPDVLAREAKEELETALNELDWLLAALEGAN

SEQ ID NO: 10636 - protein, 77 aa, Klebsiella pneumoniae
APLKLCHDMIGEEAWFEHTLDDETTKAQVAGCGHLLAAIRKRVFMMRLRTMINELDTLVATRHWFCVWCQSHYREIL

SEQ ID NO: 10637 - protein, 241 aa, Klebsiella pneumoniae
VNMKSPSGEMPQYLMIKAQLQARIQNGALKSGDKLPSERELCALFNTTRITVRESLAQLEASGVIYRADRRGWFVTPERLWLDPTQNTNFHKLCLEQGREPKTVLLDGRLAAVPLDVMAPLALQPFDQVYLLTRLRYADGRPVCYCENHCLPARVPELLRHDLNGSLTEIYQTHYDLIYTSMHLSFYPTSMPPQAAEALGVMEGRPALLLRRLNYDQHGRILDYDIEYWRHDSLRIEVDTH

SEQ ID NO: 10638 - protein, 502 aa, Klebsiella pneumoniae
LAMKAVVSRLLSVIGCAFIFAAAWFCLWSISLHLVERADLAVLLFPFGLRLGLMLQCPRGYWPVLLGTEWLLIFWLAQEVALAHPIILMTGSLLTLLPVALISRYRQQRDWLTLLRQGGALMAAALLQSLPWLAEGDEGLNALLLTLTGGLTLAPTCLVFWHYLTSTVWRPLGPALVAQPVNWRGRHLIWYLLLFTISLWLQLGLPAELSRFTPFCLALPIIALAWHYGWQGALIATLMNAIALIASQTWHDHPVDLLLSLLAQSLTGLLLGAGIQRLRELNQSLQSELARNRRLAERLLETEESVRRDVARELHDDIGQTITAIRTQAGIAQRLAPDNASVRQSGQLIEQLSLGVYDSVRRLLGRLRPRQLDDLPLEQAVRSLMREMELEDRGIVSHLDWRINEAGLSENQRVTLFRVCQEGLNNIVKHASASAVTLQGWQQDERLMLVLEDDGCGLPPGSNLQGFGLTGMRERVTALGGTLTISCTHGTRVCVNLPLRYA

SEQ ID NO: 10639 - protein, 258 aa, Klebsiella pneumoniae
QGMKMRRVRYFLLALLVAILAALAGGYYWLHSGNPDALRKIVLQQCVPHQQQQQNPSPCAEMNLKGGYVLFKNRNGPLQYLLMPTYRINGTESPLLLDPLTPNFFWQAWQGREIMSQRHGAPVPDNAVSLAINSRSGRTQNHFHIHISCLRPDVRAQLDKDAAAISSRWLPLPGGLQGHEYLARRVTEAELAQRSPFLMLAEEVPEARQHMGRFALAMAQQSDGSLVLLATERNLLTLNRASAEEIQDHRCAILNANH

SEQ ID NO: 10640 - protein, 61 aa, Klebsiella pneumoniae
TLPKSINPVVIPYISGIPCIPRSIDFNLHQAVFGGAFGGTIPPLKHQHPHNGKNVSYNKGF

SEQ ID NO: 10641 - protein, 285 aa, Klebsiella pneumoniae
FCTKKTMTVRTDRVKRMRLRLRAAAAVMLAGLALVGCDQKGNEAKHIKVGVINGAEQDVAEVAKKVAKEKYGLEVELVGFSGSLLPNESTNAGDLDANVFQHRPFLEQDNKAHNYHLVAVGNTFVFPMAGYSRKIKSVAELKDGATIAIPNDPTNLGRALLLLQKEKLITLKAGTGLLPTAVDITDNPHNLKIMELEGAQLPRVLDDPKVDVAIISTTYLQQTGLSPVRDGIFIEDKNSPYVNIIVTREDNKDAENVKEFMQSYQSPEVAKAAETIFNGGAVPGW

SEQ ID NO: 10642 - protein, 561 aa, Klebsiella pneumoniae
QCQNFVDAGGFRQALNHGFVIQRVSQTGDNLNVLVITSGDADDQTRDFIFFFTEAHAFRVLAEDDAGFQHAVLRFDGAVRYRNGLAEIGRGQFFSVQHRLHIFRLDVAAFHQLLTGEANGFFFGGGFATEEDVIRAQLEQVVVSIVKAVFQAIGDFDFVVDVALGRDQALGQAGVQTAVEEVSQRNMLRLRHLAHCPLGQVAVGDDQVNIRRQVIDCAVGDRDVAQPGILHFLAQYPGAHGAGTHPGVAGDDDFTHMAQVVGDITGRQRAGAFGFRFHVMHTTRCGFDIVFFFNFAGLEQNRRDHEGDRHRCDNRGDVSEVGAFRRHRQYRQDRAWGSRGNQTAIEDSQGEDTGHPAEDNGQDQARVHQYVREVDFMDTTQEVDDSRPACRLFCAAAAKEHVRQQNAHPWTRVSFNQEEDGFTQLVGLLNTQRREDTVVDGVVKEQDFCRFDEDRRQRQHVVRHHKVNASRQNFRQNFDRRADAEEGQNGEDHPDDAGGEVIHQHFKTGFDLTVYPVIEFLDAVAAQRAGNHGAEEHRHIRADDNAHGGDRPDHAATFAAD

SEQ ID NO: 10643 - protein, 89 aa, Klebsiella pneumoniae
GLKKSQKILDYMGSTELAANLFRATQTEEKLRRDAVDSKQLANKTHYDVGQKVRQTIKDLGGTMPEALPSPEKSIQQLTIAAKNKNAPE

SEQ ID NO: 10644 - protein, 840 aa, Klebsiella pneumoniae
RQKKSPIARCDRAYTSCCPGKTRYRETCGLNIDIRRFQGILFDKRATRLNGITHQGGEQLIGSDGILDGHAQHATAVRIHGGFPQLIRVHLAQTFIALDGETATGLFHQPVQGLLEAGYRLTTFAALDVSIFFHQAAQFLAQGTNTTIFRPHNELVIQRIVGIHAVGTYANNRLKMLQFFVLVEIEFPLAAVLFFLVQLGDQGVHPAGHLLLVRQVGLGQGRLIDKLFQQRFREAALHAANHFLGGIELGNQFFQRFARQRRRIGVGVQGRTVERDGDLILIHRFVVFNVLFLLAFLHFVQRRLGNVDVAALNDLRHLTIEEGQQQGTNVRAVDVRIGHDDDAVVAQFIRVVLIAADAAAQRGDKRGYFLRREHFIEAGFLDVKDFTLQRQDSLVLTVTALFRRAARGVPFHQVQFGQRRVALLAIRQFARQACQIQRAFTTSHLTSATCGLTGARGVNNFADHDFRIGWVFQQVFAQQFVHLLLHRRFHLGGDQLVFGLRGEFRIRHLHGYHGNQAFTRIVAGGADFRFFAVALFVHIGVKSTGHRRAEAGEVSTAVTLRNVVGKAVDVFLEAVVPLQGHFNADTVFFGGEIENIRVDRRFVLVEILNERLDAAFVVEMVFFAVALIAQADRDAGVQERQLAQAFRQDVIFKFGDIGEGFQAWPETHHGAGFVGFASHGQRCLRHTVFVHLLVNFVIALDNQLQLLRQGVNHRDAYAVQTAGNFIGVIIEFTASVQDGHDNFRCGDALFRVNAGRDAAAVILDGDGVIAVDGDNDIFAVTRERFVDSVIHNLEYHVVQTGAVIRVADMHTRALTHRIQPFQDFDTGGVIRIRHQRFSLI

SEQ ID NO: 10645 - protein, 265 aa, Klebsiella pneumoniae
PQRNANMNITHIRNATQIIHYAGKRFLIDPMLADKGAWPGFPGTARSELRNPLVELPFSRDKIVDVDAVIVTHTHDDHWDAAAIAAIPKTLPVFVQHEADAALLRSQGFQDLRLLSADSEFAGVRLLKTTSGQHGSDRTYAVPAMAERLGEACGVVFRHPQEKTLWLVGDTIWRDDIAADLLKLRPDVVVLNAGYAHVIGFGPIIMGKEDLLNVHFTLPEAKIMAIHLEAVNHCLVSREEMRQYALDNQIADVVSIPQDGETVVY

SEQ ID NO: 10646 - protein, 96 aa, Klebsiella pneumoniae
LPGKCELNHAGLALLLGNGQTSAAFSTTTCQNLTTIFSSHTSTEAVRTVALQYRRLKSAFHGDFYLNLNKFTDFCVDPNELRTTYASAWVIKEAGL

SEQ ID NO: 10647 - protein, 114 aa, Klebsiella pneumoniae
NPGNEKCPVSSVQRSLIKVNFFHTPRDSKSHRFKSKFISEGLFFPRAKINGTPRLIKRRRAQGAVGRNLTPTRFFEEKEGLGPASRIRLSYGVLGDNLCTLGTKDRSGIVTSRR

SEQ ID NO: 10648 - protein, 397 aa, Klebsiella pneumoniae
LQHLIDTGRKTNFDGQFYLCCDAGQTERLIMSGANPTLFLRCFLTMKITDSMQCDIWYQALLERAVEFTGVFFVGVKTTGVFCISVCRARKPRRENVEFYNDFKSALDAGFRPCKVCRPTENARTAPAFVEQALRLLREAPKVRLSDSELRQHDISPERVRRWFLQNHGITFQAFQRMQRLNMALQELKAGRSTTDVAFDSGYESLSGFGYTCKKLTGFAPSAQRQVVLIHRFTTPLGPMFVCATQRGICLLEFVDRRALESEFSDLQRRFNASIIAGENAHTRQAQQEITEYFAGQRQSFEVALDTPGSEFQRAVWRRLQHVSFGETTHYQSIAMEIGKPTATRAVAAANGANRVAIIIPCHRIIGKDGSMTGYGGGIARKIWLINHEATIREKRG

SEQ ID NO: 10649 - protein, 129 aa, Klebsiella pneumoniae
NPAELAAVGEKYSAGRRRLRRAGAYRRGHGAATGAGRQAGGHGLSADCDAKHSTGSDPASGGLRYDRVSRLRHRQRSLQRLGCRCAGAKNFPVIGFWPGLHQSVESRAAARGSGLCRWRRDAGKPGAVD

SEQ ID NO: 10650 - protein, 174 aa, Klebsiella pneumoniae
YGHEWRWMPGNRPHYGRWPQHDFPPFKKLRPQSVTSRIQPGSDVIVCAEMDEQWGYVGAKSRQRWLFYAYDRLRKTVVAHVFGERTMATLGRLMSLLSPFDVVIWMTDGWPLYESRLKGKLHVISKRYTQRIERHHLNLSQHLARLGRKSLSFSKSVELHDKVIGHYLNIKHYQ

SEQ ID NO: 10651 - protein, 269 aa, Klebsiella pneumoniae
SIFLEKRAQSDIPFSCTRGLLVIYKSIADRLRLRLNSADFAIGSPLPGEKKLAEEFGVARMTIRKAIDLLVDWGLVVRRHGSGTYVARKDVHHETSNLTGLAEVLRKQGKEVVSQVLAFEVMPAPPAIASLLRIKIDERIYFSRRVRYVDGKPLMLEDSYMPVKLFRNLSLSHLEGSKFDYIEKECGIIISGNYETLTPVLADKQLARSMNVPEQTPLLRITSLSYSDSGEFLNYSVMFRNASEYQVDYHLRRVQAQSPLAQSPEQHGE

SEQ ID NO: 10652 - protein, 322 aa, Klebsiella pneumoniae
PAGDHFQICHESVCGVAATGMGRGVDYHPVRLAAEHPGARYLRQEETRLIFCGAATAALNEEEIEMSMVNTAPGKISVRNLNFYYGKFHALKNINLDITKNQVTAFIGPSGCGKSTLLRTFNKMFELYPEQRAEGEILLDGDNILTNTQDIALLRAKVGMVFQKPTPFPMSIYDNIAFGVRLFEKLSRADMDERVQWALTKAALWNETKDKLHQSGYSLSGGQQQRLCIARGIAIRPEVLLLDEPCSALDPISTGRIEELITELKQDYTVVIVTHNMQQAARCSDHTAFMYLGELIEFSNTDDLFTKPAKKQTEDYITGRYG

SEQ ID NO: 10653 - protein, 143 aa, Klebsiella pneumoniae
SEGDMAMTYHLDVVSAEQQMFSGLVEKIQVTGSEGELGIYPGHAPLLTAIKPGMIRIVKQHGHEEFIYLSGGILEVQPGSVTVLADTAIRGQDLDEARALEAKRKAEEHIKSSHGDVDYAQASAELAKAIAKLRVIELTKKAM

SEQ ID NO: 10654 - protein, 65 aa, Klebsiella pneumoniae
SRTDRATQRVEKGEALFTIDPAPYQARVDRLQANLVTTLYCINVPKPQLSEARPIPPACRRNAIA

SEQ ID NO: 10655 - protein, 537 aa, Klebsiella pneumoniae
IHRLSPHGEGLFHDEQRLASHLLRDFHSHQRQHGRGDVGKFAAVDRFDRFITDVDQRNRQIGMGGVRLAGGRVAHLLGVAVVGGDQQLAANGFHRLSHLVDAAIQRFNRFYGCFHHPGMANHIAVRVVTDDGIVFSAFDGGDQFLGQLGGAHFRLQIVGRHFRRVNQDPLFAFKRLFYAAVEEEGDVSVFFSFGDAQLGFIVLRHPLAEGIGQRGGRIGAGDFDVGGVFGEHHEIEINHFLTRKAVEVGVDEGAGDFTRAVGTEVHEDQRVAVFHRGIGLAGGADNGGFHEFVVFVTGVGGLQTRDGGIGLEFAFGQGQQIISLFHAIPAVVAVHGVIAADERRDATFAQRGKFGFECRQRFFRTARRRITAVEEGVQVDLLSAALCRQLHHRHDVIFVAVDAAWRHQAHDMYCFAGGNRFIDRGGQYRVGEEGAFFNFHIETGQVLIDDTTGAQVDVAYFGVPHLTVRQADFEAGCIDQGMWTFGPQRVHYRRFSAINGVILLVFAIAVAIQNHQYHRFFRNRHCDNLMLKDRNFA

SEQ ID NO: 10656 - protein, 398 aa, Klebsiella pneumoniae
KNRLGVSGGIAAYKTPELVRRLRERGAEVRVAMTEAAKAFITPLSLQAVSGYPVSDSLLDPAAEAAMGHIELGKWADLVILAPATADLIARVAAGMANDLVSTICLATPSPVAVVPAMNQQMYRAQATQHNLQTLATRGLLLWGPDSGSQACGDVGPGRMLDPLTIVDMAAQHFASPVKDLQHLNLMITAGPTREPLDPVRYITNHSSGKMGFAIAAAAAQRGANVTLISGPVSLPTPPFVQRIDVTTALEMEAAVQAGAQQQHIFIGCAAVADYRAAVIAEDKIKKQGDELTIKMVKNPDIVAGVAALKSHRPYVVGFAAETNNVEEYARQKRARKNLDLICANDVSQPNQGFNSDSNALHLFWQDGEKRLPLERKELLGQLLLDEIVTRYDEKNRR

SEQ ID NO: 10657 - protein, 159 aa, Klebsiella pneumoniae
SGCDWMRGCMIWIGLATLVVVFVVGFRVLTSDSRRAIRRLSERLGITPVPLESMIDQLGKTAGNEYLRYLERPNEAHLQNAAQVLLIWQVAIVDASEKNLHYWYRLMQKARLAAPITDAQIRLAQGFLRELDPDVSDLHNLQQRYNDLFLPEDGVHWLH

SEQ ID NO: 10658 - protein, 210 aa, Klebsiella pneumoniae
FVGDKEQAMKLIGSYTSPFVRKISVILLEKRIPFEFVNESPYSESNGVARYNPLGKVPALVTDDGECWFDSPVIAQYLELLGVAPPMIPADPRAALRMRQLEALADGVMEAAQALVREKARPGAQQSEQELLRQREKVARGLDRLEACAADGTLRGDEVNLATISTACAIAYLNFRRVAPGWCATRPQLVKLVDALFQRASFARTEPPRT

SEQ ID NO: 10659 - protein, 135 aa, Klebsiella pneumoniae
VLGDVKGPNGLCFSPDEKTLYVVESRATPNRLILAWDVEGNTLKNKRVYLDCGNGTADGIACDADGNLWCGWGSGNEELDGVRIFNPQGKHIGTIKLPERCANLCFGGEQRNRLFMASSTSIYSLYVNAQGAKLI

SEQ ID NO: 10660 - protein, 374 aa, Klebsiella pneumoniae
RVSLMLMKTTVTSSPSLAGTSGITLDSLRVSYHGNVVLKPLSLTIEPGEVLALIGPSGSGKTTVLRAIAGFVQPAGGRILIGDTDVTQLPPYKRGLAMVVQNYALFPHMKVEDNVAFGLRAQKQPRGLIAERVTEALKIVGMADYATRYPHQLSGGQQQRVAIARAIAVRPRVLLLDEPLSALDAQIRHNMVEEIARLHRELPELTILYVTHDQTEALTLADKIGIMKDGSLIAHGETHELYHYPPNRFSAEFLGRANILQATALKDSPEPGLVSVSCGGGLINAFSRGGLHGNNKLLCIRPQHMSLAPRSATSNRLNATLTSVHWQGDLTHLLCDVAGEAVRIVMTHVNPLPRAGDKLALYFEPGDAVLIEVQ

SEQ ID NO: 10661 - protein, 199 aa, Klebsiella pneumoniae
NMAEKQTAKRNRREEILQSLALMLESSDGSQRITTAKLAASVGVSEAALYRHFPSKTRMFDSLIEFIEDSLITRINLILKDEKDTTARLRLIVLLILGFGERNPGLTRILTGHALMFEQDRLQGRINQLFERIEAQLRQVMREKKMREGEGYTLDETLLASQLLAFCEGMLSRFVRSEFKYRPTDDFDARWPLVAAQLQ

SEQ ID NO: 10662 - protein, 440 aa, Klebsiella pneumoniae
NVGLQRGDQPHHAGEDQAMFDGKAEQIRLFAHQAYRGAGDGDRLRGNHLAGNAAGGISRDQQNIGDANLLRRRCLQRGEQGVRRGVRTGQEYPQPAKERREEGKRVAGMGQRQGQRRRQPGIVRDKGERQHHADRVDRQRQILQRPGEGGQRIFRLHAQPDDGQQGGEQNGGAGCRQPVEFIYRGVGRCGANHRRHTGNHFVEEWYRNIDNEVIHRAARSEQRFEWRHAPQGHGGGQEQERRPGADHLSRRVACAGQRHIHLRGAEIAEAEDAYRLPAFEEQGQTDQGDQRRDDIRQLRAKEVRAEVLGNSERTACDYHRRPGLFNAAPAVHNRHDPEQHDNGQERQLAAHHLADGEAIDTGHLAGDQNRDAHRAEGHRRGVDDQAQASRIQRVKPETNQQRGGNRHRCAETRRPFEKGAEREADDQHLQALVRRNRQNR

SEQ ID NO: 10663 - protein, 85 aa, Klebsiella pneumoniae
NKLETVMENLNMDLLYMAAAVMMGLAAIGAAIGIGILGGKFLEGAARQPDLIPLLRTQFFIVMGLVDAIPMIAVGLGLYVMFAVA

SEQ ID NO: 10664 - protein, 149 aa, Klebsiella pneumoniae
KVMENKHATYSPAFHLISWIALIGGIVTYLVGLWNADMQLNEKGYYFAVLVLGLFAAASYQKTVRDKYEAIPTTALYYTTCLVVFVIAVGLLVIGLWNATLLLSEKGFYGLAYFLSLFGAVAVQKNVRDVWDPTRLREPLSVTEEGPET

SEQ ID NO: 10665 - protein, 183 aa, Klebsiella pneumoniae
NSSDDSGSSCNLRGAVNRPPAGARRASRDDLMEEAMPPLLIAATTPDAPGFAALRIESLEQHFNMLRRLAENWQSGKNRFNAPGETLLGAFVNHQLVGVCGINSDPFSPQPRAGRIRHLYISERYRRRGIGQQLLVSVITHSSAWFDFLNTHAPAQAWPFYERLGFRPVYDEPRVTHRLFCSL

SEQ ID NO: 10666 - protein, 214 aa, Klebsiella pneumoniae
CPREKMLQYGIETLTDVELLALFLRVGTRRQDVLSYAQALLQRFGSLYALLSADKAQLIAVDGLGLAKYAQLKGIAELARRYFSSQLVEEAALVTPSMTREFLQSQLTEEEREIFMVILLDNQNRVLKHSRLFSGTLSHVEVHPREIVREAIKVNAAAVILAHNHPSGSPEPSQADRLITERVIKCCRFMEIRVLDHLVIGRGAYVSFAERGWI

SEQ ID NO: 10667 - protein, 313 aa, Klebsiella pneumoniae
FLILRATENNEVSMSIDLSKLLTERRNANSANIDTLSTLEMLTVINQEDQQVAQAITPYLPQIAEVVDKVAAALQAGGRLIYIGAGTSGRLGILDASECPPTFGTRPEQVVGIIAGGHKAILSAVENVEDNKAQGAMDLQNLNFSNRDVLVGLAASGRTPYVIGAMEYAHSQNAFVAIVSCNPHGEMAQLADVAITPVVGPEVVTGSTRLKAGTAQKLVLNMISTGAMIRVGKVYSNLMVDVEATNAKLIERQVSIVMEATDCDRATAQKVLEACGRHCKTAIVMVLADLSAAEAQSLLAKNNGYIRKALSNT

SEQ ID NO: 10668 - protein, 713 aa, Klebsiella pneumoniae
AASLTPFHPPGKTRVRRSSPARRQGTLDKNRSQDLAMKLAALATLFVPGMAFAAWTTTDFPAFTEEGTGRFISQKVVEKGTRPLQLNFDQQCWQPSGGIKLNQMLSMEPCRGTPPQWRIFRQGLYTLEVDTRSGTPTMMISLEEKETSAAAPQIRQCPKWDGKPLTIDVSKTFAEGSKVRDFYSGNVATVSGGKITLQPAFGSNGLLLLERAETAAPAPFDWHNATVYFVLTDRFVNGNPANDNSYGRHKDGMQEIGTFHGGDLQGLTSKLDYLQQMGVNALWISSPLEQIHGWVGGGTKGDFPHYAYHGYYTQDWSKLDANMGTEADLRRLVDEAHKRGIRILFDVVMNHAGYATLADMQEFQFGSLYLQGDELKKTLGERWTDWKPGAGQTWHSFNDYINFSDKAGWEKWWGKKWIRTDIGDYDNPGYDDLTMSLAFLPDLKTESKEVSGLPNFYSHKPDTAAKAIPGYTPRDYLTHWLSQWVRDYGIDGFRVDTAKHVEMDAWQQLKTQATAALAEWKKANPDKALDAAPFWMTGEAWGHGVMQSDYYRHGFDAMINFDYQDQAAKAATCMANIDLTWQQMADKLQSFNVLSYLSSHDTRLFREGGTTAAELLLLAPGAVQIFYGDESSRPFGPTGSDPLQGTRSEMNWQDVNGKAARSVTHWQKIGQFRARHPAIGMGKQTTLSMPRGYGFVRESGEDKVMVIWAGQQQ

SEQ ID NO: 10669 - protein, 139 aa, Klebsiella pneumoniae
LMTLIITKSINPDDQQELFAGLRQYNQQYLDAAQFGDLGIYSRDAQGVMQGGLIAKRKGNWLCIEYLWVSEATRGRGLGSELMQEAEQQAQAQGCSHLLVDTFSFQALPFYQKLGYQLQMSLPDFPHAGMQRHYLSKAL

SEQ ID NO: 10670 - protein, 85 aa, Klebsiella pneumoniae
FDFWRIDMSRVCQVTGKRPVTGNNRSHALNATKRRFLPNLHSHRFWVESEKRFVTLRVSAKGMRVIDKKGIDTVLAELRARGEKY

SEQ ID NO: 10671 - protein, 335 aa, Klebsiella pneumoniae
ALFCYWSSPRRGLRNTMKKPLSSLDLNLLLCLQLLTQELSVTRTAKRMNVSPSAVSKSLAKLRAWFDDPLFVKTPLGLAPTPLVSSMEQDLADWMQMGNQILDKPHHTMPSGLKFELAAEAPLLMILFNTLSQRIYQRYPQALIRLRNWDYDSLDAIIRGEVDIGFCGRESHPQSRELLSLLPWYIDFDVLFTDLPQVWLRADHPALREEWDLAAFLRYPHITICWEQRDTWALDDVLQELGYKRNVALTVPGFEQSLFMAAQPQHTMLATAPRYCQHYNQQHQLPLVSRPLPLEAQHLEKLRVPFTLLWHKRNSYNPKLVWLRDTLKALYSGTL

SEQ ID NO: 10672 - protein, 338 aa, Klebsiella pneumoniae
TMKLSRLALLSLFALTSSPVWADGVVTVYSADGLHDGDNSWYQSQFAAFTKATGIKVQYVEGGSGAIVERLAKERTNPQADVLVTVPPFIQRAAKEQLLATFTPQGSAQIPGANDRYSPLVNNYLTFIYNSQLLKTAPASWQDLLDSRYKNKLQYSTPGQAGDGTAVMLQAFHSLGGKDAGFEYLGKLQANNVGPSASTGKLTALVNKGELYVANGDLQMNLSQMARNPNVKIFWPADDKGERSALALPYTIGLVQNGPNSENGKKLINFLLDKPAQSSVSARSWGLPVRSDVAPDDANFKAAKAALDGVKSWEPNWDDVAVSLSADIARWHKVTDSE

SEQ ID NO: 10673 - protein, 257 aa, Klebsiella pneumoniae
GIAWQQEKTMADWVSGKVTKVEYWTDALFSLYVRAPVHPFTAGQFTKLGLEIDGERVQRAYSYVNAPGNPDLEFYLVTVPEGKLSPRLAALKPGDEVLVVSEAAGFFVLEEVPDCDTLWMLATGTALGPYLSILQEGKDLERFNNLVLVHAVRYAADLSYLPLMRELEQRYAGKLRIQTVVSRETVEGSLTGRVPFLIETGALEEAVGLPMTTDTSHVMLCGNPQMVRDTQQLLKETRQMTKHLRRRPGHMTAEHYW

SEQ ID NO: 10674 - protein, 353 aa, Klebsiella pneumoniae
RRDCQMLMQHIGVGYFGYYRATAYAMKHSLMPEIAKLRMKALNFWDKHGIRAAADAFDVSTRTLYWWRRLLRTGGPEALIPRSKAPLVRRSRHWHPDVLKEIRRLRTELPNLGKEQIFVRLKPWCEARHFTCPSTSTIGRIIAGAHDKMRMIPVRLSARGKARLIKKRSVKPRRPKQYRPVKTGELIGMDAIELRMGDLRRYIITMIDEHSDYALALAVPSLNSDITSHFFSKATKLFPVAIRQVVTDNGKEFLGNFDKTLQEASIKHIWTYPYTPKMNATCERFNRTLREQFIEFNELLLFEDLNLFNQRMAEYLVLYNSKRPHKSLELMTPVDYILRESKNCNMWWTHTQC

SEQ ID NO: 10675 - protein, 398 aa, Klebsiella pneumoniae
IFCCSATFPLTLSRLCLHDNYKSGIDQMVRQMTSRNYLLLTPGPLTTSRTVKEAMLFDSCTWDDDYNLGVVQTIRQQLVQLATPADGYTAVLLQGSGSYAVEAVLGSVIGEQGKVLIVSNGAYGARMIEMAQLMGIACHPYDCGEVSRPDAAAIEQILQNDPAITHIAMVHSETTTGMLNPIEEVAELAKRYDKRYIVDAMSSFGGIPLDIAALNIDYLISSANKCIQGVPGFAFVIAREAELAACKGRSRSLSLDLYAQWRCMEDNHGKWRFTSPTHTVLAFAQALKELAQEGGVSARHQRYRNNQRRLVAGMRALGFRPLLDDSLHSPIITAFYSPDAPQYRFHTFYQKLKDQGFVIYPGKVSQSDCFRIGNIGEVYDADITALLAAIDNAMYWKQ

SEQ ID NO: 10676 - protein, 565 aa, Klebsiella pneumoniae
CIFCGRWRKKAALADPARPGRSLSLIFHGDLNDSAVVKLRKISVFEHEVVAMSVSKKPMVLVILDGYGYREDQQDNAIYSAKTPVMDALWAKRPHTLIDASGLEVGLPDRQMGNSEVGHVNLGAGRIVYQDLTRLDVEIKERTFFANPVLTAAVDKAVAAGKAVHIMGLMSPGGVHSHEDHIMAMVELAAERGAEKIYLHAFLDGRDTPPRSAEKTLATFEAKFAALGKGRIASLIGRYYAMDRDNRWDRVEQAYDLLTLAKGEFQADTAVAGLQAAYARDENDEFVKATVIRAAGQADAAMEDGDALIFMNFRADRAREITRAFVNADFDGFARKKVVNLDFVMLTEYAADIKVACAYPPASLANTFGEWMAKHDKTQLRISETEKYAHVTFFFNGGVEEPFKGEERILINSPKVATYDLQPEMSSAELTEKLVAAIKGGKYDTIICNYPNGDMVGHTGVMEAAVKAVEALDRCIDQVAQAVESVGGQLLITADHGNAEQMRDPATGQAHTAHTNLPVPLIYVGNKAVKAVNGGKLSDIAPTMLSLMGMEIPQEMTGKPLFIVE

SEQ ID NO: 10677 - protein, 66 aa, Klebsiella pneumoniae
YVIWQHYSCPTTSPKPQINMLQKSKLFICIRKWNIAAQRTLSPGLVTKGRVGYDYVSFIQFRCVIS

SEQ ID NO: 10678 - protein, 327 aa, Klebsiella pneumoniae
EHSCPDCLRAPNFKGTVMIIVTGGAGFIGSNIVKALNDKGITDILVVDNLKDGTKFVNLVDLNIADYMDKEDFLIQIMAGEEFGEIEAIFHEGACSSTTEWDGKYMMDNNYQYSKELLHYCLEREIPFLYASSAATYGGRTSDFIESREYEQPLNVYGYSKFLFDEYVRQILPEANSQIVGFRYFNVYGPREGHKGSMASVAFHLNTQLNNGESPKLFEGSDGFKRDFVYVGDVADVNLWFWENGVSGIFNLGTGRAESFQAVADATLAYHKKGSIEYIPFPDKLKGRYQAFTQADLTNLRKAGYDKPFKTVAEGVTEYMAWLNRDA

SEQ ID NO: 10679 - protein, 346 aa, Klebsiella pneumoniae
SSQCYPDLGTLAGRSDASAVRCCRRSGADCDDPREPAAARGGQAGALLRTWRCGSDRGAMMAQTLTLARPARNLRPYLWLALPLLVLATLFFYPLLLIAEQALRDASGNLSLETFWQVIDSKRFIGALLNTLQIAVFATLGCLVLGSVLALILVFIPFPGSQLVSRVIDTFIALPTFLITLAFTFIYGSAGLLNGTLMALFAFELPPVDFLYSINGVILAEITVFTPLVMRPLMAGLRQIDKSQLEAASILGAHPLRVITQVIFPAALPALMAGGSLCLLLTTNEFGIVLFIGAKGVNTLPMMVYSKAILESDYSVACMIALINILLSLGLFMLYRLAAARTGVRS

SEQ ID NO: 10680 - protein, 250 aa, Klebsiella pneumoniae
IAQCAFPLSFPTIQLAEHFTLPQHHPTRRDLMATSRRDLLKIGGLATASLLVSQKSFAAWAPSERYPDPRIVAVDDSFRRYMLASAKVERIASGFRWAEGPVWFGDMRMLLWSDIPNNAIMRWDEVSGETSVFRYPANYSNGHARDRQGRLISCEHDTRRITRTEYDGSVTVLADSYQGHRLNSPNDIVVKSDGTIWFTDPPFGISGFYEGHKATSELPQNVYCLEPESRKLSVSTGRRKRAKWFVFLAG

SEQ ID NO: 10681 - protein, 125 aa, Klebsiella pneumoniae
CCWWCMADKRRARRESDPGLQPERTSLAWFRTLLGYGALMALAIKHSWHRAGLPFWLSIGVLAIVAVILWGYTRRRHLMDVDDSDFLQPRAVRDKFLIALAVLSLAFLFAVTHLQPIVLFIRDMS

SEQ ID NO: 10682 - protein, 286 aa, Klebsiella pneumoniae
KTRCWNAYIRPGDLMISNPIRRYGAAILMLLTCIFSGSVLATTHTATKSHKAPTVKKISSTKVSSKQEYSRNSVKSSSLPDLRKYPSGTPRKKAFLRTVMPYITKQNQAITADRNWLISKQYDARWSPTEKARLKDIASRYKVKWSGNTRHVPWNALLERVDIIPNSMVATMAAAESGWGTSRLARENNNLFGMKCGAGRCRGAMKGYSQFESVEQSVQAYVTNLNTHPAYSSFRKSRLQLRKADQEVTASTMIHKLKGYSTKGSSYNNYLFAMYQDNQRLIAAHL

SEQ ID NO: 10683 - protein, 455 aa, Klebsiella pneumoniae
GMFRLSFMFIALLTAGCVSLDPHYDRPAAPVPATLPGAHGESTAVVGDWQKVVNDARLKKVVSIALNSNRDVQKALADIEAARAQYGETRASLFPTVDAELSHTRSKTVASGLSSASQADGAVSSFELDLFGKNQSLSRAARETWLASEFTAQNTRLTMIADLTTAWVTLATDNSNLALAQQTMDSAANSRNIVARQMAVGTASAGDVSSAESVYQQARASVASYRTLVAQDKNAINLLAGETVPESLLPGTLESLGDNSIALVPAGVSSSVLLRRPDIQEAEHNLKSANADIGAARANFFPSISLTASAGVGSDSLSSLFSHGMQVWSFAPSISLPLFTGGSNLAQLRYAEAEKKGLIATYEKSIQSAFKDVADALARRETLSEELDAQRQYVAAEQTSLDIAMKSYQAGVGDYLSVLTAQRTLWSAKTTLLSLQQTDLNNRITLWQSLGGGAS

SEQ ID NO: 10684 - protein, 479 aa, Klebsiella pneumoniae
HSLLRPWLPGTCAPAAFLQLELFRVSDWLFAASLNMEFSMQTYFDQLDRVRYEGPKSTNPLAFRHYNPDELVLGKRMEDHLRFAACYWHTFCWNGADMFGVGSFDRPWQQPGDALEMAKRKADVAFEFFHKLNVPYYCFHDVDVSPEGASLKEYSNNFARMVEVLAEKQQQSGVKLLWGTANCFTNPRYGAGAATNPDPEVFSWAATQVVTAMNATHQLGGENYVLWGGREGYETLLNTDLRQEREQIGRFMQLVVEHKHKIGFKGTLLIEPKPQEPTKHQYDYDASTVYGFLKQFGLEKEIKLNIEANHATLAGHSFHHEIATAIALGLFGSVDANRGDPQLGWDTDQFPNSVEENALVMYEILKAGGFTTGGLNFDAKVRRQSTDKYDLFYGHIGAMDTMALSLKVAARMIEDGELDKRVARRYAGWNGELGQQILNGQMTLSDIAQYAAQHQLAPQHRSGQQEQLENLVNHYLFDK

SEQ ID NO: 10685 - protein, 169 aa, Klebsiella pneumoniae
QPARRQGADANLQNSQVFTRFLEGENSMRNYDLSPLLRQWIGFDKLASALQTAGESQSFPPYNIEKSDDNHYRITLALAGFRQEDLDIQLEGTRLVVKGTPQQPEKETTWLHQGLVSQAFSLSFTLADNMEVSGATFTNGLLHIDLTRNEPEQIAPQRIAISERPALNS

SEQ ID NO: 10686 - protein, 349 aa, Klebsiella pneumoniae
SFNRFLARLTHHNTHKESGAMNKWGVGLTLLLASASVLAKDIQLLNVSYDPTRELYEQYNKAFSAHWKQETGDNVVIRQSHGGSGKQATSVINGIEADVVTLALAYDVDAIAERGRIDKNWLKRLPDNSAPYTSTIVFLVRKGNPKQIHDWNDLIKPGVSVITPNPKSSGGARWNYLAAWGYALHQNHGDQAKAQEFVKALYKNVEVLDSGARGSTNTFVERGIGDVLIAWENEALLATNELGKDKFEIVTPSESILAEPTVSVVDKVVDKKGTRQVAEAYLKYLYSPEGQEIAAKNFYRPRDPNVAKKYANEFPKLKLFTIDQEFGGWTKAQKEHFSNGGTFDQISQR

SEQ ID NO: 10687 - protein, 170 aa, Klebsiella pneumoniae
RLNREARRLSKSHDARVNYADDDDKEKRMTLQQWLFSIKGRIGRRDFWIWIAIWLVTMSALFTLAGSNLLNLQTAAFIIVCLLWPTAAVVVKRLHDRGKSGLWALLMVLAWMLLAGNWAMLPQVWQWGVGRFVPTLIIVMMLIDLGAFVGTQGENKFGKETQDVRWKADA

SEQ ID NO: 10688 - protein, 76 aa, Klebsiella pneumoniae
PAGRAYRRRSVSFSSCHSCQKLSLKNNIAGGGWQPPQVGPISSIIAQTPLLSQAGTQYDVRQMTPEERQHEHHPHP

SEQ ID NO: 10689 - protein, 410 aa, Klebsiella pneumoniae
RTMLKRKHDKIINIMQLRFFCQVALRGSVSRAADDLFRTQSAITRAIRDLEAALNVTLFERHYSGMVPTEYGKCILPRARRAIDDLQAIPALLQKHHTRSSGPLADAGWLFNTRRLAIFIQLYHVNHTQTVAQQLGITQPAVSAALKVLEKGADSALFRRTPEGVRPTPAAELLYPPVSRALNELENIWSDLAARRGVLEGTVRIGALPLSRTRLLPSAIAAFLAQHPGITLMTNESPYESLVADMRAGNIDFIIGALRQDEDLPDLCSEALFEEDMLILLRNNHPLLRHPDPRSQLATAQWVLPRANAPARNLLDKAFVTLGLPLPQPTVETGDAAMVRGLLQGSDMLAAVSASQMRFETDNGLLSVLPVPLPDTTRRIGLTFRAGSLPSPATQALLRFIYQQVQDGAV

SEQ ID NO: 10690 - protein, 327 aa, Klebsiella pneumoniae
RKFRRYFFIIQTPFYRQERRMDVLKTLGTRLLNGWQLSRLSTFEVAARHESFALAADELALTPSAVSHRINQLEEELGIQLFVRSHRKVELTREGKRVYWALKASLDGLNQEILDIKNQELSGSLTVYSRPSIAQCWLVPALGDFSRRYPAISLTVLTGNDNVNLQRAGIDLAIYFDDAPSSQLSHHFLMDEAIVPVCTPYYARQLQLTSNPASLRHCTLLHDRQAWSNDSGTDEWFSWAQQFGIELPQSSGIGFDRSDLAVIAAMNHVGVAMGRKRLVQKRLDSGELIAPFGDMTLKCHQHYYVTTLPGRQWPKIDAFIEWLHSLT

SEQ ID NO: 10691 - protein, 651 aa, Klebsiella pneumoniae
IPVRRQYHNNNPTLYKARGARKTGKYRSATTHGISPLSGNLTMCGIVGAVAQRDIAEILLEGLRRLEYRGYDSAGLAVVDSEGHMTRVRRLGKVQMLAQAVEEQPLHGGTGIAHTRWATHGEPSESNAHPHVSEHIVVVHNGIIENHEPLRALLQSRGYVFVTETDTEVIAHLVHWELEQGGTLREAVLRAIPQLRGAYGTVIMDTRDPGTLLAARSGSPLVIGLGMGENFIASDQLALLPVTRRFIFLEEGDIAEVTRRSVVIFDKSAAQVKRQEIESNLQYDAGDKGIYRHYMQKEIFEQPNAIKNTLTGRISHGEVDLSELGPNANEMLAQVEHIQIVACGTSYNSGMVSRYWFEALAGVPCDVEIASEFRYRKSAVRRNSLMITLSQSGETADTLAALRLSKELGYLGSLAICNVPGSSLVRESDLALMTKAGTEIGVASTKAFTTQLTVLLMLVAKLARLKGQDASIEHDIVHGLQALPNRIEQMLSQDKRIEQLAERFSDKHHALFLGRGDQYPIAMEGALKLKEISYIHAEAYAAGELKHGPLALIDAEMPVIVVAPNNELLEKLKSNIEEVRARGGELYVFADGEAGFNGSDNMHIIEMPHVEETIAPIFYTVPLQLLAYHVALIKGTDVDQPRNLAKSVTVE

SEQ ID NO: 10692 - protein, 306 aa, Klebsiella pneumoniae
VTARTAIILAFIITKTGTPMIRSMTAYARREIKGDWGSAAWELRSVNQRYLETYFRLPEQFRSLEPVVRERIRARLTRGKVECTLRFEQDPSAQGELILNEKLAKQLVNAANWVKMQSDEGEINPVDILRWPGVMAAKEQDLDAIAADILAALDGALDDFIVARETEGQALKALIEQRLEGVSGEVAKVRAHMPEILQWQRERLVAKLEDAEVQLENNRLEQELVLMAQRIDVAEELDRLEAHVKETYNILKKKEAVGRRLDFMMQEFNRESNTLASKSINAEATNSAIELKVLIEQMREQIQNIE

SEQ ID NO: 10693 - protein, 433 aa, Klebsiella pneumoniae
PGARRAKANGPLSGLVAGVVPALPFEAIVLDQRALADAIAEDSEEAAGVHRLQRALRFARLHAMERITRLLLRLLRRRLGVVWRRVVDLRLVQQAARAHQRDIRRQVIDHLLQHPHRRRMRMANGYRRTVAPRQGDGAIELVADIGFILRIVEKHLALNHLHAGTLRGAHGLGVADGDAVEKIEIVALQGLHHLLHAKQVGGHRAAHMVIQPDGVRDFAVSLANNALDLLAAHFGTQGVFFQRLFAERRHWQMDEHFMALIMRFSGHFPGVRRVRQHGDGDSCRQRQHLILGLRAVAKIVNNDGEFASERWRRQSQRTGYGKSNCAKLKQNLSSQPRLWIDRLTLAANFEIERRTALTAAAAYERDRLAGTHLGTNADQRALVIAIQAHVAFAMFDHHHQTIALQPVGQNDPTIGNGSDFGAFRRGDNHPFPT

SEQ ID NO: 10694 - protein, 121 aa, Klebsiella pneumoniae
LLHRQPRQRRCRYWLQIAAGTGAARPDRQTAEHAVGRPGYSGQNGCRCAASGSDRRLRLAVVHLPTAVQAAEIHPQLPRQLGLLDHRYHLYRSWHHVPADQSAVHLHGEDAHAAAEDSGHA

SEQ ID NO: 10695 - protein, 209 aa, Klebsiella pneumoniae
GASLMQWQTNLPLIAILRGITPDEALAHVGAVIDAGFDAVEIPLNSPQWEKSIPQVVDAYGEQALIGAGTVLQPEQVDRLAAMGCRLIVTPNIQPEVIRRAVGYGMTVCPGCATASEAFSALDAGAQALKIFPSSAFGPDYIKALKAVLPPEVPVFAVGGVTPENLAQWINAGCVGAGLGIDLYRAGQSVERTAQQAAAFVKAYREAVK

SEQ ID NO: 10696 - protein, 75 aa, Klebsiella pneumoniae
RFARHPFCAGAFRLMQGLVDVCQQSRLFQFFFDIDFMFEWSPPCHFRFGSSVLPDCRMSYQPQNSACGSAHCRRN

SEQ ID NO: 10697 - protein, 474 aa, Klebsiella pneumoniae
KFQRERLLLFVLTTVRMSMSNSAMSVVILAAGKGTRMYSDLPKVLHTLAGKPMVQHVIDAANDLGACAVHLVYGHGGDLLRQTLHEDNLNWVLQAEQLGTGHAMQQAAPFFNDDEDILMLYGDVPLISVETLQRLRAAKPQGGIGLLTVKLDDPTGYGRITRENGQVTGIVEHKDASEAQRQIQEINTGILIAGGADLKRWLAKLTNNNAQGEYYITDIIAMAHQEGHQIVAVHPQRLSEVEGVNNRLQLARLERVYQAEQAEKLLLAGVMLRDPARFDLRGTLQHGRDVEIDTNVILEGNVVLGDRVKIGAGCVIKNSTIGDDCEISPYSVVEDAQLQAACTIGPFARLRPGAELLEGAHVGNFVEMKKARLGKGSKAGHLTYLGDAEIGDNVNIGAGTITCNYDGANKHKTIIGDDVFVGSDTQLVAPVTVGNGVTIAAGTTVTRNIADNELVLSRVPQVHKQGWQRPVKKK

SEQ ID NO: 10698 - protein, 205 aa, Klebsiella pneumoniae
RLQRGKMMHNLARPTSRPLRLLSDMQAMMEETQAFENRVLERLNAGKTVRSFLIATVELLTEAVNILVLQVFRKDDYAVKYAVEPLLEGSGPLGDLSVRLKLIYGLGVISRAEYEDAELLMALREELNHDGNEYSFTDDEIIGPFGELHCVAALPPTPQFDDSDAELLAMQKLRYQQMVRSTMVLSLTELISRISLKKAFQKSTL

SEQ ID NO: 10699 - protein, 361 aa, Klebsiella pneumoniae
MAQRGIPCLWMRGGTSKAACFLADDLPADPVRRDAVLLAVMGSPDPRQIDGIGGADPLTSKVAIIRRSARPDADVDYLFAQVNVAAATVDYGQNCGNILAAVGPFAIERGLVRHDAPLTRVRIFMENTGQLAVAEIPCDADGVNYVGESRIDGVPGSASPILLHFLDVAGSSCGALLPTGRVRDRFDGVEVTCIDNGMPVILLRACDLGCTGYETREQLDNDDALKRRLESIRLQAGPLMQLGDVSQRTVPKMTLIAEPRHGGAISSRTFIPHRCHASIGVFGAVSVASACLLPGSVAQGLAQVAPGDTPLLSVEHPTGEFSVTLQLDADGALAGCGLLRTARLLFAGEVFIPARVWPREE

SEQ ID NO: 10700 - protein, 1040 aa, Klebsiella pneumoniae
RRQRLMFSRFFVRRPVFAWVIAILIMLAGVLAIRTLPVGQYPDVAPPAVKISATYTGASAETLENSVTQVIEQQLTGLDHLLYFSSTSSSDGSVSITVTFEQGTDPDTAQVQVQNKVQQAESRLPSEVQQSGVTVEKSQSSFLLILAVYDKTNRATSSDISDWLVSNMQDPLARVEGVGSLQVFGAEYAMRVWMDPTKLASYSLMPSDVQSAIEAQNVQVSAGKIGALPSSNAQQLTATVRAQSRLQTPDQFKAIIVKSQADGSVVRLSDVARVEMGSEDYTATANLNGHPAAGIAVMMAPGANALDTATLVKSKIAEFQRQMPQGYDIAYPKDSTEFIKISVEDVIQTLFEAIILVVCVMYLFLQNFRATLIPAVAVPVVLLGTFGVLALFGYSINTLTLFAMVLAIGLLVDDAIVVVENVERIMRDEGLPAREATEKSMGEISGALVAIALVLSAVFLPMAFFGGSTGVIYRQFSVTIISAMMLSVVVALTLTPALCGALLSHSKPHTKGFFGAFNRLWGRTEAGYQRRVLGGLRRGAVMMGAYALICGAMALAMWKLPGSFLPVEDQGEIMVQYTLPAGATAVRTAEVRRQVTDWFLTKEKANTDVIFTVDGFSFSGSGQNAGMAFVSLKNWSQRKGDDNTAQAIALRATKELGTIRDATLFAMTPPSVDGLGQSNGFTFELMASGGTDRDSLMKLRSQLLAAANQSSELQSVRANDLPQMPQLQVDIDNNKAVSLGLSLSDVTDTLSSAWGGTYVNDFIDRGRVKKVYIQGESDARAVPSDLGKWFVRGSDNSMTPFSAFATTHWQYGPESLVRYNGSAAFEIQGENAAGFSSGAAMDKMEKLADSLPAGSTWAWSGISLQEKLASGQAMSLYAISILVVFLCLAALYESWSVPFSVIMVIPLGLLGAALAATLRGLSNDVYFQVALLTTIGLSSKNAILIVEFAESAVDEGYSLSRAAIRAAQTRLRPIVMTSLAFIAGVLPLAIATGAGANSRVAIGTGIIGGTLTATLLAVFFVPLFFVLVKRLFTRQRPSQE

SEQ ID NO: 10701 - protein, 300 aa, Klebsiella pneumoniae
GGTLMATIELQTTAELAESRRKMQAKRRMKNRIALALSMATMAFGLFWLIWILMATITRGFDGMSLALFTEMTPPPNTAGGGLANALAGSGLLILWATVFGTPLGILAGIYLAEYGRKSVLAEIIRFINDILLSAPSIVVGLFVYTIVVAQMQHFSGWAGVIALALLQVPIVIRTTENMLKLVPDSLREAAYALGTPKWKMISAITLKASVSGIMTGILLAIARIAGETAPLLFTALSNQFWSTDMMQPIANLPVTIFKFAMSPFAEWQQLAWAGVLIITLCVLLLNILARVIFAKKKHG

SEQ ID NO: 10702 - protein, 612 aa, Klebsiella pneumoniae
SRLRAAGDDGIHHLLLSSIGAGGEHHRVSFGGQRVDQGAHPIFAPAFKEPARRRLDDDVVFPEVLRQQGAAGGPVCFAVAHPRRRIVQLETERSENREILLYRMQLVVLLGGGQRGVAIAPDRVAALRKIKTNPRRGAGQFADNRARPLVGQVKHHIVPLLAQRLNELPLHLQLIPFSLLFPAAIETINMVDIGVGCEHIPGLFIQQDIHAGGGVLLFQRVNKRRDQQHVAMMAQLNDQDPRRVQRAAGEGFRRHTLFFIQDKGSDSRGSDRLREALYCSTMTRYVWPEDVFVHNPAFLITIDTEGDNLWQKHDSITTENARYLPRFQQLCEKYGFKPVYLTNYEMAIDPFYIEFARDVIARGTAEVGMHLHAWNSPPTEPLTADDWRHKPYLIEYSDAMMREKVDYMTRLLEDTFQTKMVSHRAGRWAFDERYARLLVEYGYQVDCSVTPRVNWKTAKGAPQGDGGTDYRRFPQHAYFLDENDISREGHSPLLEVPMSIQYKHSAWMNSVKQGYDRLRGKVRSPSVHWLRPMGGNVETMKKVVEQTLTQGNDYVEYMLHSSEYMPGGSPTFQNERDIERLYADLEAFFSWLAPQVKGMTLAEYYQRKITQR

SEQ ID NO: 10703 - protein, 69 aa, Klebsiella pneumoniae
VKTRRTGEIRCGGMRMDLSPNGKCASYFALVMRWLHFLTLVTYYCMLPGMRKFAAFPQRELFSASQHSY

SEQ ID NO: 10704 - protein, 66 aa, Klebsiella pneumoniae
PRQRLAAATKFGDNLKISFQPQQLSKAGADNQMIVNKGDGGHGVSWCLKTPDGGVNALFGLRIHCL

SEQ ID NO: 10705 - protein, 290 aa, Klebsiella pneumoniae
PCQRRTGRSLLYRLEYAMPCEELDIVWNNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWTQGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPESDKPAMDMDQHFNGIHHTFEYGDGI

SEQ ID NO: 10706 - protein, 125 aa, Klebsiella pneumoniae
SLQRDEQGTVMKISRLGEAPDYRFSLANERTFLAWIRTALGFLAAGVGLDQLAPDFATPLIREILALLLCLFAGGMAIYGYLRWLNNEKAMRLKQDLPYTRTLLMISILLLAVVAAVMLLVVYGG

SEQ ID NO: 10707 - protein, 514 aa, Klebsiella pneumoniae
AAQRRRQRRAKQAERDDHDHRERHRPALIQRRQAQEHHQNRDGVEAHRLAAGQLFLQRNAAPRPGGARRQAVGQLFHLVHRRAGAEAGGVFALDLKGGGAVVAHQAFRAVLPVGGGEGGERRHAVIAAANEPFAKVRRHRARVAFALDIDLFHPAAIDKVIHVGTAPGAGERIGHVAQRQPQRDGFVVIDIHLQLRHLRQIVSAHRLQFAALVGRRQQLAAQLHQAVTVGTAAGHQFEGEAVALPETVYRRRGHGEEGGVADRPQLFGGAQGDGLGGVVVPFALRPVFQRHEGHPGVLPAAAKAEAVDGENDIGIGFLFGEEPVGDLAAHLGGTHRRRPGGQGVLDHDLPLVLHRQEAARQLPHRQRHRPANQRVSAHHHCAPAQAAEHPALVARLRTSPQAVKGAEEPFGVRFGVAEQRAAQRRGEGQRYHHRQHHRRDNGYRELAIDDPGRTAEEGHRQEHRRQHQGNRHQRAGDFAHRFFGGFASGEPFVAHNALHVLHHHDGVIHQQADR

SEQ ID NO: 10708 - protein, 110 aa, Klebsiella pneumoniae
TRRRRVPPAKRDVAHPFAANGAKLRNFPRFYLDAVSGQTARLVFTMHGYYAGIKNQLRRYPCWAFLNQVRKPTLDLPLDVRRKMWFKPFMQSLSGGFHRLPDHVPDPQEL

SEQ ID NO: 10709 - protein, 489 aa, Klebsiella pneumoniae
SAGRPRGSTPRQRDSGHRRPARSPGARPAGKPDERFSFDRTYHHDGGSIMKKFSVVIAGGGSTFTPGIVLMLLANQDRFPLRSLKFYDNDGARQETIAEACKVILKEQAPEIEFSYTTDPQAAFTDVDFVMAHIRVGKYPMREQDEKIPLRHGVLGQETCGPGGIAYGMRSIGGVLELVDYMEKYSPNAWMLNYSNPAAIVAEATRRLRPNAKILNICDMPIGIEGRMAQIVGLKDRKQMRVRYYGLNHFGWWTSIEDLDGNDLMPKLREYVAKYGYVPPSNDPHTEASWNDTFAKAKDVQALDPQTMPNTYLKYYLFPDYVVAHSNPERTRANEVMDHREKNVFSACRAIIAAGKSTAGDLEIDEHASYIVDLATAIAFNTQERMLLIVPNNGAIHNFDADAMVEIPCLVGHNGPEPLTVGDIPHFQKGLMSQQVAVEKLVVDAWEQRSYHKLWQAITLSKTVPSASVAKAILDDLIAANKDYWPELH

SEQ ID NO: 10710 - protein, 715 aa, Klebsiella pneumoniae
RAGRSRSRCRVVGYHAGCEVNPMSGRLLDAVPLSSLTGVGAAQSSKLAKIGLHTVQDLLLHLPLRYEDRTHLYPIAELLPGVYATVEGEVLNSNITFGGRRMMTCQISDGTGILTMRFFNFNAAMKNSLATGRRVLAYGEAKRGKYGAEMIHPEYRVQGDMSTPELQETLTPVYPTTEGIKQATLRKLTDQALELLETCAISELLPPELAQGMMSLPEALRTLHRPPPSLQLSELESGKHPAQQRLILEELLAHNLSMLALRAGAQRYHALPLGANDTLKNQLLASLPFKPTGAQARVTAEIEHDMALDVPMMRLVQGDVGSGKTLVAALAALRAIVHGKQVALMAPTELLAEQHANNFRNWFEPLGIEVGWLAGKQKGKARQAQQEAIASGEVQMIVGTHAIFQEQVQFNGLALVIIDEQHRFGVHQRLALWEKGQQQVFHPHQLIMTATPIPRTLAMTAYADLDTSIIDELPPGRTPVTTVAIPDTRRSDIIDRVRNACTHEGRQAYWVCTLIEESDLLEAQAAEATWEELKLALPELNIGLVHGRMKPAEKQAVMQAFKQGEMHLLVATTVIEVGVDVPNSSLMIIENPERLGLAQLHQLRGRVGRGAVASHCVLLYKSPLSKTAQKRLQVLRDSNDGFVIAQKDLEIRGPGELLGTRQTGNAEFKVADLLRDQAMIPDVQRIARHIHERYPLQAQALIERWMPETERYSNA

SEQ ID NO: 10711 - protein, 129 aa, Klebsiella pneumoniae
IKELYMKITSYMCKLVLVIILSVFSLQGLASESPIKVDVGGDKMKIGPNYLPIWSYNITSIENEVVITSIVVNRGNCLPSIAGRGNNMNKRLGYGETFTFTIPTNKDYTQCKPLELIIGTPNGSLKYTW

SEQ ID NO: 10712 - protein, 253 aa, Klebsiella pneumoniae
GAFSPRFVLVKDDKMKMIVTEDYEEMSLVASHHVLGYITVPRRVNLAVTAGSTPKRMYEHLTAAVKGKAFYDRVHYYNFDEIPFRGQSREGVTISNLRQLFFTPAQIKEENIHKLTLDNAAQHDRQLEEAGGLDLMVLGLGADGHFCGNLPNTTRFHDQTVEVPIHGEMIALIANSEMGGDISAVPNSYVTMGPRSVMAAKNLLLIVSGAAKAHALKQVVEGPVSVQVPASVLKLHPSLVIIADKAAAAELQQ

SEQ ID NO: 10713 - protein, 429 aa, Klebsiella pneumoniae
PLSRTTDRLFAMTFSLFGDKFTRHSGITRLMEDLNDGLRTPGAIMLGGGNPAQIPEMNDYFQQLLANMLDNGKALDALCNYDGPQGKSELLALLANMLRDELGWEIEPQNIALTNGSQSAFFYLFNLFAGRRADGTTRKVLFPLTPEYIGYADAGLEEDLFVATRPNIELLPEGQFKYHVDFEHLQVTEETGMICVSRPTNPTGNVITDEELIKLDALANQHGVPLVIDNAYGVPFPGIIFSDARPLWNPNIVLCMSLSKLGLPGSRCGIIIANEKIITAISNMNGIISLAPGGIGPAMMCEMIKRQDLLRLSETVIKPFYYQRVQETIAIIRRYLPEERCLIHKPEGAIFLWLWFKDLPISTELLYQRLKKRGVLMVPGDYFFPGLDKPWPHTHQCMRMNYVPDPQKIEAGVKILAEEVEFAWREQEA

SEQ ID NO: 10714 - protein, 88 aa, Klebsiella pneumoniae
GWRSDDPEFLPLKPGSGSAGYAPSPAAPASRRSVAPLPARSVPYAGAPPAPLPPASGTGYAGPAPPPSPGAPGIRGPEARPVAAASGC

SEQ ID NO: 10715 - protein, 447 aa, Klebsiella pneumoniae
ITLSLDSQRQNLTLCHPPSNTDKWSYLMANILGGIAVSHTPTIGFAVDHHKQQDPAWAPIFQSFEPLQRWLEEKKPDALVYIFNDHVTAFFFDHYSTFTLGIDSQYDVADEGGGPRCLPPVQGNAALSRHIGASLMADEFDMSFFMDKKLDHGLFSPLSALLPWDEAQGWPTAVIPLQIGVLQFPVPSARRCYKLGQALRRAIESFPEDINVAIVATGGLSHQVHGERCGFNNPDWDAQFVDMLVNDPEKLTEMTLGEYAELGGMEGSEVIMWLVMRGALSANVTETWRDYYLPSMTGIATLILENNARLPPVDTLTRHRQHMAQQLAGVEKLPGTYPFTHERSLNGLRLNRFLHRLIEPAWRERFLQSPQSLYAEAGLSEEEQQLLNARDWRGLIQYGASFFLLEKMGAVVGVSNLHIYAAMRGQTLEAFQQTRNQQVTYSVAGKR

SEQ ID NO: 10716 - protein, 160 aa, Klebsiella pneumoniae
RRVSMTEQRPPLPPFTRDSAIQKVRAAEDGWNSRDAEKVALAYTVDSEWRNRSEFVHGRGQIVEFLQRKWRKEQQYRLIKELWAWQENRIAVRFAYEWCDDSGNWFRSYGNENWEFDKHGLMQTRYACINDLPISESERLFHWPQGRRPDDHPGLSDLGL

SEQ ID NO: 10717 - protein, 365 aa, Klebsiella pneumoniae
HSSRYRMRILKQLTRKKNAFFRGIKFNLINYRYRNKPARKAFDPAAVRRVLLLRLDDKVGDMVVTTGCARILAERGYQVSVLTGPICSEILAGSEFIQQVYLYRPRMSLNTLRAAGFDAVIDFDDVTSYERFKLLADLRATSVIGFNKEPYKLYDHSIAFFDGNSHISLRYKQVVKLFGIVDDRPYHYHLPGCRHEREKVARLLSQAGEVELRIAINPFTASEDKDFCRHQVATLIERLHALPYRVCIVMVGRSEKIRQLGLDMALYIADSTINSAVEVIRSCDLVITPDTSIVHIARAFDKPMVAVYNKRKLKNTGLPGYHIWAPGYDKAKQIVCEEANVADVAIESVWPVIKEQADRLVAARS

SEQ ID NO: 10718 - protein, 223 aa, Klebsiella pneumoniae
VGSRDRHIMTAQKDQDAPRRPGRPRGKKPGTANREQLMDIALTLFARDGAGRVSLNAIAKEAGVTPAMLHYYFSSRDALVTQLIEERFMPLRNHISRIFVDHPQDPVLALTMMVETLAHMAEKNAWFAPLWMQEIIGEMPILRQHMDARFGEERFQVMLGTVRRWQQEGKINPALAPELLFTTVISLVLVPFSRIHSDPRLQAVNRQTIVSHALALMGHGVGG

SEQ ID NO: 10719 - protein, 61 aa, Klebsiella pneumoniae
CFLSGTFVLNLRQVAQAVRFENPASDMNFIYNVRDTTKTSQQKTRSQRRRVRARAAFSASE

SEQ ID NO: 10720 - protein, 452 aa, Klebsiella pneumoniae
ILLRFVKAIASIVFLNMRAATHPLMKSENSCENVKCVTNKMLHCAAFRHFLRRSLMSHSNETKPHARELARPNWSAVFAVAFCVACLITVEFLPVSLLTPMALDLGISEGMAGQSVTTTAFVAMFSSLFITTVIGKTDRRYVVILFSLLLTLSCLLVSFADSFTLLLLGRACLGLALGGFWAMSASLTMRLVPMRVVPKALSIIFGAVSIALVIAAPLGSFLGGLIGWRNVFNGAAVMGVLCTLWVLKALPSLPGESAAQQQNMFGLLKRPGVMAGMCAIFMAFAGQFAFFTYIRPVYMTLAGFDVDGLTLVLLSFGIASFIGTSLSSVLLKRSVKAALAIAPLVLTACAVALVLWGESKIIASTVAIIWGFAFALIPVGWSTWITRSLSDQAEKAGSIQVAVIQLANTCGAAVGGIALDHLGLLSPLVLSGILMLFTGLLVAAKVKVNSPA

SEQ ID NO: 10721 - protein, 149 aa, Klebsiella pneumoniae
RSSSRLPPERHSVPRVHSQGGTAGRRCPHARRNPASGHCCPAPAGCCRERRPAGSAHRDAAYASGYPAIHRYATDASSALPADKTALRRPRRTPAPPGPNRPAYTGGRDSRRPDRPETRASSRAASACRTRWPAPPDDRDTASCGISAA

SEQ ID NO: 10722 - protein, 503 aa, Klebsiella pneumoniae
FQASVAMTSQVANPPVQSIRLLFSALLLVMLLSALDQTIVSTALPTIVGELGGLDKLSWVVTAYILSSTIAVPLYGKFGDLFGRKIVLQVAIGLFLVGSALCGLAQNMTQLVLMRGLQGLGGGGLMVISMAAVADVIPPANRGRYQGLFGGVFGLATVIGPLIGGFLVQHASWRWIFYINLPLGLFALLVIGAVFHSSNKRSQHQIDWLGAIYLSMALLCIILFTSEGGSVHAWNDPQLWCILAFGIVGIIGFIYEERMAAEPIIPLALFRNRSFLLCSLIGFVIGMSLFGSVTFLPLYLQVVKEATPTEAGLQLIPLMGGLLLTSIISGRIISRTGKYRLFPILGTLLGVTGMVLLTRITIHSPLWQLYLFTGVLGAGLGLVMQVLVLAVQNAMPAQMYGVATSGVTLFRSIGGSIGVALFGAVFTHVLQSNLQQLLPEGAVLPPGMNPVAVQHLPADIRLDYLDAFGAAIHAAFLMAAGIMAVAFVLSWLLKEAPLKTATH

SEQ ID NO: 10723 - protein, 73 aa, Klebsiella pneumoniae
PGKRPVSQLTRRTYNQYASFSQVIVHLAEFFMAHLTGHILNSNGKFRYLGEYNWQNVIGYYFYIAPDSGDRMY

SEQ ID NO: 10724 - protein, 517 aa, Klebsiella pneumoniae
GDWSMQLNSTEISELIKQRIAQFNVVSEAHNEGTIVSVSDGVIRIHGLAECMQGEMISLPGNRYAIALNLERDSVGAVVMGPYADLAEGMKVKCTGRILEVPVGRGLLGRVVNTLGAPIDGKGPLENDGFSAVEAIAPGVIERQSVDQPVQTGYKSVDAMIPIGRGQRELIIGDRQTGKTALAIDAIINQRDSGIKCVYVAIGQKASTISNVVRKLEEHGALANTIVVVATASESAALQYLAPYAGCAMGEYFRDRGEDALIVYDDLSKQAVAYRQISLLLRRPPGREAFPGDVFYLHSRLLERAARVNAEYVEAFTKGEVKGKTGSLTALPIIETQAGDVSAFVPTNVISITDGQIFLETNLFNAGIRPAVNPGISVSRVGGAAQTKIMKKLSGGIRTALAQYRELAAFSQFASDLDDATRKQLDHGQKVTELLKQKQYAPMSVAQQSLVLFAAERGYLADVELAKIGSFEAALLAYVDRDHAPLMQEINQSGGYNDEIEGKLKGILDSFKATQSW

SEQ ID NO: 10725 - protein, 261 aa, Klebsiella pneumoniae
VAWRIKMRHPLVMGNWKLNGSRHMVNELVANLRTELAGVSGCAVAIAPPEMYLDLAKRAAEGSHIHLGAQNVDVNLSGAFTGETSAEMLKDIGTQYIIIGHSERRTYHKESDELIAKKFAVLKEQGLTPVLCIGETEAENEAGKTEEVCARQIDAVLKTQGAAAFEGVVIAYEPVWAIGTGKSATPAQAQAVHKFIRDHIAKADAKIAEQVIIQYGGSVNAGNAAELFTQPDIDGALVGGASLKADAFAVIVKAAEAAKKA

SEQ ID NO: 10726 - protein, 184 aa, Klebsiella pneumoniae
TVRREGLMSEFVTVARPYAKAAFDFAVEHNSVERWQDMLAFAAEVTKNDQMAELLSGALAPETLSEAFIAICGEQLDENGQNLIKVMAENNRLKVLPDVLEQFIHLRAASEAIAEVEVISANQLSDEQLARIVSAMEKRLSRKVKLNCKIDKSVMAGIIIRAGDMVIDGSVRGRLERLADVLQS

SEQ ID NO: 10727 - protein, 281 aa, Klebsiella pneumoniae
HEGRLILPGDPMAIKLIAIDMDGTLLLPDHTISPAVKAAIAAARERGVNVVLTTGRPYAGVHSYLKELHMEQPGDYCITYNGALVQKAGDGSTVAQTALSYDDYRFLEQLSREVGSHFHALDRNTLYTANRDISYYTVHESYVATIPLVFCEAEKMDPEIQLLKVMMIDEPAILDQAIARIPAEVKEKYTVLKSAPYFLEILDKRVNKGTGVKSLADALGIKPEEIMAIGDQENDIAMIEFAGVGVAMDNAIPAVKEAANFITKSNLEDGVAFAIEKYVLA

SEQ ID NO: 10728 - protein, 106 aa, Klebsiella pneumoniae
LLSGGAFLCLSPAEYLRHTVSTTRRHSSVNTSRNYVYIFLKRFSSMNANNEDINGRIINGSPIYISRIKKPALRQVFIITDTLTAAEKYPPPAGTVHAVWTAASDG

SEQ ID NO: 10729 - protein, 146 aa, Klebsiella pneumoniae
YAYGCVLMRKPINVFIILISVLILTGCDNKPDNMLSGYSHGEFVYLSYSGNEKIERILINKGDNVAAGQELVKIESFDAQNIFLRAEEKLSAESALLRNLESGERPEELDIIRSQIKKAQSAESQVKRQLGRYRNLYANHAISLAG

SEQ ID NO: 10730 - protein, 131 aa, Klebsiella pneumoniae
RRDGGDRQRRAVPGGARPRQGANRRRNDERPAGAGARRRADAGRRRGGEKAGAEGQADQRGAEVSRQIRHHLYAADPRLYRRRAAAGLRHPGGTGFRAGERPSERQPGGADWLYEGLQQRDVHLSEYPDRL

SEQ ID NO: 10731 - protein, 526 aa, Klebsiella pneumoniae
KKPGSDAGLFHHACGLMCIDKDNFQHEQQRNNNHTRAKLAQPAGTDLHHAVRDKAQGDTFGDREAKRHHHCGDERRHRLGQVAPLHAREAGGHQHADVYQRARGGIARNHPRQRREENNQQEQDTNDNGGQAGTPAHGNAGRRFDIGRHRRGTDEGARHRRDAIDKQRLLHAREFTVGIRETRFIRHANQRPGGVKQVDQHKGEDHAGQAQVQGARQIDLTNHRSHARRRRDDPGVMHVAQHPAQQGGHNDRDQYRGVNVARRQNRDDKEAQHAQQYAVGSQMTNADQRFRIGDNHPGVFQAHHADKQADTAGNTYTQAKRNIGDHPVTYAEDGQQQQAHGAPEDGAHAHLPRQPHRLHHHKGEKGVQAHRRRQGDRQVREQTHQDTAESGNQTGGHKHGAGIHARYAKNLWVNKNDIHHRQERGETGDGFGAHRGAVLAQLKYALQQTLARRLAGLLLTHYRFPNVRRENSRLSYTKLRHQARLYGNFFHLFCLYGNDCVAALSITKTLNLLIWKGYDSTRSSIF

SEQ ID NO: 10732 - protein, 80 aa, Klebsiella pneumoniae
CAAGADNQQDVGDGTKAVFGMSQQNAHPHLPTDAEHVIGDKDGDKHRGDGVADKFQHCIQRAAFRHIQFSDGFHQHQANR

SEQ ID NO: 10733 - protein, 510 aa, Klebsiella pneumoniae
SDYGTPTMTDKKYIVALDQGTTSSRAVVMDHDANIVSVSQREFEQIYPKPGWVEHDPMEIWASQSSTLVEALAKADINSDQIAAIGITNQRETVVVWERETGKPIYNAIVWQCRRTAEICEQLKRDGMEEYIRKATGLVVDPYFSGTKVKWILDHVEGSRERAKRGELLFGTVDTWLIWKMTQGRVHVTDYTNASRTMLFNIHDLDWDDKMLDALDIPRAMLPEVRKSSEVYGQTNIGGKGGTRIPIAGIAGDQQAALFGQLCVKEGMAKNTYGTGCFMLMNTGEKAVTSTHGLLTTIACGPRGEVNYALEGAVFMAGASIQWLRDEMKLISDAFDSEYFATKVKDTNGVYVVPAFTGLGAPYWDPYARGAIFGLTRGVNSNHIIRATLESIAFQTRDVLEAMQADSGIRLHALRVDGGAVANNFLMQFQSDILGTRVERPEVREVTALGAAYLAGLAVGFWQNLDELQEKAVIEREFRPGIETTERNYRYSGWKKAVKRALAWEEHDEA

SEQ ID NO: 10734 - protein, 68 aa, Klebsiella pneumoniae
SRNGRRLSAPTAGRTRINIRQSLAGEGGKVMDAIHKKRKATYQVTFFSRFHIASVVVLMGDTSCQRAR

SEQ ID NO: 10735 - protein, 263 aa, Klebsiella pneumoniae
AQRGTVRKTLPREKRMDFNALHQQNQPLLLANVWDASSAQAAQQAGYQALGSSSAAIAAMLGYEDGEEMSFDELFYVVSRIKTVSELPLSVDLEAGYGATTSHIIDNIRRLAHLGVSGINLEDSHVVDGTRRLDDAERFAVKLQEITRACPGLFVNVRTDTFLLNVQDALVQTLYRGQLYAKHGACGFFVPCVTRAEDITAIVHHVPLPLNVMCMPELADFSTLSTLGVKRISMGNFIYAATQARLKDLLCQVQTQHSFSGVF

SEQ ID NO: 10736 - protein, 712 aa, Klebsiella pneumoniae
SHSGSPLYLFESLNQLIQNYLPEDQIKRLRQAYLVARDAHEGQTRSSGEPYITHPVAVACILAEMKLDYETLMAALLHDVIEDTPATYQDMEQLFGKSVAELVEGVSKLDKLKFRDKKEAQAENFRKMIMAMVQDIRVILIKLADRTHNMRTLGSLRPDKRRRIARETLEIYSPLAHRLGIHHIKTELEELGFEALYPNRYRVIKEVVKAARGNRKEMIQKILSEIEGRLQEAGIPCRVSGREKHLYSIYCKMVLKEQRFHSIMDIYAFRVIVHDADICYRVLGQMHSLYKPRPGRFKDYIAIPKANGYQSLHTSMIGPHGVPVEVQIRTEDMDQMAEMGVAAHWAYKEHGGESSTTAQIRAQRWMQSLLELQQSAGSSFEFIESVKSDLFPDEIYVFTPEGRIVELPAGATPVDFAYAVHTDIGHACVGARVDRQPYPLSQPLSSGQTVEIITAPGARPNAAWLNFVVSSKARAKIRQLLKNLKRDDSVSLGRRLLNHALGGSRKLAEIPPENIQRELDRMKLASLDDLLAEIGLGNAMSVVVAKNLQQGEAAAAPVPANASNHGHLPIKGADGVLITFAKCCRPIPGDPIIAHVSPGKGLVIHHESCRNIRGYQKEPEKFMAVEWDKETAQEFITEIKVDMFNHQGALANLTAAINTASSNIQSLNTEEKDGRVYSAFIRLTARDRVHLANIMRKIRVMPDVIKVTRNRN

SEQ ID NO: 10737 - protein, 427 aa, Klebsiella pneumoniae
WRSGEAARLRLKHPPAEPQLGHEDQHAADNLLQRQLFAVPQRGGNDRQQRFEHHDDRRAGHRRVLLPLHLQTEAQAGSDDNAGHQPAESRQGHRLVPAFNGSGDGQPDDTGDRQLHGGQGDQRYFTRAAAGVTEPDRLHQRRQQKPALAGVEGYRHMQTEQPQANHRDRQALPPGARRAHLHHHPCGQRDEHHRQAHDKRPFAERRRRGDRIDPQAEVERKPESADDEFWPVLLLRAKTAAERQQKQRGEEKTQPKKREHRHAGDRLAGKYPAAGGNHRRGNQQQVSLPLAYHTRLSLCVGLPARHRAAVEDSLCRLRHLRRLVRLHKLLHVFRVFIVFSGHDDVHVGRVFIFDKDAVTNRRQPGLLQVGGADDSHVDFGIVEYARQLRPFQLHDLQVMRVVGDIHRRRQQAGPGFEGNQLLFLQQQ

SEQ ID NO: 10738 - protein, 129 aa, Klebsiella pneumoniae
SPGGPNAGKSSLLNALAGPRSGDRHRYRRYHPRRATRAYPYRRHAAAYHRYRRACAMLMTKWNVSASSAPGRRLPSPIGCCLWSTAPPPAPLTRRRSGQTLSSACPLNCRLPWCAIKPMSPAKRSVSAK

SEQ ID NO: 10739 - protein, 438 aa, Klebsiella pneumoniae
RVSGFLLLAAMQATFLQTTVNQLLLNNGDQVADDVVHHQARREPQEEHREDDRHKGHDLLLHRVGHGGRRHLLDEEHGRAHDDRQDVVRVLSRQVVDPQDKRRMTQFNRGAQHVIQRKEDRHLNNQREAAAQRVYFFRFIQRHHLLALTLFIVAQTLTHGLNLRLQHAHLRHGGVLRFGQRVHDATNDKGDNDDREAPVAEEAVDEFQQLEQRLGDEPQPAVVDGQIQMRRNGSHFVLNSRADPQRALQFVGLAWLHQYRLRFVANSDNAVAEVGGVEVIRPVIPRHPCGGEVLLQHGNPTVFGADVQVFVIQNGIEFIFLVFRIRSGERGATESMHRGQATGLRIATGRQRSGLLQLTEGRDFQRLLAGILHAVTHVHRIATALQGEGFGEDVAGFVSVGQRDNELILAIGQHKRLFIDVVQRTRAVCRVIRTVTAG

SEQ ID NO: 10740 - protein, 345 aa, Klebsiella pneumoniae
TTSGCLMNALNAAMTVIGAGSYGTALAITLARNGHHVVLWGHDPKHIATLQHDRCNAAFLPDVPFPDTLHLESDLATALAASRDILVVVPSHVFGQVLRQIKPLMRSDARLVWATKGLEAETGRLLQDVAREALGDDIPLAVISGPTFAKELAAGLPTAISLAATDPQFAEDLQRLLHCGKSFRVYINPDFIGVQLGGAVKNVIAIGAGMSDGIGFGANARTALITRGLVEMSRLGAALGADPETFMGMAGLGDLVLTCTDNQSRNRRFGMMLGQGMDVQSAQDKIGQVVEGYRNTKEVRVLAQRLGVEMPITEEIYQVLYCGKIAREAALTLLGRARKDERSSN

SEQ ID NO: 10741 - protein, 82 aa, Klebsiella pneumoniae
HETGWPRAQSIPYSRVFFGFSLGLTLMDCFLVKTTIETFITMVLKDSKIKSRLNTSTLGRFNQMFIMLFELIAQEQSLFILS

SEQ ID NO: 10742 - protein, 125 aa, Klebsiella pneumoniae
PLKGYLNARNDNGRTMKSRRLLKLVLFSGIISLSGCSSVMSHTGGKEGTYPGTRSSAQTLGDSDTNWGVKSLVALDMPFTAVMDTLLLPWDMFRTDSSIKSRVEKSEKATLATNSVIPPAPMPAQ

SEQ ID NO: 10743 - protein, 590 aa, Klebsiella pneumoniae
ILEGASQGEKASVAARGILPQTLREVMEEGTAMRKGGWWLALGMFSASALATCPDWPPARGRQETSRLHQQIVAWKEAYWRQGASGVSDDVYDQLTLRLAQWRQCFPGATPEDDDLPPPTGDARHPVAHTGVRKLADEDSVARWMKNKSDLWIQPKVDGVAVTLVYRQGRLVQAISRGDGLRGEAWTARARQIPALAKVMTGELADSVLQGELFLRRDGHVQQQAGGMNARAKVAGLMMRADAAAALSQLDVFIWAWPDGPSDMRRRQKLLAQAGFKYSGQYTHPVSSIEQVAQWRQRWYRSPLPFVSDGVIVREGREPPGRVWSPGKGEWLAAWKYPPASRVMQVRAIRFSTGRSGRLNVVAELEPQRLDDKRVQRVNVGSVSRWQMLDIGVGDQLQISLAGQGIPRVDAVVWRTAERHKPTPPPAKFNALTCYFATPECSEQFLSRLIWLSSKSALNVDGVGENLWRVIQQQNPMTHIFSWLALTVEQLQAVPGISAARGQHLWHQFDLVRKRPFIRWVLAMGIPVPQGALAQLESENWHLLAAKSEAQWRTLPGVGEIRARQLVAFLHHPDVVALAQWLSGQRIPGF

SEQ ID NO: 10744 - protein, 73 aa, Klebsiella pneumoniae
CSTGTSASSIPLAGLVTMPAAKTTFNSRICMLTPKGSCRLRRKPISGSANTGRQKLKSRCWTGKRREPMRRPA

SEQ ID NO: 10745 - protein, 93 aa, Klebsiella pneumoniae
NPQGNNRSEVMANIEIYTKATCPFCIRAKALLNSKGVTFHELPIDGDAAKREEMIQRSGRTTVPQIFIDAQHIGGCDDLYALDSRGGLDPLLR

SEQ ID NO: 10746 - protein, 401 aa, Klebsiella pneumoniae
KFQGELVMIISAASDYRAAAQRILPPFLFHYIDGGAYAEHTLRRNVEDLSDVALRQRILRNMSDLSLETTLFNEKLAMPTALAPVGLCGMYARRGEVQAAGAADDKGIPFTLSTVSVCPIEEVAPTIKRPMWFQLYVLRDRGFMRNALERAKAAGCSTLVFTVDMPTPGARYRDAHSGMSGPNAALRRYWQAVTHPQWAWDVGLNGRPHDLGNISAYLGKPTGLEDYIGWLANNFDPSISWKDLEWIRDFWDGPMVIKGILDPEDARDAVRFGADGIVVSNHGGRQLDGVLSSARALPAIADAVKGDITILADSGIRNGLDVVRMIALGADSVLLGRAYLYALATHGKQGVANLLNLIEKEMKVAMTLTGAKSIREISRDSLVQNAEALQTFDALKQNNAA

SEQ ID NO: 10747 - protein, 195 aa, Klebsiella pneumoniae
GSIFDRSGRMKKKLTAADMHDPQVIAETPWFSMRKVGIDVAPGERRDFYSIHYPRPAVGIVAIQDEKVLLIRHYRYLIDKVVWAIPSGGVDEGEDPAVAALRELREETGWQAQRVEEIIRFNPSYGSSDQLFITWLATGLHWVGMDADQNEVMETGWFTFDEINQLIARGEMPDGLSLVPLLQLMAQRRSGSLTA

SEQ ID NO: 10748 - protein, 462 aa, Klebsiella pneumoniae
GVFMKLTVLGGGGVRSAFLAKSLAYNAHRIGLTEVVFLDNSADNLAIFGEIARYVFNTIRPDIQFSTTTDPVAALQDANYIITTLRVGGDESRIRDERIALEHNTLGQETTGAGGFAMAMRSIPAILRYCRLIEEHAAEDAILFNFTNPSGLVTEAIIKSGFKRRVYGICDAPSELIRELPAILGCEERDLSVECYGLNHFSWFTHFTVRGEEVTERLIASPELYQKTAMQYFSPELVRLCDNQLLNEYLYYYYYRDEALKAIQGAGETRGEQIARINQEMREALRTVDARTQPEAAFTIWMQHYLRRENSYMQNESRQEKFHTREPLTLRQFIEEPDTGGYAGVALDILEAVNSTTTKRIVVSIQNHDTLDFLRPDDVIEISCDLSRDGLKPVTPVKVPTAQKNMIACVKEYERLAVAAILQQDKSLAVRALMAHPLIGSYSLAKTLVEAYLDDEQFAAWR

SEQ ID NO: 10749 - protein, 547 aa, Klebsiella pneumoniae
GNIMMRKNRIASAIVLLAPLCYSTNLLASQLTVEQRLELLEKALKDTQKELKKYQDQERKRDQIWASWSPPAEGQKRKTGGATAGPKTAVKPDAVLVKNQQPVTDGAPAYSAMTLKDFSKFVKDEIGFSYNGYFRSGWGTASHGSPKSWAIGSLGRLGNEYSGWFDLQLKQRVFQEGDKRVDAIVMLDGNVGQQYSTGWFGDNAGGENYIQFSDMYVNTKGFLPFAPEADFWVGKHGAPKIEIQMLDWKTQRTDAAAGVGLENWQVGAGKFDIALIREDVDDYDRSLSNKQQINTNTLDVRYKEIPLWDKASLMVSGRYVAANQSSSEKYKEGNEGYYPWKDTWMAGTSLTQKFANGGFNEFSFLLANNSIASSFSRYAGSSPYTTFNGRYYGDHTNGTAVRLTSQGETYLRDDVIMANAIVYSFGNDVYSYETGAHSDFESIRTVLRPAYIWDEYNQTGVELGYFKQQNKDVTGKKYNESGYKTTLFHTFKVNTSMLTSRPEIRFYATYIKAKDIDLDKAANNTTSIFEDGKNDQFAVGAQAEIWW

SEQ ID NO: 10750 - protein, 457 aa, Klebsiella pneumoniae
PRIFPPYVRKPIMSQQQTSQSSGQGLLERVFKLREHGTTVRTEAIAGFTTFLTMVYIVFVNPQILGVAGMDTSAVFVTTCLIAAFGSILMGLFANLPVALAPAMGLNAFFAFVVVQAMGLPWQVGMGAIFWGAVGLLLLTIFRVRYWMIANIPLSLRVGITSGIGLFIGMMGLKNAGVIVANPETLVSIGHLTSHSVLLGVLGFFIIAILASRNIHAAVLVSIVVTTLLGWMLGDVHYTGIVSAPPSVASVIGQVDLAGSLNLGLAGVIFSFMLVNLFDSSGTLIGVTDKAGLADANGKFPRMKQALFVDSVSSVAGSFIGTSSVTAYIESSSGVSVGGRTGLTAVVVGILFLLVIFLSPLAGMVPGYAAAGALIYVGVLMTSSLARVKWSDLTEAVPAFITAVMMPFSFSITEGIALGFISYCVMKIGTGRLRELSPCVIIVSLLFVLKIVFIDAH

SEQ ID NO: 10751 - protein, 382 aa, Klebsiella pneumoniae
QVVILKIQYYRYFANIMKLRQVCDRKLRLIYCDTGKPGRSYLISPADIEGLMQEKIHWITNLRGIACMMVVMIHSTSWYITHPHAITLLQWDIANLLNSASRVSVPLFFMISGYLFFGERSAQPRHFWRIGLCIAFYSALSLLYITLFTHINVELSLKNLLQKPVFYHLWFFFAITVIYLLSPLIQVKSTSSTMLLALMAILGILANPNMVSVKAAGIEWLPVNLYINGDTFYYVLYGVLGRAIGTLDTDKKWLTPLCAALFIAAVWVISRGTLHELRWRGDFGDTWYLYCGPAVFVCAVTLLTLAKNWLNARPLPGIACIARHSLGIYGFHALIVHALRASHLELSRWPLLDIVWIFSAALLGSLLLSGLVQRIDSRRLVS

SEQ ID NO: 10752 - protein, 555 aa, Klebsiella pneumoniae
GQPMKVDKLYIRSRFKNLENVKVDFDENHLMTVVVGRNGSGKSNVLEALVSIFRNLDLGEAPAFSYELTYRLGEPHKPNRPSNRWLEITIDADPNRGTLAKQYEVRMRNLLNDSLPEDIFDEKTLGIVIPFSKVKRNKEGKAPYLPNYVFAYYSGPSDRLESYFKKHRTDFYRHLLNDKPDKKLNLKGDIRPLFYAKPYHSQFVLLAFFLSDENSPQRTFIKEHLGIEDLDSIHFVMRQPGWAKQKGELFWGARGVVRRFLDELIKYTLAPIKVTRQEDTSLTGSHVRNEFFHLFLPNVEVLHTFAKGLSDDELFKMLESTLLSEIISEVSIRVKVSSSKVPLTFRELSEGEQQLLTVLGLLKFTGGKDSLFLLDEPDTHLNPSWAIKYLKFLREFVPNHETSHLLMVTHHPLAIAELKKQQVQVMWRDDEYNVHSQEPYIDPRGAGFMATLTEVFGLNTTLDLETQKLLDDRNELAHIESRTEAQSNQLDLLNDELNRLGFSFENRDPLYSEFLLAWQDLKYSERPPLTPDKAAQRRVAMKKVIEVLQAKKASE

SEQ ID NO: 10753 - protein, 133 aa, Klebsiella pneumoniae
CSTMCYTFNDRMSAMRIFKTKWFAREASSHGISDDELYQAIQSALQGKVVDLGGGVYKKRLNKNRDRAIILTKSAGYWFYTFLYAKQDMANINHRELMGFRELAKHYANLSEEKTTVLVKSKELVEICDDSKK

SEQ ID NO: 10754 - protein, 226 aa, Klebsiella pneumoniae
RMIFIKRDAALIPEKVLNVAQRAQNALEQLPAEQRKDFIKKKSHIWRGFSKYLAKMSYGKCWYSEAKDAGANFDVDHFRPKAEAKRAENLVDVEGYAWLAFDWKNFRLSAQNCNRLNTDESGNTVGKGSWFPLLNGSPKASWDNRCINDERVTLLDPVVQADLTYIDYDDNGRFTSSRHCIGQAALRIQQSAVIYGLNFEKMREARFQVMREAKELLETIQQSVED

SEQ ID NO: 10755 - protein, 401 aa, Klebsiella pneumoniae
KGDISRTGMAAGNPILQRKTQPLSRRMPVKRRLDTRRVMRQLPRLAPLRGNKPQLHYAGVVAHQKGYRRRLGIGAHPVARDVHQSRVAAMVGEGQTTLADARRRRRHCGCGTGQRRPARLLPAGFILRQIDNKQLRHFIAIFRQRIANKRQSMVPDPALLIGAINLIAARRGCRRRAAYQHAPVAAAIFARMLSLRRHRSIGRRHADVAQIQRRIALVQHVIVVGKTDKLTVGAIDMDVAAAAQRAGRVGGGNVHGVQILDSPLKGHHPAAMMKIILPLRIRPLGAMNKHIALLGWMHGYHAHVRALRGTINGLHSTAVYVHSLNGFAGKRCAGRTNVEYQPLAVGSPGINIGKLVMTGSKSDLFHDDTLMRDLRIRVAYRKKLAYTFHIADQQDIRQRAY

SEQ ID NO: 10756 - protein, 158 aa, Klebsiella pneumoniae
SMDMKMKTLMNFIVLIIPTFFSMKSFAENKLCEANTTFFFANNKAHTKSVELCYEKKGVKYIFGPEGKPEITLEVSREKIIYEYENGCENNTIPNGKTDYYIYQCGSAPQTDPTLQVNQYGNPVATIELDGKDGKYLNAISDAGYEQLSKIRLHRRRY

SEQ ID NO: 10757 - protein, 312 aa, Klebsiella pneumoniae
PPCIKTPLRRGFLFLKLPHIAFTYSLFSHLSVKHNTSGKRRKIMPELPEVETSRRGIEPHLVGATILHAVVRNGRLRWPVSEEIYRLSDVPVLSVRRRAKYLLLELPDGWIIVHLGMSGSLRILSEELPAEKHDHVDLVMSNGKVLRYTDPRRFGAWLWTRTLEGHPVLAHLGPEPLSDAFNADYLQQKCAKKKTAIKPWLMDNKLVVGVGNIYASESLFSAGIHPDRLASSLSREECEQLVKVIKLVLLRSIEQGGTTLKDFLQSDGKPGYFAQELQVYGRKGEPCRICGTPVVGTKHAQRATFYCRQCQK

SEQ ID NO: 10758 - protein, 160 aa, Klebsiella pneumoniae
GGSMLNIVLFEPEIPPNTGNIIRLCANTGFSLHIIEPMGFTWDDKRLRRAGLDYHEFTAVQRHADYAAFVASAQPQRLFALTTKGTPAHSAVSYQDGDFLMFGPETRGLPASILDALPPEQKIRIPMMPDSRSMNLSNAVSVVVYEAWRQLGYPGAVLRS

SEQ ID NO: 10759 - protein, 200 aa, Klebsiella pneumoniae
KTIILWDSLKQGYVMNEQQPFEAIRKSDEAGREYWSARNLGPLLDYKEWRNFYKVIAKAIISCEASGHPSADHFVETNKMVELGSGASRNLEDFHLSRYACYLVVQNGDPSKPVIAAGQTYFVLQTRRQELQDDQIFKSLREDEKRLFLRNELKEHNKHLVETAQRAGVETTLDFAVFQNHGYKGLYGGLDQKAIHERKA

SEQ ID NO: 10760 - protein, 169 aa, Klebsiella pneumoniae
GYVMTGCPANLPLTHAPGQQHDTPFQAVVVEAHHCHQPQAFYAQLRQQGLTAIHFIPQLAAGDAALWGEFLCAVFHRWVREDIGRINILLFSETLSAWCGETLTQPGAPAANSTCYGCPWLRLCRCSEQEDPLCAGYRQFYDFSGPYMRVMRDLRRQQRPPEALMPLLR

SEQ ID NO: 10761 - protein, 426 aa, Klebsiella pneumoniae
SFPMRGKAMYSTTWIAAAVRSVLYASALSAGVLLCASSAHADDRDQLKSIQADIAARQRAIKQQQQQRASLLAQLKAQEEAIAAAARKLRETQDSLNQLNKQIDEMNAALAKLERQRASQERNLAAQLDAAFRQGPHTGIQMVLSGEEGQRNQRMQVYFSYFNQARQETIAELKKTREEMAVQKSMLEEKQSQQQTLVYEQKAQQAKLEQARNERKKTLSGLESSIQQGQQQLSELRANESRLRGRIAQAEAAAKARADREARDAQAVRDRQQEASRKGTTYKPTESERSLMSRTGGLGSPRGQAFWPVRGPLLHRYGEQLQGELRWKGMVIAASEGTEVRAIADGRVILADWLQGYGLVVVVEHGKGDMSLYGYNQSALVSVGTQVRAGQPIALVGSSGGQGRPSLYFEIRRQGQAVNPQPWLGR

SEQ ID NO: 10762 - protein, 231 aa, Klebsiella pneumoniae
RVTMSHNDTIVAQATPPGRGGVGILRISGLKARDVAQAVLGKLPKPRYADYLPFNDVDGTPLDQGIALWFPGPNSFTGEDVLELQGHGGPVILDLLLKRILTLPGLRIARPGEFSERAFLNDKLDLAQAEAIADLIDASSEQAARSALNSLQGAFSARVNHLVEALTHLRIYVEAAIDFPDEEIDFLSDGKIEAQLNEVMADLDAVRAEARQGSLLREGMKVVIAGRPKCR

SEQ ID NO: 10763 - protein, 272 aa, Klebsiella pneumoniae
GTAMNRISALILDWAGTTVDFGSFAPTQIFVEAFRQAFDIEITLEEARVPMGLGKWQHIEALGKLPAVDSRWQAKFGRAMTAADIDAIYAAFMPLQIAKVVDFSVPIAGVVDTIAALRAEGLKIGSCSGYPRPVMEKLVPAAAAQGYAPDYWVATDDLAAGGRPGPWMALQNVITLGIDDVAHCVKVDDAAPGISEGLHAGMWSVGLAVSGNEFGATWEEYQGMSKEEIATRRERAADKLYAAGAHYVVDTLADLPDVIADINARLAKGERP

SEQ ID NO: 10764 - protein, 692 aa, Klebsiella pneumoniae
EAAMSENTFLVEIGTEELPPKALRSLAESFAANVTAELDNAGLAHGKVEWFAAPRRLALKVANLAAAQADREVEKRGPAIAQAFDAEGKPSKAAEGWARGCGITVDQAERLTTDKGEWLLYRAHVKGESTEALLPNMIASSLAKLPIPKLMRWGASDVHFVRPVHTVTLLLGDKVIPATILGIPSDRVIRGHRFMGEPEFTIDHADQYPQILLERGKVIADYEQRKAKIKADAQEAARKIGGQADLSESLLEEVTSLVEWPVVLTAKFEEKFLAVPSEALVYTMKGDQKYFPVYDNAGKLLPNFIFVANIESKDPQQIISGNEKVVRPRLADAEFFFNTDRKKRLENNLPRLETVLFQQQLGTLRDKTDRIQALAGWIAEQIGADVNHATRAGLLSKCDLMTNMVFEFTDTQGVMGMHYARHDGEAEDVAVALNEQYQPRFAGDTLPSNPVACAVAIADKMDTLAGIFGIGQHPKGDKDPFALRRAALGVLRIIVEKNLDLDLQTLTEEAVRLYGEKLTNANVVDDVIDFMLGRFRAWYQDEGYGVDTIQAVLARRPTRPADFDARMKAVSHFRTLEESSALAAANKRVSNILAKSDETLNDIVHASVLKEAAEIKLAGNLVVLRDKLQPYFAAGRYQDALIELAALREPVDEFFENVMVNAEDKDVRINRLTLLSKLRELFLQVADISLLQ

SEQ ID NO: 10765 - protein, 295 aa, Klebsiella pneumoniae
GNHMTARYIAIDWGSTNLRAWLYQGEECLESRQSEAGVTRLNGRSPAAVLAEITQHWRDGATPVVMAGMVGSNVGWKIAPYLPLPAAFSDIGQQLTAVGDNIWIIPGLCVSRDDNHNVMRGEETQLLGARALAPSSVYVMPGTHCKWVLADRRQIHDFRTVLTGELHHLLLQHSLVGAGLPPQETSAAAFAAGLQRGINNPAVLPQLFEVRASHVLGALPREQVSEFLSGLLIGAEVATLSDTFAGQQAISLVAGLSLTSRYQQAFAAIGREVSAVAGDTAFQTGIRSIAYAVAN

SEQ ID NO: 10766 - protein, 279 aa, Klebsiella pneumoniae
DDNINKNHSLRKLTNYLPTTGHDKLKKTTEEAIMSHPVSEKSALVVSAHSADFVWRAGGAIALHALQGYQVHVVCLSFGERGESAKLWRKGNMTEEAVKQVRREEAQAAAAILGASVEFFDIGDYPLRADKETLFRLADVYRRIQPHFVLTHSLHDPYNYDHPLASHLAQEARIIAQAEGYRPGEKIVAAPPVYCFEPHQPEQCNWKPDVLLDITAVWEKKYQAIQCMQGQEHLWEYYTRVALQRGVQAKRNIGITAARDIVHGEAFQSIFPRVTENLA

SEQ ID NO: 10767 - protein, 355 aa, Klebsiella pneumoniae
ETSMKILVVGPSWVGDMMMSQSLYRTLRARYPQAIIDVMAPAWCRPLLSRMPEVNEAIPMPLGHGALAIGERRKLGHSLRERRYDRAYVLPNSFKSALVPFFANIPLRTGWRGEMRYGLLNDARVLDKDAWPLMVERYVALAYDNGVMRCAKDLPQPLLWPQLQVNEGEKSQACSAFNLSYDRPIVGFCPGAEFGPAKRWPHYHYAALAKKLIDDGYQIALFGSAKDNEPGKEIIAALSSEQQAWCRNLAGETQLEQAVILIAACKAVVTNDSGLMHVAAALDRPLVALYGPSSPDFTPPLSHKARVIRLITGYHKVRKGDAAEGYHQSLIDITPERVLQELNELLAEKTEHEEA

SEQ ID NO: 10768 - protein, 238 aa, Klebsiella pneumoniae
PDGIKTMSIPAASLSTDQALPSFYYGRQTKPLFAVESLLSAFLPASSPFALPRSTYYRFPPTQAESGLILLEEGIASLCHAENNMVISTIFAPSLLGLIDGYGVFNGIPEKHHCSLFAETDLRGRWIGHQAAVEILNAQNLWQEMAHVLAQRLMVLSMRSQEMMGVDSYLMVRTLLTELADYPEAYRRQINVLSFIQRRTNLSRSRIMSILSELRKGDYITIHRGVLRTIAHPLPAHF

SEQ ID NO: 10769 - protein, 168 aa, Klebsiella pneumoniae
  UNSURE (158): Identity of amino acid at the above locations are unknown.
RLVFLFDKIDSQMIKTSTGENMSKYSDLLQVIKSRVCQNNNFPQTLLADSHSYRARQVWYRIGQIFTLECILDEYRKHFSSDYYYLDNDKALHHLIFEMTKWKPEEIRRLSLNDCLFIIASQLKPSYMSEDAAAVLASLNLPTGHYPVEDFPTTRIFXHGGRACPLRI

SEQ ID NO: 10770 - protein, 377 aa, Klebsiella pneumoniae
ENIMKYIIAPIATALFLLSGCDNAQTSAPQQPTPEVGVVTLQSQPVPVVSQLTGRTTASLSAEVRPQVGGIIQKRLFTEGDMVKAGQALYQIDPSSYRATWNEAAAALKQAQALVVSDCQKAQRYASLVRDNGVSRQDADDAASTCAQDKASVESKKAALESARINLNWTTVTAPIAGRIGISSVTPGALVSADQDTALATIRGLDTMYVDLTRSSVDLLRLRKQSLASNSDTLSVTLTLEDGSTYPEKGRLALTEVAVDESTGSVTLRAIFPNPQHVLLPGMFVRARIDEGIMNDAILAPQQGITRDAKGDATALVVDAANKVEQRTVETGDTYGDKWLVLSGLKAGDKLIVEGTGKVAPGQTVKAVAVNNNGGNA

SEQ ID NO: 10771 - protein, 412 aa, Klebsiella pneumoniae
LWVICAKFCRIWRVAMRGDFYKQLTSNLETARAEGLFKEERIITSAQQADITVGDSHVINFCANNYLGLANHPELIAAAKSGMDSHGFGMASVRFICGTQDTHKQLEKKLADFLGMEDAILYSSCFDANGGLFETLLGPEDAIISDALNHASIIDGVRLCKAKRFRYANNDMQELEARLKEAREAGARHVLIATDGVFSMDGVIANLQGVCDLADKYDALVMVDDSHAVGFVGENGRGSHEYCDVMGRVDIITGTLGKALGGASGGYTAARKEVVEWLRQRSRPYLFSNSLAPAIVAASIKVLEMVEEGADLRDRLWANARLFREKMTAAGFTLAGADHAIIPVMLGEAVVAQNFARELQKEGIYVTGFFYPVVPKGQARIRTQMSAAHTPEQIERAVEAFTRIGKQLGVIA

SEQ ID NO: 10772 - protein, 80 aa, Klebsiella pneumoniae
APAMILPMVDVLGQVKCRASHHGFSLTKICSLPRLGNSVLRRLISLSTSGCQCLERRTRGALLLGISASGPPVRSNRRHQ

SEQ ID NO: 10773 - protein, 105 aa, Klebsiella pneumoniae
QTEIKENYRMTTICPQCCSDRVSERHIGRKTGGIVGGAAGALSGAGTGAAIGSVVPVVGTATGAVIGALLGRFVAGATAGAVTGSAMDGVLFDRYECRNCKHTFD

SEQ ID NO: 10774 - protein, 372 aa, Klebsiella pneumoniae
SPRIGTLILDEEQSMTPETLSRGPLNPARILVIKLRHHGDMLLITPLIHALKQQYPAASVDVLLYEETRDMLAANPDIHHIYGLDRRWKKQGKRYQLKMQWQLIQTLRQQRYDMVLNLADQWPSAVISKLTGAATRIGFDFPKRRHPVWRYCHTALASTQQHNQLHTVQQNLSILAPLGLQLNDAPARMGYSEADWAASRALLPEDFREHYIVIQPTSRWFFKCWREDRMSALINALSAEGYAVVLTSGPDAREKKMVDTIIAGCPQARLHSLAGQLTLRQLAAVIDHARLFIGVDSVPMHMAAALGTPLVALFGPSKLSFWRPWQAKGEVIWAGDFGPLPDPDAIDTNTDERYLDLIPTDAVIAAAKKVLA

SEQ ID NO: 10775 - protein, 88 aa, Klebsiella pneumoniae
KGLITVSDRRSRSCRLIISHIIAGPMPPGARLIIPFMLLMAVMIFSLAMIIPQRLPGRPSLDRLIHSTMFGFHSGRASLKIMPGNGTP

SEQ ID NO: 10776 - protein, 154 aa, Klebsiella pneumoniae
PVMMKKIDVKILDPRVGQQFPLPTYATSGSAGLDLRACLDDAVELAPGATTLLPTGLAIHIADPSLAAVILPRSGLGHKHGVVLGNLVGLIDSDYQGQLMVSVWNRGQQSFIIEPGERIAQMVFVPVVQAEFNLVESFDATDRGEGGFGHSGRK

SEQ ID NO: 10777 - protein, 290 aa, Klebsiella pneumoniae
GVMMTIAFIGFGEAGGILAADLAREHAVTIWDCKLNGPEREAMLSKARDSRVQVGNSLAQALEGATLVFSTVTAGEALKVAQQAAALLQPGQYFLDLNSVAPETKRQAAEHFLPGAYIDVAVMAPVPPARLQTPLLIGGPQAEAIAPRLQRLGLNARYGASTVGQVSAIKMCRSVMIKGLEALTTECLFAAREYGVEEEVLSSLHHSFPSLGWTGAFPDYLISRVAEHGIRRSEEMEEVVKTLRDVGSAGIMSEAIAKSQRQLPEQMAARSLSYRQLTPFDWKTLVARLK

SEQ ID NO: 10778 - protein, 776 aa, Klebsiella pneumoniae
EDVLMKISDGNWLIQPGLNLIQPVQVYEVEQQGNEMVVYAAPRDVRERAWQLDTPLFTLRFFSPQEGIIGVRMEHFQGALDNGPHYPLNVQKDVHVEIENTAGFAELKSGSLSVRVTKGEFWALDFLRDGVRITGSQLKNNGYVQDSKTQRNYMFERLDLGVGETVYGLGERFTALVRNGQTVETWNEDGGTSTEQSYKNIPFYLTNRGYGVLVNHPQRVSFEVGSEKVSKVQFSVEGEYLEYFVIEGPTPKAVLNRYTQFTGRPALPPAWSFGLWLTTSFTTNYDEATVNSFIDGMAERHLPLHVFHFDCFWMKAFQWCDFEWDPLTFPDPEGMIKRLKAKGLKVCVWINPYIGQRSPVFKELKEKGYLLKRPDGSLWQWDKWQPGLAIYDFTNPEARQWYADKLKGLVAMGVDCFKTDFGERIPTDVQWFDGSDPQKMHNHYAFIYNELVWKVLKETVGEQEAVLFARSASVGAQQFPVHWGGDCYANYESMAESLRGGLSIGMSGFGFWSHDIGGFENTAPAHVYKRWCAFGLLSSHSRLHGSKSYRVPWAYDDESCDVVRHFTQLKCRMMPYLYRQAALANECGTPMLRAMMLEFPDDPACDYLDRQYMLGDSVLVAPVFSEAGEVQFYLPEGHWTHLWHNDELPGSRWHKQHHDALSLPVYVRDNSLLALGNNDQKPDYAWHEGTAFQLFHLENGREARCDVPAADGSTIFTLKARRQGNAIAVSGECEARGWTLCLRNIPHVAGVHGGTQTGIEWGVVVSAEGNTLTITL

SEQ ID NO: 10779 - protein, 261 aa, Klebsiella pneumoniae
YQAIIAPAVLSRPLLTERRMATHFARGILSTGEPLSTRLSAACHQSARLLPTYRQARFCASRSLLAELLFMLYGISELPEIINEANGRPVFSDRQLPRFSIAYTGNIVGVALTTEGDCGLDMELQRTVRSHDADRHNFSNNENLWINIQHDPDEARSQLVALRRSVLKLTGEASTQLQLLPGSGRLRTAGSQPIEAVCDAESLLVWSIAATPNIGSLKVWEYDAKGGDWRSLADAQQRAREPSARLMRFTSLPMEKTLSLN

SEQ ID NO: 10780 - protein, 225 aa, Klebsiella pneumoniae
GYEMKALSKLKAEEGIWMTDVPEPEVGHNDLLIKIRKTAICGTDVHIYNWDEWSQKTIPVPMVVGHEYVGEVVGIGQEVRGFKIGDRVSGEGHITCGHCRNCRAGRTHLCRNTIGVGVNRPGCFAEYLVIPAFNAFKIPDNISDDLASIFDPFGNAVHTALSFDLVGEDVLVSGAGPIGVMAAAVAKHVGARNVVITDVNEYRLELARKMGVTRAVNVAKENLMT

SEQ ID NO: 10781 - protein, 592 aa, Klebsiella pneumoniae
VDNFGQIKTMNGITNRNGAACCRTGKFLFSSQAGNQEKEGHSPYELLHEDFPMLSQIQRFGGAMFTPVLLFPFAGIVVGIAIMLRNPMFVGEALTAPDSLFAQIVHIIEEGGWTVFRNMPLIFAVGLPIGLAKQAQGRACLAVLVSFLTWNYFINAMGMTWGHFFGVDFSAEPTAGSGLTMIAGIKTLDTSIIGAIVISGLVTALHNRYFDKPLPVFLGIFQGSSFVVIVAFLAMIPCAWLTLLGWPKVQLGIESLQAFLRSAGALGVWVYIFLERILIPTGLHHFVYGPFIFGPAVVEGGLQVYWAEHLQAFSQSTEPLKTLFPEGGFALHGNSKVFGSVGIALALYFTAAPENRVKVAGLLIPATLTAMLVGITEPLEFTFLFISPLLFAVHAVLAATMATVMYICGVVGNFGGGLLDQFLPQNWIPMFHHHASMMFIQIGIGLCFTALYFVVFRTLILRLNLKTPGREESEIKLYSKADYQAARGKTTAAAAPETRLGQAAGFLQALGGADNIESINNCATRLRIALVDMAKTQSDDVFKALGAHGVVRRGNGIQVIVGLHVPQVRDQLENLMKDSLSTEHTTMTEAVS

SEQ ID NO: 10782 - protein, 440 aa, Klebsiella pneumoniae
QRVLKTSLLYKGCIGGIRLATGGNPPGGWIHQKPEDVMALTDVKVKTAKPKEKPYKLADSGGMYLLINANGSKYWRMKYRFAGKEKMLSIGVYPDVSLADAREKRNEARKILATGGDPGEAKKEEKIAQQMSLKNTFEAVAREWHQTKADRWSLRYRDEIIDTFEKDIFPYIGKRPIAEIKPMELLEALRKMEKRGALEKMRKVRQRCGEVFRYAIVTGRADYNPAPDLASALATPKKVHFPFLTANELPHFLNDLAGYTGSIITKTATQIIMLTGVRTQELRFARWEDIDFEAKLWEIPAEVMKMKRPHIVPLSEQVIALFKQLEPISKHHPLVFIGRNDPRKPISKESINQVIELLGYKGRLTGHGFRHTMSTILHEEGFNSAWIETQLAHVDKNAIRGTYNHAQYLDGRREMMQWYADYIDALAKGTVIQGTFGKTA

SEQ ID NO: 10783 - protein, 382 aa, Klebsiella pneumoniae
KIIVKKINFSFSVTRWIGVVIKEIHELRRDKVSISMVLLTPLFQLIILGYAINMDPHNLPTALLNYDTERMSQIFVTEAQNTGYFSMIPVDSEEAAQKAFVRGDVTFIVTIPEGFTRKLLRGEKPQILIQGDAIDPITTENALRTLVQVAKSMFQHDLPGDMRVVQKEDDFELIIHRMFNPEGITQFNTIPGIMGSILSTTLILMTALSITRERENGALENLLVSPLSGLEVIIGKITPFVIIGLFQATLILIAAVLLFDIPLHGSVFLLFFVLLIYVFLCLSIGIGISGLAQNQLQALQMSSFYFIPSLMLSGFVSPFISMPDWAKAIGSCLPLTYFIRLVKGIMLKGYSAMALLPDLLPLIGLAVIVIGVGLKSYRKTLD

SEQ ID NO: 10784 - protein, 132 aa, Klebsiella pneumoniae
SAPVDQGGEMITKRNIARGMMATGSLVYLLGIWRTCPLFSGKGYFLGVLVMGMFAVLAHQRASQWQEQDDGFIALCRLVLLLSVGLLLVGAWYVPADWHEKAVYIAAWFVCLYGASATPERTRIARAMQKTE

SEQ ID NO: 10785 - protein, 289 aa, Klebsiella pneumoniae
YSAVAGAVYALSAGGGAHWRKELTMLIWSRKGRAAAGALAVTLFAGVFLLPLAVILLSSLSKQWNGLLPTGFTFTHFVNAFRGAAWDSLFSSLMVGFCASLLALLCGMWAALVLRQYGATLQKYLGLAFYLPSAIPSVSVGLGILVAFSQGPLQMNGTFWIVLAAHFVLISAFTFSNVTTGLARISADIENVASSLGASPWYRLRHVTLPLMTPWMISALALSLSLSMGELGATVMIYPPGWTTLPVTIFSLTDRGNIADGSALTIVLVGVTLLLMMKLERIARRLSQR

SEQ ID NO: 10786 - protein, 582 aa, Klebsiella pneumoniae
HGDVHLTEWKTMKFLGKLILWLLVALLLVIIGAWFLLQTHWGARQASAWLSNGTGWQVSFDEMEHDFSSPLHVQLRNVTFGREGKPATLVAKTVDIGFSTRQFSDPLHADEIVLNDGTLNLSPHSADLPFAADRLMLRNMAFNSPETGWALSAQRVTGGVSPWTPEAGNVLGKTAQIQMSAGSMTLNGVEASNVLIQGKIDQGEVTLSTLGADVARGTLTGNAKRSADGSWRVDNLQLNEIRLQSPASLTEFFAPLTTVPSLQIGRLDITDARLQGPDWAVTDLDLSLRNLTLSHGGWQSEDGTLSMNASEFIYGSLHFFDPILNAEFSPQGIALRQFTSRWEGGMVRTSGNWLRAGNALVLDDTAFAGLEYTLPANWKQLWMTPLPTWLQSLTLKKFSASRNLIIDVDPAFPWQITALDGYGGELQLVKNGSWGVWNGSATLNAAAATFNRIDVRRPSLKLNATASTVNITELSAFTERGILQATAAVSQLPQRQVNLSFSGRGVPLNILQAWGWPSLPISGDGNLQLTASGSVQADAPLKPTVNGQLSAVNMEKQLVAQIMRNGEVSPAPAAPAPAPVTP

SEQ ID NO: 10787 - protein, 241 aa, Klebsiella pneumoniae
RRPVFLRKKKGWAPRRESGFPTACWEITFAPWVPKTGPGLLLPGVKYRLMLREDNTNLRLTEQGRKLGLVNDERWARYNEKLESIERERQRLKSTWVNPQAESANEVNAHLTAPLSREASGEDLLRRPEMTYEQLVQLSPFTPGLEDRQAAEQVEIQVKYEGYIARQQDEIEKQQRNENTLLPATLDYRQVTGLSNEVIAKLNDHKPSSIGQASRISRITPAAISILLVWLKKQGMLRRSA

SEQ ID NO: 10788 - protein, 152 aa, Klebsiella pneumoniae
TITVPISAPSLFATNSAAGCGGTTQCTAISAVHSGIASFSSEVLVFLAMENASGISSTTPTSTNRVMPQIRPTSTIITSADSQRQRWSVRPMRSAAPETSIILPRMVPRPITAARKPSVPPIPLSMALTISSGPIPIIAPTKKLASSSARNG

SEQ ID NO: 10789 - protein, 140 aa, Klebsiella pneumoniae
NMTVEYTVIEKVPSAEAFCHLRVAAGMSPRPLEGARAGLPHSCYGVHILWQETPIAMGRIVGDGAINFDIVDVAVDPAHQGKGLGRLVMEKLVAWLDANAFDGAYVTLVADVPELYAKFGFESVRPESEGMARVWRTRSR

SEQ ID NO: 10790 - protein, 413 aa, Klebsiella pneumoniae
VRHVDADFNHRGGYQQMHLALLEGLHHRLLLRRFHPPVDEADIELRQRQFELFPGGFRRLGFQQIGLFNQRTDPIGLATFMGTGVAHAVDNIAAPGVGDGDSGHRSSAWRQLVDNRGVQIGVGGHRQGAGDRGGGHDQLMRVEYLLLTFLPQRQPLMHAEAVLFVNNHQRQAVKLHLLLEDGVGADNHLHLAAGDSLLLRLAGFAFLFARQPADFNTQRFEPVAEVIGMLLGKQFGGRHQRHLFAVDDSAQGGQGSDQRFTGANVALHQAHHRHVQRHIVFNLGGNPRLRAGGLKGQGGQQLVFQGIVGAERQGVIALGACPQRQHAEVMRQQLFQNQTLLRRVLAAFQLAKLQGGRRAVQRTQRLRQAHHPLRQLRRQEFANRAGFQELKRLIGELAQGRLLDAFGGRIDWG

SEQ ID NO: 10791 - protein, 474 aa, Klebsiella pneumoniae
NSRFATLGLLVMSVNTAESENAQPVAHKPASELIYRLEDRPPLPQTLFAAFQHLLAMFVAVITPALLICQALGLPAQDTQHIISMSLFASGVASIIQIKAWGPVGSGLLSIQGTSFNFVAPLIMGGTALKTGGADVPTMMAALFGTLMLASCTEMVLSRILHLARRIITPLVSGVVVMIIGLSLIQVGLTSIGGGYAAMADHTFGAPKNLLLAGIVLALIIILNRQRNPYLRIASLVIAMAAGYLAAWFLDMLPANTAPTNSSLITVPTPLYYGLGIDWSLLLPLMLVFMITSLETIGDITATSDVSEQPVSGPLYMKRLKGGVLANGLNSFVSAVFNTFPNSCFGQNNGVIQLTGVASRYVGFVVALMLIVLGLFPAVSGFVQHIPEPVLGGATLVMFGTIAASGVRIVSREPLNRRAILIIALSLAVGLGVSQQPLILQFAPDWLKNLLSSGIAAGGITAIVLNLIFPPEKA

SEQ ID NO: 10792 - protein, 94 aa, Klebsiella pneumoniae
GAPVASVSISCPSCSATDGVVRNRKSTAGHQRYLCSHCRKTWQLQFTYTASQPGTHQKIIDMAMNGVGCRATARIMGVGLNTIFRHLKNSGRSR

SEQ ID NO: 10793 - protein, 498 aa, Klebsiella pneumoniae
RAAVGIQQSSSGQHYSGTHRDRLGGRRGLTRLFRRGFKMATGKIVQVIGAVVDVEFPQDAVPRVYEALEVQNGNEVLVLEVQQQLGGGIVRTIAMGSSDGLRRGLDVKDLEHPIEVPVGKATLGRIMNVLGQPVDMKGDIGEEERWAIHRAAPSYEELSSSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDIIAILGMDELSEEDKLVVARARKIQRFLSQPFFVAEVFTGSPGKYVALKDTIRGFKGIMEGEYDHLPEQAFYMVGSIDEAVEKAKKL

SEQ ID NO: 10794 - protein, 482 aa, Klebsiella pneumoniae
QSGFPEHSRSAHRYDGLRYAAGRQRPELCSVADPSGALRGVEMSSLYQSMIAVIEQSITPLAGRLGQQKYVIAIRDGFTAALPFMIIGSFMLVFIFPPFSPDTTNGFARGWLDFSQHYREQLMLPFNLSMGVMTFFISVGIGASLGRQFQLDPVMSGLLAFMAFLLVAAPYADGKISTQYLSGQGIFTALITAIYSTRVYAWLKQNNITIRLPKEVPTGVARSFEILIPVLVVIATLHPLNLFIEAQTGMILPQAIMHLLEPLVSASDSLPAILLSVLMCQIFWFAGIHGSLIVTGIMNPFWMANLSANQAALAAGTVLPHVYLQGFWDHYLLIGGVGSTLPLAFLLLRSRATHLRTIGKMGIVPSFFNINEPILFGAPIIMNPMMFIPFVCVPMVNAVLAYGATRLGWLSQVVSLTPWTTPAPIGASWAANWTLSPVVMCLICMVMSAVIYLPFLRAYERSLMKTEVEKAKNSVPVAETVS

SEQ ID NO: 10795 - protein, 476 aa, Klebsiella pneumoniae
NVQVLHDSDIYRIATCTGRHLPAFFHYLSAKRRMMKHADLTTLTATFPLVQDLIALKETTWFNPATTTLAEGLPYVGLTADDVQDAHARLQRFASYLAAAFPETAASGGIIESEVVAIPAMKRSLEQKFGQPISGELLLKKDSHLPISGSIKARGGIYEVLTHAEKLALEAGLLTTADDYRKLLTPEFKQFFSQFSIAVGSTGNLGMSIGIMSARIGFKVTVHMSADARAWKKAKLRSHGVTVVEYEEDYGVAVEQGRQAAESDPNCFFIDDENSRTLFLGYAVAGERLKAQFAQAGRVVDADHPLFVYLPCGVGGGPGGVAFGLKLAFGDHVHCLFAEPTHSPCMLLGVYTGLHDQIAVQDLGIDNLTAADGLAVGRASGFVGRAMERLLDGFYTLDDQTMYDMLGWLAAAENIRLEPSALAGMAGPQRVCASKAYHQLQGLSEQQLQQATHLVWATGGGMVPEEEMAQYLAKGR

SEQ ID NO: 10796 - protein, 70 aa, Klebsiella pneumoniae
CMMVFYEVLQWLLFLSAVPPVQLLTGWCVTAKAPPDISAISALTAVKHGNCSSLTPLLNPVRTRKSLIWP

SEQ ID NO: 10797 - protein, 62 aa, Klebsiella pneumoniae
FTVVWRNVACIAARRRNPDTLHSSSRRCVGFISSPQSLTTVSSWGLTNLPPFCNLNYFEYLR

SEQ ID NO: 10798 - protein, 114 aa, Klebsiella pneumoniae
RHVVNDGGNILRAGDARHKKTACAVFGVELTAIERLNQRILYVEKKGIGADINKQTGTGAGYFLQFDGKALRIVKTTRTIHHMTILEIYSTHAEMRQTPDIVNDVAGCRAVARL

SEQ ID NO: 10799 - protein, 121 aa, Klebsiella pneumoniae
PCVVKLAFPRELRLLTPSHFTFVFQQPQRAGTPQITILGRLNSLGHPRIGLTVAKKNVKRAHERNRIKRLTRESFRLRQHELPPMDFVVVAKRGVADLDNRALSEALEKLWRRHCRLARGS

SEQ ID NO: 10800 - protein, 231 aa, Klebsiella pneumoniae
CPAVLLRLRTTPSVAEQEGQLIETEATGAPHKTPSYTKSVSWQHHPLAEWEDIRDELTQKGAQVEELINQLKARQLPARQDELSKQRSMVAAAKLERDKALWDVQQTTIVSPVNAKVFDIIYRAGERPSAGKPIISLLPPENIKVRFFIPEAKLGKFKIGSKVKLICDGCAEPIAGIINYISPEAEFTPPVIYSTKRREKLIFMAEAIPALQQAGRMKIGQPFDVEIIGDE

SEQ ID NO: 10801 - protein, 324 aa, Klebsiella pneumoniae
RMRVLIVKTSSMGDVLHTLPALTDAAQAIPGIRFDWVVEEGFAQIPSWHESVERVIPVAIRRWRKAWFSAPIKAERQAFREAVQAVKYDAIIDAQGLVKSAALVTRLAHGVKHGMDWQTAREPLASLFYNRRHHIAKQQHAVERTRELFAKSLGYAKPQTQGDYAIARHFLQHEASAAAPYLVFLHATTRDDKHWPETRWQELLDLLADSGVHIKLPWGAPHEEARAKRLAEGREYVEVLPRMSLEQVAQVLAGARAVVSVDTGLSHLTAALDKPNFTLYGPTDPGLIGGYGKNQHIVRPENSASTGDIAASRIHLLLQNQGLL

SEQ ID NO: 10802 - protein, 74 aa, Klebsiella pneumoniae
NLSLLFLRFIKQAIKFRKEKECQIHEGIYKGLRSYFYVDISLMYTPPCQILNLVTYLKLHPNFYQLSNPLHQVL

SEQ ID NO: 10803 - protein, 74 aa, Klebsiella pneumoniae
LVSLTISSIALPNGYFPSPLSQNILIFSMIICLNFLRSKSKQKNLSIIPTDRIMGKNENDHSHHKTRGDALFTS

SEQ ID NO: 10804 - protein, 557 aa, Klebsiella pneumoniae
GRSLLLPIRLLQQRNIRHLQEQFTQFGQQRQTVDADIFVFSVNHHVLEELIHRLAQRGQLNQRILITACGEIRLQLVAQHHQITRQLNFRRFFQHRSVNDVVQRLIGFREDVGDTFVCRRQRGGLFQSTEVRYRLHTRIEIRRAGWTTRQYRLDRVDAVAFVLIPGTEAAQHKVDHIINHVGVGQLLTVQTNRFFGQRLQIEIQVLLNDDTQHAQRGATQRKRVFIAFRMLTDTKDTRQGVHLIGNRYRAGHRIRRQRVASKSRLILLVQRHGHVFRFAVMARVVHPHHALGVGELEDHVGHQVALGQQARAGCVVHVSANLFGNPTRQRLDAIGLVAQSPKLLLEQHGFQTRQVIFQTFFTVGIEEELGIGQTRTDHLLVTGDDLLRIFGLDVGHEDKVRQQFAGVVVDREVLLVALHGVNQRFRRHREEFFFELRRQHHRPFHQRGDLFQQAFAQIGLTANLTRRLLRISFDFGFTLFVIGNDFTALQQDLRVLVGMVDGELRLAHKAMPANHAIGRNTEDSGRDHFVTQQQSHRVYRTHEVDVRRAPAHQFRDR

SEQ ID NO: 10805 - protein, 571 aa, Klebsiella pneumoniae
LMISTNSCNWIDLKIGDIADVVAGGTPKSGNQENFKESGTGIPWLTPADLSGYTGKYISFGARDLSQQGYDSSSAKILPKGSLLFSSRAPIGYVAIAQNEISTNQGFKSFVFTYGVDSVYAYHYLRSIKDVAESMGTGTTFKEISGATAKTLPFILPPLAEQKVIADKLDTLLAQVEATKARLERIPEILKTFRQSILTAAVSGKLTEIWRMKNKFNNVAVKHNVNLPTLTQDEYYLDPIEGWQWVRLGSVVNLINGDRGKNYPNKSEYVEKGIPFINTGHINADGTLADERMNFISEAKYGSLSGGKTKSTDLVYCLRGATMGKTARVHYKIGAIASSLVIVRPSDYIDRDFAYYFLISPPAKNLINKFDNGSAQPNLSAKSLATYPLQLPSCKEQIEIVRRVEELFTFADHAEIKVAIALERINKISQSILVKAFRGELTADWRVANPDLISGENSVEVLLQKIKTAREAVKKQPKPTRSAVKKNAGSRMSKQIIKVVEALKQAGEPLSGQQLLAAAGYPNDSSTEQLEQFFLDIRDALAIEKSIVKLERGDDGQDWFTLAEKVEISKA

SEQ ID NO: 10806 - protein, 84 aa, Klebsiella pneumoniae
VSTSWKASVPIIEAGTWPVMQTSGIESRRASAIAVTRFVAPGPLQAIQTAGLPSVRAIPWAIKPAPCSWRARMWRICVLWLKAS

SEQ ID NO: 10807 - protein, 381 aa, Klebsiella pneumoniae
CSTSIRWADFHFLHITVIAVSPFFPSRQRSTMAPSFHSPESQTGAVMKAIAITQAAADGNNIPSLTEIDLPIPTAHGRDLLVAVKAISVNPVDTKVRAGFQGDTPRVLGWDAVGVVQSVGEEVTLFAPGDEVWYAGALGRAGSNSEYQLVDERLVAHKPRTLDNASAAALPLTAITAWELLFHRLGVEEGGNAGDTLLIVGAAGGVGSILTQLASKLTAMTVIGTASRPESQQWVREAGAHHVIDHSKPLADELARIGITSVTHVASLTNTEQHFNALIDALAPQGKLALIDDPETLDVVPLKAKSLSLHWEFMFTRSMFETDDMIAQHQLLTRVAALIDNHTIKTTLGEHYGAITAANLQKAHRQLETGRAVGKIVLEGF

SEQ ID NO: 10808 - protein, 83 aa, Klebsiella pneumoniae
SDYSQKEDVMAKIGDGVPRLIDKAVDFMASSQAFMEYLKKSPRLQHVPRDIPQDKEALFLQRLEYYRQLYRPTCDQTEPESER

SEQ ID NO: 10809 - protein, 199 aa, Klebsiella pneumoniae
SGCSRRLSPAMFGGFALPGTTLMPELLTPRLRCSPLQLDDWSFFLSLQQDPQVMLYVADPRPQAAIREAFDSRLPPWTPGDEHWLCLVVRDRLTHTPLGLTGYQHHQRDIAEVGFLFAPAAQGRGYGYESLRALCDYAFTTGGVRRLTASVTAGNEASKQLLLKAGFRLEGELRENYWLNGRWHNDWLFGRLRGEGDAP

SEQ ID NO: 10810 - protein, 589 aa, Klebsiella pneumoniae
NLPFRSKTMIKTTIWRQVVIAALLAGGSFTVAANPPPPPPVSYGVEEDVFHPVRARQGMVASVDALATRVGVDILRQGGNAVDAAVAVGYALAVTHPQAGNIGGGGFMMLRTKDGKTTAIDFREMAPEQATRDMFLDDQGNPDSKKSLTSHLASGTPGSVAGFSLALEKYGTMPLNKVIRPAIKLAEEGFIVNDALADDLKTYGSEVIPQHENSKAIFWKNGEPLKKGDRLVQKNLGKSLELIAEHGPDAFYKGAIADQIANEMKKHGGLITKADLAGYKAVERTPVSGEYRGYEVYSMPPPSSGGIHIVQILNILENFDMQKYGFGSADAMQVMAEAEKHAYADRSEYLGDPDFVNVPWQALTSKAYAKAIAAEIDVNKAKPSSQIRPGKLAPYESNQTTHFSVVDKDGNAVAVTYTLNTTFGTGIVAGDSGILLNNQMDDFSAKPGVPNVYGLVGGDANAVEPKKRPLSSMSPTIVVKDGKTWLVTGSPGGSRIITTVLQMVVNTIDFGMNVAEATNAPRFHHQWLPDELRVEKGFSPDTLKLLEAKGQKVALKEAMGSTQSIMVGPDGMLYGASDPRSPDDLTAGY

SEQ ID NO: 10811 - protein, 98 aa, Klebsiella pneumoniae
RQRSIVRFLLFTITLGREAPALEKWMKSLFKVTLLAATMAVALNAPLTFAADTATKAAPAAESKSAFKNDDQKSAYGAGRVHGALHGKLPERTREAGH

SEQ ID NO: 10812 - protein, 200 aa, Klebsiella pneumoniae
GFSSCPAALGVCEAGLSLTNSLSSTEKMAEKRNIFLVGPMGAGKSTIGRQLAQQLNMEFYDSDQEIEKRTGADVGWVFDVEGEEGFRDREEKIINELTEKQGIVLATGGGSVKSRETRNRLSARGVVVYLETTIEKQLARTQRDKKRPLLQVDAPPREVLEALADERNPLYEEIADVTIRTDDQSAKVVANQIIHMLESN

SEQ ID NO: 10813 - protein, 443 aa, Klebsiella pneumoniae
SPGSPGIFIFALMKKNINLRSLAAQAIEQVVEKGQSLSNVLPPLQQKVSDKDKALLQELCFGVLRTLSQLEWLISKLMARPMTGKQRTVHFLIMVGLYQLLYTRIPPHAALAETVEGAVAIKRPQLKGLINGVLRQFQRQQEALLAEFAEHENRYLHPKWLLKRLQQAWPEQWQEIVEANNQRPPMWLRVNRNHHSRDEWLALLNETGLEGFTHPDYPDAVRLATPAPVHALPGFAEGWVTVQDASAQGCMRYLQPENGERILDLCAAPGGKTTHILEVAPQAQVMAVDIDEQRLSRVYDNLKRLGMKAEVKQGDGRFPEQWCGNEQFDRILLDAPCSATGVIRRHPDIKWLRRDRDIAELAQLQAEILNATWTHLKPGGTLVYATCSILPEENSQQIAAFLARTPDAELHATGTPASPGQQNLPGVEEGDGFFYAKLIKRRN

SEQ ID NO: 10814 - protein, 100 aa, Klebsiella pneumoniae
KEFSMEYKDPVFELLSSLEHIVFKDDNQKLTSNRKSTVFSEFEQLRKGTGLKIDDFANVMGVSVAMVREWESRRVRPSPTELKLMRLIQANPQLSRQLLD

SEQ ID NO: 10815 - protein, 179 aa, Klebsiella pneumoniae
RLPSRECSTQDAGETAAPAVRSNGHRQTYGRSNTMAYKHILIAVDLSPESKVLVEKAVSMARPYNAKVSLIHVDVNYSDLYTGLIDVNLGDMQKRISEETHHALTELSTNAGYPITETLSGSGDLGQVLVDAIKKYDMDLVVCGHHQDFWSKLMSSARQLINTVHVDMLIVPLRDEEDE

SEQ ID NO: 10816 - protein, 232 aa, Klebsiella pneumoniae
LPSSASAASTWSPVVDKGELVGCLMEKEIAHLLEDDVTEDAQLQGATLPLEKPYLEISPWTLWKKRSVWLLLLFVAEAYTSSVLQHFEEALESAIALAFFIPLLIGTGGNSGTQITSTLVRSMALGEVRLRDMGRVIRKEVSTSFLIALTLGLAGCLRAWMMGIGMEITLIVSLTLVCITLWSAIVSSVIPMVLKRIGIDPAVVSAPFIATLIDGTGLIIYFKIAQYFLGLN

SEQ ID NO: 10817 - protein, 637 aa, Klebsiella pneumoniae
APLSSTGPGGSSQRSCAAAPWPTGTGWPTPSPPEVSMAGSDLLLAGVLFLFAAVIAVPLASRLGIGAVLGYLLAGIAIGPWGLGFISDVDEILHFSELGVVFLMFIIGLELNPAKLWRLRSSIFGVGAAQVMLSAAILGGLLMTTGFSWQAAVVGGIGLAMSSTAMALQLMREKGMSRSEAGQLGFSVLLFQDLAVIPALALVPLLAGSADEHVNWLTVGMKVLAFAGMLIGGRYLLRPVFRFIASSGVREVFTAATLLLVLGSALFMEALGLSMALGTFIAGVLLAESEYRHELEIAIDPFKGLLLGLFFISVGMALNLGVLYTHLLWVAVSVAVLVAVKMLVLYLLARLYGLRSSERMQFAGVLSQGGEFAFVLFSLPASQRLFQHDQMALLLVAVTLSMMTTPLLMKGIDKLLSRRLNPADDTGEAPWVEDDKPQVIIVGFGRFGQVIGRLLMANKMRITVLERDISAVNLMRNYGYKVYFGDATQLELLRSAGAEEAQSIVITCNEPEDTMRLVEMCQQHFPHLHILARARGRVEAHELLQAGVTQFSRETFSSALELGRKALITLGMHPHQAQRAQLHFRRLDMRMLRELMPVHTDTVQISRVREARRELEEIFQREMQKESRQLDGWDEFE

SEQ ID NO: 10818 - protein, 439 aa, Klebsiella pneumoniae
PMISLRHTALGLALSLAFAGQALAVTTIPFWHSMEGELGKEVDSLAQRFNAANPDYKIVPVYKGNYEQSLSAGIAAFRTGNAPAILQVYEVGTATMMASKAIKPVYQVFSEAGIKFDESQFVPTVAGYYTDSKTGHLLSQPFNSSTPVLYYNKDAFKKAGLDPDQPPKTWQDLAAYTAKLKAAGMKCGYASGWQGWIQIENFSAWHGLPVATKNNGFDGTDAVLEFNKPEQVKHIALLEEMNKKGDFSYFGRKDESTEKFYNGDCAITTASSGSLADIRQYAKFNYGVGMMPYDADVKGAPQNAIIGGASLWVMQGKDKETYTGVAKFLDFLTKPENAAEWHQKTGYLPITTAAYDLTRQQGFYDKNPGADIATRQMLNKPPLPFTKGLRLGNMPQIRTIVDEELESVWTGKKTPQQALDSAVQRGNQLLRRFEQATKS

SEQ ID NO: 10819 - protein, 417 aa, Klebsiella pneumoniae
STGLKPKSRALSEGESTIVRNIAVSKEKFERTKPHVNVGTIGHVDHGKTTLTAAITTVLAKTYGGSARAFDQIDNAPEEKARGITINTSHVEYDTPTRHYAHVDCPGHADYVKNMITGAAQMDGAILVVAATDGPMPQTREHILLGRQVGVPYIIVFLNKCDMVDDEELLELVEMEVRELLSQYDFPGDDTPIVRGSALKALEGDAEWEAKIIELAGHLDTYIPEPERAIDKPFLLPIEDVFSISGRGTVVTGRVERGIIKVGEEVEIVGIKETAKTTCTGVEMFRKLLDEGRAGENVGVLLRGIKREEIERGQVLAKPGTINPHTKFESEVYILSKDEGGRHTPFFKGYRPQFYFRTTDVTGTIELPEGVEMVMPGDNIKMVVTLIHPIAMDDGLRFAIREGGRTVGAGVVAKVLG

SEQ ID NO: 10820 - protein, 703 aa, Klebsiella pneumoniae
MKKSLFWLLALVLSPVAVLVVITPMDSQKQYIFGLLSIGILFLMGFSKRRSVSVIMVVTSLLMSTRYMYFRLTQTLHFNSSIEAILGMGLFLAEVYIWVMLLLNYLQTVWPLKRGIVPLPDDMSKWPTVDIYIPSYNEPLEVVRDTVLAAQCIDYPKDKMKIYLLDDGKRSEFAVFAADVGVGYITRNDNKHAKAGNLNHALTLTQGELICVFDCDHVATRVFLQATVGGFLKDPMLALVQTPHYFYSPDPFERNLSVGRNIPNEGMLFYGPIQQGNDNWNATFFCGSCAVIRREALAQIGGFAVETVTEDAHTALKFQRLGWKSAFLDIPLAAGLATERLVVHVIQRTRWARGMTQIFRVDNPLFGRGLTFQQRLCYLSAMLYYQFALPRVVFVTAPLAYLLFNLNIIYSSASLIVSYALPHLFLAIYVGSRMNGRYRYSFWGEIYDIVLAFHLVLPTLVTMIFPKRGKFNVTDKGGLLDVGYFDFTVVRPHLVVACLLALGVVVGIVRAIGHDYFGSDPNVIALNVGWGIYSLIFLLAAIAVARETRQVRKTIRIDVDIPVVIHYASGIVSRSHTADLSMGGCRVVAPDNRHLEDDIEEIELILQSGAISIPAQLVTSDERFLRLKFDEDIPLSRRRELVRVVLARADAWINPPRPQDNPFRSFFTILRCVFELFWLTWKTRRSQRNRATVAKTAQEDGTL

SEQ ID NO: 10821 - protein, 666 aa, Klebsiella pneumoniae
RGRSFMKAVVFAYHDMGCTGIQSLLDAGYDIAAIFTHPDNPGENHFFGSVARLAAEQGIPVWAPEDVNHPLWIERIREMKPDVLFSFYYRNLLGDEILNLAPKGAFNLHGSLLPKYRGRAPLNWVLVNGESETGVTLHRMVNRADAGDIVAQQAVAIGADDAALTLHRKLCAAATELLSRALPAILAGTTDERPQDHSQATYVGRRTPEDGRLDWELPAQTLHNLVRAVSDPWPGAFGYAGANKFIVWKSRVRHDLPAAKPGTVLSIAPLIVACQDGALEIVTGQTERGVYMQGAQLAQALGLVSGAVISSKPVVAIKRRTRVLILGVNGFIGNHLTERLLQDDNYEIYGLDIGSDAISRFLDCPRFHFVEGDISIHSEWIEYHIKKCDVVLPLVAIATPIEYTRNPLRVFELDFEENLKIIRDCVKYNKRIIFPSTSEVYGMCTDKNFDEDSSNLVVGPINKQRWIYSVSKQLLDRVIWAYGDKNGLKFTLFRPFNWMGPRLDNLNAARIGSSRAITQLILNLVEGSPIKLIEGGKQKRCFTDISDGIEALFRIIENKDGRCDGQIINIGNPDNEASIKELAEMLLACFERHPLRDRFPPFAGFREVESSDYYGKGYQDVEHRKPSIRNAKRCLNWEPKVEMEETVEHTLDFFLRTVELVDDKNP

SEQ ID NO: 10822 - protein, 89 aa, Klebsiella pneumoniae
LAGSILNSLAVTLRDAQGDVPAVVMHYGVFIQNVFDFIIVAFAIFMAIKLMNKLNRKKEEAPAAPPAPSKEEVLLSEIRDLLKEQNNRS

SEQ ID NO: 10823 - protein, 72 aa, Klebsiella pneumoniae
FTMSGKMTGIVKWFNADKGFGFITPDDGSKDVFVHFSAIQNDGYKSLDEGQKVSFTIESGAKGPAAGNVTSL

SEQ ID NO: 10824 - protein, 226 aa, Klebsiella pneumoniae
RYPSAFFKLKGTRQQNSATICATILPISGDIMKVAKDLVVSLAYQVRTEDGVLVDESPVSAPLDYLHGHGSLISGLENALDGHEVGDKFDVAVGANDAYGQYDENLVQRVPKDVFMGVDELQVGMRFLAETDQGPVPVEITEVEDDHVVVDGNHMLAGQNLKFNVEVVAIREATAEELEHGHVHGAHGHDHDHDHGHDGCCGGHGHDHGHDHGKGGCGGHGGCGCH

SEQ ID NO: 10825 - protein, 69 aa, Klebsiella pneumoniae
WATSGCGVSANRKAVFICSAGLILFSLVWVNAGWFDLFGMAIANGAHVAGLATGLAMAFVDTLHGRKRA

SEQ ID NO: 10826 - protein, 177 aa, Klebsiella pneumoniae
SVMFKGTFHLNEEQGMSDIVIRHAEPKDIDAIRQIHAQPEVYHNTLQVPHPSEHMWRERLTDTPGVKQLVACIDEQVVGHLSIAVVQRPRRSHVADFGVSVDSRWHNRGVASALMRTMIDMCDNWLRVERIELTVFADNAPAIAVYKKYGFEIEGTGRRYALRNGEYVDAYYMARMK

SEQ ID NO: 10827 - protein, 463 aa, Klebsiella pneumoniae
TSVPRSVCQESRMTKTTIDIQAFINEHPFTRYQWMILALCFITVAMDGFDTAIIGFIASDLVQEWGVEKSALGPVMSAALVGLAVGALTAGPLADRIGRKKVLIMSIVVFGGFSLLTAFATSLNQLTLLRFLTGLGLGAAMPNAATLMSEYAPERRRALLVNLMFVGFPMGSSLGGFLSAWMIPHYGWQSVLVLGGVMPLLLAVALIFLLPESVRYLVVKQHPAQRIAAILRRIAPLPKAVEFVLREAGQVKEKSAIGVIFSPRYAVGTVMLCLTYFMGLLIFYLLTSWLPLLIRETGASMSQASIITALFPLGGGIGVLILGALMDKINPNKVVAVGWLLTGVFVCLVGFSTSSLALMGVMVFIAGSIMNGAQSSMPALAAGFYPTQGRATGVAWMLGIGRFGGILGAFSGAFLMQAQLSFETIFTLLAIPAFLSAIALLIKYRVSKSVPATTDEARSLQKA

SEQ ID NO: 10828 - protein, 91 aa, Klebsiella pneumoniae
STAPVSCRIFPNIAPSATTIARKPSVPPIPFSIVAAILSSGMPEKRPAPIETTIKATKACIRAFMTKNSSSNTEPTAVKTSVKVLTSDCLC

SEQ ID NO: 10829 - protein, 364 aa, Klebsiella pneumoniae
CADPSASGRGVSAHQLCLADVGRAPGGRGDPVRPGDQRDPFRPDYPGNAIMLRYILRRLLLLIPLLLAASAIIFLLLRLGTGDPALDYLRLSNLPPTEEMVASTRELLGLNQPLAMQYLHWLWRALHLDFGLSYATQRPVLDDLLHFLPATLLLTGAALALILVTSLPLGIWAARHRDRLPDYIVRLIAFLGVSMPNFWLAFLLVMLFSVHLQWLPAMGYGDWQHLILPAVSIAFMSLAINARLLRASMLDAASQRHVIWARLRGLSARQVERRHILRNATLPVVTAMGMHIGELIGGTMIIENIFAWPGVGRYAVSAIFNRDYPVIQCFTLMMVTVFVLANLAVDVLNAALDPRLRRHEEVSA

SEQ ID NO: 10830 - protein, 151 aa, Klebsiella pneumoniae
AGRPSPLAWRRVDRRGHCHSGDQRLMGFFWALLSVGLVSAAQLLLRSAMVALPPLTDIVAFLQHLLHFQPGTFGLFFGLLGYLLSMVCWYFALHRLPLSKAYALLSLSYILVWAAAIWLPGWHEPFYWQSLLGVAIIVAGVLTIFWPVKRR

SEQ ID NO: 10831 - protein, 87 aa, Klebsiella pneumoniae
RTSFGTKGSEVRILYHRPNSKSLLNEQAFLHLRPARMRTSGGRRFDSSEARERCVSNGPQGEPRSGESSSITDQIRKACSMSRLFCI

SEQ ID NO: 10832 - protein, 285 aa, Klebsiella pneumoniae
GALPMIENRRGLTIFSHTMLILGIAVILFPLYVAFVAATLDNKSVFETPMTLLPGGHLLENMKTIWVNGVGVNSAPFWLMMLNSFIMAFAITVGKIVVSMLSAFAIVWFRFPLRNLFFWMIFITLMLPVEVRIFPTVEVIANLNMLDSYAGLTLPLMASATATFLFRQFFMTLPDELIEAARIDGASPMRFFRDIVLPLSKTNLAALFVITFIYGWNQYLWPLLIIQDVNLGTAVAGIKGMIATGEGTTQWNQVMAAMLLTLIPPVVIVLAMQRAFVRGLVDSEK

SEQ ID NO: 10833 - protein, 440 aa, Klebsiella pneumoniae
TTSFLICCDNVTYTTGDSQVKSSELNQRRQQATPRGVGVMCNYFVEKAENATLWDIEGNEVIDFAAGIAVLNTGHRHPKVVAAVAEQLQAFTHTAYQIVPYESYVSLAERINDLAPIDGPAKTAFFTTGAEAVENAVKIARAYTGRPGLITFGGGFHGRTFMTMALTGKVAPYKIGFGPFPGSVYHGVYPNAAHGVTTADALKSLERIFKADIAPDQVAAIILEPIQGEGGFNVAPADFMQALRDLCDTHGILLIADEVQTGFARTGKLFAMQHYEVKPDLMTMAKSLAGGFPLSGVVGRAEVMDAPAPGGLGGTYAGNPLAVAAAHAVLDVIAEEQLCQRAEQLGSHLQEVLNQARATCPAIVDVRGRGSMVAVEFNDPQTGEPSPEFTRQVQQKAQENGLLLLSCGVYGNVIRFLYPLTIPDAQFSKALDILARVLKS

SEQ ID NO: 10834 - protein, 364 aa, Klebsiella pneumoniae
SEGPACAMVEGSSLTKDSVMTLHCAFIGFGKSTTRYHLPYVLHRKDRWQVAHIYRRRAKPEEQAPQYSHIHFTSDLDEVLNDPLVKLVVVCTHADSHFEYAKKALEAGKNVLVEKPFTPTLEEAKTLFALANSKGLTVTPYQNRRFDSCFLTTKKVIESGKLGELVEIESHFDNYRPLAETNPGGPQNGEFYGLGVHTLDQIISLFGRPDHVSYDLRSLRNKANPDDTFEAQLFYGDMKAIVKTSHLVQIDYPKFIVHGHKGSFVKYGIDQQETSLKANVMPGEPGFGADDSVGELVYVNEAGEMVREAVPLESGDYGRVYDALYDTLVNGQPNYVKETDVLTNMEILQRGFEQPSPATITLTR

SEQ ID NO: 10835 - protein, 97 aa, Klebsiella pneumoniae
LSALSTGAWLAPSLFCWCYGCLSASGCASPCLSRQWSSGWRSARCCRPLPYGPPVSPPRPPPRPHRPIPGPTPPLAPRPAPPTAIFRRRPSRRPQPT

SEQ ID NO: 10836 - protein, 582 aa, Klebsiella pneumoniae
RRLPFDEGDRLRFVAAIAQLVGLAQHPVALQARFEFTNVIRPRAARQSGDLRQSQIVLVVPRQVESRGVDPFGVLRLAVDHRPHQRVGLLAFAGADQIPRQTVGYPDAVRIQRQAPTLNFRRLRPVALALQSLRLFLQPVVSQAALNIIDTAPLSGREAGDPGAGFLRRFGAIEVGQAAHRQVIAAIQAQRLLVIALRRRRLFARRRDVPQPQHGIAVGAIDPLRLGIIVLRLRKLAGFQGVIPLLYQQPVAVSLQQAVPLAAVRAVRVHGNRFTELRHCPRAVAALGIGLAESAHRVAVAAVGLNGFLQIRDRLRGIPGLDRRQPFRAGAESRILQLRLLLVEQNAGVRRHRAGGKLQKKLLQRLHAGLTHRHAFHLTEPHIGGDTASRGRSGHLRQIGEPLLRFVIGEHLLRQRSQQADVARRAGVQFFQLADAFAMAGRQARHQRPVFNGDVNVIRHPAVQFFIGGDGFIDLPGHAQQSRLLQRLAALAGVAFHLIARRLQLRGVRRQLRQSFQLFLRPGGIPLTQQIAHPRGNQLRVVGINQLQTVQRLAHQVFTIAGLAEAHLLQQMLLGRRRRRLR

SEQ ID NO: 10837 - protein, 256 aa, Klebsiella pneumoniae
PLMPQKIQLEQISLAADRPLVRDVSFTLRRGQVLALLGSSGCGKSLTCAAALGLLPPGVRQTAGRVLLDGIPVHGEQLRGATIATIMQNPRSAFNPLQTMAAHARETCRAAGREANDAVLLAAMEEVGLDNPRALLKRYPFEMSGGMLQRMMVALALLSRAPFIIADEPTTDLDAIAQARILDLLADIVARRGLGLLLVTHDMGVVARLAHHVTVMENGRLVEHCDVNTLFSAPRHPLSQRLLAAHLALYGLEKTP

SEQ ID NO: 10838 - protein, 153 aa, Klebsiella pneumoniae
KNPPWRVFLYLPHPHFTTLSVLFLFIPWSRRMWLLDQWAERHILDAQTKGEFDNLPGSGEPLTLDDDSHVPAELRAGYRLLKNAGCLPPELEQRKEALALADLLNGVRQDDPRHAELSKCLALLELKLRQAGLNTDFLRGEYADALLQKINQE

SEQ ID NO: 10839 - protein, 115 aa, Klebsiella pneumoniae
IHAPQHPLRIDMQIKEGEILLELEDLARQGAVEIGQHGDKVIERRRQHAEQRGEHHQHRRHHQGNGERTPHPAANEPGDQRVENNSEKQRQQQLHQDIGGGVDPGEDNHQRRQLK

SEQ ID NO: 10840 - protein, 567 aa, Klebsiella pneumoniae
IYEPGRGQYPAINPTIYSSTSWLRSSDMRVNHGLTPQDLKAYGINDVQDIVHNPSYDMLFQEELDPNLEGYERGVLTTLGAIAVDTGIFTGRSPKDKYLVRDDTTRDTVWWSDKGKGKNDNKPLSQETWQHLKGLVTQQLSGKRLFIVDAFCGANADTRLSVRFITEVAWQAHFVKNMFIRPSDEELAEFEPDFIVMNGAKCTNPQWKEQGLNSENFVAFNLTERIQLIGGTWYGGEMKKGMFSIMNYLLPLKGIASMHCSANVGEKGDVAIFFGLSGTGKTTLSTDPKRRLIGDDEHGWDDDGVFNFEGGCYAKTIKLSEAAEPDIYHAIRRNALLENVVVRADGTVDFDDGSKTENTRVSYPIDHIDNIVKPVSKAGHATKVIFLTADAFGVLPPVSRLTADQTQYHFLSGFTAKLAGTERGVTEPTPTFSACFGAAFLSLHPTQYAEVLVKRMQAAGAQAYLVNTGWNGTGKRISIKDTRAIIDAILNGSLDNAETFTLPMFNLQIPTALPGVDTHILDPRSTYGSPEQWQEKADQLAKLFIENFEKYTDTPAGAALVAAGPQR

SEQ ID NO: 10841 - protein, 716 aa, Klebsiella pneumoniae
PAGPLARGAKYRLHALSRQQSGQWRRGGKRRYRQSWPRTFAVADPAPAGDDLAGPGGAMTSLAAGKPAPLGASYDGKGGDFALFSAHAERVELCVFDEQGNEQRFDLPARSGDIWHGWLAAAGPGLRYGYRVHGPWDPAQGHRFNPAKLLIDPSAHRVEGDLPDDERLHGGMWQPDRRDSAAVAPKSQVVDLRYDWRGDKPPRTPWGETVIYEAHVKGLTLLNPQLPEAIRGTYKALGHPAMIAYFKSLGISALELLPVAQFASEPRLQRMGLSNYWGYNPLAWFALDPRYASDPDRALDEFRDAVKALHAAGIEVILDIVLNHSAEIDLDGPTVSLRGIDNRSYYWVREDGDYHNWTGCGNTLNLSHPGVVEWARQCLRFWVDECHVDGFRFDLASVMGRTPEFRQDAPLFEAIRRDSVLSQVKLIAEPWDIGPGGYQVGNFPPLFAEWNDHFRDSARRFWLQQNVSLGDFAQRFAASSDLFARDGKPPSATVNLVTAHDGFTLRDCVCFNQKHNEANGEENRDGTNNNYSNNHGIEGLEANFAVIERRRASAHALLTTLLLAQGTPMLLAGDEQGHSQHGNNNAYCQDNALTWLDWRQANPGLTAFTAALIHLRRRIPALTRNRWWQEGDGNVRWLNRNAQPLTAAEWQQGAACMQIQLSDRWLLTLNATAEVVDMVLPEGEWRAVPPFAGEDNPVIMAVWHGPAHGVCVFQRS

SEQ ID NO: 10842 - protein, 422 aa, Klebsiella pneumoniae
LAKLKITTETIRRLRRSPLSAGSATGSGIRFHQISTTSFHYYHAVGGKAALLSEYWQSANRYTYLARLIKGIPMSPPQADKAGLHILLKLAALVIILAGIHAAADILVQLLLALFFAIVLNPLVTWFIRRRVRRPFAITLVVTAMLVMLTALLGVLAASLNDFVAMLPDFNRALTRKILQLQEYLPFLNLHINPERMLRRMDSERLMTWATTLMTQLSGAMASIVLLVMTVIFMLFEVRHLPYKLRFALNNPRLHIAGLHRALKGVTHYLALKTLISLWTGLIVWLGLLAMGVQFALMWGVLAFLLNYVPNIGSAISAIPPMLQALLFSGIYECLLVGALFLVVHMVLGNMVEPRMMGHRLGMSTLVVFLSLLVWGWLLGPVGMLLSVPLTSVCKIWMETTVGGSKLAILLGPGRPKSRLPG

SEQ ID NO: 10843 - protein, 331 aa, Klebsiella pneumoniae
TTHTTEIRMKPSVILYKTLPDDLLQRLEEHFSVTQVKNLRPETVSQHAEAFAQAEGLLGSSEKVDAALLEKMPKLRATSTVSVGYDNFDVEALNARRVLLMHTPTVLTETVADTVMALVLSTARRVVEVAERVKAGEWTKSIGPDWFGTDVHHKTLGIVGMGRIGMALAQRAHFGFGMPILYNARRHHPQAEERFNARYCDLDTLLQEADFVCLILPLSEETHHLFGQAQFAKMKSSAIFINAGRGPVVDEQALIAALQNGEIHAAGLDVFEHEPLAKDSPLLSLPNVVALPHIGSATHETRYNMAACAVDNLIDALNGNVEKNCVNPQVK

SEQ ID NO: 10844 - protein, 246 aa, Klebsiella pneumoniae
SAHTLVRHKMENAMLTFDNVSAHYGKIQALHNVSLHIKQGEIVTLIGANGAGKTTLLGTLCGDPRASSGRIVFDGKDITDWQTAKIMREAVAIVPEGRRVFSRMTVEENLAMGGFFADRDQFQTRIKWVYELFPRLHERRIQRAGTMSGGEQQMLAIGRALMSQPRLLLLDEPSLGLAPIIIQQIFDTIEQLREQGMTIFLVEQNANQALKLADRGYVLENGHVVLEDTGDALLANEAVRSAYLGG

SEQ ID NO: 10845 - protein, 345 aa, Klebsiella pneumoniae
LSVTTQTTAHSSEGRETGSFTFPCLITRNTVSQSLRIIFAGTPDFAARHLDALLSSEHQVVGVFTQPDRPAGRGKKLMPSPVKVLAEAHNLPVFQPSSLRPQDNQRLVADLGADIMVVVAYGLILPKAVLEMPRLGCINVHGSLLPRWRGAAPIQRSLWAGDSETGVTIMQMDVGLDTGDMLYKLSCPITAEDTSGSLYDKLAELGPQGLLATLAQLANGTARPEVQDESLVCHAEKLSKEEARIDWSLSAAQLERCIRAFNPWPMSWLEIDGQPVKVWRASVIAEAAHAEPGTIVAATKQGIQVATGDGILSLESLQPAGKKAMSAQDLLNSRREWFIPGTRLA

SEQ ID NO: 10846 - protein, 301 aa, Klebsiella pneumoniae
GDATTSFNQGVVMSAKHPVIAVTGSSGAGTTTTSLAFRKIFAQLNLHAAEVEGDSFHRYTRPEMDMAIRKARDQGKHISYFGPEANDFGLLEQTFVDYGRHGKGQSRKYLHTYDEAVPWNQVPGTFTPWQPLPEPTDVLFYEGLHGGVVTPQHDVASHVDLLVGVVPIVNLEWIQKLIRDTSERGHSREAVMDSVVRSMEDYINFITPQFSRTHINFQRVPTVDTSNPFAAKAIPSLDESFVVIHFRNLQNIDFPWLLAMLQGSFISHMNTLVVPGGKMGLAMELIMTPLVERLMEGRKIG

SEQ ID NO: 10847 - protein, 168 aa, Klebsiella pneumoniae
MMSTFDKHDLSGFIGKHLVYTYDNGWNYEIYVKNGHTLDYRIHSGIVGNRWVKDQEAYIVRVGESIYKISWTEPTGTDVSLIVNLGDKLFHGTIFFPRWIMNNPEKTICFQNDHIPLMNSYRDAGPAYPTEVIDEFATITFIRDCGADNDEVINCPASELPADFPANL

SEQ ID NO: 10848 - protein, 61 aa, Klebsiella pneumoniae
AYGTVYHPAFFKAKWNYIAGESRLRRHDRRGSSRATYPGTDCRAFAWMTVNSLQPGGFAGL

SEQ ID NO: 10849 - protein, 100 aa, Klebsiella pneumoniae
PTITTLWRVEAMKLVTGMVASLVIGTLSFGAFAAKEIQKEDVAKMNLTKVGSITTSRTTSPMDARRDLSKKADELGGKYFVVIAGQKNEKTVHANADVYK

SEQ ID NO: 10850 - protein, 251 aa, Klebsiella pneumoniae
NRTTRMSNWPYPRIVAHRGGGKLAPENTLAAIDVGARYGHTMIEFDAKLSKDGQIFLLHDDNLERTSNGWGVAGELAWDDLLKVDAGSWFSREFKGEPLPLLSQVAERCRCHGMMANIEIKPTTGLGPQTGRVVALAARDLWQGMTAPLLSSFEIDALEAAQEAAPELPRGLLLDEWRDDWRELTTRLGCVSIHLNHKLLDAARVASLKQAGLHILVYTVNKPQRAAELLCWGVDCICTDAIDVIGPNFQP

SEQ ID NO: 10851 - protein, 213 aa, Klebsiella pneumoniae
EVETMIGLVGKKVGMTRIFTEDGVSIPVTVIEVEANRVTQVKDLANDGYRAIQVTTGAKKANRVTKPEAGHFAKAGVEAGRGLWEFRLADGEEFTVGQNISVELFADVKKVDVTGTSKGKGFAGTVKRWNFRTQDATHGNSLSHRVPGSIGQNQTPGKVFKGKKMAGQLGNERVTVQSLDVVRVDAERNLLLVKGAVPGATGSDLIVKPAVKA

SEQ ID NO: 10852 - protein, 121 aa, Klebsiella pneumoniae
GLPTFASTLNSRFIRSTMMSRCSSPIPAIIVWLDSSSVHTRKDGSSLARRPRARPIFSWSALVFGSTAMEITGSGNSIRSRMIGASGSHRVSPVVTSFRPIAAAMSPARTSLISSRLLACI

SEQ ID NO: 10853 - protein, 147 aa, Klebsiella pneumoniae
LPTTDPFAYPEGEAMKEKPTETVRLDKWLWAARFYKTRALAREMIEGGKVHYNGQRSKPGKIVELDAMLTLRQGNDERTVRIIGITEQRRPASEAVNLYEETAESIEKREKMALARKMNALTMPHPDRRPDKKERRDLMRFKHGESE

SEQ ID NO: 10854 - protein, 363 aa, Klebsiella pneumoniae
RLATAICMEAFGVNKRDAMNQIRQFGSKFDRLRNAAGGGGGGRNAPKRPKAAPNPASRKSNVFNEQVRYAWHGALQDLKSTPLATFLTVMVIAISLTLPSVCYMVYKNVSSAASQYYPSPQITVYLEKTLDDDAAARVVGQLQAEQGVDKVNYLSRDEALGEFRNWSGFGGALDMLEENPLPAVAIVVPKLDFQSTEALNTLRDRVTRIQGVDEVRMDDSWFARLSSLTGLVGRVSAMIGVLMVAAVFLVIGNSVRLSIFARRDTINVQKLIGATDGFILRPFLYGGAMLGFSGAFLSLILSEILVMRLSSAVTEVAKVFGTQFELSGLGFDECLLMLIVCSMIGWVAAWLATVQHLRHFTPD

SEQ ID NO: 10855 - protein, 407 aa, Klebsiella pneumoniae
FIRTTAMNAANRQSTRWLTLIGTIITQFALGSVYTWSLFNSSLSDKLGEPVSQVAFSFGLLSLGLALSSSVAGKLQERFGVKRVTMASGILLGLGFFLTAHSSSLMMLWLSAGVLVGLADGAGYLLTLSNCVKWFPERKGLISAFSIGSYGLGSLGFKFIDSHLLATVGLEKTFVIWGAIVLVMIVFGATLMKDAPNHPAATAANGVVENDFTLAESMRKPQYWMLAVMFLTACMSGLYVIGVAKDIAQGMVHLDVATAANAVTVISIANLSGRLVLGILSDKISRIRVITIGQVVSLVGMAALLFAPLNALTFFAAIACVAFNFGGTITVFPSLVSEFFGLNNLAKNYGVIYLGFGIGSICGSLIASLFGGFYVTFCVIFALLILSLALSTTIRQPKSTVYNEAHA

SEQ ID NO: 10856 - protein, 74 aa, Klebsiella pneumoniae
RLFATRNAGLNGGRLSRCRCVVCGPQSRSLTDVSSRGFRVLTPFCNAKCWVKWVGAFHSANALSAALNPGHLLM

SEQ ID NO: 10857 - protein, 154 aa, Klebsiella pneumoniae
FVFAVSWRHWPQDHILANPLHALRGIVIITFINCSGAMVEIIPTDMTPPENDSREFHPMRGVGNRHLQTMLPRLIRRKLRFTPHWQRLELPDGDFVDLAWSEDPHQARHKPRLVVFHGLGRHSAQPVRPWSDPRGDAARLAGRGDAFPRLQRRT

SEQ ID NO: 10858 - protein, 415 aa, Klebsiella pneumoniae
QRIAVLKDKPCRQTIGQILQRTVSDGVRQTAGAAHQRQRPVLQTIQLGQAAGFKAARDQNDVGAAHNAVGEGLMVANLHTHFARVFGGGGEENFLQHRIAGAQQRQLGALLKQTRQRFKHQVQPFLAGKTADDGKQRRFIIDLQAHGNLQLTLVLRLLLQRVAIVAHRQQQIVLRAPDTVVNAVENSRQPTFMMALAQQPLHAVGVLRLGDLARVGRAHRRNMVGVVEAGLEKRDLPVKLEAMHVIERPRQLNVIHMPGVKHPLVRQVVHGKHRFSRASARRQVGRRQAGVPVMGMHHIRAPERIQSAGHFTSHPAQQRKAQDVVGISVLVGIVVRAPRTVIEMRGVYQVDPHAVKVAVQQRDPPGEGIPAGHHLGIHHAATDIGKRRQQHARIDTLRDLRRRQCADDVRQTARL

SEQ ID NO: 10859 - protein, 73 aa, Klebsiella pneumoniae
PEIAAYTCGTQGTIRGATMRPLTDKQKSRLWEQTRNTNFQASRRLEGVTVPLVTLTAEEALARLATLRREYER

SEQ ID NO: 10860 - protein, 121 aa, Klebsiella pneumoniae
SMIAEQSEKQLILHIVHRRWSSSKAQRLSGKSPGEWNIFRRYFIDPDYGLSVKSGAFPLAKKKRQTQSQQGLTRDTSIIVALIRANSWQGKEGKRAAYCKEARVSSVTLAFYFPRAGDERA

SEQ ID NO: 10861 - protein, 194 aa, Klebsiella pneumoniae
RYAALIFLQQHRVVMTKSALFSVRKNEPCPQCGAELVIRSGKHGPFLGCSHYPDCDYIRPLKSQADGHIVKVLEGQECPSCGAVMVLRQGRFGMFIGCSRYPECEHTELIDKPDETAIACPQCGQGHLVQRRSRFGKTFHSCDRYPDCQFVINFKPVAGECPECHYPLLIEKKTAQGLRRFCASKQCGKPIPAE

SEQ ID NO: 10862 - protein, 221 aa, Klebsiella pneumoniae
PAAADGQTVSRHKRRPFFLASRADRLVCRCKRAGAPGGACALIAFLLHSQRNKINAMFIKKNKTEPQISEAATPPAINPEPEAVASKKHETTVIASGVHFVGNIVASGHVYIHGQVTGNIEAKEHLIKVMREGQVEGNVSCRELIIDGKVQGQCHGDSITIEEHGHLEGTLAYRALAIKKGSVFSGRAEMLAAAENKSHILGLVADAPSKTDAEPVRPQSA

SEQ ID NO: 10863 - protein, 103 aa, Klebsiella pneumoniae
KTAAERVSGAERGSRSDRASARRALLLLSPSSGGTLPPVLPGPFCVTAQHLPLNDRQKPGKEYDLSLIFNIFPRQVILNPHMLPVSSISGATGKKIASYPFSG

SEQ ID NO: 10864 - protein, 136 aa, Klebsiella pneumoniae
RGHAMQRVTLTLDDDLLAALDALSARRGYHNRSEAVRDILRDALNQDPPSPESRRGYAVLSYVYEHEKRELASRLVATQHHHHDLSVATLHVHISHDDCLEIAVLKGDMAEVQHFADDVIAQRGVRHGHLQCLADD

SEQ ID NO: 10865 - protein, 95 aa, Klebsiella pneumoniae
GQRAGVAAISSAVSHRLGGGERPRSARPTAGAAAGSDFPRPLGRAGGGQVREYHAGGRGSAESRSGRQPRQRRGGRSRPGLFPARRPRAGSGAAQ

SEQ ID NO: 10866 - protein, 485 aa, Klebsiella pneumoniae
NRFAGDSGPGRQRGAAHSRRAGRVTFLRNDNSRPVPYLQRGTAASVSTDVCLLIDRGKPMNSSTNATKRWWYIMPIVFITYSLAYLDRANFSFASAAGITEDLGITKGISSLLGALFFLGYFFFQIPGAIYAERRSVRKLIFICLILWGGCASLTGIVHNIPALAAIRFILGVVEAAVMPAMLIYISNWFTKSERSRANTFLILGNPVTVLWMSVVSGYLIQAFGWREMFIIEGVPAVIWAFCWWVLVKDKPSQVSWLAESEKAALQEQLDREQQGIKAVRNYGEAFRSRNVILLCAQYFAWSIGVYGFVLWLPSIIRSGGENMGMVEVGWLSSVPYLAATIAMIVVSWASDKLQNRKLFVWPLLLIGGLAFIGSWAVGANHFWVSYTLLVVAGAAMYAPYGPFFAIIPEMLPRNVAGGAMALINSMGALGSFCGSWFVGYLNGATGSPAASYIFMGVALFASVWLTLIVKPANNQNLPLGAHHA

SEQ ID NO: 10867 - protein, 72 aa, Klebsiella pneumoniae
TVSARGEPMETYCRFGNPIAHSKSPAIHQLFGPPVRNYSSLWTCTGAAGRFCLFSESVLCRRRKGGQRHRSF

SEQ ID NO: 10868 - protein, 85 aa, Klebsiella pneumoniae
VESARRIRLKRLPMHDSTLETRLAELESRLAFQEITIEDLNKTVTAHEIEMAKMREHMRLMIEKLKATQPSHIASQAEETPPPHY

SEQ ID NO: 10869 - protein, 414 aa, Klebsiella pneumoniae
NLSARRSVNALYLSIHRPVMTNSNRIKLTWISFFSYALTGALVIVTGMVMGNIADYFHLPVSSMSNTFTFLNAGILISIFLNAWLMEIVPLKTQLRFGFILMVLAVAGLMLSHSLALFSASMFVLGLVSGITMSIGTFLITHMYEGRQRGARLLFTDSFFSMAGMIFPMVAAVLLARSIEWYWVYACIGLVYVAIFVLTFGCDFPVLGKKAQSENSQPVVKEKWGIGVLFLSVAALCYILGQLGFISWVPEYAKSLGMSLGDAGKLVSDFWMSYMIGMWSFSFILRFFDLQRILTVLAGLATVLMYLFINGSPEHMPWFILTLGFFSSAIYTSIITLGSQQTRVASPKLVNFILTCGTIGTMLTFVVTGPIVAASGPLAALHTANGLYAVVFVMCFILGFVSRHRQNNAQAASH

SEQ ID NO: 10870 - protein, 453 aa, Klebsiella pneumoniae
HRPAELPGPVLGALTPGHRHGEREILLWAVIAALAEGVAAEIFVVVPDHIVEADGDATIILVDDLVVVPGHPAHAPVIRHVFTGQRVGAQRGPDAVSLPAIVAQAQAAAVGADAAPGGAGMAAAVLLPAKGEQRAGDRPPVDVDRVPHRPDVAAVAQPPHHIDNIEAHRRSADIPAPGVILPADRHAGPAVGLIFTAAGTGDLPAGAPAGRVAPVAVGGKAAGIHIDQIGAKEHPAIRQRSIHLQHGGMRLQVGIAAGAAGTPEVVFQGDVQILLTIKVGGIAADPTLQPVIMAVVARQPRKSIVILRLRGGNAGGHHRFPVVRQRLLRRPALGGKARGIAQHQRALHRGRLRLRLRHNLIKNPLRVSGIAKASSRQRHPPLHVHGFGLCAFQLHDLRPGGRFIALGQVDFRKAEARIAVVGLLTQHPLIVGNRRLAVSALLRPVGQRQVIAH

SEQ ID NO: 10871 - protein, 407 aa, Klebsiella pneumoniae
REYAPRLSHAGRGGQASCLLFDRDVIEVVFAQRVHHIAFDFFTHRLIDGGVSNDQRRSLVMHHYLSLFVQFNTLVVVVGSAGRLNEIFKRLIAPARVVGAVFRRGAAEQGREEVIRIPVVAGPAHHHALVLARFRPLQILAPLVGDDLGLDANLGPVSLNHLRHAAGVRVVRTLYRHRPQIDGEAFFQARFFQQLLRLLRIVGVVLNVVVIAPHGRRDQVLRRLACALVNRFDDRFFVDRVGQRLTYFDVVQRFLLGVKGEITNVQTRLFQQGNVLIFLHARDVRRVRVRHHLALIFLQLGIAHGSVRGDGEDQTIDLRLGTPVAREGFIQNAGIFLVLQQLEWAGTDRIEIHFFRRAGFQHVVSILFRKNGGEVHGQISEERRFRTGQDELDGIIVHFLHFANQVR

SEQ ID NO: 10872 - protein, 258 aa, Klebsiella pneumoniae
ATNAGSKSAMARKIIVVTAAYGNDHVKSLGGQAAVLPFIANAGADGVEIRRELCSAEELNALPSLAATIERHGLLACYSAPQALFTDNGELNPDLPTLLAEAQTLNALWLKLSLGHFLHNQQLDELRDILSDSGMALVVENDQTDCGQLAPMQRFKAACRVHQLPITLTFDMGNWLWVGDSPEEAARHLAPAVSYIHVKAAEPHHEKFRAVPPDQAAERWLALLDNLPADAPRGIEFPLTGHDLTAVTRRYVNLLRED

SEQ ID NO: 10873 - protein, 106 aa, Klebsiella pneumoniae
RRCASRTIACASGWLEPCSTAAASASSALSSTSAVAITEVTCGWPTVRVPVLSNATWRTWPSCSSAAPPLISAPRRAATARPEVMAAGVEMTSAHGQPISSSVSPL

SEQ ID NO: 10874 - protein, 147 aa, Klebsiella pneumoniae
RERALMRINLRGAWTGLPILLAMGLSGGGVALWRDLRPPQAAVTRDAALQTQWRRIMALRIPGEENPGARIDTQSFSPIAIPLSGAKLIAWRPQGSGGEMELTLSWSTVPALFSWLARCGMNPRSFSLGREAQTLRLRLLLEAEDER

SEQ ID NO: 10875 - protein, 372 aa, Klebsiella pneumoniae
PCSARLCAAWSIVRNKMAGLKLQAVSKSWDGKTQVIQPLTLDVADGEFIVMVGPSGCGKSTLLRMVAGLERVTSGDIWIDRKRVTEMEPKDRGIAMVFQNYALYPHMSVEENMAWGLKIRGMGKGLIAERVQEAARILELDGLLKRRPRELSGGQRQRVAMGRAIVRDPAVFLFDEPLSNLDAKLRVQMRLELQQLHRRLKTTSLYVTHDQVEAMTLAQRVMVMNKGVAEQIGTPVEVYEKPASRFVASFIGSPAMNLLEGRISDDGGRFELAGGMQLPTNHEHRRHAGRKMTLGIRPEHFILSSQAQGGIPLLMDTLEILGADNLAHGRWGEQKLVVRLPHQQRPAAGSTLWLHLPLEHLHLFDGETGQRA

SEQ ID NO: 10876 - protein, 80 aa, Klebsiella pneumoniae
NDGASVPTSRFIVLILTGIRQGGVAGMSEKCDPEHYSVGEKAKICCKNHRDMTIERLPPVAKNLLQANTRKKSSSSSPRY

SEQ ID NO: 10877 - protein, 253 aa, Klebsiella pneumoniae
AGLAQQLEGDHTDNRPGGAKDGFHHGPGLQRLGFTGAGKFTEQPEAGVVHVAYHNRAAGDTDRQCRHLRAAVVQLLNHRHHQADRRQARHGGRALNDTHRRRQYEAGNSDRQPHSGQRFTKRRANAGVNQHLLEDAASPDHQQNNPGRLQRVAANLHHPVFRHSLTYRQTVNRHQAGHQDRGERVADKLEPFVGSGTHRHKARGDGFQANQHQRQQDQRQAEAEGGHFAFAEMRFRDVVRNMQFDVAADEVAP

SEQ ID NO: 10878 - protein, 150 aa, Klebsiella pneumoniae
RNSAYSATSRRRAPAAGAAYPDPPASRPPSSGRKAAHGSGCNPSPAEYRPRRRRTSCWSPAAPPALWRCNRIHGCCSPPPSARWRAAGSRTGSGSAADSGLASGCANGTMTPTRRAPRTSSRCADARSPARRTRDTPVGCNSRPGRGCSR

SEQ ID NO: 10879 - protein, 133 aa, Klebsiella pneumoniae
ARPALWSLSGSAPPPVHRASEFPAGSPCSGQSPADAGRRRPGCWPDGWHAPAGRYAPARWRPCPALRSAPDGRPAFSAGRRRARFSAADAAPPAGFQSPSFRGTGARAGRSAPRPSAQSADPAALPGAGRAAE

SEQ ID NO: 10880 - protein, 81 aa, Klebsiella pneumoniae
KSTALEVFMRTVNYSEARQNLADVLESAVTGVPVTITRRGHKSAVIISAEEFERYQAARMDDEFAAIMAVHGDEIRELADK

SEQ ID NO: 10881 - protein, 93 aa, Klebsiella pneumoniae
NAAAGTECMNQAIQFPDRESWDAERQGVVFPALVNGMQLTCAISGQILQQRFGAEGPAQWLAAFQEHRWDLEEEAEALIRDGQEDAQGWIWLS

SEQ ID NO: 10882 - protein, 161 aa, Klebsiella pneumoniae
GGQAMFDVLMYLFETYIHSEAEMRVDQDKLTRDLTDAGFEREDIYNALMWLEKLADYQEGLVEPMQLASDPLSLRVYTEEECQRLDASCRGFLLFLEQIQVLNLETREMVIERVLALDTAEFELEDLKWVILMVLFNIPGCENAYQQMEELLFEVNEGMLH

SEQ ID NO: 10883 - protein, 527 aa, Klebsiella pneumoniae
PTYFTLTFFGSPSVGCCCNQECSSGVHMQGTTIKLLTGGLLMVAAAGYVQAEALQPDPAWQQGTLANGLSWQVLATPQRPSDRIEVRLSVNIGSLSESTQQSGFSRFIPRLALTQSGSLPTMQARSLWQQSIDPKRPLPPAIVSYDYTMFNLSLPNNRNDLLKEALSWLADASGKLAITPESINHALQGSDMVATWPLDTKEGWWRYRLKGSTMLGHDPAAPLKQPIDVAQLKDFYQKWYTPDAMTLIVVGNVDSRSVAEQINKTFGDLKGKRETPAAVPTLSPLPTVPVSIMTNAVRQDKLSIMWDAPWQPIRDSAALQRYWRDDLAREALFWHVQQSLSKNNVKDIGLGFDCRVLYQRAQCAINIDSPGERLNNNLSVVSRELAKVRDNGLPQEEFDALIAQKSLELQKLFATYARTDTDILMSQRMRSLQNQVVDIAPEQYQKLRQEFLNSLTVDMLNQYLRQQLSQDMALVLQQPKGEPEYNMKELQATWEKLMAPNPAATAASGSADTVDAHSEASDIPPGQ

SEQ ID NO: 10884 - protein, 127 aa, Klebsiella pneumoniae
RLRAGPGRFPSVPAAMSVWICLVCASLLSCAGQLCQKQATRPSRRGRRSRHILFWLGMALLCLGCGMLLWLSVLQSIPVSIAYPMLSLNFVWVTLAGWGIWHEPVARRHWLGVGLIVVGIVILGTSV

SEQ ID NO: 10885 - protein, 214 aa, Klebsiella pneumoniae
RSGAVCEQMSCAAKSARVSCLRTVRDEDVAQTPDGLDVARMRRILFHHAPQAGDLYVDGALHRRVFAAAGEVHQLIARQRLTGMAHQRLQDREFAAGQRHRLVFTEHLAGTQVQFEFTKGDNRLFLRRRARQLVRLAAQHRPDAGQQFTRVKRLRNVVVSPDLQTHDPIDLFAFRRHHNDRHRVTLAAQTTADRETIFARQHQIQHHQVEGFTG

SEQ ID NO: 10886 - protein, 128 aa, Klebsiella pneumoniae
SPAACHPPPTAPHRYRPPGSAVATIAYLSPSSAAASSSSTTLPPPAAAPSGRAETTAERRAAKRGQTRTRRPGLIRPRTASARNFAGHRDGPADRAPAFLPPPAPPRSPPPTADGYTVRQGSAPCRRK

SEQ ID NO: 10887 - protein, 287 aa, Klebsiella pneumoniae
RPAAPAQPAPAGRASGVIRSGENTMNLLSATGVSHDYPHHGRVLHEIQLAIAPGETVALLGRSGCGKSTLARMLVGLETPQHGDIAWRGTPLTALKGEAIGAFRRDIQLVFQDAFSAVNPRKTVREIVSEPLRHLLCLSREARARRVEEMLLAVDLASSLLDKRPAQLSGGQLQRVCLARALAVRPQLLILDEAVSNLDLLLQAEIIALLKRLQAQFDTACLFITHDLRLVERFCQRVLVMEHGRIVETATVSLPLRLRSPAGQALQQAVLPPFPATLLNEAMPCSA

SEQ ID NO: 10888 - protein, 183 aa, Klebsiella pneumoniae
KNAALSLSARQSVIPLCRPVGWSTTMSPAASVTLEVRMIRKWDTEDTAPLLALWLDSTIHAHPFISESYWRDSVAVVRDVYLPAASTWVWEQDGELKGFVSVLDSRFVGALFVAPGATRQGIGRALLDEVKRHYAWLSLEVYQKNESAVSFYHAQGFRIEDCAWQDDTQHPTWIMRWPADQMP

SEQ ID NO: 10889 - protein, 106 aa, Klebsiella pneumoniae
FSAAGAGRGAILGGGAMAGSDAGIEGAGVGAGSCLTGSGAAAAVSTTGWEVAGAAEAADTTGSEVGAAATAASTWRNRSAGTDCGNGAETEPPSAREEDFSVPGFS

SEQ ID NO: 10890 - protein, 272 aa, Klebsiella pneumoniae
YFQARTAERGAEALAAAGRVCREKIRKPEMAILGLQGVRGGTGVTSITAALAWALQLLGESVLAIDASPDNMLRFFFNTDIHHQDGWARALLDGRDWRDAGLRYTQHIDLLPFGQLSAGERENVDQLQPTLGAIAEAVQQLQGQYRWLLLDLPAGYSPLTRELLTLCDRSLVVVHPDANSHIRLHQQPLPANGDILINDLRVGSQLQEDLYQLWLESQPRILPVTIHRDEAMAECLAAKQPLGEYRQDSLAAEEVLTLANWCLIHYSAGRAA

SEQ ID NO: 10891 - protein, 429 aa, Klebsiella pneumoniae
AAQARRQKFRHKRRSGQGESSEHSRRKPPGTARLGWLTVQANQSAHHAVGPAKAILQGILPAATLMGDAGGNMVFFNQLVMLLVKVVDRLQPAPGNLISQRILAVTFKSLDRHPLQRRPAVGFIPLLTAFVFGGHDPPGGEQAGPHRIGKAFCLFVGRQADVKGDDTGCGKQRQLFTAPVIIAETAVLIIPQIAVDRRPPILGLLAEGRLRLAIALQAGEVGNGRLQLEQEGVQVDGDKLRRADAGQPRDIPQPAAGVVPAGRGARPQVAVYFIGGPPGVSGGLHVFAPRLIPRRVTVVPVAIEQGAIRHTHHVAIRLVRDQRLGAVHPEGVLHLQMVQIALRAAHAILFKEFDHQGEHRRLRAAEVVGAVAVRNVAVGFNQPGKVIGHAFQQIFPAALRQPQHGEIRVPVIGFAKATAGHDVGLRQRQ

SEQ ID NO: 10892 - protein, 343 aa, Klebsiella pneumoniae
CREAWIMSTQKAATPQPLLQAIDLKKHYPVKKGLFAPERLVKALDGVSFTLERGKTLAVVGESGCGKSTLGRLLTMIEIPTGGELYYQGQDLLKHDPQAQKLRRQKIQIVFQNPYGSLNPRKKVGQILEEPLLINSSLSKEQRREKALAMMAKVGLKTEHYDRYPHMFSGGQRQRIAIARGLMLDPDVVIADEPVSALDVSVRAQVLNLMMDLQQDLGLSYVFISHDLSVVEHIADEVMVMYLGRCVEKGTKDQIFNNPRHPYTQALLSATPRLNPDDRRERIKLTGELPSPLNPPPGCAFNARCRRRFGPCTQLQPQLKDYGGQLVACFAVDQDENPQKSHA

SEQ ID NO: 10893 - protein, 260 aa, Klebsiella pneumoniae
ARRAFLRIRTDYCSEPLGVQTMQENYKILVVDDDMRLRALLERYLTEQGFQVRSVANAEQMDRLLTRESFHLMVLDLMLPGEDGLSICRRLRSQSNPMPIIMVTAKGEEVDRIVGLEIGADDYIPKPFNPRELLARIRAVLRRQANELPGAPSQEEAVIAFGKFKLNLGTREMFREDEPMPLTSGEFAVLKALVSHPREPLSRDKLMNLARGREYSAMERSIDVQISRLRRMVEEDPAHPRYIQTVWGLGYVFVPDGSKA

SEQ ID NO: 10894 - protein, 279 aa, Klebsiella pneumoniae
YSRAVLPDKEIVSMAFRNWRLGMHIQQDSIAIVALLHERSHWALRRWWRIPLPPGLVRQGMVADVSALGSRLAAWRRELPAQHQVSIAFPAVRTLQKRLPYPQFALREREQATWVASAMSQQLAMPASALCIDYAPTSRDDGWQVTAAQRLDINVLRELAGRLRLRVAAIVPDASALGAFFPWMTAADQGLAWRDEKRWLWATREAWGSDACADVGSLSQLAGQLQVPLRLCIDAGDEASRFDVWQVIHRRQPPLPADGDRYAIALGLALGGGRHDACR

SEQ ID NO: 10895 - protein, 68 aa, Klebsiella pneumoniae
YRCYGSVRWVLYEPFDSSFISLGVQLSYPERATHLKRPPGDYDSEGITNGSERTPCWLRPYGERLHVS

SEQ ID NO: 10896 - protein, 87 aa, Klebsiella pneumoniae
VILYHRPNSKSLLNEQAFLHLRPLRMRTSGGRRFDSRFVGPRKRSAAGHHQCTTGQKYHQNHNKRLYSRFQPAIRYFVTSSIAFFYR

SEQ ID NO: 10897 - protein, 190 aa, Klebsiella pneumoniae
QRNYQVIWSSTMAKLHDYYKDEVVKKLMTEFNYNSVMQVPRVEKITLNMGVGEAIADKKLLDNAAADLAAISGQKPLITKARKSVAGFKIRQGYPIGCKVTLRGERMWEFFERLITIAVPRIRDFRGLSAKSFDGRGNYSMGVREQIIFPEIDYDKVDRVRGLDITITTTAKSDEEGRALLAAFDFPFRK

SEQ ID NO: 10898 - protein, 158 aa, Klebsiella pneumoniae
RLRYGGPAGAPPASSIQWRRQRHPAPRRTVFHRRRWLHRPSRPRPAVAPAAAPGGPRRCCFSSHCATPSAPGSPAPASSVVPALFAPRRHPPDAADSASARQSAPGCWDQSAPDGTATGAPGLHDCWPRRGAPAPADAPGQASSSPALTVAAQRRGTA

SEQ ID NO: 10899 - protein, 89 aa, Klebsiella pneumoniae
AGSYPVAGYLPHRDAGVCDWHLCGAGPDDHPVAGAGDVQLLGRGAGAEPQRQNTGLRAAGRRLRDGGDDQGLPGAGGAGGGRSAVGDRP

SEQ ID NO: 10900 - protein, 118 aa, Klebsiella pneumoniae
KLSLWHQKYSKERIMAAKIRRDDEVIVLTGKDKGKRGKVKNVLSSGKVIVEGINLVKKHQKPVPALNQPGGIVEKEAAIQVSNVAIFNAATGKADRVGFRFEDGKKVRFFKSNSETIK

SEQ ID NO: 10901 - protein, 428 aa, Klebsiella pneumoniae
MDDFKPEDDMKADRNDRRAGRSRQSSERDADPQINFDDVDLDADEGRPTRAGKARREREEEEFEEELDAQDEEMLEEQPVERRPRKRKKAPAKPASRQYIMMGVGILVLLLLIVGIGSALKSPSSSSQQTASGEKSINLSDDQSASMPAAGQDQTAAANSTSQQDVTVPPIAANPTQGQAAVAPQGQQRIEVQGDLNNALTQQQGQLDGAVANSTLPTEPATVAPIRNGANGTAAPRQATERQTAATPRPAERKHTVIEAKPQSKPQAVAKTPVESKPVQQKHVESTATTAPAKTSVSESKPVATAQSKPTTTTAAPAATAAAAAPAAKSGKTAGDVSSMKTAPSGHYTLQLSSSSNYDNLNNWAKKEKLDKYVVYETSRNGQPWYVLVSGIYASKDEAKRAVTSLPADVQAKNPWAKPLHQVQADLK

SEQ ID NO: 10902 - protein, 227 aa, Klebsiella pneumoniae
KSDFQHLFTVVLAHFAQFSPFSGDAQGDKSHQTLLTFPYFEGYMAAQVRPYKAFFPQIGLRVMIDASSVVIGDVRIADDVSVWPLVAIRGDVNYVSIGQRSNIQDGSVLHVTHKSSYKPEGNPLIIGEDVTVGHKVMLHGCTIGNRVLVGMGSILLDGVVVGDDVMIGAGSLVPQNKQLESGYLYFGNPVKQIRPLTEAEREGLKYSANNYVKWKNEYMDQDNQIQP

SEQ ID NO: 10903 - protein, 809 aa, Klebsiella pneumoniae
RRLYPDALNAPRRRSPQTRQWLNNDDNAMKRKLSWMCAVAVGMCSWYPLASYAAPAAVANAAPGVQPQAATPAAPIVVGEPTATLAEPTAPAAVAENVPQREVKLSFATIAPPPGSIVLRGSRPDASVEFGMRSDELVANALLNLEYTPSPSLLPVQSQLKVYLNDELMGVLPVTKEQLGKKIRAQLPIDPLYITDFNRVRLEFVGHYRDVCENPASSTLWLDVGRESYLDLTYQSLKVNNDLSHFPVPFYDPRDNRPLKLPMIFPGSPAVTQQQAAAIVASWFGSKAGWRGQQFPVYFNELPDRNAIVFATNDKRPDFLRDHPPVKAPTIEMIDNPNDPYVKLLVIFGRDDNDLLLAAKGIAQGNILFRGSSVTVDGIKTLQPRQPYDAPNWVRTDRSVTFAELKTYEQQLQSSGLVPDAITVALNLPPDLYLLRANGIDMDLKYRYTMPPVKDSSRMDISLNDQFLQSFSLNSSQDMNKLILRLPVLQGLLDGKSEVTIPALRLGAVNQLRFDFQYMNPMPGGSIDNCITFQPVQNHVVIGDDSTIDFSKYYHFIALPDLRVFANAGFPYSRMADLSDTLVVVPKAPTQGQVATLLQALGGIGSQTGLAAINLQMTDDGNQIKNKDADLLLIGAIPSSLKDDTKINLLVEATKSWVKMPMRHYDLASIYPDDEARTPNTRTDITSSGPMAAVIGFQSPYNDQRSVVALLADSPRGNELLTNALNDSGKRAAMFGSVAVIRESGVNSLRVGDIYYVGHLPWFERIWFALSNHPILLAIFAAISIVLLAWVLWRMLRIISRRRLSLDDE

SEQ ID NO: 10904 - protein, 745 aa, Klebsiella pneumoniae
ENYHFPEGAMSTPDAQDKKVPQFSSFTMRPATAPAESCCTDHACATESAPAAEALSGARYSWQVDGMDCAACARKVETAVRQVPGVSQVQVLFATEKLLVNAEGDVRAQVENAVRQAGYTLRDADAPAAEQTRGSLLRDNLPLLTLVIMMALSWGLEQANHPAGQLAFIATTLVGLWPVARQALRLIKSGSWFAIETLMSVAAIGALFIGATAEAAMVLLLFLIGERLEGWAASRARQGVSALMALKPDTAIRLRNGVRETVAQRDLRPGDVIEVAAGGRLPADGQLLSPFASFDESALTGESVPVERQAGERVAAGATSVDRLVQLTVISEPGDSAIDRILKLIEEAEERRAPIERFIDRFSRIYTPAIMVVALLVAIVPPLFFASAWLPWIYKGLTLLLIGCPCALVISTPAAITSGLAVAARRGALIKGGAALEQLGQVRQVAFDKTGTLTVGQPQVTSVIATAEVDDNALLALAAAVEQGSSHPLAQAIVREAQRRQLSIPLASGQRALAGSGIEAEVNGNRILICAASKAAPAEHEAQIQQLESAGQTVVLVMRGETLLGILALRDTLRDDARQAVDALHQLGVQGVILTGDNPRAAAAIASELGLEFRAGLLPADKVNAVIALNADAPLAMVGDGINDAPAMKAATIGIAMGSGTDVALETADAALTHNRLTGLAQMISLARATHANIRQNIAIALGLKGIFLVTTLLGLTGLWLAVLADTGATVLVTANALRLLRKKL

SEQ ID NO: 10905 - protein, 422 aa, Klebsiella pneumoniae
LDYHNRICVTKRDGQDMATEQPAITRATFDEVILPIYAPAEFIPVKGKGSRVWDQQGKEYIDFAGGIAVTALGHCHPALVAALHQQGETLWHTSNVFTNEPALRLGRKLVEATFAERVVFMNSGTEANETAFKLARHYAVTRHSPYKTKIIAFHNAFHGRSLFTVSVGGQPKYSDGFGPKPADIVHVPFNDLQAVKAVMDDHTCAVVVEPIQGEGGVTAATPAFLQGLRELCDQHQALLVFDEVQCGMGRTGSLFAYMHYGVTPDILTSAKALGGGFPVSAMLTTHEIASAFHAGSHGSTYGGNPLACAVANAAFDLINTPAVLDGVSAKRELFVKHLQRLDAEFDLFSDIRGMGLLIGAELKPQHKGRARDFLYAAADAGVMVLNAGPDVMRFVPSLIIDEQDITEGMARFAQAVAKVING

SEQ ID NO: 10906 - protein, 430 aa, Klebsiella pneumoniae
LHHQSGMQLGHPVDLVADHYRQPGHPHTAAVRLVDNRGAAEKVGIVRILLLQGLEEIVVNLEDNLQMARQNFTQHIHRPGLERFAHQGVVGIGEDLTGHLERLVPAELMFVDKQTHQLRYRQHRVGVIQVNGNLVRQVVIGFMQHVMATQDILHRGRHEEILLAQAQLAAGVGRVVRIEHAGDVFGVVFILYRGEVVALVEFTEVNFATGLRAPQTQCVGGVGVKAGDDLVVGFRNDLLRLNPAGFLSFLLNAAAEAHFIAGVVALKLPRVTVLQPVVRRLFLPAIDNILFKHPVVVADAVTASRQTQRRQGVKEASRQAAQTAVAKPGVILFIDQLFEIEPHLRQRAAHIVINAQRQQRIREGAADQKLHRQIVHLAHFLGELRAVGAQPALHHAIANGKQRGVKPFMLVGDGRIFTDDKHQFIGNRML

SEQ ID NO: 10907 - protein, 708 aa, Klebsiella pneumoniae
TRNQMARTTPIARYRNIGISAHIDAGKTTTTERILFYTGVNHKIGEVHDGAATMDWMEQEQERGITITSAATTAFWSGMAKQYEPHRVNIIDTPGHVDFTIEVERSMRVLDGAVMVYCAVGGVQPQSETVWRQANKYKVPRIAFVNKMDRMGANFLKVVGQIKTRLGANPVPLQLAIGAEEGFTGVVDLVKMKAINWNDADQGVTFEYEDIPADMQDLADEWHQNLIESAAEASEELMEKYLGGEELTEEEIKKALRQRVLNNEIILVTCGSAFKNKGVQAMLDAVIDYLPSPVDVPAINGILDDGKDTPAERHASDDEPFSALAFKIATDPFVGNLTFFRVYSGVVNSGDTVLNSVKAARERFGRIVQMHANKREEIKEVRAGDIAAAIGLKDVTTGDTLCDPDAPIILERMEFPEPVISIAVEPKTKADQEKMGLALGRLAKEDPSFRVWTDEESNQTIIAGMGELHLDIIVDRMKREFNVEANVGKPQVAYREAIRAKVTDIEGKHAKQSGGRGQYGHVVIDMYPLEPGSNPKGYEFINDIKGGVIPGEYIPAVDKGIQEQLKAGPLAGYPVVDMGIRLHFGSYHDVDSSELAFKLAASIAFKEGFKKAKPVLLEPIMKVEVETPEENTGDVIGDLSRRRGMLRGQESEVTGVKIHAEVPLSEMFGYATQLRSLTKGRASYTMEFLKYDDAPNNVAQAVIEARGK

SEQ ID NO: 10908 - protein, 330 aa, Klebsiella pneumoniae
GIIQLETGQAQTAHTSQEYVMKNVGFIGWRGMVGSVLMQRMVEERDFDAIRPVFFSTSQLGQPAPSFGGSTGGTLQDAFDLDALKALDIIVTCQGGDYTNEIYPKLRASGWQGYWIDAASSLRMKDDAIIILDPVNQDVITAGLNNGVKTFVGGNCTVSLMLMSLGGLFAQDLVEWVSVATYQAASGGGARHMRELLSQMGQLHNHVAAELADPASAILDIERKVTSLTRSGELPVDNFGVPLAGSLIPWIDKQLDNGQSREEWKGQAETNKILATSSVIPVDGLCVRVGALRCHSQAFTIKLKKDVSIPTVEELLARAQPVGQSGTERS

SEQ ID NO: 10909 - protein, 794 aa, Klebsiella pneumoniae
TVAHHAVMTPAFADQEPPLPTSSATKTILTAAHWGPMLVETDGENVLSSRGALATPFANSLQTAVRDQVHSKTRVRYPMVRKGFLASPDKPQGVRGQDEFVRVSWEQALDLIDAQHRRIRDSYGPASIFAGSYGWRSNGVLHKAATLLQRYMSLAGGYTGHLGDYSTGAAQAIMPYVVGGNEVYQQQTSWPLVLEHSEVVVLWSANPLNTLKIAWNASDEQGIPWFDRLRQSGKRLICIDPMRSETVDFFGDSMEWIAPHMGTDVALMLGIAHTLVENDWQDDAFLTRCTSGYDIFARYLTGESDGVAKTAEWAAAICGVKADKIRELAQLFHENTTMLMAGWGMQRQQYGEQKHWMLVTLAAMLGQIGTPGGGFGLSYHFANGGNPTRRAAVLGSMQGSVAGGVDAVEKIPVARIVEALENPGAEYQHNGMARRFPDIRFIWWAGGANFTHHQDTNRLIQAWQKPELIVISECFWTAAARHADIVLPATTSFERNDLTMTGDYSNQHLVPMKQVVAPRDEARDDFAVFADLSERWEAGGRERFTEGKSDLQWLETFYQMAARRGAQQQVTLPPFAEFWQANQLIEMPEEPENARFARFAAFRADPQANPLKTASGKIEIHSPTIAAFGYADCPPHPMWLEPDEWHGNAEAGQLQLLSAHPAHRLHSQLNHTALRERYAVAGREPVTIHPQDAQARGIVDGDLVRVWNARGQVLAGAVVTEGIRPGVICLHEGAWPDLDPQVGICKNGAVNVLTKDIPTSRLGNGCAGNTALAWLEKYTGPALPLTAFDPPANA

SEQ ID NO: 10910 - protein, 465 aa, Klebsiella pneumoniae
FCVQELGKPRLGLDRKQAVLNREGDMTAAPLWLIQNVRLADRDGLWQIAIDKGRFGAITPMGEAHDESYEVLNARGGLAIPPFIEPHIHLDTTQTAGEPNWNQSGTLFEGIERWAERKALLSHEDVKARAWKTLKWQIANGVQFVRTHVDVSDPTLTALKAMLEVKQEVAPWVELQIVAFPQEGILSYPNGEALLEEALKLGADVVGAIPHFEFTREYGVESLHIAFRLAQQYDRPLDIHCDEIDDEQSRFVETVAALALKAGIGPRVTASHTTAMHSYNGAYTSRLFRLLKLSGINFVANPLVNIHLQGRFDDYPKRRGITRVKELLAAGINVCFGHDDVFDPWYPLGTGNMLQVLHMGLHVCQLMGYQQINDGLQLITDNSARTFGLEDYGIVSGNPANLIILPAENGFEAVRCQVPVRWSIRQGRVIATTQPAQSWIQTDRGGEELSFMRNSPLADAKGPKA

SEQ ID NO: 10911 - protein, 575 aa, Klebsiella pneumoniae
LVPQRQAVFYSSFSRFACMKYIRTMTQQKLSFWLALYIGWFMNVAVFFRRFDGYAQEFTFWKGLSGVVELVATVFVTFFLLRLLSLFGRRIWRILATLIVLFSAAASYYMTFLNVVIGYGIIASVMTTDIDLSKEVIGWHLILWLVAVSAPPLLFIWSNRCRHTLLRQLRTPGQRVKNVLIVVLAGLIVWGPIRLLELRQHDVERHSEVDMPSYGGVIANSYLPSNWLSALGLYAWAQVDESSDNKSLINPAKKFTYVAPEGLDDTYVVFIIGETTRWDHMGILGYSRNTTPELEKEKNLVAFRGYSCDTATKLSLRCMFVREGGAEDNPQRTLKEQNVFAVLHQLGFSGNLYAMQSEMWFYSNTMANNIAYREQIGAEPRNRGKSVDDMLLVDEMKRGMAQGNASGKHLIILHTKGSHFNYTQRYPRSFAQWKPECVGVDNKCSKAELINSYDNSVTYVDHFIVSVLDQLRDKKAIVFYAADHGESINEREHLHGTPRKMAPPEQFRVPMMVWMSDKYLENPDHAAAFAHLQQQAAMKVPRRHVELYDTIMGCLGYTSPDGGINENNNWCRWKK

SEQ ID NO: 10912 - protein, 586 aa, Klebsiella pneumoniae
SHAQFASHSPKRLSTLNRQGRVCPAPNSRYPEVRIAMFSQKLRHVEDDELRIDIDPCYEADPYELKLDEMIDAEPEPEVIEGLPASDALTPADRYLELFTNVQKSRIFADSKTFPDCAPKHDPLDILRNYRKVKRQPDFDLRQFVEDNFWLPESQSDIYISDPSLTLKEHIDKLWPVLTREPQDHIPWSSLLALPQAYIVPGGRFSETYYWDSYFTMLGLAESGREDLLKCMADNFAWLIETYGHIPNGNRTYYLSRSQPPVFALMVELFEEDGVRGAKRYLDHLKMEHAFWMDGAESLIPHQAYRHVVRMPDGSLLNRYWDDRDTPRDESWREDVETARHSGRPANEVYRDLRAGAASGWDYSSRWLRDITRLASIRTTQFIPIDLNAFLFKLETTIANLSGLKGDRETETAFRQKAQDRRAAVNRYLWDDENGCFRDYDWRREQLALFSAASIVTLYVGLATHEQAERLADAVRARLLTPGGIMATEYESGEQWDKPNGWAPLQWMAIQGFKRYGQDPLGDEIAWSWLQTVNHFYKQHHKLIEKYHIATGVPHEGGGGEYPLQDGFGWTNGVVRRLIGLYGEPT

SEQ ID NO: 10913 - protein, 159 aa, Klebsiella pneumoniae
RSGQYLGCGHHLLGAGAWRMGFFSANLFALCAMLTSYWGLGGSFLTNIFDQFRLGNDEQPARRLMVLLVVAIPPFVLAYSGMVSFVNALYFAGVFSGVILSIMPILMLKGARQRGDLTPGWTCPAWMTHPLIQCFIVLLYLCSAAYAIASAVGYLPAGW

SEQ ID NO: 10914 - protein, 254 aa, Klebsiella pneumoniae
PSLQIRQRRQPRRLRVNRHLKMTIRNRPMALGASMGRYMENSLKEQEKLGIKLDKAQLIAGEQDAFADKSKLSDQEIEQTLQAFETRVKTAAQQKMEKDATENEAKGKAFRDSFAKEKGVKTSKTGLLYKVEKEGAGDAPKDSDTVVVNYKGTLIDGKEFDNSYTRGEPLSFRLDGVIPGWTEGLKNIKKGGKIKLVIPPDLAYGKTGVPGIPANSTLVFDVELLDIKPAPKADAQPEAAGDAKAADAKADAKK

SEQ ID NO: 10915 - protein, 122 aa, Klebsiella pneumoniae
MTLQIISAEEIIQFHDRLLRVTPGVAGMPDPGRAEAIMYRVLNKIEYEGVTDVWRLAAMHLLAISRGHIFNDGNKRTALFITLLFLKRNGIILPANPDFVGMTVEAAAGQLTLEQIVARLRG

SEQ ID NO: 10916 - protein, 106 aa, Klebsiella pneumoniae
PVQQLFCWCRSEYPGPATLSYRESGQLQGEPSEQKNEHGDVELKFPSLPPTLFLLRFFISSVAAISTSRCEFTQFVTDHFVGNKYWNVLTTIMDSDGQTDHVRKDR

SEQ ID NO: 10917 - protein, 875 aa, Klebsiella pneumoniae
KRQHCRGEAHWPLAAGFAGGDIHFLRGYPLLRGLRRHRREALQQTRFLLIAIMEHAHPQVDANRVIAADRRLFGFQLPAFPFLIAHPVRGKAFRRGLQQQAQVTVAQSGPRRAKTHKVGGQLRRKIAGVKPPAAVIGKTDFSRQQHRAEARHRHRLFSDNPRQQGFTGLGVLRLLPQAPRLQQRPGYPQIRVGRRVAVQQGPLLIVLFAPQPARQMLFQIAFRQVVLRPGQQFVEPRAIVGRQGEKQAIALPFGGGDFARIAGVNHPSLGADVRLFKLLPGGPLAGGAHLARRQQQRREHRATKYFHHGLLIIQAKTAAADDAQHAPQHPCQQHNADGGEDRQQYRVVRQREPDALEPGQMTHVVNIPHPQTVDAGFADHRHRAKHRCPLTAVVEGVGQQFITARAVGQQGHHAALIVIRRLEANHRRHRPGRGNVGAGIGRAGLIVGINARQVIVAHRHFHPAFGRLDQQVDFGVVLEGRRDRADQQQIRIFVLDLVAIVGHLQINRRQTGLRADAPQRLQQRRHLALGRRLRHHHQRVGKVGHTAVREARIGEDAQVRQGDKVIILREVDGRIVADHHVVLHRLEGNTVVDGAAGHRVHILEVKAQLVDRPKTQRGDGDLRFAVQQPLQHRQAQDQFVHVLGAVKAERLQELVVEADIHPRAVLHRRHGVAVFQIHIDAVGPQQIEIRRQVKRHGDGIRHQPAGLQLLLIGFQLSEGDRAVGAHPVRRVVRLTRLQGFDAVHGDAAAAEQNIALSNPLRRQQQVVIIAAENHQQLDVGIVRVVDHFDGRRLDRRMIAQEVRTLVVGGEDNGVTIRQFIEIDRELLAAPAGLAAEPGGDYRRRLLLGDRWRARENHRQLQRAVIARIVERHREV

SEQ ID NO: 10918 - protein, 127 aa, Klebsiella pneumoniae
RSTKMIQEQTMLNVADNSGARRVMCIKVLGGSHRRYAGVGDIIKITIKEAIPRGKVKKGDVLKAVVVRTKKGVRRPDGSVIRFDGNACVILNNNSEQPIGTRIFGPVTRELRTEKFMKIISLAPEVL

SEQ ID NO: 10919 - protein, 335 aa, Klebsiella pneumoniae
NMTKPIVFSGAQPSGELTIGNYMGALRQWVNMQDDYHCIYCIVDQHAITVRQDPQQLRKATLDTLALYLACGIDPQKSTIFVQSHVPEHAQLGWALNCYTYFGELSRMTQFKDKSARYAENINAGLFDYPVLMAADILLYQTNQVPVGEDQKQHLELSRDIAQRFNAIYGDIFKVPEPFIPKSGARVMSLLEPTKKMSKSDDNRNNVIGLLEDPKSVVKKIKRAVTDSDEPPVVRYDLKEKAGVSNLLDILSAVTGKTIPELEQHFEGKMYGHLKGEVAEAVSGMLIDLQERYHRFRNDEAFLNQVMKDGAEKASARASQTLKAVYEAIGFVAKP

SEQ ID NO: 10920 - protein, 85 aa, Klebsiella pneumoniae
RETKMSELFSTPDHTLDALGLRCPEPVMMVRKTVRTMPVGETLLIIADDPATTRDIPGFCRFMEHELVAQETEALPYRYLIRKSH

SEQ ID NO: 10921 - protein, 419 aa, Klebsiella pneumoniae
FKANELAQNFSYNARANGTAAFTDCETQTVVHRDRVDQGNNHFDVVARHYHLYAFRQFDGASHVSSTEVELRTVAFEERSMTAAFVFGQDVHFRFELGVRVDGARLSQYLTTFDFFTFDTTQQNTYVLTSTAFVQQFAEHFNASTGGFRGFFDTNDFNFFTYFDDTALYTTGNNGTTTGDGEYVFDRQQERLVNRTLWFRDIGIQVASQFDDFRFPLCVAFQRFQSRTTNDRGVVAREIVLRQQFTNFHLNQFQQLFVINHIAFVQEHDDVRNAYLTTQQDVLTSLRHRAVSRSNNQDRAVHLRSTGDHVFNIVGVARAVYVRVVASRGVIFNVRGVDGDTTSFFFRRVIDLVECASGTTVGFSQNGSDGSSQGSFTMVNVADSTNVDVRFCTFKFFFRHGYIPYYSALPFGESTGLRF

SEQ ID NO: 10922 - protein, 444 aa, Klebsiella pneumoniae
QMAKQPGLDFQSAKGGLGELKRRLLFVVGALIVFRIGSFIPIPGIDAAVLAKLLEQQRGTIIEMFNMFSGGALSRASIFALGIMPYISASIIVQLLTVVYQPLAELKKEGESGRRKISQYTRYGTLVLAIFQSIGIATGLPNMPGMQGLVINPGFAFYFTAVVSLVTGTMFLMWLGEQITERGIGNGISIIIFAGIVAGLPPAIAHTIEQARQGDLHFLLLLLVAVLVFAVTFFVVFVERGQRRIVVNYAKRQQGRRVYAAQSTHLPLKVNMAGVIPAIFASSIILFPATITSWFGGGTGWNWLTTISLYLQPGQPLYVLLYASAIIFFCFFYTALVFNPRETADNLKKSGAFVPGIRPGEQTAKYIDKVMTRLTLVGALYITFICLIPEFMRDAMKVPFYFGGTSLLIVVVVIMDFMAQVQTLMMSSQYESALKKANLKGYGR

SEQ ID NO: 10923 - protein, 254 aa, Klebsiella pneumoniae
VMDKLQAIRGIAFDLDGTLVDSAPGLTSAVDNALYALELPVAGEERVITWIGNGADVLMERALTWARQERATLRAAMGKPSVDDHDIPQDEQLRILRKLFDRYYAEAAEEGSFLFPAVADTLGALYAKGLPLALVTNKPTPFVAPLLDALDIAKYFTVVIGGDDVQNKKPHPEPLLLVAEKLSLAPAELLFVGDSRNDIQAAKAAGCCSVGLTYGYNYGEPLALSEPDYLFDQFNELLPALGLPHSETQELKHD

SEQ ID NO: 10924 - protein, 513 aa, Klebsiella pneumoniae
AQDKLIPRRLTPREGFFSHSGRVWQVTSSSLITPVSSLPLCMNFSWRERMKVIKGLVLLCLMMLAGCQSEEETSQFLLACKYDAPATIATMRENGMDGDGQDKTGLSGLMVAAAENRRDVVELLLKRRAKPNLQTRQGVTALMLAAARGSDTAIIGDLLQAGASVNQTSIDKSTALMSAISDGGDVRNDYQHILAMKKPDAPVEEESTLDKIVGATAAKSLATGNRALMTEDMALQLAPGAFKKNVDEIVALLLKHGADVKAVNASGESAFFLAVDHARSAETITTLANAGADTSLADKSGTTPLMLAAAGDDPDLVLALSASGVEVDQPNREGLTALQVAAGQGAPAVIAALVQRGAKVDQLSANDLSPLMLAVKMNNKANVEALLAAGASVNLSNKAGYTAIGYSRAGEVRQLLLAQHAELKGQAAHMAQSELQFCANAFADKLAYSDIARAVNNDTRPDIMRHQQSCLELGELTMLLGEFTFTPAGATYLGEPVTCKVSEYRKTFEVNCR

SEQ ID NO: 10925 - protein, 411 aa, Klebsiella pneumoniae
NIYKTRQLGNEERGVERFDAIVVGAGAAGMFCAAQAGQLGCRVLLLDNGKKPGRKILMSGGGRCNFTNMYVEPAAYLSQNPHFCKSALARYTQWDFIELVGKYGIAWHEKTLGQLFCDDSAEQIVNLLLAECEKGGVQIRLRSEILSVESDEQGYRLQVNGETLMTKKLVIASGGLSMPGLGASPFGYKVAEQFGLKVLPTRAGLVPFTLHKPLLEQLQVLSGVSVPSTITAENGTLFRENLLFTHRGLSGPAVLQISSYWQPGEFVTVNLLPDCDLDDFLNEQRSAHPNQSLKNTLAMQLPKRLVECLQQLGQIPDVTLKQLNVRDQQTLVETLTAWRVQPNGTEGYRTAEVTLGGVDTNELSSRTMEARKAPGLYFIGEVMDVTGWLGGYNFQWAWSSAWACAQALVEG

SEQ ID NO: 10926 - protein, 225 aa, Klebsiella pneumoniae
KGHNMNPFTTVQRKKALVWLSLFHLLVITSSNYLVQLPISIFGFHTTWGAFSFPFIFLATDLTVRIFGAPLARRIIFAVMVPALAISYGISALFYMGEWQGFAALGTFNLFVARIAVASFMAYALGQILDVHVFNRLRQSRRWWLAPTASTLFGNISDTVAFFFIAFWRSPDPFMAAHWGEIALVDYSFKVLISIIFFLPMYGVLLNMLLKRLADKSDLSALQPS

SEQ ID NO: 10927 - protein, 154 aa, Klebsiella pneumoniae
CTRKKQRSARQQFWVHWRLCFALDLPPMKLTIIRLQHFSDQDRIDLGKIWPSQDLSTLTLDENHRLYAARFNERLLGAVRVTLRGVEGELSDLCVREVTRRRGVGQYLVEETLRDNPAINSWRVADHGMEDRGVMAAFMQALGFSAQQNGWEKH

SEQ ID NO: 10928 - protein, 330 aa, Klebsiella pneumoniae
LTSKTAQRTLALISIPLQVLAMSKKIAVIGECMIELSEKNGAVNRGFGGDTLNTSVYIARQTDVSALSVHYVTALGTDAFSQQMLDSWQQENVNTDLIQRMADRLPGLYYIETDDTGERTFYYWRNEAAAKFWLESDRAAAICEELATFDYLYLSGISLAILSPASRDKLFTLLRECRANGGKVIFDNNYRPRLWASQAETQQVYQEMLACTDIAFLTLDDEDALWGEKPVAEVIARTHAAGVEEVVVKRGADACLVSVSGQPLREVPAVRLAKEKVVDTTAAGDSFSAGYLAVRLTGGDAESAARRGHLTASTVIQYRGAIIPREAMPQ

SEQ ID NO: 10929 - protein, 125 aa, Klebsiella pneumoniae
GFLNMSSIQLCAAHQATSGFDGDAIAQYMRTDFITLQEHLSVHEAREHFISQLASDDIPGQVFVVAGKKLRGSLSVKKLLQETDINQSIRHLMDSCLFRVKPDDERQQVIAELSERGLDLVPRRR

SEQ ID NO: 10930 - protein, 234 aa, Klebsiella pneumoniae
DQINFKEMRMKQYLIAPSILSADFARLGEDTAKALAAGADVVHFDVMDNHYVPNLTIGPMVLKSLRNYGITAPIDVHLMVKPVDRIIPDFAEAGASIITFHPEASEHVDRSLQLIKEHGCKAGLVFNPATPLSYLDYVMDKLDVILLMSVNPGFGGQSFIPQTLDKLREVRQRIDASGYDIRLEVDGGVKASNIGEIAAAGADMFVAGSAIFGQPDYKQVIDQMRSELAKVSHG

SEQ ID NO: 10931 - protein, 303 aa, Klebsiella pneumoniae
FAVNCALPRTGSALSCRTAILSIWPGAKTRTRRAISRASSFFTALEGTLHSPYAHGLIHAAMQRGWLGVVMHFRGCSGEPNRNHRIYHSGETEDGTWFLHWLKREFGPAPTAAVGYSLGGNMLGCLLAEEGDRCPLDAAVIVSAPFMLEACSYHMDKGFSRVYQRYLLNLLKANASRKLKAYPGSLPVDLRQLKGMRRIREFDDMITAKIHGFADALDYYRQCSAMPRLSDITKPTLIIHAKDDPFMDHHSIPPQEQLPANVEYQLTEQGGHVGFVSGTLRKPEMWLERRIPDWLNRWLEVPA

SEQ ID NO: 10932 - protein, 71 aa, Klebsiella pneumoniae
IKVNLMAVRKRFIAGAKCPACQAQDSLAMWRENNVDVVECVKCGHQMREADKEAREHVRKEEQVIGIFHPD

SEQ ID NO: 10933 - protein, 294 aa, Klebsiella pneumoniae
IHSNFRLIMHKTTLEQWALLEKVVELGSFARAAEETKRSQSSVSYNLALLQERLGVALLAPSGRRAVLTPAGELLLNQVKPLLQAFAYVETHAATLRNGARTRLDLVVDSIFPRQRLFAILRQFQQRYPQTQVRLTEVLENLDDESAARTEADVMVLTRRQDITGRGEWLMNIDFIAVAHRDHPLAALDGPLEDSALAPWPLVRIADQGGDSQAPRDAWTFSTIDAAIDAVMYQVGFGWLPEERIRPHLDQGVLKRLPLSHGARRATPLHLIVKRDLAPIDEQVATLLALFRTP

SEQ ID NO: 10934 - protein, 60 aa, Klebsiella pneumoniae
TMAKTIKITQTRSAIGRLPKHKATLLGLGLRRIGHTVEREDTPAVRGMVNAVSFMVKVEE

SEQ ID NO: 10935 - protein, 130 aa, Klebsiella pneumoniae
IMAKAPIRARKRVRKQVSDGVAHIHASFNNTIVTITDRQGNALGWATAGGSGFRGSRKSTPFAAQVAAERCAEAVKEYGIKNLEVMVKGPGPGRESTIRALNAAGFRITNITDVTPIPHNGCRPPKKRRV

SEQ ID NO: 10936 - protein, 773 aa, Klebsiella pneumoniae
NMQKLTVGLIGNPNSGKTTLFNQLTGARQRVGNWAGVTVERKEGIFATTDHQVTLVDLPGTYSLTTISSQTSLDEQIACHYILSGDADMLINVVDASNLERNLYLTLQLLELGIPCVVALNMLDIAEKQQVRIDIDALAARLGCPVIPLVSTRGRGIEALKIALDRHQANSDLELVHYPQPLLREADLLAQQMSAQIPPRQRRWLGLQMLEGDIYSRAYAGDAADKLDIALANLSDEIDDPALHIADARYQTIAAICDAVSNTLTAEPSRFTAAMDKVILNRFLGLPIFLFVMYLMFLLAINIGGALQPIFDAGSVAIFVHGIQWLGYTLHFPDWLTVFLAQGIGGGINTVLPLVPQIGMMYLFLSFLEDSGYMARAAFVMDRLMQALGLPGKSFVPLIVGFGCNVPSVMGARTLDAPRERLMTIMMAPFMSCGARLVKIAVFAAAFFGQNGALAVFSLYVLGIVMAILTGLMLKHTIMRGEASPFVMELPVYHVPHIKSLIIQTWQRLKGFVLRAGKVIVIVSIFLSALNSFSLSGKVVDNINDSALASVSRVITPVFKPIGVHEDNWQATVGLFTGAMAKEVVVGTLNTLYTAEDIQNEEFNPQTFSLGEELLAAVDETWQGLKDTFSLSVLANPIEASKGDGEMATGAMGVMGSKFGSAAAAYSYLIFVLLYIPCISVMGAIARESSRGWMTFSILWGLNIAYSLSTLYYQTVSFSDHPRYSLVCILAVVLFNVVLFGLLRRARSRVDVSLLATRKTPASCCSSPAGDCH

SEQ ID NO: 10937 - protein, 76 aa, Klebsiella pneumoniae
LFENSWVVYQQLINHINYTLCELSRFANNGASFNDLVMARLLHKYKLPPCWYRERPLREIQASIESRCCQGNFWRS

SEQ ID NO: 10938 - protein, 64 aa, Klebsiella pneumoniae
RGENNHKAPYVQTMLICHYDNVVWKRIASPGRHGSPKRRRYTKSFWLCQNAGAVQAARRPTGGE

SEQ ID NO: 10939 - protein, 312 aa, Klebsiella pneumoniae
VVENLDVITIGEAMAMFVATETGDLAEVEHFMKRVAGAELNVATGLARLGLKVGWVSRVGNDSFGRFVLQSLAKEGIDSHAVAIDNRFATGFQMKSKVENGTDPIVEYFRKGSAASHLSPDDFRADYFTSARHLHLSGVAAALSESSYALLEHAAKVMKAEGKTLSFDPNLRPVLWKSEAEMVEKLNRLAFQADWVLPGLKEGVILTGQQTPEGIADFYLSRGVKAVVIKTGCDGAWFKSASGEQGTVDAIKVDNVVDTVGAGDGFAVGVISALLEGKTLLQAVNRGNKIGSLAIQVQGDSEGLPTRDALGE

SEQ ID NO: 10940 - protein, 181 aa, Klebsiella pneumoniae
SEEKMSRVAKAPVVVPAGVDVKINGQVITIKGKNGELTRTLNDAVEVKHADNALTFGPRDGYADGWAQAGTARALLNSMVIGVTEGFTKKLQLVGVGYRAAVKGNVVNLALGFSHPVDHQLPAGITAECPTQTEIVLKGADKQVIGQVAADLRAYRRPEPYKGKGVRYADEVVRTKEAKKK

SEQ ID NO: 10941 - protein, 428 aa, Klebsiella pneumoniae
IKGKIMKRQLSLLAVALLLAQPVLAKDIPLNRAAALANSVTPAASSQAYDDLEQQALAQLRHALQGNAATLTRDRLAHTKQNQTQADTAWLKASGYDFQTRANQQAGIALLSAFSTLPETVVKQNLATVTAINRDAVQTTRRQALADAEGISYLYFLSDALGPRLGKAFLTAYDQGALGKAAALIKASEVSTGEAKKHFNNPRPFLVQGNTIHLVPDDVVVKDNQPYTADGGSFPSGHTNTGYTDALLLAAMIPERYDALVARGARYGYSRIVLGVHYPLDVIGSRMVAERNVAHYLNDPHYRVLFNEARDQLRAALAKACGTSLAECAKSSVKDDPWRDPAMRDFSRFTMTYDLPQQKGPQPRLQVPEGAEVLLEDALPHLSAAQRRTLMVNTALPAGYPLSGATPEQQFWQRLNLSAAWEMAQKRQ

SEQ ID NO: 10942 - protein, 458 aa, Klebsiella pneumoniae
LFLKCFQGVIFKPQTSNIPSCSVVIPKGHPMKTSIFKSLYVQVLTAIAIGILLGHFYPELGAQMKPFGDAFVKLIKMVIAPVIFCTVVTGIAGMESMKAVGRTGAVALLYFEVVSTIALIIGLIIVNVVQPGAGMNVDPSTLDAKAVAVYAEQAKDQGVVAFLLDVIPGSVIGAFASGNILQVLLFAVLFGFALHRLGSKGQLIFNVIESFSQVIFGIINMIMRLAPIGAFGAMAFTIGKYGVGTLVQLGQLIICFYITCILFVVVVLGSIARATGFSIFKFIRYIREELLIVLGTSSSESALPRMLDKMEKLGCRKSVVGLVIPTGYSFNLDGTSIYLTMAAVFIAQATNSHMDIFHQITLLVVLLLSSKGAAGVTGSGFIVLAATISAVGHLPVAGLALILGIDRFMSEARALTNLVGNGVATVVVAKWVKELDAKQMDDVLNNRVPANKTHELSS

SEQ ID NO: 10943 - protein, 642 aa, Klebsiella pneumoniae
HSLNIRRLMIVFSSLQIRRGVRVLLDNATATINPGQKVGLVGKNGCGKSTLLSLLKNEISADGGSMTFPGNWQLAWVNQETPALPQPAIDYVIDGDREYRQLEAALQQANERNDGHAIATVHGKLDAIDAWTIRSRAASLLHGLGFSNEQLERPVSDFSGGWRMRLNLAQALICRSDLLLLDEPTNHLDLDAVIWLEKWLKGYTGTLILISHDRDFLDPIVDKIIHIEQQTMFEYTGNYSSFEVQRATRLAQQQAMYESQQQRVAHLQSYIDRFRAKATKAKQAQSRIKMLERMELIAPAHVDNPFHFSFRQPESLPNPLLKMEKVSAGYGERIILDSIKLNLVPGSRIGLLGRNGAGKSTLIKLLAGELQPVSGEIGLAKGIKLGYFAQHQLEFLRADESPLQHLARLAPQELEQKLRDYLGGFGFQGDKVSEETRRFSGGEKARLVLALIVWQRPNLLLLDEPTNHLDLDMRQALTEALIDFEGALVVVSHDRHLIRSTTDDLYLVHDGKVEPFDGDLEDYQQWLSDSQKQESQSGEAPKESGNSAQARKDQKRREAELRSQTQPLRKEIARLEKEMDKLNAQLASAEEKLGDSELYDASRKAELTECLQQQASAKSGLEECEMAWLEAQEQLERMLQEG

SEQ ID NO: 10944 - protein, 302 aa, Klebsiella pneumoniae
KSMKQVGLRIDVDTFRGTRDGVPRLLELLGRHGIQASFFFSVGPDNMGRHLWRLIKPKFLWKMLRSRAASLYGWDILLAGTAWPGRRIGAGNEAVIRAAAESHEVGLHAWDHYSWQAWSGVWPQERLALEVERGLLELERIIGRPVTCSAVAGWRADQRVVKAKESFDFLYNSDCRGTRPFLPQLGSGTFGTVQIPVTLPTWDEAVGTAVDIAGFNRYLLDCIHRDPGVPVYTIHAEVEGIAYADQFNELLTMAAEEEIQFCPLSQLLPADFSELPSGKVVRGELAGREGWLGREQLLTSGV

SEQ ID NO: 10945 - protein, 370 aa, Klebsiella pneumoniae
TMMKVLCGAVLSALLLAAGQVGAACQWPAWEQFKQAYVSPEGRVIDPSDARKISTSEGQSYGLFFALAANDRAGFDKLLTWTQNNLAEGDLKQHLPGWLWGKKDDEQWTLLDSNSASDSDLWIAWALLEAGRLWQQPQYTETGKALLARIVAEETVAVPGLGTMLLPGKVGFADDSGWRFNPSYLPPQLATYFVRFGAPWPALRDSNLRLLLETAPKGFTPDWVRYEKGKGWQLKTEKPPIGSYDAIRVYLWVGMLHDGDKQKARLLQRFAPMAAQTTEQGIPPEKVNIATGKTSGQGPVGFSAAMLPFLQDDEARSVQRQRVADNYPGADAYYSAVLTLFGQGWDQHRFRFTANGELQPDWNQECASSH

SEQ ID NO: 10946 - protein, 222 aa, Klebsiella pneumoniae
SRVNELSFMAEESLTMLTILGKRSSINVRKVLWTCEEAGLAYQQEDYGSGFKPLDTPEFQRLNPNSLVPVLLDDDFVLWESNSICRYLARKAERWDLLPAEPQPAAEVEHWMDWQATEFNTAWRHAFMGLVRKDPRFQDPVAIKESIAAWTHCVRIVEAQLQRTGAWIAGERFTLADIVLGLSVHRWKMTPFAHPEMPAVERWYMALNQRPAFMRHGNNGVA

SEQ ID NO: 10947 - protein, 216 aa, Klebsiella pneumoniae
PKTKTIHKVILAVSKRRGCAGRQKTYGRGMMSQTAKVLLLYAHPESQDSVANRVLLEPALQLPNVTVHDLYAHYPDFFIDIAYEQDLLRRHEVIVFQHPLYTWSCPALLKEWLDRVLSRGFASGAGGNELAGKYWRSVITTGEPESAYRRDANRYPMNDILRPFELTAGMCRMHWMSPIIVYWARRQQPEELRSRALAYRDWLANPIAAGGVHGGI

SEQ ID NO: 10948 - protein, 249 aa, Klebsiella pneumoniae
SPAKWVHTDSIDNIRGCNMIYLRKANERGHANHGWLDSWHTFSFANYYDPNFMGFSALRVINDDVIDAGQGFGTHPHKDMEILTYVLEGAVEHQDSMGNKEQVPAGEFQIMSAGTGVRHSEYNPSKTDRLRLYQIWIIPEETGITPRYEQRRFDAAQGKQLVLSPDARDGSLKVYQDMELYRWALLKDEQSVHQIAAERRVWIQVVKGEVTINGTKATTSDGLAIWDEQAISVHADSDSEILLFDLPPV

SEQ ID NO: 10949 - protein, 117 aa, Klebsiella pneumoniae
RRALTPGASGRRITTTGGGSRGSAAGRSASAPPSPPDRCRPPRDRSYPAARRQCTARPKRRGSTTRYRRTTRRCSAPPSGTAPGAARPSGQRSVPSGLSPAAGRRRPAADCRSPAAV

SEQ ID NO: 10950 - protein, 506 aa, Klebsiella pneumoniae
EGKNVETKDMIVIGGCINGAGIAADAAGRGLSVLMLEARDLACATSSASSKLIHGGLRYLEHYEFRLVSEALAEREVLLKMAPHIAFPMRFRLPHRPHLRPAWMIRIGLFMYDHLGKRTSLPGSTGLRFGAESVLKPEIVRGFEYSDCWVDDARLVLANAQMVVRKGGEVRTRTRAISAKRENGLWVVEAEDIDSGEKFTWKARGLVNATGPWVKQFFDEGMHLRSPYGIRLIKGSHIVVPRVHTQKQAYILQNEDKRIVFVIPWMDEFSIIGTTDVEYKGDPKAVAIDDKEINYLLNVYNAHFKKTLSRDDIVWTYSGVRPLCDDESDSPQAITRDYTLDIHDENGQAPLLSVFGGKLTTYRKLAEHALEKLTPYYKGIGPAWTKTAVLPGGDIGGDRDDYAAKLRRRFPFISESLARHYARTYGSNSEWILKEASALSDLGEDFGHEFYEAELKYLVEHEWVRSLDDAIWRRTKQGMWLTAEQQARISEWLAQHAGKSELSLAS

SEQ ID NO: 10951 - protein, 349 aa, Klebsiella pneumoniae
KRKKLRMTPENDDRRPPQEPDTQPEKSKSTLEALNDTAVGQKASQALKTVTGTAAKVQRNPVIAHLLRAAERFNDRLGNQFGAAITYFSFLSMIPILMVSFAAAGFVLAWHPTLLQDIFDKILQNVSDPTLAATLKNTINTAVQQRTAVGLVGLLVALYSGINWMGNLREAIRAQSRDVWERRPQDEEKIWVKYFRDLISLIGLLVALIITLSITSVAGSAQQMIISALYLDNIEWLKPAWRLIGLAISIFANYLLFFWIFWRLPRHRPRRKALFRGTLIAAIGFEIIKIVMTWTLPALVKSPSGAAFGSVLGLMAFFYFFARLTLFCAAWIATAEYKDDRRMPGKTHR

SEQ ID NO: 10952 - protein, 146 aa, Klebsiella pneumoniae
SDRNIAILELNFMQARVKWVEGLTFIGESASGHQILMDGNSGDKAPSPMEMVLMAAGGCSAIDVVSILQKGRHDVTNCEVKLTSERREEAPRLFTHINLHFIVTGKALKDAAVSRAVDLSAEKYCSVALMLEKAVNITHSYEVIEA

SEQ ID NO: 10953 - protein, 453 aa, Klebsiella pneumoniae
GRRFLRAADSGAVSDADRHSGPPGGGKSMKPMQIAMALLSAVMFFILAGVFMGVQLELNGTKLVVDTAADIRWQWIFIGTAVVFFFQLLRPLFQKAVKNVSGPKFIMPAIDGSTVKQKLFLIALLVIAVAWPFMVSRGTVDIATLTMIYIILGLGLNVVVGLSGLLVLGYGGFYAIGAYTFALLNHYYGLGFWTCLPLAGLVSAAAGFLLGFPVLRLRGDYLAIVTLGFGEIVRILLLNNTEITGGPNGISQIPKPTFFGLEFSRSAREGGWDTFSNFFGVKYDPSDRVIFLYLVALLLVVLSLFVINRLLRMPLGRAWEALREDEIACRSLGLSPTRIKLTAFTISAAFAGFAGTLFAARQGFVSPESFTFAESAFVLAIVVLGGMGSQFAVILAAILLVVSRELMRDFNEYSMLMLGGLMVLMMIWRPQGLLPMTRVQLKLKNGQAKGEQA

SEQ ID NO: 10954 - protein, 196 aa, Klebsiella pneumoniae
PGFDCSGAAMILLIDNYDSFTWNLYQYFCELGAEVLVRRNDALTLEEIAALAPEKIVISPGPCTPDEAGISLAVIRHYAGKTPLLGVCLGHQAIAQAFGATIVRAAQVMHGKTSLIEHNGEGVFQGLNNPLTVTRYHSLVIDPPTLPSEFNVTARSASGEIMGIRHREWDLEGVQFHPESILSEQGHQLLANFLKR

SEQ ID NO: 10955 - protein, 136 aa, Klebsiella pneumoniae
GFTEKDKVMRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRAEPKAEAAAE

SEQ ID NO: 10956 - protein, 94 aa, Klebsiella pneumoniae
DFTDSEGGCVMTDKIRTLQGRVVSDKMEKSIVVAIERMVKHPVYGKFIKRTTKLHVHDENNECGIGDKVEIRECRPLSKTKSWTLVRVVEKAVL

SEQ ID NO: 10957 - protein, 559 aa, Klebsiella pneumoniae
TITDFGCLMKSIRYGVSLIALFALYYLLPLNFRLLWQPDETRYAEISREMLATGDWVVPHFLGLRYFEKPIAGYWINSIGQWLFGHNNFGVRFGSVFAITMTALLVAWLAWRIFRDKRVAILSPVIFLTAMLVYAIGTYAVLDPMITLWLALAMCSFWGAAQAQSRSGKILGYVLLGVACGMGVMTKGFLALAVPVVGVLPWVIARKRWREVLTYGWLAVIVCTLVVLPWGLAIAQREPDFWRYFFWVEHIQRFAEKDAQHKAPFWYYIPFLIAGSLPWLALLPGALKRGWLERDEARGALYLLGWVAMPFLFFSIAKGKLPTYILPCFAPLSILMARYALEAAKTGAKALRINGMINLGVGLLGLIAVLVVSPWGFMHKPVWTKIELYKCLLAAIAFAVWALMGWLAMKDSGRRWSLAALCPLGLALLVGFAIPDRVIDSKQPQFLVDIVSESLQPSRYVLTNNVGIAGGLAWELKRSDIIMFDKQGELKYGLDWPDAQESFVSQAGFADWLAAHRQQGPVSLVLLMDKGESMLDLPLPKPDNAYELGRVVFLQYLPQ

SEQ ID NO: 10958 - protein, 324 aa, Klebsiella pneumoniae
RFYDSVMFCNAFSRNETARRRSGNLGRSAVNYRLTCLLPGISASMLSYRHSFHAGNHADVLKHTVQSLIIESLKEKEKPFLYLDTHAGAGRYQLSGEHAERTGEYLEGIARIWQQDDLPAELEPYISVVEHFNRNGQLRYYPGSPLIARQLLREQDSLQMTELHPSDFPLLRAEFQKDSRARVDKADGYQQLKAKLPPVSRRGLILIDPPYEIKTDYQAVVTGINEGYKRFATGTYALWYPVVLRAQIKRMIKELEATGIRKILQIELAVRPDSDQRGMTASGMIVINPPWKLEQQMNNVLPWLHSKLVPTGTGHATVSWVVPE

SEQ ID NO: 10959 - protein, 67 aa, Klebsiella pneumoniae
LLGEPSALTECGGRYKVGNIFYNEVLKGYPPANVARRTRAKRQRQLSGPMVIDKLMEGVTLWLTNIF

SEQ ID NO: 10960 - protein, 93 aa, Klebsiella pneumoniae
SATEKITPPLAVPSSLVRVIPVKPTASWNSLAWLIAFCPVLASMVNITSCGASTSSFFITRTIFFSSSIRCDLFCKRPAVSAISTSTWRAFAA

SEQ ID NO: 10961 - protein, 201 aa, Klebsiella pneumoniae
QLTDTPPSRWISQPRRGVPVQWEDALSTTNHDHHVYVLMGVSGSGKSAVASEVAHQLHAAFLDGDFLHPRSNITKMASGEPLNDDDRTPWLQALNDAAFAMQRTNKVSLIVCSALKKSYRDILRKGNPNLSFIYLKGDFDVIESRLKARKGHFFKTQMLVTQFETLQEPGADESDVLIVDIDQPLEGVVASTIEVINKGSH

SEQ ID NO: 10962 - protein, 129 aa, Klebsiella pneumoniae
VMRFALTVTGPAYGTQQASSAWQFAQAVLQEGHELACVFFYREGVLNANQLTAPASDEFDLVRGWQSLHDEHGVALHICVAAALRRGVTDEREAQQLALPGHNLQPGFTLSGLGALAEAALTCDRMVQF

SEQ ID NO: 10963 - protein, 145 aa, Klebsiella pneumoniae
EMRLNTLSPAEGSKKAGKRLGRGIGSGLGKTGGRGHKGQKSRSGGGVRRGFEGGQMPLYRRLPKFGFTSRKAMITAEIRLSDLAHVEGDVVDLNALKAANIIGVQIEFAKVILSGEVTRPVTVRGLRVTKGARAAIEAAGGKIEE

SEQ ID NO: 10964 - protein, 258 aa, Klebsiella pneumoniae
RMNDIWWQTIGEGDCHLVLLHGWGLNAQVWDCITPQLASHFTLHLVDLPGYGRSGGFGAMSLEAMAQRVLEQAPPQAVWLGWSLGGLVASQVAIMRPERVQALVTVASSPCFAARDDWPGIKPEVLAGFQQQLSDDFQRTVERFLALQTMGTESARQDARALKQAVLSLPMPSAEALNGGLEILRTVDLRQALVGLPMPFLRLYGRLDGLVPRKIVPLLDKLWPESESILFDKAAHAPFVSHPAAFCEPLLALKTRLG

SEQ ID NO: 10965 - protein, 148 aa, Klebsiella pneumoniae
SARLVTMTPKGLPTVVSERLVGFGHTVNVFTFLNCSTFVVCSISEFVRQAQSHGFITAFTSSFNDPTHCQGITTDRTNFNWNLISRTTYAAGLNFDSRAHVFERNFEGFQFRFTRTLSQGLQRAVYDSFCSRFFTIYHQDIDKFSQQF

SEQ ID NO: 10966 - protein, 300 aa, Klebsiella pneumoniae
LAPEREMIMTQHDQLHRYLFENYAVRGELVTVSETLEQILANHTYPQPVKTVLAELLVATSLLTATLKFAGDITVQLQGDGPLQLAVINGNNQQQLRGVARVQGEIADDADLKTMVGNGYLVITISPEEGERYQGVVGLEGDTLAACLEDYFQRSEQLPTRLIIRTGDHEGQPMAGGMLLQVMPAQDAQTADFEHLATLTETIKAEELFTLPANDVLWRLYHEEEVTVYDPQSVEFKCTCSRERCAGALKTLPDEEIDSILADEGEIDMHCDYCGNHYIFNAMDIAEIRNNASPADPQVH

SEQ ID NO: 10967 - protein, 284 aa, Klebsiella pneumoniae
MTKEMQTLALAPVGNLESYIRAANTWPMLSADEERELAEKLHYQGDLEAAKKLILSHLRFVVHIARNYSGYGLPQADLIQEGNIGLMKAVRRFNPEVGVRLVSFAVHWIKAEIHEYVLRNWRIVKVATTKAQRKLFFNLRKTKQRLGWFNQDEVEMVARELGVSSKDVREMESRMAAQDMTFDMSSDDESDSQPMAPVLYLQDKTSNFADGIEDDNWEEQAANKLTDAMQGLDERSQDIIRARWLDEDNKSTLQELADRYGVSAERVRQLEKNAMKKLRAAIEA

SEQ ID NO: 10968 - protein, 330 aa, Klebsiella pneumoniae
IWKEFLPRSIPMSAMFSMIVLRMKAYPQHSTGKEGVTISLSIMSENSTFSPVLTGRERTAVPAKSLSFVEGVSMIVGTNIGAGVLSIAYASSKAGFLPLLFWLVLVGSLTTVTMLYVAESTLRTRKHLQLSGLSKRYVGGFGALMMFLSVCVNSVGALTAYMTGSGKLLHSLFGISPALGSVLFFVPAAGVLYLGLKAIGRGEKFISIGMVVMISVLVIATLLKETTRVGYLLDGNWLYMVPVFNVVAFCFSAQYIVPEMARGFADKPEKLPKAIMVGMALTFTLLALVPLSVISLNGLDNISDVATISWGRALGEWASSQPICLRCARC

SEQ ID NO: 10969 - protein, 568 aa, Klebsiella pneumoniae
NGEEGAERVILRARRINPRIRAGQHHAHQFTAARKRNIFIKLEAQEALVRGDKLGRNRDSPGLQDQLNLFDVILQMAIIRRDHAAAAHRQVRGMAARDDAAGVMDHHRNIDIDTNGFSHLPRFARHGNRRQQEDQTVDPPPDVEGDNVGIRAKIVMANRPDDADHHPQRQQAGHHQVRAHHGEIEVADVQQAALIGDVELAAFRENHRHQGRQHQVEGQHNIVNFPPEAVAIAAVHSRTDVNSEEQVRQGIGDDQARRRVNNIEVKQQVSQRGGDKHHPGQRELVVEHGAEIAQALLKSQPAAKQRIIDAENLRHPARPAGTLDDVHHQAFSSEACGQWDIEKGRLPPQTLKLQRRMSIFGHRFDGETADLRQRLATDHRAGAAEKGGVPVVVPLLNRAIEQHPFVGNVASDGEVTFKRVRGIEVVRRLHQSQHRVFQETADGGLQEDARGDVVAVENADKLPLSQGQRMVKVPRFGVLVVIAGDIAHPNVGGEDGKLAALTVIQKIDFHFIFWIINALCRQDGIAHHLQRFVIARNIDIDRRPLTHIIRQRNNAALQRPDRLQIVKQ

SEQ ID NO: 10970 - protein, 335 aa, Klebsiella pneumoniae
YQREDTMQGSVTEFLKPRLVDIEQVSSTHAKVTLEPLERGFGHTLGNALRRILLSSMPGCAVTDVDIDGVLHEYSTKEGVHEDILEILLNLKWLAVRVHGKDEFILTLNKSGIGPVTAADITHDGDVEIVKPQHVICHLTDENAAISMRIKVQRGRGYVPASARIHSEEDERPIGRLLVDACYSPVERIAYNVEAARVEQRTDLDKLVIEMETNGTIDPEEAIRRAATILAEQLEAFVDLRDVRQPEVKEEKPEFDPILLRPVDDLELTVRSANWLKAEAIHYIGDLVQRTEVELLKTPNLGKKSLTEIKDVLASRGLSLGMRLENWPPASIADE

SEQ ID NO: 10971 - protein, 207 aa, Klebsiella pneumoniae
RREEIAMELVLKDAQSALTVSETTFGRDFNEALVHQVVVAYAAGARQGTRAQKTRAEITGSGKKPWRQKGTGRARSGSIKSPIWRSGGVTFAARPQDHSQKVNKKMYRGALKSILSELVRQDRLIVVEKFSVEAPKTKLLAQKLKDMALEDVLIITGELDENLFLAARNLHKVDVRDANGIDPVSLIAFDKVVMTADAVKQVEEMLA

SEQ ID NO: 10972 - protein, 545 aa, Klebsiella pneumoniae
SRLLPKYDESLKSSYFPVVEIAILSIIRLTLLALVACVPLLAQAAPYQLTTAWPVNVGPLNPHLYTPNQMFAQSMVYEPLVKYQADGSVQPWLATRWRHSADGKTWWFTLRDDVAFSNGEPFNAQAAAANFQAVLANRQRHAWLELANQITDVRALSATELQITLKSAYAPLLQELALPRPFRFIAPSQFIDGGTARGIKAPIGTGPWRLANSQLNQRDVLVRNERYWGRKPALQQITIKVIPDATSRAVAFETGEIDMLYGDEGLLPLDTFERFRHHPGYVARLSAPAETVMLALNASQGPTRELTVREALNYAVDKQTLVDSVLYGTQQVADTLFAPSVPYAPQDLTPRRYDPTKARALLEQAGWQQLEGQPWRQKAGQPLAIELAFIGTDALAKSMAEIIQANLRQVGVQVTLVGEEESSIYARQREGRFGMIFNRTWGAPYDPHAFLSSMRVPSHADYQAQRGLPDKALIDKEISEVLTTGDEAQRRKLYHDVLTRLHQDAVYLPISYVSLMSVARQEVGEIPFAPVTSEIPFDQITPVTP

SEQ ID NO: 10973 - protein, 231 aa, Klebsiella pneumoniae
GTFCPRGLRMIRFEQVSKAYLGGRQALQGVTFHLQPGEMAFLTGHSGAGKSTLLKLICGIERPSAGKIFFSGHEISRLKSREVPFLRRQIGMIFQDHHLLMDRTVYDNVAIPLIIAGASGDDIRRRVSAALDKVGLLDKAKNFPIQLSGGEQQRVGIARAVVNKPAVLLADEPTGNLDEALSEGILRLFEEFNRVGVTVLMATHDLGLISSRPYRVLTLSDGHLHGGIRGE

SEQ ID NO: 10974 - protein, 65 aa, Klebsiella pneumoniae
GCYCRSRWRIEIINHRNNLSIARNGPFTMARQKKLPQPRLQRQQRLAEGRGMGNKRRMRGLIEED

SEQ ID NO: 10975 - protein, 860 aa, Klebsiella pneumoniae
PLDCHIAVIFTAYFCLLTHTIVFRITLFAHPRHSSLSNPRQDEDDESGGRHTSAIVLVKDPDLIMSQTTFNKAQFQAALTRQWQHFGLQSASEMTQRQWWRAVSGALAELLAAQPVAKPAQGQRHVNYISMEFLIGRLTGNNLLNLGWYEGVSDALKGYDVNLTDLLEEETDPALGNGGLGRLAACFLDSMATVGQSATGYGLNYQYGLFRQSFDDGQQMEAPDDWGRSSYPWFRHNEALDVQVGIGGKVSKNGEWQPAFVITGEAWDLPVLGYRNNVAQPLRLWQAKHAHPFNLTKFNDGDFLRAEQQGIDAEKLTKVLYPNDNHQAGKKLRLMQQYFQCACSVADILRRHHLAGRKLAELADYEVIQLNDTHPTIAIPELLRVLIDEHQLSWDDAWAITSKTFAYTNHTLMPEALECWDEKLVKALLPRHMQIIKEINDRFKQLVDKTWPGDKQVWAKLAVVHDKQVRMANMCVVGGFAVNGVAALHSDLVVKDLFPEYNQLWPNKFHNVTNGITPRRWIKQCNPALASLLDETLKKEWANDLDQLINLEKYADDAAFRQTYRDIKQANKVHLAEFVKQRTGIEINPQAIFDIQIKRLHEYKRQHLNLLHILALYKEIRENPQSDRVPRVFLFGAKAAPGYYLAKNIIFAINKVAEAINNDPKVSDKLKVVFLPDYCVSAAEKLIPAADISEQISTAGKEASGTGNMKLALNGALTVGTLDGANVEIAEQVGEENIFIFGHTVEEVKALKAKGYDPLKWRKKDKLLDAVLKELENGTYSNGDKHAFDQMLHSLLQGGDPYLVLADFEAYVAAQKRVDELYRDQEAWTRAAILNTARCGMFSSDRSIRDYQQRIWQAKR

SEQ ID NO: 10976 - protein, 174 aa, Klebsiella pneumoniae
RRDCQMLMQHIGVGYFGYYRATAYAMKHSLMPEIAKLRMKALNFWDKHGIRAAADAFDVSTRTLYWWRRLLRTGGPEALIPRSKAPLVRRSRHWHPDVLKEIRRLRTELPNLGKEQIFVRLKPWCEARHFTCPSTSTIGRIIAGAHDKMRMIPVRLSARGKARLSSAGVEISAP

SEQ ID NO: 10977 - protein, 838 aa, Klebsiella pneumoniae
LAGCRELLSRTLSTLDVTTGVIVMNVPFSYASPTLSVEALKHSIAYKLMFIIGKDPAIANKHEWLNATLFAVRDRMVERWLRSNRAQLSQEVRQVYYLSMEFLIGRTLSNALLSLGIYDDVSSALAEMGLDLEELIDEENDPGLGNGGLGRLAACFLDSLAALGLPGRGYGIRYDYGMFKQNIVDGRQKESPDYWLEYGNPWEFERHNTRYKVRFGGRIQQEGKKTRWIETEEIIAEAYDQIIPGFDTDATNTLRLWSAQASSEINLGKFNQGDYFAAVEDKNHSENVSRVLYPDDSTYSGRELRLRQEYFLVSATVQDILSRHYMLHKTYDNLADKIAIHLNDTHPVLSIPELMRLLIDEHKFSWDEAFEVTCQVFSYTNHTLMSEALETWPVDMLGKILPRHLQIIFEINDYFLKTLQEQYPNDTDLLSRTSIIDESNGRRVRMAWLAVVVSHKVNGVSELHSRLMVESLFAEFAKIFPMRFINVTNGVTPRRWLALANPPLSKVLDEHIGRTWRTDLSQLDELKQHIDYPMVNQAVRQAKFENKQRLASYIAQQLNVVVNPKALFDVQIKRIHEYKRQLMNVLHVITRYNRIKADPQAEWVPRVNIFAGKAASAYYMAKHIIHLINDVAAVINNDPQIGDKLKVVFIPNYSVSLAQLIIPAADLSEQISLAGTEASGTSNMKFALNGALTIGTLDGANVEMQEHVGEENIFIFGNTAEEVEELRRSGYKPREYYEQDEELHQALTQIGTGVFSPAEPGRYRDLLDSLINFGDHYQVLADYRSYVDCQDRVDELYQNPEEWAYKAMLNIANMGYFSSDRTIQEYAKYIWHIDPVRL

SEQ ID NO: 10978 - protein, 175 aa, Klebsiella pneumoniae
IRLWNFMAVLQVLHIPDERLRKVAEPVKEVNAEIQRIVDDMFDTMYAEEGIGLAATQVDIHQRIIVIDVSENREEQLVLINPEMLEKDGETGIEEGCLSIPEQRALVPRAEKVKIRALDRDGKPFELEADGLLAICIQHEMDHLVGKLFIDYLSPLKQQRIRQKVEKLDRLRSRA

SEQ ID NO: 10979 - protein, 486 aa, Klebsiella pneumoniae
EGVCRQHVGPQVAVVTCRIAASEDVAKGVREAAPGRPRHHGDLLFNLGQGLKDFRPLLRFVLRMQAEIEQAELQLAQNKHRRLVVFRRQHFLQQLLRQRFSGFIMAGDKRQRFRLPAPVLHKLARQLDRIPRHPADAGNPGGVDAGQHMVQTVAELVEQGDHFVMGEQRRLAVDRAVEVTGQVGDRLLQGTIQFTHLADAVVHPRPPALMLAGIQVEIETTAQLVVFVIQLEEAHFRMPHIDIGTLFSGNTVNALNHFKQAANGFVFREIGAQLLITDAVEVLLLFFAVVGNVPRLQLIDAKLGFGEGAQLGQLFFALRTGAFCQVGEEIEHLLRILRHFGGEGFIRIAVKAQQLRQLVTQGEDLRHHRAVIPFPGVRALIGGAGGIGAIHLFAQRLVIAVGHHRQIARNIQGQQIPFLLFGLRLSLSGGQRAFRHAGQIGDIGHQLVPAHGGVEDVVAVLVAQLREARGDFTVAFLRLRRQANPG

SEQ ID NO: 10980 - protein, 246 aa, Klebsiella pneumoniae
AIRCMLMITSFANPRVAQAFVDYMATQGIILTIQQHTQSDVWLADESQAGRVRAELARFLENPADPRYLAASWQSGQTNSGLRYQRFPFFATLRHNAGPFTWAILLICIAVFILQNLLGDQPVMIWLAWPYDPSLQFEAWRYFSHAFMHFSLMHILFNLLWWWYLGGAVEKRIGSGKLVVITVISALLSGFVQHQFSGPWFGGLSGVVYALMGYVWLRGERESQSGIYLQRGVDTLLFSVGKCWLV

SEQ ID NO: 10981 - protein, 126 aa, Klebsiella pneumoniae
YFLWVTLMSKMPLFFVLVVAVIVVAASFRYVQQRREKQANDAAPLLQKRVIVSNKREKVINDRRSRQQTVTPAGSEMRYEASFRPENGGLEVVFRLDAPQYHALSVGDRGMLSYKGTAFVAFTPDP

SEQ ID NO: 10982 - protein, 680 aa, Klebsiella pneumoniae
YRVCIQYQWRTPLRVSRSLTIKQMAMVASVSMAFVLVFCTILLFHFVQQSRFTTATQLESIARSVREPLSAAILKADIPEAEAILSRIQPAGIVSRADVVLPNQFQALRMRFIPERPVPVTVTRLFELPVQISLPIYSLERPANPQPLAYLVLQADSYRMYKFVMSALATLVTAYLLLVLMLTVALTWCINRLMVRPLRRIARELNDLSQQERLGHQLTLPRLHHDDEIGMLVRSYNRNQQSLVRQHDELSIQSTRFPVSELPNKAFLLAMLEQTVARPQSAALIVVACETLQDAAGVLKESQREMLLLTLVEKLRAAIPPQMVLAQVSGYDFAILADGLAEPWQAVTLSKQVLTIINERLPLHGLQLRPYASVGIALFHAGLSAEQLYRRAVSAAVTARRKGKNQIEFFDPEQMEKAQRRLMEEHDIMTSLDNQQFAIWLQPQVACASGEICGAEVLLRQRQADGSWSLPPALIERIESCGLIIPVGYWVMEEACRQLAAWQSQGIMLPLSVNVSLLQLLEHDRGEEMLKLIARYRIAPGTLILEVTESCRMDDPQDVMARLRPLREAGVHIALDDFGMGYAGLHQLQQMKALPVDILKIDKVFIDMLPEDVSMVPAMIQLARGLSLRIVAEGVENDAQYRWLQAAGVEVLQGHLFGCALPQEAFSARYLSPVREDENL

SEQ ID NO: 10983 - protein, 74 aa, Klebsiella pneumoniae
YISCKQTWKKKNKTPPDAVARVSRLIGCVRVGYQKPLQTAISRPQGTRKVSGGNVIQPNIYKTFGWIGTICLGK

SEQ ID NO: 10984 - protein, 87 aa, Klebsiella pneumoniae
AAECARSRRSLRSQSPGSRRANAIPGSPAGNRPPRRPGRPAGDRSRSRDRNSGSAAQRYTRRWHRTRRSPAPAGRKGRPPRSTRGRG

SEQ ID NO: 10985 - protein, 155 aa, Klebsiella pneumoniae
VRRCVAAKNKSGVNMYRIGELAKLADVTPDTIRYYEKQQMMDHDIRTEGGFRLYSDNDLQRLRFIRYARQLGFTLEAIRELLSIRIDPEHHTCQESKGIVQARLSEVEARIKELQTMRRSLQRLNDACCGTAHSSVYCSILEALEQGASNGNGGR

SEQ ID NO: 10986 - protein, 328 aa, Klebsiella pneumoniae
LARWRCAYRAYDVPYVGRVRRRRHPALFRNPISMSSSRPVFRSRWLPYVLVAPQLIITLIFFIWPAGEALWYSLQSVDPFGLSSQFVGLDNFVALFHDPYYLDSFWTTIKFSALVTVSGLLISLFFAALVDYVVRGSRFYQTLMLLPYAVAPAVAAVLWIFLFNPGRGLITHFLGELGYDWNHAQNSGQAMFLVVFASVWKQISYNFLFFFAALQSIPRSLVEAAAIDGAGPIRRFFKLALPLIAPVSFFLLVVNLVYAFFDTFPVIDAATAGGPVQATTTLIYKIYREGFAGLDLSASAAQSVVLMFLVIILTVVQFRYVESKVRYQ

SEQ ID NO: 10987 - protein, 341 aa, Klebsiella pneumoniae; identical to SEQ ID NO: 9238

SEQ ID NO: 10988 - protein, 150 aa, Klebsiella pneumoniae
IRVRFRWAVRRRRSACDCCWRRKMSGKRWIFLWLPLSLLAAERDPFQPVEDPCRTAQLSQWRYGGAVGDDAGWTGFLQDGNGKWRRVRMDEQLPTGWRVSRLTAGELDIVTSSGCEPPAWRWQREGKQHDAMDKPAASAAAAGGGPRRPQ

SEQ ID NO: 10989 - protein, 292 aa, Klebsiella pneumoniae
RGARPAPAPPRGGERMRGQQSFRWPVKLAMLVIALLAVIAIGSGWWLPWDPAAIDLQQRLLPPGAAHWLGTDHLGRDIFSRLLAATRVSLGAVMACLLLVLLIGLAVGGCAGLLGGRADRGLMRIAELFMTFPTSILSFFMVGVLGTGLTNVILAIALSHWAWYARMVRNLVVSLRQREFILAARLSGASQWRLFSDHLAGAVIPSLLVLASLDIGHMMLHVAGMSFLGLGVSAPTAEWGVMINDARQYIWTQPLQMVWPGLALFISVMAFNLLGDALRDRLDPHLIAEHSH

SEQ ID NO: 10990 - protein, 192 aa, Klebsiella pneumoniae
QPLLEMAEQKTDGHGQTQHQRLPQCIVDFRVVNQPAPHEGKTKTAYCGSNTPLSNLTGAVDDDGFTVRGNQVLIFQHFQNTTNGFTRAADDLTNFLAGNFNLHTVRVGHGIRLLRQVQQRLGDTARHVEEGKVAHFLRRDLQTASHLRRETHQNVRVHLDQLTEFLIRDFGHFTCGFRPYPGATLLTLFKQA

SEQ ID NO: 10991 - protein, 158 aa, Klebsiella pneumoniae
TLDRRNNISRIFDYRLTLRHINKKVIFTLKIACSASYVLMIKTILIIIDYRTFFLFSLATVPGATASRRPENSSSVSDRQVGPMQFTPDSAWKITGFSRDISPAYRQKLLSLGMLPGSSFHVVRVAPLGDPVHIETRRVSLVLRKKDLALIELEAVAQ

SEQ ID NO: 10992 - protein, 389 aa, Klebsiella pneumoniae
RLCRIISTMPDPLSPRGRGGGRIPAIPGNAFVSNTDALSPGGASLERIRVMLQFILRRLGLVIPTFIGITLLTFAFVHMIPGDPVMIMAGERGISPERHAQLLAEMGLDKPLWQQYAHYIWGVLHGDLGISLKSRIPVWQEFVPRFKATLELGVCAMIFAVAVGIPVGVLAAVKRGSIFDHTAVGLALTGYSMPIFWWGMMLIMLVSVQLNLTPVSGRISDTVFLDDTLPLTGFMLIDTAIWGEQGDFIDALMHMILPAIVLGTIPLAVIVRMTRSSMLEVLGEDYIRTARAKGLTRMRVIVIHALRNAMLPVVTVIGLQVGTLLAGAILTETIFSWPGLGRWLIDALQRRDYPVVQGGVLLVATMIILVNLLVDLLYGVVNPRIRHKK

SEQ ID NO: 10993 - protein, 369 aa, Klebsiella pneumoniae
GGCRVMERLTVTLGERSYPITIAAGLFNDPASFLPLKSGDQAMLVTNETLAPLYLDTVRSALEQSGVNVDSVILPDGEQYKSLAVMDTVFTALLQKPHGRDTTLVALGGGVIGDLTGFAAASYQRGVRFIQVPTTLLSQVDSSVGGKTAVNHPLGKNMIGAFWQPVSVVVDLNCLKTLPKRELASGLAEVIKYGVILDGEFFSWLENNIDALLALDDTAMAYCIRRCCELKAEVVAADERETGLRALLNLGHTFGHAIEAEMGYGNWLHGEAVAAGMVMVARTSERLGQFRAQDTQRIIELLKRAGLPVRGPQEMSAQAYLPHMMRDKKVLAGEMRLVLPLAIGSSELRGGVPHDVVLGAIADTQQAQQ

SEQ ID NO: 10994 - protein, 178 aa, Klebsiella pneumoniae
ARRRAAYLRGGRPASWRNGRTRSATARSAWPQFAAGFYLERARRASGSGAYLRSDGAVLMKRVAFVFSSAPHGSAAGREGLDALLATSALTDDIGVFFVGDGVFQLLPEQRPGAVLARDYIATFKLLSLYDIDQCWLCADSARERGLDPATPWVVDVECLAPDALRARLHEFDVILRF

SEQ ID NO: 10995 - protein, 500 aa, Klebsiella pneumoniae
RPMLHLFAGLDLHTGLLLLLALAFVLFYEAINGFHDTANAVATVIYTRAMRSQLAVAMAALFNFFGVLLGGLSVAYAIVHMLPTDLLLNMGSAHGLAMVFSMLLAAIIWNLGTWYFGLPASSSHTLIGAIIGIGLTNALMTGTSVVDALNIPKVIGIFASLIISPIVGLVIAGGLIFLLRRYWSGTKKRARIHLTPAEREKKDGKKKPPFWTRIALILSAIGVSFSHGANDGQKGIGLVMLVLIGVAPAGFVVNMNASGYEITRTRDAVNNVETFFQQRPELLKKATGVDQLVPSPDTNTAANGEFHCHPANTINALDRVKTMLTGVENYESLKPEQRGQLRRIMLCISDTTDKVAKLPDVSADDQRLLKKLKTDMLSTIEYAPIWIIMAVALALGIGTMIGWRRVATTIGEKIGKKGMTYAQGMSAQMTAAVSIGLASYTGMPVSTTHVLSSSVAGTMLVDGGGLQKKTVTSILMAWVLTLPAAIILSGVLYWLSLKLI

SEQ ID NO: 10996 - protein, 246 aa, Klebsiella pneumoniae
KGVLFFMSRSLLTNETSELDLLDQRPFDQTDFDILKSYEAVVDGLAMLIGSHCEIVLHSLQDLKCSAIRIANGEHTGRQIGSPITDLALRMLHDMTGADSSVSKCYFTRAKSGVLMKSVTIAIRNRDHRVIGLLCINMNLDVPFSQIMSTFIPPETPEVNSPVNFASSVDDLVAQTLEFTIEEVNADRSVSNNAKNRQIVLNLYEKGIFDIKDAINQVADRLNISKHTVYLYIRQFKSGDFQGLDK

SEQ ID NO: 10997 - protein, 665 aa, Klebsiella pneumoniae
DVHRPVFADADLRIQVGPRSFMQANHPRADPLRHHGAGQHLTAGVPYPHQIAIDNPARLRILRMNSHRFAPGDGIALAQRGVVQLAVQTVGRMGRQQLQLPRLCVAMPLVGLQPHRMRRTVGVTKSGDGRRVDLYFTARRFQRVGLGIGAEGGETRKTGILRLLRHLNQLVSLPEFGKWRQRHLLLGAAPGGHLIESLQPLQITLPFGEAFAATRLPAFAEVGKDREIVARFISRGNHLLHRHQMLVTVVPGHGQIVALKRGGRRQDDIGMARGGGPEAFGNDDKLRFLPRLNQSVGVLMMSKVGAAGPPDKANIGKAPRHAVVLILRPRILQRLDNSCDRDLLHRVHASGHAPLHRAQHRRAAGRVAAVGKMIGKTKPATGGADLSQHGGQSDQHPVFLLAILLTLHAPAGHQHSGIFVEKLRQFADFICFNAADRCCPLSGFRYAVAFAGQIAGKNIVAAGAAGKKRIILPVIFHQRMGDPQHQRDVGAHMRRDPLHRIAKEIDGFRSHRIDADQPLTALAQPIKPRDPLLVGGIPGDFQRVQRVGAPQHHHFAVLEHQRPTGLLLIHLIAANDVRHDRLRRAGGVIAKMAGIAARQAHIALQQRRRLMQYAVRAPAVGAGKNGGRTVAVADPPMLGIDQIQRLLPAHPHEFILTADPLGLVR

SEQ ID NO: 10998 - protein, 174 aa, Klebsiella pneumoniae
RKHRRALYSLYVRRSLMMTENNNPVVMTWFQQQQTPAGWFDLLIIMIEGMLNNAGELESQPFLRQMGASLAETHPLPASETVGDLEANINRLLTHFHWGVVTIDVGEDGLRLRHQALPVSRDEAGRVRWCNAFCAILEGLYSRWLQSQGGSAHVILQRERVFSVSDVQFLYYHP

SEQ ID NO: 10999 - protein, 522 aa, Klebsiella pneumoniae
ANNRSMASYQTFSARSGIRVHTFWESNTRRRNMNTTAPTGLLQQPRPFFMIFFVELWERFGYYGVQGILAVFFVKQLGFSQEQAFITFGAFAALVYGLISIGGYVGDHLLGTKRTLVLGAIVLAIGYFMTGMSLLKPQLIFIALGTIAVGNGLFKANPASLLSKCYPPKDARLDGAFTLFYMSINIGSLLSLSLAPVIAEKFGYAVTYNLCGAGLIIALLVYFACRGMVKDIGSEPDHRPLSLRNLALVLAGTVVMIFLCAWLMHNVMIANLVLIVLSVVVIAFFFREAFRLDKTGRNKMFVAFILMIEAVLFYILYAQMPTSLNFFAINNVHHEILGFTINPVSFQALNPFWVVVASPVLAAIYTHLGHKGKDLTMPVKFTLGMFLCALGFLTAAAAGMWFADAQGLTSPWFIVLVYLFQSLGELLISALGLAMVAALVPQHLMGFILGMWFLTQAAAFLLGGYVATFTAVPENITDPLQTLPVYTNVFSKIGLVTLGVTVVMALMVPWLNRMINTPASAE

SEQ ID NO: 11000 - protein, 118 aa, Klebsiella pneumoniae
AGRRGGGMISTIALFWALCVVCVVNMARYFSSLRALLVVLRGCDPLLYQYVDGGGFFTSHGQPSKQMRLVWYIYAQRYRDHHDDEFIRRCERVRRQFILTSALCGLVVVSLIALMIWH

SEQ ID NO: 11001 - protein, 72 aa, Klebsiella pneumoniae
CASRATTPMSCVTSSSPRPRLATISASRSRMRAWAMASRSVVGSSAMIKGARLSRARATIIRCSMPPLISKG

SEQ ID NO: 11002 - protein, 172 aa, Klebsiella pneumoniae
AGLRFNEWKRRDYIMKGDVKIISYLNKLLGNELVAINQYFLHARMFKNWGLMRLNDIEYHESIDEMKHADKYIERILFLEGIPNLQDLGKLGIGEDVEEMLRSDLRLELEGAQNLREAIAYADSVHDYVSRDMMIEILADEEGHIDWLETELDLIGKIGLQNYLQSQIKVSD

SEQ ID NO: 11003 - protein, 825 aa, Klebsiella pneumoniae
FLSLHHDLRSAAAEGSAAAFTGAGGGGSAAGRCPAASVSGSASNVDGQHRAAGGLPAIRRHPRTAILAAAESVGGLGDGAKKAVMWFPARCTACRAFPATGGLIAAIPRLTHRPSLKFPQLSPILDLMHKRRTRASFTLFNRTAHMTNPLLTPFSLPPFSAIKPEHVVPAVTKALEDCRAAVESAVAHGAPYSWENLCQPLAEVDDVLGRIFSPVSHLNSVKNSPELREAYEQTLPLLSEYSTWVGQHEGLYKAYRDLRDGDNYATLNTAQKKAVDNALRDFELSGIGLPPEAQKRYGEIAARLSELGNQYSNNVLDATMGWNKLVTDVADLAGMPESALAAAQAQAQAKEQEGYLLTLDIPSYLPVMTYCDNQALREEMYRAYSTRASDQGPNAGKWDNSPVMAEILALRHELAQLLGFDSYAYKSLATKMAKDPQQVLDFLTDLAKRARPQGEKELAQLRAFAKAEFGVDELQPWDIAYYSEKQKQHLYSISDEQLRPYFPENKAVSGLFEVVKRIYGITAKERTDVDVWHPEVRFFELYDEHNELRGSFYLDLYAREHKRGGAWMDDCVGQMRKLDGSLQKPVAYLTCNFNRPVNGKPALFTHDEVITLFHEFGHGLHHMLTRIDTAGVSGISGVPWDAVELPSQFMENWCWEPEALAFISGHYETGEPLPQELLEKMLAAKNYQAAMFILRQLEFGLFDFRLHAEYKPEQGAKILETLAEIKKQVAVVPGPTWGRFPHAFSHIFAGGYAAGYYSYLWADVLAADAFSRFEEEGIFNRETGQSFLDNILSRGGSEEPMELFKRFRGREPQLDAMLEHYGIKG

SEQ ID NO: 11004 - protein, 181 aa, Klebsiella pneumoniae
GISLPCLMLAGCMWEANKRGLAIISTCCLRSSADSSSSSKRPLILPMLNPARVLASFTDTSLLRVVICPEPGGLPASASRHFTPSSRRLVSLIDTIWAASSTWPTGRSISCAQAFNAGRCRASSRISSRLVRLSAIRCPLALSSFPPLLASSSASAKCRVTLSACRGRFCRRFSCSASRCA

SEQ ID NO: 11005 - protein, 90 aa, Klebsiella pneumoniae
RHPRWTPLATLPRTTPVNHPRGASLMMSLADILQLVVLCALLFFPLGYLTRHYQRRIRTTLRLMFFKPRYVKPAGVLRRGTTVKQGKANK

SEQ ID NO: 11006 - protein, 93 aa, Klebsiella pneumoniae
AMPRSLKKGPFIDLHLLKKVEKAVESGDKKPLRTWSRRSTIFPNMIGLTIAVHNGRQHVPVFVSDEMVGHKLGEFAPTRTYRGHAADKKAKKK

SEQ ID NO: 11007 - protein, 140 aa, Klebsiella pneumoniae
GASLMLQPKRTKFRKVHKGRNRGLAQGTDVSFGTFGLKAVGRGRLTARQIEAARRAMTRAVKRQGKIWIRVFPDKPITEKPLEVRMGKGKGNVEYWVALIQPGKVLYEMDGVPEELAREAFGLAAAKLPIKTTFVTKTVM

SEQ ID NO: 11008 - protein, 114 aa, Klebsiella pneumoniae
SHAREEKTMKAILFLAALMPLGVLAQPININNNPNQPGYVVPSQQRMQNEMKIQQQQQQSMLKQDLNNQTRSQQQHLQNQLQTNQQRAAQGGNLNAPQQVRPNNNGGMLRQTNP

SEQ ID NO: 11009 - protein, 853 aa, Klebsiella pneumoniae
PVPLLLHHFTLRVRTVLADVENPSQPAQSGNSGENGAGGWDVMKRLTTLALLAGMLSAPALHSEEPGSGAAAPLSFPQLNDAADSEPGDEPPAASPEEGASPAAPATAGDAAATAPAPVMPDLPPPVSGTAAPEVIPVAPVWGGDLNLAQMGMPDGIILSGGQRQGGVSFTLPADQVVIHSQLSLAVRVSPEMASRNATLQLMLNGQPLGTLPLGADGEDVSHYQLDIPPALMVSSNNLSVKINDGDTLQCQRDIHDTSRVTVLPTSHFSWESQQLNISDDLSHFPRPFFDSMQMTPADIAVAYGAKPSADVFSAAALISSWLGIQADYRGIAFSALRDRLPERHGIVIGHPGEQVGGMMLPETDKPLLRIIANPANPAYKLLLIVGKNDTALRIAAWRLTRGNFAPQTATLDVEPQTIPVGKAYDAPRWIPTDRPVKLSELLRKDQSPTVSGVWHEPLRIAFRAAPDLYLWDGETIPLQVGYRFPSESWINEDKSLLSVTLNGTFLNNLPMNKQGPLEKVWRYLGGDARQERFTIPLAPYLIYGDNQLSMYFNVVPKDDVPCSVLLNNNIKSRITDDSWIDLSKTRHFSLLPNLSYFVGASFPFSRLADYSQTTLLLPADPSETQVATLLNLAARSGNATGTALANNRVVLGMPTGGGDLQSLRERDVLAVTALDQQAFNQSLLADSPYRPVDNVLSVREPDLWQKVQRRLTGDWTSASLDADRYFSSSSAWRGFISYRSPWNSTRLVVVALASNDDQLARLKTDLESPRINAGIRGDTAVITSDNGVRSFQVSTPFPSGQMPWYMMAVWYASQHSGFLAVLGLIATSIMGLALTAMFKRHARKRLGSGDNQ

SEQ ID NO: 11010 - protein, 101 aa, Klebsiella pneumoniae
LTILLGYNTPISGGLQGTAQTPYLNRRGAVSQKQAGYLGDGAAGRDDIIHQSDMESLHGKFKLKGIFQVLPALAGIERMLDGAGSLASQAFAMPDASSPAG

SEQ ID NO: 11011 - protein, 111 aa, Klebsiella pneumoniae
FFKRADLHSRRVYTYTGVTMSRYQHTKGQIKDNAIEALLHDPLFRQRVEKNKKGKGSYQRKDKHAGRIDREASGKQANRFFTTGLLLSLLIKNGCFVLSADREFRSAELLL

SEQ ID NO: 11012 - protein, 220 aa, Klebsiella pneumoniae
MKKRVLMIAALVSGTLAISGCTTNPYTGEREAGKSGIGAGIGSLVGAGVGALSSSKHDRGKGALIGAAAGAALGGGIGYYMDVQEAKLRDKMQGTGVSVTRNGDNIVLNMPNNVTFDSNSANLKPAGANTLTGVAMVLKEYEKTAVNVVGYTDSTGSKDLNMRLSQQRADSVASALITQGVAANRIRTTGMGPANPIASNSTAEGKAQNRRVEITLSPLQ

SEQ ID NO: 11013 - protein, 452 aa, Klebsiella pneumoniae
GMKRVRFSPRSSFARTLLLIVTLLFVSLVTTYLVVLNFAILPSLQQFNKVLAYEVRMLMTDKLQLEDGTQLVVPPAFRREIYRELGISLYSNEAAEDAGLRWAQHYEFLSQQMAHQLGGPTEVRVEVNKSSPVVWLKTWLSPNIWVRVPLTEIHQGDFSPLFRYTLAIMLLAIGGAWLFIRIQNRPLVDLEHAALQVGRGIIPPPLREYGASEVRSVTRAFNHMAAGVKQLADDRTLLMAGVSHDLRTPLTRIRLATEMMGEQDGYLAESINKDIEECNAIIEQFIDYLRTGQEMPMELADLNAVLGEVIAAESGYEREIATALQAGEIPVRMHPLSIKRALANMVVNAARYGNGWIKVSSGSEASRAWFQVEDDGPGIKPEQREHLFQPFVRGDSARSTSGTGLGLAIVQRIIDNHNGRLEIGSSERGGLLIRAWLPVHRMLAPMKPARES

SEQ ID NO: 11014 - protein, 491 aa, Klebsiella pneumoniae
KRRRRRGSDASVPVNNVESRSRRNKSVNNNLPSEAVAHAVAVLKNEHVIAYPTEAVFGVGCDPDSETAVMRLLELKQRPVEKGLILIAASFEQLKPYIDDSRLSDSQREAIFSCWPGPVTFVFPARPETPRWLTGRFDSLAVRVTNHPLVIELCEAYGKPLVSTSANLTGQPPCRTTAEVHAQFGDSFPVVDGATGGRQNPSEIRDALTGELFPPGVNPWKPIAVLVIRSRTASRLLFISCLARQLGITHPYGRVLAPLDDFVSSLNQFFAEGGKGANVTVPFKEEAFARADELTERAALAGAVNTLKRLEDGRLLGDNTDGIGLLSDLERLGFIKPRQRILLVGAGGASRGVLLPLLSLGCAVTIVNRTYSRARELATLFAHTGSVSAREMDTLSGETFDLIVNATSSGIDGDVPAIPASIVNADVYCYDMFYQKGPTPFLHWCQQYGAVHCADGLGMLVAQAAHAVLLWHGVLPAIAPVIETLQQELNA

SEQ ID NO: 11015 - protein, 352 aa, Klebsiella pneumoniae
GRLRFVRDKLRKCFPLITVRTMKKKRPVLQDVADLVGVTKMTVSRYLRNPEQVSEALRGKIAVALDELGYIPNRAPDILSNATSRAIGVLLPSLTNQVFSEVLRGIESVTDAFGYQTMLAHYGYKPEMEEKRLESMLSWNIDGLILTERTHTPRTLKMIEVAGIPVVELMDSRSPCLDIAVGFDNFEAARQMTAAIIARGHRHVAYLGARLDERTIIKQKGYEQAMLDAGMTPYSVMVEQSSSYSSGIELMRQARREYPQLDGIFCTNDDLAVGAAFECQRLGLKIPDDMAIAGFHGHDIGQVMEPRLASVLTPRERMGRIGAERLLARIRGEAITPKMLDLGFTLSPGGSI

SEQ ID NO: 11016 - protein, 425 aa, Klebsiella pneumoniae
HRQRFLSHKRQFIHSTLLPASNKAERWIMCIVDSSLFAEKEPDMLTPFTVLMPANIRFGRGQAESAAPWLAQQGGPILLVHGASPQRAAFLRQQLETLQLAVTTLAISREPWLSDIEQGVQLAREKGIRAVVSLGGGAVIDAGKAIAALVPAAGPVIDYLEVVGTGRQLEASPLPFVAIPTTAGTGAEVTKNAVINVPEQQRKVSLRDDRMLPDLAIVDPALTDNAPRSITLSSGLDALTQVIEPWLCSRATPFTDALCQQAIPRGIRALKILMEQECPASRDEMAWVSLCGGLALANAGLGVIHGLAGPLGGLSRASHGALCGSLLPFGLALNESQINDPGLRQRVNDVRRWLADGLDVPVDQVWDSLREWSHRAGLGTLRDLGVARDALEPAALAASTSSSMKANPVSLSGEQLLEMLEAAWE

SEQ ID NO: 11017 - protein, 525 aa, Klebsiella pneumoniae
PGQRRPELRQLAGARFAVASTHVHSPLQPAAGFLLQRLHHGVHLTQHPRLGGVHRQIGALDPRQRGTGRGGRLGNLPRHVLPVGGGRPRRRRRLRHADKGVIRRQHPADGRRFATVGALHAQQFAAGAAQIGHRLLMMSLGLRHSRQQQQAIRGVILAQTAGQLFSAIVVPRRQRHVDGPGARILVRRIARHQVVIDHPGLFVHFAALVQPRHGEHQIGILRIALHSADQLVIRRSVIALLAQAVGFVDHIAIANARQLRRRTAGLQLRIADQVLRLAGQPGLIQDSDLIGVIPGIAGYAAADIVAHQRDRGGQVAALGQQTRQLAGVRRGFWRRGGHRPQGIAGGDGIALRQVVFGRHQLQVVVHPLAQIAHVAGLAAAGNARQQRLRLLPGAVFAGKQGGGIQRTVAGAGAIGRRHQRRGLAAVTRFLQQPGQVEAQPGIVRIAGDAFAQGGNGAGWVTAADLRLGLTAQGIARHTGHHPRLQFLPQALRERLQHRLRLGGFILLAQHVIEVFPRRRVLRIVI

SEQ ID NO: 11018 - protein, 709 aa, Klebsiella pneumoniae
VAKRRIAPAVRRFCFSLMWRRLIYHPEVNYALRQTLVLCLPVAIGLLLGHLQQGLLFSLVPACCNIAGLDTPHKRFFKRLIIGGCLFAGCSLVVQLLLAQAIPLPFILSGLALLLGVTAEISSLHARLLPASLIAAIFTLSLAGNMPIWEPLLIYAFGTLWYGVFNWFWFWLWREQPLRESLSLLYRELADYCEAKYSLLTQHTDPSTALPPLLTRQQKVVDLITQCYQQMHMLAANQRNDHKRLLRAFQMGLDLQEHISVSLHQPEEVQKLVERSHAEAVIRWNAQTVAARLRVLADDMLYHRFPKRFQMDKQIEALEKIARQHPDNPVGHFCAWHFSRIARVLHTQRPLYARDLMADKERRLPLLPALKNYLSLKSPALRNAARISVMLSVASLMGNALHLPKPYWILMTVLFVTQNGYGATRVRIVHRAAGTLAGLTIAGLTLHFHVPESYTLSGMLLITLLSYLIIRKHYGWAMVGFTVTAVYTLQLLTLNGEQFIIARLIDTLIGCLIAFGGMVWLWPQWQSGLLKKNAHDALEADQQAIRLILSADPKAPALAYQRMRVNQAHNALYNSLNQAMQEPGFNTHYLEDMKLWVTHSQFIVEHINAMTTLAREHTMLTPDLAQRYLESCEIALQRCQQRLDSDGPGSAGDANIMESPESEVPIGPLSTLEQHLQRILGHLNTMHTISSVAWRQRPHHGIWLRKINR

SEQ ID NO: 11019 - protein, 442 aa, Klebsiella pneumoniae
AGKRGCKKELIMVRLEKNDPLMLARQLPIKSVALILAGGRGTRLKDLTIKRAKPAVHFGGKFRIIDFALSNCINSGIRRIGVITQYQSHTLVQHIQRGWSFFSEEMNEFVDLLPAQQRVHGENWYRGTADAVTQNLDIISRYKAEYVVILAGDHIYKQDYSRMLIDHVEKGARCTVACMPVPIEEASAFGVMAVDENEKIIEFVEKPANPPAMPTDPTKSLASMGIYVFDAAYLYELLEEDDRNENSSHDFGKDIIPKITEAGMAYAHPFPLSCVQSDPNAEPYWRDVGTLEAYWKANLDLASVTPELDMYDQNWPIRTHMESLPPAKFVQDRSGSHGMTLNSLVSGGCIISGSVVVQSVLFPRVRVNSFCNIDSAVLLPDVWVGRSCRLRRCVIDRACVIPEGMVIGENAEEDARRFYRSEEGIVLVTRDMLRKLGHKQER

SEQ ID NO: 11020 - protein, 247 aa, Klebsiella pneumoniae
FSRRQGVIPCRPFSARWRVIMHFDIAWQEVDTVLLDMDGTLLDLAFDNYFWQTLVPETWGAARGLNLQEAKDAMRQEYHAVQHTLNWYCLDYWSERLGLDICAMTSEQGPRATLREDTVPFLDALKACGKRRILLTNAHPHNLAVKLKHTGLDAHLDLLLSTHTFGYPKEDQRLWRAVAEETGLEAHKTLFVDDSEAILDAAREFGIRYCLGITNPDSGLAEKQYLRHPGLNDYRRLIPSLTPKERR

SEQ ID NO: 11021 - protein, 403 aa, Klebsiella pneumoniae
VRRRRIFYSNDPDSCVGHLQNRMMMSDFLPFSRPSMGDAELAALREVLASGWITTGPKNQALEAAFCQLTGNRHAIAVSSATGGMHVTLMALGIGPGDEVITPSQTWVSTLNMICLLGATPVMIDVDNDNLMITPDAVEAAITSRTKAIIPVHYAGAPADIDAIRAVGERHGISVIEDAAHAAGTHYKARHVGWQGTAIFSFHAIKNMTCAEGGLIVTDDDELASRIRSLKFHGLGVDAYDRQTHGRAPQAEVITPGFKYNLADINAALALVQLEKLSHANQRRTEIAQRYLRELADTPFKPLSVPTWDHQHAWHLFIIRVDEAACGISRDALMEKLKAMGIGTGLHFRAAHTQKYYRERFPEVSLPNTEWNSARICSLPLFPDMTDDDVTRVISALRQLSGR

SEQ ID NO: 11022 - protein, 403 aa, Klebsiella pneumoniae
LYSRQNPLQLTVSLSNRKDCQYRLWQGVRMTPDEIWLRLMKVSSLYGDRMVEIAQRLCAAASVDREALHAVGMTAAQAKLFFRLDEHELDETRRWLGQPDHHLLRGDDPRYPLRLKAIADYPGALLVSGGLALLHSAQLAVIGSRSHSWYGARWGKLFSETLAQKGITITSGLALGIDGVAHRGALAAEGKTIAVLGNGLSQVYPRRHATLARQIIDNGGTLVSEFPLITPPLPAHFPRRNRIISGLSLGVLVIEAALRSGSLVTVRCALEQGRDVFALPGPIGNPGSEGPHWLIKQGAVPVTSPEDIVEYWHNELAWLTDTSDSINICVDQPSVALPFPELLANVGDEVTPVDVVAERAGQSVPVTVAQLLELELAGWIAAVPGGYVRLRRASHVRRTHVFV

SEQ ID NO: 11023 - protein, 193 aa, Klebsiella pneumoniae
SQHRPMTMSKSLQKPTILNVETVARSRLFNVESVDLEFSNGVRRVYERMRPSTREAVMIVPIVDDHIILIREYAVGTESYELGFSKGLIDPGETVDEAANRELKEEVGYGANKLTFLKKLSMAPSYFSSKMNIMVAEDLYPESLPGDEPEPLPQVRWPLAQLMSLLDEEDFNEARNVSALFLVREWLQAQGRL

SEQ ID NO: 11024 - protein, 259 aa, Klebsiella pneumoniae
RSCRSHPEAHQPHHCGCVRSLRLWRLAMGQKVHPNGIRLGIVKPWNSTWFANTKEFADNLDSDFKVRQFLTKELAKASVSRIVIERPAKSIRVTIHTARPGIVIGKKGEDVEKLRKVVADIAGVPAQINIAEVRKPELDAKLVADSITSQLERRVMFRRAMKRAVQNAMRLGAKGIKVEVSGRLGGAEIARTEWYREGRVPLHTLRADIDYNTSEAHTTYGVIGVKVWIFKGEILGGMAAVEQPEPAAQPKKQQRKGRK

SEQ ID NO: 11025 - protein, 203 aa, Klebsiella pneumoniae
DLSREMKKPNHAGSGQIRIIGGQWRGRKLPVPESPGLRPTTDRVRETLFNWLAPSIVDAHCLDCFAGSGALGLEALSRYAASTTLLEMERGVAQQLQKNLATLKADRGKVITTNTLSFLSQPGTPHQIVFVDPPFRQGLLEETLRLLETQGWLADEALVYVESEVENGLPPVPANWQLYREKVAGQVAYRLYQREAQGEHHAD

SEQ ID NO: 11026 - protein, 349 aa, Klebsiella pneumoniae
GVGRFSAKEATMAKAARATISDVAKAAKTGKTSISRYLNGEKHLLSDDLLSRIEKAIAELDYRPSLMARGLKHGRTRLIGLIIADITNPYSVNVMSGIEAACREKGFTLLVCNTNNELDQELHYLDLLRSYQVEGIVVNAVGMREDGLNRLQQSALPMVLIDRKIPDFACDVVGLDNAQAATTATEHLVEKGFEAILFLSEPLGSVNTRRERLSAFRATLARHHGVVAENAEVQLNDGAMLDNVLRQFHARHRGMRKAVISANGALTLQVARALKRVGLIWGSDIGLLGFDELEWAELAGVGITTLKQPTWQIGYAAVEQVIRRIAGTNDPIRERVFSGELIVRGSTSR

SEQ ID NO: 11027 - protein, 177 aa, Klebsiella pneumoniae
FVGSCMPPASSKRPPSSLMRPSSRFMAGLPIKLATKRLAGFSYTSTGVPICSATPLFITITRWARVIASTWSWVTYSEVVFRRRCSCCSSRRICTRSLASRFDNGSSKRNTAGSRTMARPIATRWRWPPDSSRGRRLSRPSSSRMRAASCTRSAINPLPMPRIFSPHAMFSSTLICG

SEQ ID NO: 11028 - protein, 168 aa, Klebsiella pneumoniae
SAGRVKLTPPCRWPPLRIIPSGIPICARFRSPPQTGATGMTSGAAVPLTGGGKSGITGAGAVAAASPAVAGAAGEAPSSGEAAGGSSPGSLSAASLSCGKLSGAAAPEPGSSLCSAGAESIPASSASVVNRFITSHPPAPFSPLLPDCAGCDGFSTSARTVRTRSVKW

SEQ ID NO: 11029 - protein, 544 aa, Klebsiella pneumoniae
KRGRESLAFFTHRCGEGIHHRAVAGRLRLATAGFGGFRGRAISLRALLTTAAAGVAVARLLVETHGQGDTLTRQIDFHHFDLDDVARFHHGVRILNKPVRKRRNVYQSVLMNADINKRAEVGDVGDGTFQNHSRQQVIHGLHTIGELRGLKLRTRIAARFFQLFDNVGDRRDAKLLIGEVHCLQVAQRTAIAHQIFQRLLGGGQNTFDHRVSFRVNGGGIQRVVAVVDTQEARALFKGFRPQTADFQQLLAVLELTILVAPGDDVLRHHAGQAGDAGQQRNGGGVQVNADGVHTVFHHRVQLTRQLGLADVVLILADANGFRVDFHQLGQGILQTAGDGDRAAQRHVEVRKLLRRQLGGGVNGSPGFADDHLLGGDLRELFLHVEEETLGFTRGGTVADGHQLNVVLLTQRGDGDGRFGGLAGVGIDGIGGDQFTGGVDDGHFHPGAQARIESHGGAQPGGRGHQQIVQVAGEDVDCLVLRAFAHGAHQLGFEMHQDFDPPGPADDAFTPAVRRGVIQAQAQVVDNNLLAVALFRRLVKLRVSV

SEQ ID NO: 11030 - protein, 84 aa, Klebsiella pneumoniae
SRQSGPYQWLFATGRRGLPGVRSESTKAALLSYHPLYSIRLVFCLTPIAAYPILVHKISKKEKSAFSMTYKNTDKSNAYPLSGR

SEQ ID NO: 11031 - protein, 565 aa, Klebsiella pneumoniae
ARQSEQMTNKKTTAAPLPLWQYWRGLGGWNFYFLVKFALLWAGYLNFHPMLNLVFLAFLLVPIPREKLHRIRHWIAIPLGFALFWHDTWLPGPESIFSQGSQIAGFSASYIWDLIVRFINWSMVGAFFVLLVLWLFISQWLRVTVFVSAMVVWLAVSPLLPAFTLWPSGQPTTAAATTAQANTGANAAAGAASSPANSDIPPQTEPPTSANLTNWLNAFYAAEQKRKTPFPDQLPADAQPFDLLVINICSFSWSDIEAAGLMDHPLWKHFDIVFKNFNSATSYSGPAAVRLLRASCGQLSHTNLYQPSGADCYLFENLAKLGFNQQLMLGHNGLFGDFLKELRSLGGMQSPLMDQTGLPVSLQAFDGSPVYEDLAVLNRWLKTEEASSNPRNATFYNTLPLHDGNHFPGQSKTADYKVRAQKLFDDLDNFFTELEKSGRKVMVVVVPEHGGALKGDKMQVSGLRDIPSPSITNVPTAVKFFGMKAPHEGAPIIIDQPSSYLAVSELVVRALDGKMFSEDSVNWQQYVANLPQSAAVSENANAIVIQYQGKPYVQLNGGSWVPYPQ

SEQ ID NO: 11032 - protein, 1351 aa, Klebsiella pneumoniae
PMKRKIIITMKNTRRLTTFCLTGALTLAASGGALAAGNDAALQALFAQANYWHEKSHDELAMESLQKVLSVDANNTQALYLMALWSQQGGDMQAAAQWRARLAKAAPDSPGLQDLDNAKKMSQVPQGQLNLARQQARGGNIPGALATWRSMFNGNTPPAGLAAEYYLTMASDKSLYPQAISELRQYVAQHPQENAPRVALGKALTWREETRREGIALLEPMASGNKEADSGLRQALLWLGPQAGDEQYYDTWMQRHPQDSEVQNYFRERRSGQARGQGYANLNSGNTAAAKQQFEEVLQTNPQDADALAGMGYIAQRSGDYQAASQYLSRAADLGGDASATRRQQAADALFYGQLAQAQQAYKQGNISQALALSAPLAQQSGAQGASAKLFRADVLRHNKDLPQAEQTLRSLLNDDPQNAAARENLYYVLREQNKSAEAQAMLQTLPQSLRQKLQPRVVAGMPGDALRRQAQAQVSGGNPAGAIATLREGVARYPDDPWLRLDLARLLQKSGNGSEASSLMSAAYRPGASNSALYAAALFASENGAWQQAQTLLARIPGGSQTSDMRDLRQRVNYNLQLVTAENYLAQGNTIAASNTLRAMASTPPKAPADAGKLARLLAESGDLTTAVSLVRNNISSGVSGNAGDYADQIAVLNQAGLTGEAQNLISNPQLQASSTPTQLASIRNGYVINEADRLREQGNYAAAYDKLIRAMQSDPQNTDLMFAMARLYQSGKMNKEAGVVYDYLMTRDTPNQDARAGAIDVALSAGNNDRAEQLAGGLRQDNSPDRLLLLARVAEAQGHHQQAMTYLRSARGKLLGMQSTNSSETPTVGGVLAADNPFIGVSQTSAPTRTASAYGQYMPWQVAQSAAAPGSTLPGIQRTDLPVDTAQTRMLRQVDTMMESLQEKTGSWLQGGMDVRGRDGESGTSKLTELRTPLTWSSSPFGDSRFDFTVTPVSLNAGTASGDAWRRYGANPLANAVSNMVSTATSEQAAIASMTEAERTAYFASNPGAEALSGLGTLNAADFNPTTSSGMENLAKLGSYDAGQVASYLSSSSRKPNVDQTSGSTDSQKANGVELALALSGDDYRVDIGSTPLGQDLNTVVGGVKWSPKLTNYLSLILTGERRSLTDSLLSYVGLKDAYSGKNWGQVTKNGGTLQLSYDDGDAGFYVGGGGYSYLGQNVASNTSINANAGVYLRPYHDEYRQLQAGLSMSYMDYSKNLSYFTYGQGGYFSPQNYVSVSLPVSLTEKYDNWTMKLGGSVGYQSYSQDKSAYFPTNSEWQQTLETAVSNGFAKEAYYSATSKSGIGYTLRAGADYKVNKQMTLGGQIGYDTFGDYNESTAGLYIRYMLGDH

SEQ ID NO: 11033 - protein, 511 aa, Klebsiella pneumoniae
ECGRGCTPLLSLRGRYRAGDPRHAAEIRAQTGALMQVLHVCSEMFPLLKTGGLADVIGALPAAQIAEGIDTRVLLPAFPDIRRGVVDAQVVTRRDTFAGRITLLYGHFNGVGIYLIDAPHLYDRPGSPYHDTNQHAYPDNVLRFALLGWMGSEMASGLDPFWRPDVVHAHDWHAGLTPAYLAARGRPAKSVFTVHNLAYQGMFYSWHMNDIELPWSFYNMHGLEFNGQISFLKAGLYYADHITAVSPTYAREITEPQYAYGMEGLLRQRHHEGRLSGILNGVDDGIWSPQNDLLLPMRYDRDTLEEKAENKRQLQIAMGLKVDDKAPLFAVVSRLTSQKGLDLVLEALPGLLEQGAQLALLGAGDPVLQEVFFAAAAEHPGKVGVQIGYHEAFSHRIMGGADVILVPSRFEPCGLTQLYGLKYGTLPLVRRTGGLADTVADSSLENLADGLATGFVFEDSNALSLLRAIRRAFVLWSRPSLWRYVQRQAMNMDFSWQVAANSYRELYQRLM

SEQ ID NO: 11034 - protein, 132 aa, Klebsiella pneumoniae
RQMSMQDPIADMLTRIRNGQAANKAAVTMPSSKLKVAIANVLKEEGFIEDFKVEGDTKPELELTLKYFQGKAVVESIQRVSRPGLRIYKKKDELPKVMAGLGIAVVSTSKGVMTDRAARQAGLGGEIICYVA

SEQ ID NO: 11035 - protein, 440 aa, Klebsiella pneumoniae
RPVSWTSSRLRDVNRQRGAGNVKGNNMMRWISLLLLLLPLAVAPAARNDKPVSLVIDDAPVAQVLQALAEMNHKNLVVAPDVSGTLSLRLQKVPWSQALRAVADSAGLSLQQQGTVIYAHTQAWQKANQAQREAEQEKRLQNLPLQAESVTLHFADAEELAKSGGKLLSARGHLMADKRTNRLLIRDDARHLPALKAWAQEMDLPVGQVELAAHIVSMSETSLRELGVKWRLAEAGSPPGSGQITTLSSDVSVNDASTRAGFNIGKINGRLLELELSALERKQQVEIIASPRLLASHMQPASIKQGSEIPYQVSSGESGATSVEFKEAVLGMEVTPTVLQQGRVRLKLRISENTPGQVLKQENGEALAIDKQEIETLVEVRSGETLALGGIFSQKNKTARDSVPLLGDIPVLGRLFRRDGKDNERRELVVFITPRILAVR

SEQ ID NO: 11036 - protein, 333 aa, Klebsiella pneumoniae
SSKRFEMALLNVDKLSVHFGDENAPFRAVDRISYSVKQGEVVGIVGESGSGKSVSSLAIMGLIDYPGRVMADKLEFNGRDLQRISEKERRQLVGAEVAMIFQDPMTSLNPCFTVGYQIMEAIKVHQGGNKQTRRQRAIDLLNLVGIPDPASRLDVYPHQLSGGMSQRVMIAMAIACRPKLLIADEPTTALDVTIQAQIIELLLDLQQQENMALVLITHDLALVAEAAHKIIVMYAGQVVETGDAKDIFRAPRHPYTQALLRALPEFAQDKARLASLPGVVPGKYDRPNGCLLNPRCPYATDKCRSEEPALADLTGGRQSKCHYPLDDAGRPGL

SEQ ID NO: 11037 - protein, 215 aa, Klebsiella pneumoniae
LPKRRWRVWRRCGGSMSDKFGDERDPYLYPALNVLRNRLGIRQAKNLQQAAFEMTALRAATLPLGPRVRGLPYLCAIHHQLYQDLFDWAGRLREVNLYLGDTPFCHFARIEEEGNALMQALEQEDYLSGLPRDTFIERLSWFYGEINVLHPFRLGNGLTQRIFFEQLAIHAGYLLNWRDVDPAGWSAACQQSAMGDLAPLVAIFRKVVSEARESE

SEQ ID NO: 11038 - protein, 110 aa, Klebsiella pneumoniae
NNWSSGLMQNQRIRIRLKAFDHRLIDQSTAEIVETAKRTGAQVRGPIPLPTRKERFTVLISPHVNKDARDQYEIRTHKRLVDIVEPTEKTVDALMRLDLAAGVDVQISLG

SEQ ID NO: 11039 - protein, 281 aa, Klebsiella pneumoniae
VSRRSNTMAVVKCKPTSSGRRHVVKVVNPKLHKGKPFAPVLGKKQQNPGVVTPMARITTRHIGGGHKQAYRIVDFKRNKDGIPAVVERLEYDPNRSANIALVLYKDGERRYILAPKGLKAGDQIQSGVDAAIKAGNTLPMRNIPVGSTVHNVEMKPGKGGQLARSAGTYVQIVARDGAYVTLRLRSGEMRKVEADCRATLGEVGNAEHMLRVLGKAGAARWRGVRPTVRGTAMNPVDHPHGGGEGRNFGKHPVSPWGLQTKGKKTRSNKRTDKFIVRRRSK

SEQ ID NO: 11040 - protein, 690 aa, Klebsiella pneumoniae
CKRSGVGMSRTRKTLVIITGTILLLIVLFFIVLATFDWNRLKPTINQKVSAELNRPFAIRGDLGVVWERQPDERGWRSWIPWPHVHAEDIVLGNPPAIPQVTMIHLPRVEATLAPLALLSKTVYLPWIKLEQPDVRLIRLAEDNNNWTFQLAGDKRTSGDSAPSSWSFRLDNILFDRGTIAIDDKITRSDITILVDPLGKPLPFSEVTGTKDRHSAAKPGDYVFGLSLKGRYKGQPVTGNGKIGGMLALRSASAPFPLQGDFHSGNTRVAFSGTVSDPLNVGGIDLRLKFAGDSLRDLYDLTGVLLPETPSFSTDGRLRADFTQKNRMRFNYQNFNGRIGDSDIHGSLTYTTGKPRPKLSGDMESKQLRLADLGPLIGVDSGKGTKKSASRQADDRPQPAGKVLPADRFETDKWQVMDADVRFKGRRIEHGGTLPISDLSTHVILEDGDLRLQPVRFGLANGSIAGSVHLQGDKKPLQGEANLQARRLKLKALMPNVEMMQKTLGEMNGDVQLRGSGNSVAALLGNSNGNLKLLMNDGLISRNLMEILGLNVGNYLIGQIFGDEEVRVNCAAANIDVTNGVARPQIFAFDTENALINVTGTASFASEQLDLTIDPESKGFRVITLRSPLYVRGTFKSPQAGVKAGPLIVRGAVAAALATLVTPAAALLALISPAEGDSNQCRTILSQMKK

SEQ ID NO: 11041 - protein, 107 aa, Klebsiella pneumoniae
PAPGPDGAGHRPAYRPPPAAAVFAAGSAGASAASPAPRRIYSARAARNRGFPAPPRSADRHLTVSAAFAPPGANLCCAAAHRRGTASPRRPAPRSAAPTARRAPAPG

SEQ ID NO: 11042 - protein, 104 aa, Klebsiella pneumoniae
GDAGMIREERLLKVLRAPHVSEKASTAMEKTNTIVLKVAKDATKAEIKAAVQKLFEVEVEVVNTLVVKGKVKRHGQRIGRRSDWKKAYVTLKEGQNLDFVGGAE

SEQ ID NO: 11043 - protein, 101 aa, Klebsiella pneumoniae
RPAGETGAGSGEPGQLGAGGGSSASAPGAGSGQRLDNLPSGAGSGQRRRTPGGRRADADDGQPPAAGRRTGLRLGTLPVGERPGRSGSGANRRSAAQRVDG

SEQ ID NO: 11044 - protein, 114 aa, Klebsiella pneumoniae
YFFGIRNKFLINSMIGVFYGRNLTEMRSCHEKENRNAIVEIKRELNQFTIYYSVIVTLNDKKLAQITKLFLLNYKFAGKSAGNSLAGQLMTSSLSAPQSRMKVIVANSSITSVG

SEQ ID NO: 11045 - protein, 105 aa, Klebsiella pneumoniae
LIVGFSRFQSKVASTIKKRTISNSIVPVMITNVLRVLLIPTPLLLHHVSPEYSQKAAFILEMRFSSHYARQVKKIMERCFNMIDQQNSAAHTSAYIDSIAGSGYV

SEQ ID NO: 11046 - protein, 204 aa, Klebsiella pneumoniae
FTVGSPRCQPMAIVTPLPLGWHWEAGGMTHVVNLLPWRDLRRRQRLRYVLLLTIGIVLLGGMGLLVSRTARLQRDFLATLHTTADAQLLASLKQREQAMREAWQQHQRQRQQYQRRSAIAAWQPRLQALAADLPAQAWLTRLEYQGILLTLDGLALNLQALTSVEAALTRVAGFAPAKAGGTQRDAEGRWQFSFTLTGARADAD

SEQ ID NO: 11047 - protein, 468 aa, Klebsiella pneumoniae
SNVGTNGSLQMKIIILGAGQVGGTLAENLVGENNDITLVDTNGDRLRSLQDKFDLRVVQGHGSHPRVLREAGADDADMLVAVTSSDETNMVACQVAYSLFNTPNRIARIRAPDYVRDAEKLFNSEAVPIDHLIAPEQLVIDNIHRLIEYPGALQVVNFAEGKVSLAVVKAYYGGPLVGNALSTMREHMPHIDTRVAAIFRHDRPIRPQGSTIVEAGDEVFFIAASQHIRAVMSELQRLEKPYKRIMLVGGGNIGAGLAHKLEKDYSVKLIERNQQRAAELAEKLQHTIVFYGDASDQELLAEEHIDQVDLFIAVTNDDEANIMSAMLAKRMGAKKVMVLIQRRAYVDLVQGSVIDIAISPQQATISALLSHVRKADIVGVSSLRRGVAEAIEAVAHGDESTSRVVGRSIDEIKLPPGTIIGAVVRGNDVMIANNNLRIEQGDHVIMFLTDKKFISDVERLFQPSPFFL

SEQ ID NO: 11048 - protein, 119 aa, Klebsiella pneumoniae
AYPGYSGGGKSMSQWVNICSIDDILPATGVCALLGQQQVAIFRPYHDDRVFAISNIDPFFNASVLSRGIIAEHDGALWVASPLKKQRFRLSDGLCMEDASHSIARFDARVKDGHVQLKA

SEQ ID NO: 11049 - protein, 551 aa, Klebsiella pneumoniae
RSGGYMQTTSQFWSRIMSISLKKSGMLKLGLSLVAMTVAASVQAKTLVYCSEGSPEGFNPQLFTSGTTYDASSVPIYNRLVEFKTGTTEVIPGLAEKWEVSADGKTYTFHLRQGVKWQDNKDFKPTRDLNADDVVFSFDRQKNTNNPYHKVSGGSYEYFEGMGLPDLISEVKKVDDNTVQFVLTRPEAPFLADLAMDFASILSKEYADNMLKAGTPEKVDLNPIGTGPFQLLQYQKDSRILYKAFPGYWGTKPKIDRLVFSITPDASVRYAKLQKNECQVMPYPNPADIARMKEDKNITLLEQPGLNVGYLSFNTEKKPLDDVKVRQALTYAVNKEAIIKAVYQGAGQAAKNLIPPTMWGYNDDVKDYTYDPEKAKQLLKEAGLEKGFTIDLWAMPVQRPYNPNARRMAEMIQADWAKIGVQAKIVTYEWGEYLKRAKAGEHQSVMMGWTGDNGDPDNFFATLFSCAAAKDGSNYSRWCYKPFEDLIQPARATDDHNKRIELYKQAQVVMHDQAPALIIAHSTVYEPVRKEVKGYVVDPLGKHHFDNVSVE

SEQ ID NO: 11050 - protein, 545 aa, Klebsiella pneumoniae
FHSGVLMAHCAHIPAFVLHQVTCQFATGQTLFGPLSVSLEPSLCGLVGRNGVGKTRLLRLLAGLDSPAGGHIERAAAVAWVAQQPTLTPETTLATLLGYASVFAALSRLEQGQGLADDFDLLDGHWDLTDRLSLAFREADLPPFSADRPAFSLSGGERMKALLCGAFVSGADYLLLDEPTNHLDRQGREWLYHQLESWQGGALIASHDRELLTRMPRIIELTPTALRSYGGNYDEYQRQRMAEQQAARAALEHAVTDRRRTRARMQKEHDAAQRRSAQTLRTVDTLNIASFERVKYKGAAKERPGALRRQHREQNSSLNAAVQQARERIEDDNPVMFTLPGSEVAAGKQVLVVESLQLDHAPAAPLNWRIDGPMRIALKGPNGCGKTTLLKTLLGLEQAASGDVRLSVSAAYLDQHLTQLDLSLSVMAHLSLEDTPLDEGLLRTRLAQLQLGADKVTLPLSALSGGERLKAALACVLWRREPAQLLLLDEPTNHLDLASTQAIESALAAFPGAMLVVSHDEAFLQGLKLTHSLAWRETGWHFSLL

SEQ ID NO: 11051 - protein, 77 aa, Klebsiella pneumoniae
KESGLVAQRGKTSKTAMKNGPAGPFSYDWIIYKRQRSRVRFFRFSARQSPQSISHPAHRLFSTDRVGHPSATSSWRS

SEQ ID NO: 11052 - protein, 118 aa, Klebsiella pneumoniae
AAPGGRRWWRPPLPVPRPDAPPAPTRRSGRFHQSWQTATAAGHPPADARRQPLQSHLRDAGRAGRRFPARRCADGWRCRASAPSARSPPAVRGWRPSLRDARRSGTAAGPSPPPRWRR

SEQ ID NO: 11053 - protein, 1163 aa, Klebsiella pneumoniae
LEPGMRKLTLSLLTLSLGVALLPLAQATTTPAQEHLLEQVRLGEASNREDLVRQSLYRLELIDPNNPELIAARMRYLLRQGDAAGAQKELERLTKLAPDSPELKASRNEMKSNTGEGRQALQQARLLGVAGKVDEAIAAYEKLYGGVPDDVDVAIEYWTLVARLPARHSEGVSQLKKLNASAPGNVSLLTSLAKQMFADNKPQEGFAYLAEMARSASGRGIAADMWFSEVKSMPVSKASVQALQQFLLQFPTGSVAANARVLLDQQQAQLQDPTFRARSEGLAAVKSGNTTQAVADLQKAVQADSRDSDAVGALGQAYSQRGDRARAVAQLSKAIAMDPDSPNRGKWDSLLQTNRYWLLIKQGDNALKAGQLSQAQNYYAQAQRVDRTDSYAVLGLGDVAAARKEAAAAERYYQQALRLDRGNNLAVRGLANLYRAESPEKASAWIAGLPPAQRRSIDDIERSLTNDRLEKQAQALESQGNWAQAAEVQRRRLALDPDSVWITYRLARDLVSAGERQEADALMRTMVNRQPQDAERVYASGLYLSGNDQDDLALAQIAALPRSAWTDNIRELEARLQSDRVLRQANQLRDSGDEAQAIALIKRQPSSVRYDLTLADWAQQRGDSQTAIADYQRVLRQEADNGDARLGLAEVYLAEGDKPAARAQVMQLKGAETESMNMQRRVALARAGLGDTADAQRIFNQIVPQAKAQPPSMESALVLRDAARFATQSGAPQQALTHYREAMVASGITPAQPQDNDTFTRLTRNDSHDDWLKRGIRSDAADLYRQQDLNVTLEHDFWGSSGTGGYSDLKAHTTMLQVDAPLADGRMFFRTDLVNMDAGSFSTHSDGSYSPSWGTCGEIACTSGSKNQTDSGTSVAVGWKNDTWSGDIGTTPMGFNVVDVVGGLSYSSDVGPVGYTVNVHRRPISSSLLSFGGQKDSSSHTGATWGGVRADGGGLSLSYDRGEAHGIWSSLGADSLTGKNVADNWRVRWMTGYYYKVINENNRRVTVGLNNMIWHYDKDLSGYTLGQGGYYSPQEYLSFAVPVTWRQRTENWSWELGGSVSWSHSRTQTQARYPLLNLIPSDYRQRASELTEEGSSSHGFGYTARALVERRVTSNWFVGAAVDIQQAKDYTPSHALLYVRYSAAGWQGDLDMPPQPLVPYADW

SEQ ID NO: 11054 - protein, 484 aa, Klebsiella pneumoniae
NAAGTRRRRERCAYRRYRPAAGRRGGQHHRGDQQRQSLVSTLTLVLTAVGSVLLLLFLVMKARMHAFVALMVVSIGAGLFSGMPLDKIAATMEKGMGGTLGFLAIVVALGAMFGKILHETGAVDQIAVKMLKSFGHNRAHYAIGLAGLICALPLFFEVAIVLLISVAFSMARHTGTNLVKLVIPLFAGVAAAAAFLLPGPAPMLLASQMHADFGWMILIGLCAAIPGMIIAGPLWGNFISRYVELHIPDDVTEPHLGEGKMPSFGFSLALILLPLVLVGLKTIAARFVPVGSTAYEWFEFIGHPFTAILVACLVAIYGLAVRQGMAKDRVMEICGHALQPAGIILLVIGAGGVFKQVLVDSGVGPALGEALTGMGLPIAITCFVLAAAVRIIQGSATVACLTAVGLVMPVIEQLNYSGAQMAALSICIAGGSIVVSHVNDAGFWLFGKFTGASEAQTLKTWTMMETILGTTGAIVGMIAFQLLS

SEQ ID NO: 11055 - protein, 454 aa, Klebsiella pneumoniae
GHMGMSKHYDYLAIGGGSGGIASINRAAMYGQKCALIEAKELGGTCVNVGCVPKKVMWHAAQIREAIHLYGPDYGFDTTINHFDWEKLVASRSAYIDRIHTSYDNVLGKNKVDVIKGFARFVDAHTVEVNGEIITADHILIATGGRPSHPDIPGVEYGIDSDGFFELPALPKRVAVVGAGYIAVELAGVINGLGAETHLFVRKHAPLRSFDPLIVETLVEVMNAEGPQLHTNAIPKAVVKNADGSLTLELEDGRSQTVDCLIWAIGREPATDNFNLAATGVKTNDKGYIIVDKFQNTNVPGIYAVGDNTGAVELTPVAVAAGRRLSERLFNNKPEEHLDYSNIPTVVFSHPPIGTVGLTEPQAREQYGDDAVKVYKSSFTAMYTAVTSHRQPCRMKLVCVGPEEKIVGIHGIGFGMDEMLQGFAVALKMGATKKDFDNTVAIHPTAAEEFVTMR

SEQ ID NO: 11056 - protein, 946 aa, Klebsiella pneumoniae
RSAGRQPAAGRSLPAVAGEPAAHPAGDDSPRRGDGRVPGGETASRGVSSGFAGGGRGADPGELVPDPLFRRESGMIRLSTLLLAPPVGERLRARYDDYRQHGASWLSASLGCLWASLVWALMPLETPRWQAILARHETYFPHINPHRPRPLDPLRYLLQSLWLLTTRVPEPEKKVNWRSLAALEGVHGRYTQWLEKLPEQMNARTGHLDKQKELAHLNPKLRRAILGGATFCSLVLALMCITQPFNPLSQFIFLMLLWGVALLVRRIPGRFSALMLIVLSLTVSCRYIWWRYTSTLNWNDPVSLVCGIILLFAETYAWVVLVLGYFQVVWPLNRQPVPLPEDMDLWPTVDIFVPTYNEDLNVVKNTIYASQGIDWPKDKLNIWILDDGGREAFRQFAKDVGVHYIARTSHEHAKAGNINNALKYAKGEFVSIFDCDHVPTRSFLQMTMGWFLKEKELAMMQTPHHFFSPDPFERNLGRFRKTPNEGTLFYGLVQDGNDMWDATFFCGSCAVIRRGPLDEIGGIAVETVTEDAHTSLRLHRRGYTSAYMRIPQAAGLATESLSAHIGQRIRWARGMVQIFRLDNPLFGKGLKLVQRVCYANAMLHFLSGIPRLIFLTAPLAFLLLHAYIIYAPALMIALFVLPHMIHASLTNSKIQGKYRHSFWSEIYETVLAWYIAPPTFVALINPHKGKFNVTAKGGLVEEEYVDWVISRPYIYLVLLNLVGVAVGIWRFMYGPENEILTVWVSIVWVFYNLIILGGAVAVSVESKQVRRSHRVEMSMPAAIAREDGHLFSCTVHDYSDGGLGIKINGDAQVLEGQNARLLLKRGQQEYAFPVRVARVNGSEVGLQLLPLTNQQHIDFVQCTFARADTWALWQDSFPEDKPMESLLDILKLGFRGYRHLAEFSPPSVKVVFRALTSLVAWIASFVPRRPERAAPTLSADPAMAQQ

SEQ ID NO: 11057 - protein, 82 aa, Klebsiella pneumoniae
LFQGKSIQLANKLKVRHNATNNIAALCLRKMRGLMNLRIGRRGVITDLGNIHGIEDIVVTAVVAVHINFAFVGEDAINLFIR

SEQ ID NO: 11058 - protein, 239 aa, Klebsiella pneumoniae
LIQGNRIPTKNTAILPIRLFSGVALMIIKKCNGLRGFLIPASVSVWVSCVSGANAWQQEYIAIDTKSNTSERYTWDSDHQPRYEDILAERMKSSETPGGLALNQGLAPPDSGRGLSVGWNYPLANGVTSGPVASLRSDVTAPTVRNAGEAGYVNTLGWRMDYQALWGVHPWAQVSYNQSLASDVWAPMTRAREGGWSDVTLGADMRLGSHVAAWATLSQADNLPSGENTLYLMGVSANF

SEQ ID NO: 11059 - protein, 214 aa, Klebsiella pneumoniae
QIQGLTMLWSFIAVCFSAWLYVDASYLGPAWRRWVFKPVTLILLLLLAWQAPMFNAISYLVLAGLCASLLGDALTLLPRQRVMYAVGAFFLSHLLYTIWFASQLTLSFFWPLPLVLLVFGALLMAVIWSRLEEMKMPVLTFIGMTLVMVWLAGELWFARPTNTALSGFAGAALLLLSNAVWLVSHYRRRFRADNAIAAAFYFAGHFLIVRALYL

SEQ ID NO: 11060 - protein, 213 aa, Klebsiella pneumoniae
VQQGTRGTSLSPTVCVTITRTEGQCIICMFNFNSIVESTSQLAVFTFDRNNLTVDFYINAGRNNDRCFSNTRHFFLRLGYVADNFATKTSLARCTISHNTFRGRNNCDTQTGHNFRQLIFFLIDAQTWAADTLNAFYNSFALEILESKFQFRLGVAFNFKIFDKTFFLQHVGDCHFQLGGRHGDRSFVRGLTVTDTGQHIRDRILHAHLSLLP

SEQ ID NO: 11061 - protein, 190 aa, Klebsiella pneumoniae
RIEGGQQVIIKGQGYALHGMASLSRVAGKGGSTACWSACPAGERRRSGRLTVAVSTMRPCSITSTRWQKRSTSRRSWVMNRQAVSNCACRRFSRAIISACSSRSRFETASSRINSCGRTARARARQTRCSCPPLSCAGRLSSSDDARSTASSISSTRRARASRDKHNRWRSGSLTISRTVLRGFTALKAS

SEQ ID NO: 11062 - protein, 172 aa, Klebsiella pneumoniae
ASRGPRTRSCSSTRRSVRGCWRRRYVCWRHKAGWPMRPWCTSKAKSKTAYRRCRLTGNCIVKKWPDRSPTVFTNVRPKESTMLINLGRLLMLCVWAFLLLNLFQPFPKPLNIFVNVALIFMILMHGLQLTLLKATQPKEAPPLSRFEQIRIFIFGVFELVAWQKKLKATLKK

SEQ ID NO: 11063 - protein, 189 aa, Klebsiella pneumoniae
YEIFKIMRLSMNHYDDLQRFQEKTRTQNLNFQDLSSQAATREHGDWAILNQLNPGTEKSSSLALGGSVSAPLPQSVPADLFRQVEAAVAAAPTSDPVVSAASAAPATSQPVVETAAAAPEPVRQEPAPTPAPSIPASEPAMAPPPRMAPRPAPAAENYAHLFAAKSAEPVAKNKDQPLKSLLERIATCR

SEQ ID NO: 11064 - protein, 194 aa, Klebsiella pneumoniae
WPFIERKMSMRNLVKYVGIGLLVMGLAACDNSDSKAPTVGAAAESNASGQAISLLDGKLSFTLPAGMADQSGKLGTQANNMHVYSDATGQKAVIVIVGDSTNEDLAVLAKRLEDQQRSRDPQLQVVSNKPLESKGHTLQQLDSIISAKGQTAWSSVILGKVDDKLLTLQVTLPADNQQQAQTEAESIINTLTIQ

SEQ ID NO: 11065 - protein, 66 aa, Klebsiella pneumoniae
WVLMNVAMRQEPFKGRVCLRFAKHHARLSSVISYLRAPTLHGVRACNRIVSLYLGSWLMIFRQPVM

SEQ ID NO: 11066 - protein, 106 aa, Klebsiella pneumoniae
ICFLPNLLISVVAIRWAPPQSASSLPSIAPKPMISARLPRVPPTPFLMETITLSSGIPCINPTASATRTSAMKPFILKRIINSNNRATPIATMTNGMIYLALICYG

SEQ ID NO: 11067 - protein, 326 aa, Klebsiella pneumoniae
RRVIPPPAIRGRFEKGYLMSEQFLYFLQQMFNGVTLGSTYALIAIGYTMVYGIIGMINFAHGEVYMIGSYVSFMIIAALMMMGIDTSWLLVAAGFVGAIVIASAYGWSIERVAYRPVRNSKRLIALISAIGMSIFLQNYVSLTQGSRDVALPSLFNGQWVVGHSDSFSATITTMQLVIWVVTFIAMLALTLFIRYSRMGRACRACAEDLKMASLLGINTDRVIALTFVIGAAMAAVAGVLLGQFYGVINPYIGFMAGMKAFTAAVLGGIGSIPGAMIGGLILGIAEALSSAYLSTEYKDVVSFALLILVLLVMPTGILGRPEVEKV

SEQ ID NO: 11068 - protein, 65 aa, Klebsiella pneumoniae
ICSMSQISTLAENGKKSQAGLVGRGFQAVAGGVWVDLFYAKSSCLFLLNYCQRFLRSNLFCGSMR

SEQ ID NO: 11069 - protein, 443 aa, Klebsiella pneumoniae
ERSMQATATTLENTQETAPVNSRNKVVVASLIGTAIEFFDFYIYATAAVIVFPHIFFPQGDAAAATLQSLATFAIAFVARPIGSALFGHFGDRVGRKVTLVASLLTMGISTVVIGLLPGYESIGIVAPMLLALARFGQGLGLGGEWGGAALLATENAPARKRALYGSFPQLGAPIGFFFANGTFLLLSWLLTDQQFMEWGWRVPFIFSAVLVIIGLYVRVSLHETPVFAKVAAAKKQVKIPLGTLLTKHVRVTVLGTFIMLATYTLFYIMTVYSMTFSTGAAPNGLGLPRNEVLWMLMMAVIGFGVMVPVAGLLADAFGRRKSMIIITTMIILFALFAFKPLLGSGNPLLVFAFLLLGLSLMGLTFGPMGALLPELFPTEVRYTGASFSYNVSSILGASVAPYIAAWLQGNYGLAAVGTYLAAMAALTLIALLLTHETRHQSL

SEQ ID NO: 11070 - protein, 120 aa, Klebsiella pneumoniae
GNTMDKKSARIRRATRARRKLQELGATRLVVHRTPRHIYAQVIAPNGSEVLVAASTVEKAIAEQLKYTGNKDAAAAVGKAVAERALEKGIKDVSFDRSGFQYHGRVQALADAAREAGLQF

SEQ ID NO: 11071 - protein, 194 aa, Klebsiella pneumoniae
ANAMIRISDAAQAHFAKLLANQEEGTQIRVFVINPGTPNAECGVSYCPPDAVEDTDTALKFEQLTAYVDELSAPYLEDAEIDFVTDQLGSQLTLKAPNAKMRKVSDDAPLMERVEYLLQSQINPQLAGHGGRVSLMEITDDGLAILQFGGGCNGCSMVDVTLKEGIEKQLLNEFPELKGVRDLTEHQRGEHSYY

SEQ ID NO: 11072 - protein, 208 aa, Klebsiella pneumoniae
IWYIFQAKLLQSIFNSRLSIHLIIRHSIYPVGIITRYKLCATTDSQKVELTMKTPLITREGYEKLKQEMDYLWRQERPEVTKKVTWAASLGDRSENADYQYNKKRLREIDRRVRYLTKCLEQLKIVDYSPQQEGKVFFGAWVEIENDEGDIKRFRIVGYDEIFGRKDYISIDSPMARALLKKEVGDLAIVNTPAGEASWYVNEIEYVK

SEQ ID NO: 11073 - protein, 743 aa, Klebsiella pneumoniae
MSCIATRRPGPARLSSTPRAAACSAPTARSAIISNVSGRRNAKGRPMESKRLDNAALAAGISPSYINAHGKPQSIAAVTKQRLLDAMHRSTAATKVAVNPLPNVKIFTHGKKMSLPVAGRGEYQWILTTEDGKQYQGKTRGGETLPLPAKLPEGYHSLTLTQEGERWHCRTIVAPARCYEPQPLKEGKKLWGTCVQLYTLRSEKNWGIGDFGDLRAMLPEIARRGGSFIGLNPIHALYPANPESASPYSPSSRRWLNVIYIDVNAVEDFQRSEEAQAWWQSPATQQALQAARETDDVDYTAVTTLKMTALRMAWKQFSRREDEQMTAFREFVLREGESLYWQAAFDALHAWQVQQDPLRWGWPAWPKAFQDIDSPEVKAFCVEHEDDVSFYLWLQWLAWSQFAACWETSQRDGMPIGLYRDLAVGVAEGGSETWCDRELYCLKASVGAPPDILGPLGQNWGLPPMDPHIIAARAYEPFIDLLRANMQNCGALRIDHVMSVLRLWWIPYGETADHGAYVQYPVDDLLSLLALESQRHRCMVIGEDLGTVPVEIVSKLRKSGVYSYKVLYFESDAEKTFRAPALYPEQSMAVATTHDLPTLRGYWESGDLTLGKALGLYPDEVVLRGLYQDRELAKQGLLDALHKYGCLPKRAGHKASLMSMTGILNRGMQRYIADSNSALLGLQPEDWLEMATPVNIPGTSTEYPNWRRKLSVTLEQMFADERVNKLIKDLDKRRKAASKKAAS

SEQ ID NO: 11074 - protein, 161 aa, Klebsiella pneumoniae
QRSISMPRRRVIGQRKILPDPKFGSELLAKFVNILMVDGKKSTAETIVYSALETLAQRSGKSELEAFEVALENVRPTVEVKSRRVGGSTYQVPVEVRPVRRNALAMRWIVEAARKRGDKSMALRLANELTDAADNKGTAVKKREDVHRMAEANKAFAHYRW

SEQ ID NO: 11075 - protein, 400 aa, Klebsiella pneumoniae
LAIICFSYRYKQNNALINNITTNAKTIIMGSLRMNMKGKALLAGCIALVMSSAALAEDIKIAVVGAMSGPVAQYGDQEFTGAEQAVADINAKGGIKGNKLQIVKYDDACDPKQAVAVANKVVNDGIKYVIGHLCSSSTQPASDIYEDEGILMITPAATAPELTARGYKLILRTTGLDSDQGPTAAKYILDKVKPQRIAVVHDKQQYGEGLARAVQDGLKKGGANVVFFDGITAGEKDFSTLVARLKKENIDFVYYGGYHPEMGQILRQARAAGLKTQFMGPEGVANVSLSNIAGESAEGLLVTKPKNYDQVPANKPIVDAIKAKKQDPSGAFVWTTYAALQSLQAGLNQSDDPAEIAKYLKGATVDTVMGPLSWDQKGDLKGFEFGVFTWHANGTATDAK

SEQ ID NO: 11076 - protein, 303 aa, Klebsiella pneumoniae
GAIMSQVTENKVIAAPVPMTPLQEFWHYFKRNKGAVVGLVYVVVMIVIAVFANFLAPYNPADQFRDSLLAPPFWQDGGSMAHLLGTDDVGRDILSRLMYGARLSLLVGCLVVVLSLILGVVLGLVAGYFGGVVDSIIMRVVDIMLALPSLLLALVLVAIFGPSIVNASLALTFVALPHYVRLTRAAVLVEVNRDYVTASRVAGAGAMRQMFVNILPNCLAPLIVQASLGFSNAILDMAALGFLGMGAQPPTPEWGTMLSDVLQFAQSAWWVVTFPGVAILLTVLAFNLMGDGLRDALDPKLKQ

SEQ ID NO: 11077 - protein, 192 aa, Klebsiella pneumoniae
GISMLKSTLAAMAAVFAISAFSPAMAAKGDPHVLLTTSAGNIELELNSQKAPISVDNFLKYVNSGFYNNTTFHRVIPGFMVQGGGFNEQMQQKQPNPPIKNEADNGLRNTRGTIAMARTADQDSATSQFFINVADNAFLDHGQRDFGYAVFGKVVKGMDVADKISQVQTHNVGPYQNVPTKPVVILSAKVLP

SEQ ID NO: 11078 - protein, 268 aa, Klebsiella pneumoniae
CNPIPERSAPSRAAAQDDNLLRRLFATRCRSSVTVLFLLDRRPNMLTAHSLCWLCQMPLAVACWGICSRCSRALLACPPLCPQCGLPAAASRHPCGRCLQKPPPWHRLVAVNDYRPPLSGLVQQLKFHHRPELGAALARLLLQRLLQRDDLPPVDALVGVPLWHRRRWRRGYNQCDELCRPLARWRGCVWHREGLTRQRAGAVQHSLNARQRRQNLKNAFQLEFAVQGLHIALVDDVVTTGSTVAEISRLLLRNGAATVQVWCLCRTL

SEQ ID NO: 11079 - protein, 520 aa, Klebsiella pneumoniae
SCAMNKQRGVWSQMAKEKKRGFFSWLGFGQKEQAQETETEQKVEEQQAVAEEIPAVETPAEPSAPKADPEAFAEDVVEVTETVVESEKAHLAEPASAQEEEWVETPALTEETPVVEPEPAVSEPPEQPAVVEPLAEEVIAEPVVAEAVAEQPVEGIVVQPQETEAPEEDAPLSDEELEAQALAAEAAEEAAVVVPAPEDEAPLEALAQEQEKPTKEGFFARLKRSLLKTKQNLGSGFISLFRGKKIDDDLFEELEEQLLIADVGVETTRKIITNLTEGASRKQLRDAEALYGLLKEEMGEILAKVDEPLNVEGKTPFVILMVGVNGVGKTTTIGKLARQFEQQGKSVMLAAGDTFRAAAVEQLQVWGQRNNIPVIAQHTGADSASVIFDAIQAAKARHVDVLIADTAGRLQNKSHLMEELKKIVRVMKKLDVDAPHEVMLTIDASTGQNAISQAKLFHEAVGLTGITLTKLDGTAKGGVIFSVADQFGIPIRYIGVGERIEDLRPFNAGDFIEALFARED

SEQ ID NO: 11080 - protein, 278 aa, Klebsiella pneumoniae
LGSMKKNRAFLKWAGGKFPLLDDIKKHLPEGECLIEPFVGAGSVFLNTDFSRYILADINSDLIGLYNIVKLRTDEYVAAAREMFTPENNVAERYYLYRDEFNQSQDPLRRAVLFLYLNRHGYNGLCRYNLRGEFNVPFGRYKKPYFPEAELYHFAEKAQNAEFYCESYEECMQRADSRTVVYCDPPYAPLTATANFTAYHTNSFNLEQQVLLAQKAESLMKKRIPVLISNHRTPLTQEWYKNAAETHIVKVRRSISSNGGTRKKVDELLALYRPPKTK

SEQ ID NO: 11081 - protein, 302 aa, Klebsiella pneumoniae
AIGMDKIHAMQLFIRVADLESFSRAAETLALPKGSVSRQIQALESHLGVRLLHRTTRRVQLTQDGMVYYERAKDLLSNLDELDGMFQHDPASISGRLRVDMPVGFAKKMVIPHLPTFLQQYPGIELELSSSDRLVDVIREGFDCVVRVGALKDSGLIARPLGKLTQINCASPDYLARFGYPQSLEDLADHALIHYASTLGVRPPGFEVMIDGAVRWVKTGGILTVNSTETYQAACIAGLGIIQVPRTGVREALRAGDLIEILPQYRAEPLPVSLIYPHRRNLSRRVNLFMEWLGGLMKAYVD

SEQ ID NO: 11082 - protein, 104 aa, Klebsiella pneumoniae
GYLMAKQSMKAREVKRVALADKFFAKRAELKAIISDVNATDEDRWNAVLKLQTLPRDSSPSRQRNRCRQTGRPHGFLRKFGLSRIKVREAAMRGEIPGLKKASW

SEQ ID NO: 11083 - protein, 80 aa, Klebsiella pneumoniae; identical to SEQ ID NO: 10772

SEQ ID NO: 11084 - protein, 863 aa, Klebsiella pneumoniae
TAQIKLNGKTPVKFVKYLLILAVCCVLLGAGSIFGLYKYIEPQLPDVATLKDVRLQIPMQVYSADGELIAQYGEKRRIPVTLQQIPPELVKAFIATEDSRFYEHHGVDPVGIFRAASVAMFSGHASQGASTITQQLARNFFLSPEKTLMRKIKEAFLAIRIEQLLNKDEILELYLNKIYLGYRAYGVGAAAQVYFGKPIDQLTLSEMAVIAGLPKAPSTFNPLYSMDRATARRNVVLSRMLSEGYITQAQYDEARSEPIDASYHAPKIAFSAPYLSEMVRQEMVNRYGEQAYEDGYRVYTTITRKNQQAAQQAVRNNVLDYDMRHGYRGPASVLWKVGETPWETKKIVDSLKRQSGYGPLFPAVVTSANAQEAVALLANGDSVSLTMEGVRWARRFISDTQQGATPRKVNDVVQAGQQIWVRKVGDSWWLSQLPDVNSALVSINPQNGAIIALVGGFDFNQSKFNRATQALRQVGSNIKPFLYTAAMDKGLTLASMLNDVPISRWDAGAGSDWRPKNSPPQYAGPIRLRQGLGQSKNVVMVRAMRAMGVDYAAEYLQRFGFPAQNIVHTESLALGSASFTPLQVARGYSVMANGGFLVNPFFISKIENDQGGVLFEERPKIACPQCDLPVIYGDTPKSNVLENKDVEDVATSAEPQNGNVPPQPQLEQANQSLVAQSGAQEYAPHVINTPLAFLIKSALNSNIFGEPGWMGTGWRAGRDLQRHDIGGKTGTTNSSKDAWFSGYGPGVVTSVWIGFDDHRRDLGRTTASGAIKDQISGYEGGAKSAQPAWDSFMKSVLEGVPEEPLTPPPGIVTVNIDRSTGQLANGGNSRAEYFIEGTQPTQQAVREVGTTLTDGGGETHELF

SEQ ID NO: 11085 - protein, 78 aa, Klebsiella pneumoniae
QRKIIISCHSRRAGMTSNYAQEAVLQQGSTGLRGGFKRIIRAFCSPEHGYSERHPSVWHPVLSPISPPPPWQRRYPPG

SEQ ID NO: 11086 - protein, 299 aa, Klebsiella pneumoniae
LQRIQHVNARRPDGADDDLASAGASANDARAVEAEKRSGERRAGMSQPLLSVSGLMMRFGGLLAVNNVSLELREREIVSLIGPNGAGKTTVFNCLTGFYKPTGGTILLRDQHLEGLPGQQIARMGVVRTFQHVRLFREMTVIENLLVAQHQQLKTGLFSGLLKTPAFRRAQSEALDRAATWLERIGLLEHANRQASNLAYGDQRRLEIARCMVTQPEILMLDEPAAGLNPKETKELDELIAELRNHHNTTILLIEHDMKLVMGISDRIYVVNQGTPLANGTPEEIRNNPDVIRAYLGEA

SEQ ID NO: 11087 - protein, 62 aa, Klebsiella pneumoniae
GRRILGRCRKGVKKYTTIPPSPGQLTGMFDCESDEISIANPADTVRNLTSQPAGVNVVLQHV

SEQ ID NO: 11088 - protein, 195 aa, Klebsiella pneumoniae
ECGMWDPFPENAFCAEWERMSIVTQCSSIIAGSTMLAALPFLLCYSGLTVALCHQDLRHGLLPDRYTCPLLWSGLLFYLCLAPHQLHDAVWGAIAGYLSLAAIYWLYRGIRGYEGLGYGDIKYLAALGAWHGWRLLPQLVLVASLLAGIAWAGAGLYASCGRKSKWGRSNPLPFGPFLAAAGFWCGWQTLANLTL

SEQ ID NO: 11089 - protein, 927 aa, Klebsiella pneumoniae
SPTLLDINYEAQKKSQPLSCTAKCRTMLIPSKLSRPVRLEHTVVRERLLAKLSGANNYRLVLITSPAGYGKTTLISQWAAGKNDLGWFSLDEGDNQQERFASYLIAAIQQATGNHCAASEAMVQKRQYASLSSLFAQLFIELADWQRPLYLVIDDYHLINNPVIHDAMRFFLRHQPENMTLVVLSRNLPQLGIANLRVRDQLLEIGSQQLAFTHQEAKQFFDCRLTSPIEADDSSRLCDDVAGWATALQLIALSARQNNSSAQHSARRLAGINASHLSDYLVDEVLDNVDARTRNFLLKSSLLRSMNDALIVRVTGEENGQMQLEEIERQGLFLQRMDDSGEWFRYHPLFGSFLRQRCQWELAVELPEIHRAAAESWMAQGFPSEAIHHALAAGDAKMLRDILLNHAWGMFNHSELGLLEQSLAALPWSNLLENPRLILLQAWLMQSQHRYSEVNTLLARAEQEMSVEMDTAMHGDFNALRAQVAINDGDQDEAERLSMVALEELPLANYYSRIVATSVHGEVLHCKGKLTKSLAVMQQTEQMARRHDVWHYALWSIIQQSEILFAQGFLQAAWESQEKAFQLVREQHLEQLPMHEFLLRIRSQLLWAWARLDEAEACARQGMDVLSTYQPQQQLQCLALMVQCSLARGDLDNARSHLNRLENLLGNGHYHSDWVSNADKVRVIYWQMTGDKTAAANWLRQTPKPEFANNHFLQSQWRNIARAQILLGDFEPAEMVLEELNENARSLRLMSDLNRNLLLLNQLYWQSGRKSEAQKALLEALTLANRTGFINHFVIEGEAMAQQLRQLIQLNTLPELEQHRAQRILRDINQHHRHKFAHFDEGFVERLLNHPEVPELIRTSPLTQREWQVLGLIYSGYSNEQIAGELDVAATTIKTHIRNLYQKLGVAHRQDAVQHAQQLLKMMGYGV

SEQ ID NO: 11090 - protein, 685 aa, Klebsiella pneumoniae
CTTFGQRTQLSCITEHFGQRYFSVDLNAGYFGFLTAQHTATTAQVTDNVTSVLFRSFYFNLHDRLKQNWFCFLKAFFKGNRRSQFKRQLRGVNVVVRTEVQTDTHINYRVTCQRTSFQLFLDAFINGRDVFARNYTTFDVVDELVTFRVRARLQRVHVDHNVTVLTTTTRLLGVFTFDIGNFRANRFTVSNLRFTDVRFNVEFTLHTVNDDVEVQLTHTGDNCLVRLFVSPYAERRVFFSQTTQSQTHFFLVSFGFRLNGDGDYRLREFHTLQNDRRIRVTQGVTSSYVFQTDSSSDVARANFFDLFTFVSVHLNDTTETLTCSFHGVQYGITRVNHTGVHAEEGQVTHERVGSDFERQCRERLVVACVTLSRGIFTVVQDTVDRRYVNRRWQVINYRIQHRLNAFVLERRTTGYQDDFVVQNALTQSFFDLFFSQFFTTQVFFHQLFRSFSCGFDQVLVPFISQVLHVSRDIFVFEGYALVCIVPVDGFHFHQVNNAGKTFFSTNCQLQRNRVRAQTGFDLTNNFQEVSAHAVHFVNERDARNFIFVCLTPYGFRLRLNTTNCAVNHYRTIKNTHGTFYFDSEVNVPRGVDDVYAVRFILFGHTRPECSSRSGSDGDTTFLLLLHPVHGSGAVMNFTDFVVYTGVEQNTFGSSGFTGVDVRTDTDVTVACDGCCTSHLIPRLFL

SEQ ID NO: 11091 - protein, 538 aa, Klebsiella pneumoniae
LGLMPAASAALSRRLLSIGLPLAFRLPDTLLIIADRAVGAEHAAARGVEDSRAGPGLLVAIQLIYPFLRRYVGFEIGQHQVRIAALQQAVQHLIEGMLVAVAVGAVLQLLKHRIEQLVFFTPFQRIVAFRFQGFHLFNRVAEDKDVLLAHLLSDFHVSAIQRPDGQRAVQRQLHVAGARGFFTRGGDLLGDIRRRDQFFCCRYTIVRQEDHLQLIADFRVVVDRFRYLIDGKNNVFRQIVARRRFRAEQEDARYAVGLRVFADLFVQRKDMQQVKVLTLILVQTFDLDIEDRLRVDLNPGTLLHKLSQMNFVGLLDIAISLTERRIVSIFFQVDQLVEVIGPLFFQRLIQQRGQRRVALLDPAARRDAVGHVMEFVRPQLVIFREQIFYHQIRVQRRHAVDSKAAHHAHVGHPNLFVMHHRQLRPDLLIARPGFVHQLFKAVVDLFNDLHMARQQRFHQLLIPAFQRFRHQGVVGVSKGFAGDRPGVVPAQLVLVNQHAQQLRDGDGRVRIVQLDHFVIRQLGQLAACQMMTAQDIGH

SEQ ID NO: 11092 - protein, 91 aa, Klebsiella pneumoniae
PRSISSRLIPRSRTPTFSPARPSSSSLRNISTPVQVVFAVSLIPTISTSSPTLMIPRSTRPVTTVPRPEMENTSSIGSRNGLSIARSGSGI

SEQ ID NO: 11093 - protein, 217 aa, Klebsiella pneumoniae
RCVFQVSWRKKMARYLGPKLKLSRREGTDLFLKSGVRAIDTKCKIEQAPGQHGARKPRLSDYGVQLREKQKVRRMYGVLERQFRNYYKEAARLKGNTGENLLALLEGRLDNVVYRMGFGATRAEARQLVSHKAIMVNGRVVNIASYQVKANDVVSIREKAKKQSRVKAALELAEQREKPTWLEVDAGKMEGTFKRQPERSDLSADINEHLIVELYSK

SEQ ID NO: 11094 - protein, 346 aa, Klebsiella pneumoniae
PMTMSLALSPHCASCQDVDMLTYPPVKKVSVVIPVYNEQDSLPELLRRTDAACATLGRQYEILLIDDGSSDDSARMLTEAAEAEGSHVVAVLLNRNYGQHSAIMAGFSHVTGDLIITLDADLQNPPEEIPRLVAKADEGYDVVGTVRQNRQDSIFRKTASKMINRLIQRTTGKAMGDYGCMLRAYRRHIIDAMLNCHERSTFIPILANTFARRAVEIPVMHAEREFGDSKYSFMRLINLMYDLVTCLTTTPLRLLSIFGSVIALLGFAFGLLLVVLRLAFGPQWAAEGVFMLFAVLFMFIGAQFVGMGLLGEYIGRIYNDVRARPRYFIQRVVRQPETASKEEDRS

SEQ ID NO: 11095 - protein, 280 aa, Klebsiella pneumoniae
RPAFEITSGKDRDMPLICVCSPKGGVGKTTLAANLAYSLARTGSKVLALDFDVQNALRLHFGVPLNDERGYVAKALELHDWSQCVLSAGSNIFVLPYGEVSEAQRQAFDEQLTHNDHFLQRGLSALLNYPGLITIADMPPGPSPALKALTGLADLHLIPLLADTASMSTLAHVEKQRLTGAALNHKHGHYFVINQSDSRRQVSRDVTSLMEEKLGERLLGVIHRDESVVEANASQKSILDFNASSAAAFDIEIMAKKISSLLGIHIGDGTVHSQPRMSGR

SEQ ID NO: 11096 - protein, 170 aa, Klebsiella pneumoniae
RCKMAHIEKQAGELQEKLIAVNRVSKTVKGGRIFSFTALTVVGDGNGRVGFGYGKAREVPAAIQKAMEKARRNMINVALNHGTLQHPVKGTHTGSRVFMQPASEGTGIIAGGAMRAVLEVAGVRNVLAKAYGSTNPINVVRATIDGLENMKSPDMVAAKRGKSVEEILGK

SEQ ID NO: 11097 - protein, 113 aa, Klebsiella pneumoniae
EEEMETLAQHRHARSSAQKVRLVADLIRGKKVSQALDILTYTNKKAAVLVKKVLESAIANAEHNDGADIDDLKVAKIFVDEGPSMKRIMPRAKGRADRILKRTSHITVVVSDR

SEQ ID NO: 11098 - protein, 416 aa, Klebsiella pneumoniae
KLVVEIWWNLMPEPVAEPALNGLRLNLRIVSVVIFNFASYLTIGLPLAVLPGYVHDVMGFSAFWAGLVISLQYFATLLSRPHAGRYADLLGPKKIVVFGLGGCFLSGLSYLLAAWGSGWPLISLLLLCLGRVILGIGQSFAGTGSTLWGVGVVGSLHIGRVISWNGIVTYGAMAMGAPLGVLCYSHIGLSGLAGVIMAVALVAILCALPRAAVKAAKGKAMSFRAVLGRVWPYGMALALASAGFGVIATFITLFYDAKGWDGAAFALTLFSCAFVGARLLFPNAINRLGGLNVAMLCFSVEAIGLLLVGFADTPMMAKIGTFLTGAGFSLVFPALGVVAVKAVPQHNQGSALATYTVFMDLSLGVSGPLAGLLMAWTGISMIYLAAAGLVMAALLLGWRLKKRPPVSEPEASAPGQ

SEQ ID NO: 11099 - protein, 460 aa, Klebsiella pneumoniae
GYSVDHLPIFCQLRQRDCLLVGGGDVAERKARLLLDAGANVTVNALDFTPQFQVWADSQMLTLVQGEFIPSLLDNCWLAIAATDDETVNQQVSEAAEARRIFCNVVDAPRQASFIMPSIIDRSPLMVAVSSGGTSPVLARLLREKLESILPLHLGQLARYAGHLRARVKQQFATVGERRRFWEKLFVNDRLAQSLANDDRQAVADTTEQLLTEPLEHRGEVVLVGAGPGDAGLLTLKGLQQIQQADVVVYDRLVSDDIMNLVRRDADRVFVGKRSGYHCVPQEEINQILLREAQKGRRVVRLKGGDPFIFGRGGEELETLCEAGIPFSVVPGITAASGCSAYSGIPLTHRDFAQGVRLVTGHLKTGGELDWANLAVEKQTLVFYMGLNQAPAIREKLIAHGMAEDMPAAIVENGTAVTQKVVSGTLGQLDILAQQMASPALIIVGRVVGLRDKLNWFSNH

SEQ ID NO: 11100 - protein, 538 aa, Klebsiella pneumoniae
VYSVGFASKLIQCQSGRTRDAVDNVFTLGISSLWDEVCHMPVGGVWWLNVDRYADAVSLFNQTLAAQAKNSHVAALVMGNKPKDIISLDHIHGPDNIALFTLPNRPQALEEIHRDLVCSLEPGNYLFILLCAENAWQNINNEKLCAWVEKTSRWAQYHRCAFLAINSAQDIDRQLTPLLREYRSLSGLASIRYQGDRHIFDIAWWGSDKGISAQQQLMVQHDDAGWRLAQDAETSVQPRSDEKAILSHVRVLEGAPPLSEYWTLFDTNDEVFNAGRTAQAATILFSITQNTQIEQLGRYIHTLRRQRGTALKIIVREQTPSLRATDERLLLSSGASLVIPSSASLSRCLTLIESVQNQKFSRHIPEDFATLLTWSQPLKLRGYQKWDAFCEAVHNVMTNTLLPPDSKGVMVALRPAPGLRVEQALTLCKPNRMGDIITIGNNRLVLFLSFCRINDLDTALNHIFPLPTGDIFSNRMVWFEDKQILSEIVIMRGVEPARWNTPLPLSVGKNETINATHDGRHWRRYPEPHRLTTREEQA

SEQ ID NO: 11101 - protein, 82 aa, Klebsiella pneumoniae
GGTVASLMEVRDMLALQGRMEAKQLSARLQTPQPLIDAMLERMEAMGKVVRISETSEGCLSGSCKSCPEGKAACRQEWWALR

SEQ ID NO: 11102 - protein, 67 aa, Klebsiella pneumoniae
DGDVMKAKELREKSVEELNAELLNLLREQFNLRMQAASGQLQQTHLLKQVRRDVARVKTLLTQKAGA

SEQ ID NO: 11103 - protein, 93 aa, Klebsiella pneumoniae
TGDVAGKTHSRLVKPLAGGSRMIIPWQDLDPETLDNLIESFVLREGTDYGEYERSLADKVADVKQQLKRGEAVLVWSELHETVNIMPRALFNG

SEQ ID NO: 11104 - protein, 78 aa, Klebsiella pneumoniae
AVYVLWFNNKFRTDRDMPAKDPAVPTDATLGYTFQNDFLALSRAFSLPDIDYHDISRREQLNAALKRWPLLAEFAEKK

SEQ ID NO: 11105 - protein, 73 aa, Klebsiella pneumoniae
TYNVSWHKENKMSFLKEFREFAMRGNVVDLAVGVIIGAAFGKIVSSLVADIIMPPLGLLIGGIDFKQFGRHAT

SEQ ID NO: 11106 - protein, 287 aa, Klebsiella pneumoniae
RSDVLLFVSIAIYSCCQAFAPETHDTQTDTLAGIKNPRRPLHFFIIINATPEKSRIGNIAVFLVGIRFPCINYYLYLSAVKAGVHFFSAEGETAMQRCGWVSQDPLYIEYHDTEWGVAQKEGRQLFEMICLEGQQAGLSWITVLKKRQNYRQAFHQFDPVRVAAMGDDDIERLLQDTGIIRHRGKIQAIIGNARAYLAMEENGESFTDFVWSFVDNAPQVTRAATLAEIPATTPASDALSKALKKRGFKFVGSTICYSFMQACGLVNDHVTGCFCHPGGQDDPQVGH

SEQ ID NO: 11107 - protein, 139 aa, Klebsiella pneumoniae
HIGVSLPPDGTLQGKIGPAIARHDKKENRIMEQFECINVEEAHQKLHQQTAVLVDIRDPQSYAMGHTPGAFHLTNDTLGAFMRDNDFDTAVMVMCYHGNSSKGAAQYLLQQGFDKVYSVDGGFDAWHRHFPAEVARGTF

SEQ ID NO: 11108 - protein, 733 aa, Klebsiella pneumoniae
HCSLTLVFTFTDDFVRKNNFDGMGMGTFLIFLTALLICVLLIGWWYRAHARRRRLPLLHAFSDATTRQLPADERQAIEKYVAELSHAQQVPASGATSAPVALALNEQSDTVYAVTRAITRYGITTDAPNKWRYFLDSVEVHLPPFWEQHINDENSVELIPTDSLPLVITLNGHSMSDYRQEAQSYALERASASQASIRGEESEQVELRQIRRETPEEHALNRPDGLREAILIVASFLFFYFSLIGPAVFTPWLVAAGLLLLAAGLWGIYAPPRRAALREIHCLRGVPKRWGLFGENDQEQINNISLGIIDLIYPRHWQPWIAQDLGQQTDIDIYLNRHVARQGRYLSLHDEVKNFPLQYWLRSAIIAAGALVVVIMLWASVPLNMPFKFTLSWLKGAQTIEATTVSQLEKAHVRIGDTLRLTGTGMCNIRTPGSWSAKEDSPFLPFDCSQIVWNDAPPLPLPESDIVSKATALMQSVQRQLHPETDDDSRVSPALRSAIQKSGMVLLDDFGDIVQKTNDLCSAKDDCLRLKNALVNLGNTRNWETLTKRATAGKLDGVNVLLRPVSAESLENLVTTSTAPFVIRETSRAAQALNSPAPGGFLIASDEGSVLVNQPWPAVSLYDYPAHEQWGELRRLAGMLMHTPFHAEGIVTNLFTDANGTQHINLHRIPDRSGLWRYLGITLLLLSMVGCTAYHAVQALRRYQRHRQRMEEIQKYYESCLNPVLLPSSDSQD

SEQ ID NO: 11109 - protein, 714 aa, Klebsiella pneumoniae
RRSLPGSHAGPAAPAAAERRPACRERYRHLCVSRPVSWIFIVHQFNRAQEEVQRVFDRFFHLHLRLPVQAAFGVADARLTMLNVLVALSVVIAAFHFTEAGERREAIAQRMTFEAGEQHFGQLFDARFVIRVADVNDLPVAAAVFVLDDAEQRFDTVADVGETALLLAAFDKLDRRPFHQVEDQLGDSAGAADTRGVEVIQPRPHPVERTEKGELEAILIAIGPDHAIEQLLGDRVDPALFVDRPHHQVGAIFVEVFVGAHAVHFRGRREDNALIVFHAVADDFQVLFEIQLEHAQRVAGVFDRRGDGHQRQHHVAFLNVILDPLRVNADIAFHKVETRTVEKTADGVGADIQTVNLIVVVLQQALGQVVTDKAVDAEDQHPGATLNRHHRFAADHRPGHQAQRLRQLSALHVHAAFGLAGDNLQRPVLARDDQRSNGEHGARFSCWQIVANAGFPDDKLVRSGVAEGARPRIRDRTHQIVQGLRRQLPVQPAIFRGTTPHIGCLAVILRTLIGGAGEDRWQRPAQQLSGGSAQLTMQRQGGVIRANRHGLLGDDIASVCAVHHPVQGDAGFAFAIDQHPVQRRAAAIFWQQRTVQVERPFRRQIEDLIAQQVAIVEGEQHVRFHLADTLNPQRMVHVFRGPHRNTLLGGKARHGAKEMVFARVIRVGENSSDIIPGVQQGLDTGAAHIVISEDYGFHERSSSLDAVSGWRTTR

SEQ ID NO: 11110 - protein, 121 aa, Klebsiella pneumoniae
ECIVARIAGINIPDHKHTVIALTAIFGIGKTRSKAICAETGIAENVKISELSEEQIDILREAVGKFVVEGDLRREITLSIKRLMDLGCYRGLRHRRGLPVRGQRTKTNARTRKGPRKPIKK

SEQ ID NO: 11111 - protein, 212 aa, Klebsiella pneumoniae
PRMVLGKPQTDPTLEWFLSHCHIHKYPSKSTLIHQGEKAETLYYIVKGSVAVLIKDEEGKEMILSYLNQGDFIGELGLFEEGQERSAWVRAKTACEVAEISYKKFRQLIQVNPDILMRLSSQMARRLQVTSEKVGNLAFLDVTGRIAQTLLNLAKQPDAMTHPDGMQIKITRQEIGQIVGCSRETVGRILKMLEDQNLISAHGKTIVVYGTR

SEQ ID NO: 11112 - protein, 286 aa, Klebsiella pneumoniae
AAAVPKSRWSCSNASAGASRSWTRCWSITGSKADCYVKICLIDETGAGDGALSVLAARWGLEQDDDNPMALALTTEHLELRKRDEPKLGGIFVDFVGGAMAHRRKFGGGRGEAVAKAVGIKGDYLPDVVDATAGLGRDAFVLASVGCRVRMLERNPVVAALLDDGLARGYADAEIGGWLQERLQLIHASSLTALTDITPRPQVVYLDPMFPHKQKSALVKKEMRVFQSLVGPDLDADGLLAPARQLATKRVVVKRPDYAPPLADVATPNAVVTKGHRFDIYAGTPA

SEQ ID NO: 11113 - protein, 260 aa, Klebsiella pneumoniae
ATFFQGYFMKQTQRHDAIIELVKKQGYVSTEELVEQFAVSPQTIRRDLNDLAEQKMILRHHGGAALPSSSVNTSWHDRKATQTAEKERIARRVASEIPDGATLFIDIGTTPEAVAHALLDHNDLRIVTNNLNVANTLMVKEDFRIILAGGELRSRDGGIIGEATLDFISQFRLDFGILGISGVDSDGSLLEFDYHEVRTKRAIIENSRHVMLVVDHTKFGRNAMVNMGSISMVDAVYTDVLPPAGVLKVITDNNLQLELC

SEQ ID NO: 11114 - protein, 108 aa, Klebsiella pneumoniae
RLQVKGQAVQREEYALVLQPRQPRLRGQICRQRLQPGLPGGDRRSALVLLALPLMLLPRLTHRLLALLKRSEQLRVGRRVKRRQEVALQTRRSAHQQAHPAQQHNADG

SEQ ID NO: 11115 - protein, 861 aa, Klebsiella pneumoniae
IVKVGGNRKEIEAKMSKVRIAIIGNGMVGHRFIEELLDKAPAGQFDITVFCEEPRIAYDRVHLSSYFSHHTAEELSLVREGFYEKHGVKVLVGERAITINRQEKVIHSSAGRTVFYDKLIMATGSYPWIPPIKGAETQDCFVYRTIEDLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSTDNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 11116 - protein, 420 aa, Klebsiella pneumoniae
KIEVLICFLVKNCAKPLNSMVKMALFNKSTECFLTIKIQNIYTTSRTGFCSMKRNAKTIVAGIVALAMSHAAMAKDIKVAVVGAMSGPVAQWGDMEFNGARQAIKDINASGGIKGDKLVAVEYDDACDPKQAVAVANKIVNDGIQYVIGHLCSSSTQPASDIYEDEGILMISPGATNPELTQRGYQYIMRTAGLDSSQGPTAAKYIVEKVKPQRIAIIHDKQQYGEGLARSVQDNLKKAGANIVFFDGITAGEKDFSALLARLKKENIDFVYYGGYYPEMGQMLRQARSVGLKTVFMGPEGVGNASLSNIAGAAAEGMLVTMPKRYDQDPANSAIVNALKAEKKDPSGPYVWITYAAVQSLAQAMDRTGSQQPLDLIKDLKAHGAKTVIGPLTWDEKGDLKGFEFGVFQWHADGSSSAAK

SEQ ID NO: 11117 - protein, 216 aa, Klebsiella pneumoniae
KKRVSPLFCRLRAEAQRLVAAAATVAAAAAFTMVVTMIVAVAAAATVMTMVMIVIVAMRAVHVTVLQLFRSRFADGDDFHIKLQVLASQHVVAINHNVVVFNFSDFYWYRTLIGFRQEAHANLQFINAHEDVFRYTLHQVFVILTVSVVSADGNVKFVAHFVAIQRVFQAGNQGAVTVQVIQRRAYRRFINQHTVFCTYLIGQADHQVFCYFHDIS

SEQ ID NO: 11118 - protein, 269 aa, Klebsiella pneumoniae
QERVSCEAELDYPCQRLARVCRCALFLAERSKKMATGKSCSRWFAAMAALLMVVSLSGCFDKEGDQRKAFIDFLQNTAMRSGERLPTLTADQKKQFGPFVSDYAVIYGYSQQVSQAMDAGLRPVVDSVNAIRVPQDYMTQREPLRQANGALGVLSQQLQNAKMQADAAHGALKQADDLKPVFDQVYAKVVTAPADALQPLIPAAQIFTQQLVQVGDFVAQQGTQVSFVANGIQFPTSQQASQYNALIGPLAAQHQAFNQAWTAAVNATR

SEQ ID NO: 11119 - protein, 141 aa, Klebsiella pneumoniae
GDLLRVYEAKAKTRSYLMATINQLVRKPRARKVAKSNVPALEACPQKRGVCTRVYTTTPKKPNSALRKVCRVRLTNGFEVTSYIGGEGHNLQEHSVILIRGGRVKDLPGVRYHTVRGALDCSGVKDRKQARSKYGVKRPKA

SEQ ID NO: 11120 - protein, 439 aa, Klebsiella pneumoniae
IMPLVIVAIGVALLLLLMIRFKMNGFIALVLVALAVGLMQGMPLDKVIVSIKNGVGGTLGSLALIMGFGAMLGKLLADCGGAQRIATTLINKFGKKHIQWAVVLTGFTVGFALFYEVGFVLMLPLVFTIAASARIPLLYVGVPMAAALSVTHGFLPPHPGPTAIATIFHADMGKTLLYGTILAIPTVILAGPVFARFLKGIDKPIPEGLHNPKVFTEEEMPGFGVSVWTSLVPVILMAMRAVAEMILPKGHAFLPIAEFFGDPVMATLIAVLIALFTFGLNRGRSMEQINDTLTSSIKIIAMMLLIIGGGGAFKQVLVDSGMDKYIASIMHESNMSPLFMAWSIAAVLRIALGSATVAAITAGGIAAPLIATTGVSPELMVIAVGSGSVIFSHVNDPGFWLFKEYFNLTIGETIKSWSVLETIISVCGLVGCLLLGMVV

SEQ ID NO: 11121 - protein, 301 aa, Klebsiella pneumoniae
ITALHEFYPCRSPIVVVNETVKRNVAYLLLHEQLISYNTITTQPERGLLMTQRIALVTGGSRGLGKNAALKLAAKGTDILLTYHSNRQAALDVVAEIEQKGVKAAALALNVGDSTTFDAFASEVAQVLAQKWGRTTFDYLLNNAGIGLNAPFAETSEAQFDELMNIQFKGPFFLTQRLLPLLQDGGRILNVSSGLARFALPGYAAYAAMKGAMEVLTRYQAKELGGRGISVNIIAPGAIETDFGGGEVRDNAEVNRHIAAQTALGRVGLPDDIGDAIAALLSDELAWMNAQRVEVSGGMFL

SEQ ID NO: 11122 - protein, 788 aa, Klebsiella pneumoniae
SLFFDPKDELKAMMNDSLCRIIAGELQARAEQVEAAVRLLDEGNTVPFIARYRKEVTGGLDDTQLRNLETRLGYLRELEDRRQAILKSIAEQGKLTDALEKAINTTLSKTELEDLYLPYKPKRRTRGQIAIEAGLEPLADLLWNEPAHDPEAEAAKYIDADKGVADSKAALDGARYILMERFAEDAALLAKVRDYLWKNAHLVSTVVSGKEEEGAKFRDYFDHHEPIATVPSHRALAMFRGRNEGVLQLSLNADPQFDEPPKESHGEQIIIDHLGLRLNNAPADSWRKGVVSWTWRIKVLMHLETELMGTVRERAEDEAINVFARNLHDLLMAAPAGLRATMGLDPGLRTGVKVAVVDATGKLVATDTIYPHTGQAAKAAVAVAALCEKYNVELVAIGNGTASRETERFFLDVQKQFPKVTAQKVIVSEAGASVYSASELAAQEFPDLDVSLRGAVSIARRLQDPLAELVKIDPKSIGVGQYQHDVSQTQLARKLDAVVEDCVNAVGVDLNTASVPLLTRVAGLTRMMAQNIVAWRDENGQFQNRQQLLKVSRLGPKAFEQCAGFLRINHGDNPLDASTVHPEAYPVVERILAATQQALKDLMGNSSALRHLKAVDFTDEKFGVPTVTDIIKELEKPGRDPRPEFKTAKFADGVETMNDLLPGMILEGAVTNVTNFGAFVDIGVHQDGLVHISSLSDRFVEDPHTVVKAGDIVKVKVMEVDLPRKRIALTMRLDEQPGDSNARRGGGQERPQGNRPAAKAAKPRGREAQPAGNSAMMDALAAAMGKKR

SEQ ID NO: 11123 - protein, 510 aa, Klebsiella pneumoniae
GIQLRSLVGDLVLVRLQEERDPLLHKRLYNALRRAILDGSLAPQSRLPPSRDLAGELGVSRNTILTTYEQLLAEGYVVSRRGSGTFVAQTAPESSLTAKEERENNSLAAPTAHLSRRGQHLLGQVSASPRQWGAFIPGVPDVNAFPHPLFSKIQARISRRPKPERLSYSCNGGTPELQQALVDYLRVSRGVHCQSDQILITEGIHQAIDLVTRMLCDNGDLAWVEEPSYWGIRHVLAMNDVRAEPLTVDANGLCPPETVDDAPRLIFVTPSHQYPLGAVMSLERRQRLLALARQQGSWIVEDDYDSEFRFSGQPIPALQGLVADAPVVYIGTFSKTLYPGLRLGYVVIPRPLVSDLKHAHAELYRGGHSLIQMALAEFITAGHYSAHIRRMRLLYSRRRAFLTELIQRHCMPYALSDFSDNAGLHLILNLPAEADDVAIAREANARHILVRPLSRYYLTAARKKGLLMGFASQPEEQMASAFSVLLGCLQTHCPQMLLLREDAEKQNAPT

SEQ ID NO: 11124 - protein, 169 aa, Klebsiella pneumoniae
AAISGYAGRRPGAATDHRAAGGLGQHFRREDNDRFGRHILVRTNVMGLDLGDLIRNIHPLHHFAEYRIAKVALAMVEEGVIRHVDEELTGGAILIGGTRHRDGAAGVAQAVVCFILDRRVRLLLLHLFIKAAALHHESRDHAVKGGVVVEAAVDVLQEVIHGNRGFLAV

SEQ ID NO: 11125 - protein, 102 aa, Klebsiella pneumoniae
FCVSEAPMLHTLSVSPWHADIAAMLRLMEHGDDLVLLSDGVTAAIADGRFLEILQSAPITLYVLQDDVDARGLAGQIADSVGRVSYTDFVRLTVKHAGQLAW

SEQ ID NO: 11126 - protein, 346 aa, Klebsiella pneumoniae
RSVSLLPSIKSEFMPLRALVAVIVTTVVMLVPRAWADTAWERYKARFMMPDGRIIDTANGNVSHTEGQGFAMLLAVANNDRPAFDKLWQWTDNTLRNKSNGLFYWRYNPVAPDPIADKNNASDGDTLIAWALLRAQKQWQDKRYAIASDAITAALLKSTVVSFAGRQVMLPGVKGFNLNDHLNLNPSYFIFPAWRAFAERTHLTAWRTLQSDGQALLGQMGWGKSHLPSDWVALRADGKMLPAKEWPPRMSFDAIRIPLYLSWADPHSALLAPWKAWMQSYPRLQTPAWINVSTNEVAPWYMAGGLLAVRDLTLGEPQEAPQIDDKDDYYSASLKLLVWLAKQDQR

SEQ ID NO: 11127 - protein, 68 aa, Klebsiella pneumoniae
TGVSMYVCLCNGVSDKKIRQVVRQFQPQSFQQLRKFVPVGNQCGKCVRAAREVMEDELTTMPEFKEIA

SEQ ID NO: 11128 - protein, 94 aa, Klebsiella pneumoniae
QSPSPIVCHQMSFIRYRSLFTGQKAKYANSTQLMLAMPNAAGSRLLGDLLPLQPRPARLSPALPAVRPAGGGIPSPLRPLPAKAASLASAGGGQ

SEQ ID NO: 11129 - protein, 237 aa, Klebsiella pneumoniae
TSASLKSRPKVVSETVSALCASFNTNSIAISSRLHSWFNDQVATGRTRDSTFNQQQVALSVNTYYVQALNGYTLITQLTCHFLAFEHFARSLVLTDRTRNAVGQGVTVSSVLGTEVPALNGTSKTFTFRGTGYVNFFNVSKQFNANVLTYGEFFAVSQTEFPQTTASFNASFSEVTRFRLGYTVSFFSTGGNLDCAVAIVSQVFNLSNTVCFNFDYGYWDRNAIFSEDAGHAHFFTD

SEQ ID NO: 11130 - protein, 213 aa, Klebsiella pneumoniae
ASASSGASSSGAGTTTAASSAASAASACASSSSSLNGASSSGASVSCGWTTMPSTGCSATASATTGSAITSSASGSTTAGCSGGSLTAGSGSTTGVSSVRAGVSTHSSSCALAGSARCAFSLSTTVSVTSTTSSANASGSAFGALGSAGVSTAGISSATACCSSTFCSVSVSCACSFCPKPSQEKKPRFFSFAICDHTPRCLFMAQLHQKLKK

SEQ ID NO: 11131 - protein, 768 aa, Klebsiella pneumoniae
VRNSLPEGGTEQEDAESTAPFRSKKVASYRNERHLQQDESMSNHIDRDVINALIAGHFADPFSVLGMHRTDAGLEVRALLPDATDVWVIEPKTGRKVGKLECLDSRGFFSGVLPRRKNAFRYQLAVTWHGQQNLIDDPYRFGPLLQDLDVWLLSEGTHLRPYETLGAHAATMDGVTGTRFSVWAPNARRVSVVGQFNYWDGRRHPMRFRKESGIWELFVPGAHNGQLYKFELIDAHGNLRVKADPYAFESQMRPESASLICDLPPKVEQPADRRAANQFDAPISIYEVHLGSWRRHTDNNFWLSYRELADQLVPYAKWMGFTHLELLPVNEHPFDGSWGYQPTGLYAPTRRFGTRDDFRYFINAAHAAGLNVILDWVPGHFPADDFALASFDGTSLYEHSDPREGYHQDWNTLIYNYGRREVSNYLVGNALYWIERFGIDALRVDAVASMIYRDYSRKAGEWIPNEYGGRENLEAIEFLRNTNRILGEQTPGAVTMAEESTDFAGVTRPPAGGGLGFWFKWNLGWMHDTLDYMKLDPVHRRYHHDKMTFGMLYNYTENFVLPLSHDEVVHGKKSILDRMPGDAWQKFANLRAYYGWLFAFPGKKLLFMGNEFAQGREWNHDVSLDWHLLEGGDNWHHGVQRLVRDLNHTYRHHKALHELDFDPYGFEWLVVDDHERSVFVFVRRDRAGNEIIVASNFTPVPRHDYRFGINQPGRWREALNTDSMHYHGSNQGNGGVVESDAIASHGREHSLSLTLPPLATIWLVREAQ

SEQ ID NO: 11132 - protein, 65 aa, Klebsiella pneumoniae
RHRSHCDAWLPTIRCRWAHCALITKSRLRVGANISVVGYDDTEDSSCYIPPLTTHQTGFSPAGEN

SEQ ID NO: 11133 - protein, 92 aa, Klebsiella pneumoniae
MSRSADKTTSSTNAKRAYRKGKPMSASERQLAAIARKRETHKEVKVFVKNPLKDVMIAVCEEEGLTQAQFIEKLLERELTERGLIDVKTSHS

SEQ ID NO: 11134 - protein, 363 aa, Klebsiella pneumoniae
VKRSTFTRMSLSRANGWGAGHYCTGDGGFHGRRLWGCSSHGSSRGRTIREFVTGVLFVPAGFTLMWMTVFGNSAIYLIMNQGATDLANTVQQDVALALFNFLEHFPFSSVLSFIAMAMVIVFFVTSADSGAMVVDTLATGGVANTPVWQRIFWASLMGIVAIALLLAGGLSALQTVTIASALPFSVILLISIYGLLKALRRDLTKRESLSMATIAPTAARNPIPWQRRLRNIAYLPKRSLVKRFMDDVIQPAMTLVQEELNKQGTISHISDAVEDRIRLEVDLGNELNFIYEVRLRGYSSPTFALAAMDNNEQQTEQHRYYRAEVYLKEGGQNYDVMGWNQEQLINDILDQYEKHLHFLHLVR

SEQ ID NO: 11135 - protein, 112 aa, Klebsiella pneumoniae
SFNSAKVRFIQQSHFGTGYSSLNYLREFPFDAIKLDRTFISGIAHVARDLSIVRSIVSLGKAFSLGIVAEGVENNEQFELLKNMNCDEFQGYYYSKPLSGDQLIDFLRGQKK

SEQ ID NO: 11136 - protein, 239 aa, Klebsiella pneumoniae
LERLRKSLPARPNFSADIAHEIRTPITNLVTQTEIALSQDRTQRELEDVLYSSLEEYNRMTKMVSDMLFLAQADNNQLIPDRVMFDLRAEVMKVFEFFEAWAEERNITLKFNGMPCLVEGDPQMFRRAINNLLSNALRYTPEGQAITVSIREQESFFDLVIENPGKPIPEEHLSRLFDRFYRVDPSRQRKGEGSGIGLAIVKSIVEAHHGRVQVESDVRSTRFILSVPRLEKMIPETQC

SEQ ID NO: 11137 - protein, 67 aa, Klebsiella pneumoniae
SFESLSVRGTCPFVMSAMPLKTSPPRILMRDWNRHAFPLNLEQLVISFNHMIGKIEEVFTRQAQFLC

SEQ ID NO: 11138 - protein, 312 aa, Klebsiella pneumoniae
DRLLVVFILGFCLNAGAPAVEAFIEKDSRRSNFEYGRARMFGCVGWALCASIVGIMFTINNQFVFWLGSGCAFILAVLLFFAKTDAPSSATVANAVGANHSAFSLKLALELFRQPKLWFLSLYVIGVSCTYDVFDQQFANFFTSFFATGEQGTRVFGYVTTMGELLNASIMFFAPLIINRIGGKNALLLAGTIMSVRIIGSSFATSALEVVILKTLHMFEVPFLLVGCFKYITSQFEVRFSATIYLVCFCFFKQLAMIFMSILAGNMYESIGFQGAYLVLGLVALGFTLISVFTLSGPGPLSLLRRQVNEVA

SEQ ID NO: 11139 - protein, 81 aa, Klebsiella pneumoniae
IGCPVSLADGIFRHDLCGSRCHCVFSFLQLPPLAGRLTSSVKCAFQFQRAEYLPEGGIFHRGDVDTAPFAVTSGDMTPESS

SEQ ID NO: 11140 - protein, 203 aa, Klebsiella pneumoniae
NRGPGNSTGDGFKRQNNGLRRFIMAARGVNKVILVGHLGQDPEVRYMPNGGAVANLTLATSETWRDKQTGEMRENTEWHRVVMFGKLAEVAGEYLRKGAQAYIEGQLRTRNWQDDAGVTRYVTEVLVGQNGTLQMLGGRRESGVPESAAQPQNPATPAQPAQAAAKSPKAKGGKKGRQDAAPSQQPPQPLPNDFPPMDDDAPF

SEQ ID NO: 11141 - protein, 233 aa, Klebsiella pneumoniae
SRKPNAENKDVNDKDVISLSCSKQKPFDIISATYQEGWIASSIPGVRVRQEMNIQPSSGEINAAELVSVMELKTPVVLPRTSLIQKWRVIMKNIVLASLLGFGLISSAWATETVNIHDRVNNAQAPAHQMQSAEAPVGIQGTAPRMTGMDQHEQAIIAHETMTNGSADAHQKMVESHQKMMGNNTVSTTVPSTSYAAMNEHERAAVAHEFMNNGQSGPHQAMAEAHRRMINAG

SEQ ID NO: 11142 - protein, 202 aa, Klebsiella pneumoniae
SSPFFPSFSRSGFALKPSRPASCFICAAASGVALASSAFRRAVVSARHNPVPQSYEPVEVAMYHARQTMLNVEESDRLSFLPDLFGNDFLAGEMQVYALAEKHITDYCGGFWHFIRIPEGGGYMMPDGDRFHLTNPDNWFDRSVSADAAGVIITALAINRRIWLHHERGDAALTRHLMLRESQLWNFIDSHDECAAIYAALD

SEQ ID NO: 11143 - protein, 463 aa, Klebsiella pneumoniae
HTGPVRKTSALPAPRSLIATCRPGGGNYLSRPQYEECRMISRWKWILKQTVKKLWFRATLFAIVAIITALLSILFKSMIPESVSVKVGAEAVDNILNILASSMLAVTTFSLSIMVTAYGSATTNVTPRATRLVVEDVTTQNVLATFIGSFLFSLVGIIALSMGAYGERGRVILFIVTLVVIALILITLLRWIQHLTSLGRVGETTAKVEQAAIETFIARARNPCLGGYPWLENNEQPKGTVAVYPKKIGYVEYINMVKLSKLLTNDPRHVYLVAQPGSFIHPSMPVLYLSQGQESSISADLLETIIVSDVRSFAQDPRFCLSVMAEIACRALSPAVNDPGTAIDVIGRGVRILSTYAQNKSDEIEVKYPSVHVAPLQNNDLLEDFFSPVARDGAGMREIQIRVLKGLSMLSKGWPGIFSEAAHNLAFETLEHAIRADHIDSDRCLIKSIYYNLFSGEDSNKKP

SEQ ID NO: 11144 - protein, 467 aa, Klebsiella pneumoniae
GEPPREGRQLQEGENTMTPTTAQIMTENTVSQTYRATYSPDDNKLRLYASLRLDEETYSLINKAGFRWAPKQELFVAPAWTPGREDVLLSLAGDIEDEDSTLFDRQEQRAGRFSDYSDRRAVESEQALAHVDSLASAVPLGQPILVGHHSERRARRHAQKIENGMKRAVMLFERAEYWEQRAQASLRHAKYKERPDVRYRRIKKIEAELRKSQKHITRSEEYMTMWRAQTLDLKMALLVSNYDHIYACFTLDKYPRPAEKSQYEGSMSLHSALSEEIITFEQARDIAIRCHERTISHQQRWVNHYQNRLAYERAMLNENGGVVTRTQEFEPGGQVLSRGEWLTILRVNRSKGEVSSVETPGYRFLGYSGTMKLTPDRITDYKAPTAEEASDAKKAAKRPPIVNYPGEGFREMTKAEWAKLPADYKGVRGAAETETHGAYRFRRCMTHGCTLVNVYITDMKTVEIPKK

SEQ ID NO: 11145 - protein, 200 aa, Klebsiella pneumoniae
LLKPKKRRKPVKNSLKNLAKTPLAALALSLALAGMAHAGTLDEVKSLWDPQGISGTETASPQSSTPQAVSGASQPRWLRLSNGKQVDLRDWKVVLFMQGHCPYCHKFDPVLKQLAGQYGFSVFSYTIDGQGDDAFPEALPAPPDVMQTFFPNIPVATPTTFLVNVNTLAAYPILQGATDAQGFMARVDTVFQMMENPNNG

SEQ ID NO: 11146 - protein, 151 aa, Klebsiella pneumoniae
PGRPCLPVFRVRKSIMYYLKNTNFWMFGLFFFFYFFIMGAYFPFFPIWLHDINHISKSDTGIIFAAISLFSLLFQPLFGLLSDKLGLRKYLLWIITGMLVMFAPFFIFIFGPLLQYNILVGSIVGGIYLRLLFKRRCASSRGIYRERQPSQ

SEQ ID NO: 11147 - protein, 157 aa, Klebsiella pneumoniae
ADCTRWVVHPLVSLWNFSVTEASLNRELLMRSRIFLFERRELNPHILTNSTNDSSRVSLFTPYSDMERIIPSQTLKSVSISRREPVILTSVYPSLLAIDSCTSSSVASVTFFRFALLFPVDFRVGTKRPSLMSATGCTVLVLLTSSLTTSPVVLSTS

SEQ ID NO: 11148 - protein, 121 aa, Klebsiella pneumoniae
CWLTRKVARLSLSVTALSVRTTWRNSSSMSPATLNRISKECVMRNIRFPDLDITGMWVLAVGVFFHLIARLVRKQPELAVQAGEIFGLGMVVFGGYRILNALIAEAEKEEKACEKQPEEPR

SEQ ID NO: 11149 - protein, 62 aa, Klebsiella pneumoniae
SVRLSAVCRSACCCRAGTTTRDWPLSPYNIPSLKNPAGAGGFRTPVGRLLRIILSSGLLSSP

SEQ ID NO: 11150 - protein, 438 aa, Klebsiella pneumoniae
MSVTRIRVKERDAIIQSLKSGVTPRIGIQHIQVGRVNEITALHQDIERIADGGASFRLIIGEYGSGKTFFLSVVRSIALEKKLVSVSADLSPDRRIHSSGGQARNLYSELMKNMSTRNKPDGNALLSVVERFVTEARKEADTDGSEVSSVIHKRLAALSDMVGGYDFAKVIDAFWRGHEQDNETLKSNAIRWLRGEYTTKTDARHDLDVRTIISDASFYDSLKLMSLFVRQAGYAGLLVSLDEMVNLLKLNNTQARTANYEQILRILNDCLQGSAENIGFILGGTPEFLFDPRKGLYSYEALQSRLAENRFAQKAGVIDYSSPTLHLASLTPEELYILLRNLRHVYAGGDPENYLVPDEALTGFLHHCSKTIGDAYFRTPRNTIKGFLDMLAVLEQNRTMNWQTLIEGVAIEEDRPSDMDDTTTEESDDDDGLANFKL

SEQ ID NO: 11151 - protein, 329 aa, Klebsiella pneumoniae
INRTFAELKDQITYLPDNADRSVAKQKFKITNWPTYNKALINRGSITFWLDDEAIQAWYESATPSSRGRPQRYSDLAITTVLVIKRVFRLTLRAAQGFIDSIFSLMNVPLRCPDYSCVSRQAKSVNVSFKTPTRGEIAHLVIDSTGLKVFGEGEWKVKKHGQERRRIWRKLHLAVDSKTHEIICADLSLNNVTDSEAFPGLIRQTHRKIRAASADGAYDTRLCHDELRRKKISALIPPRKGAGYWPGEYADRNRAVANQQMTGSNARWKWTTDYNRRSIAETAMYRVKQLFGGALTLRDYDGQVAEAMALVRALNKMTKAGMPESVRIA

SEQ ID NO: 11152 - protein, 225 aa, Klebsiella pneumoniae
INRTFAELKDQITYLPDNADRSVAKQKFKITNWPTYNKALINRGSITFWLDDEAIQAWYESATPSSRGRPQRYSDLAITTVLVIKRVFRLTLRAAQGFIDSIFSLMNVPLRCPDYSCVSRRAKSVNVSFKTPTRGEIAHLVIDSTGLKVFGEGEWKVKKHGQERRRIWRKLHLAVDSKTHEIICADLSLNNVTDSEAFPGSYPADSQKNQGSIGRRRLRHPALSR

SEQ ID NO: 11153 - protein, 83 aa, Klebsiella pneumoniae
RTGTGRSRQAWLTNPTVSSNLEAGNTPPFQGCVGLTCLKRLYEGVAGSPVAPFSCKQEKKPARQAGKNLSSTYNTDSMNRKSH

SEQ ID NO: 11154 - protein, 98 aa, Klebsiella pneumoniae; identical to SEQ ID NO: 9193

SEQ ID NO: 11155 - protein, 110 aa, Klebsiella pneumoniae
KSPTIEGPAIHKVPESCVAYREVWGEALTGVLTGQPLSHEMYIKLPGADVVLLTEGNIIGCDTASATWTRRGLRPWHVNTISTREPGDLPSDHLPVSEMARTGKTRSHSR

SEQ ID NO: 11156 - protein, 77 aa, Klebsiella pneumoniae
LSQTKKPPDGGQKCSNVVSGKSIREKVTARILPSHSACIDHAAVRFGHGLMWAGLPVIHEFMSNRCSFMLIHRRVRR

SEQ ID NO: 11157 - protein, 740 aa, Klebsiella pneumoniae
RRRTGELQTMSSAYDSLDPRVRKWVYKQGWSTLRPLQESSIPAILARDRDVLISAGTAAGKTEAFFLPACSAVADLTNGFGIVYISPLKALINDQYRRLGSLGDALEMPVTPWHGDVPQSKKKKARTNPAGILLITPESLESLLINSMGWLKQAFSSVAYIVIDEFHAFIGSERGVQLLSLLNRIDHVLGCQVNPIPRVALSATLGELEKVPEMLRPDKRLPCVTVTDSNSMATLQVQVKGYLERVIQNEEELQSSAEHDVCADIFRLCRGDSHLVFANSRKRTESIAATLSDMCEEQIVPNEFFPHHGSLAKELREVLESRLQKGNLPTTAVCTMTLELGIDIGKVKSVIQVTPPHSVSSLRQRMGRSGRRDSPSVLRMLITENELTVSSSIVDHLRLQLVQSMAMIRLMISKQWFEPADSRQMHYSTLLHQILAITAQWGGVRADQLWSQLCQTGPFRNVDLNDFKSLLKHMGACGLLTQLASGEMVVGAEGEKLTNHYTFYAVFNTPEEFRIITGNRTLGTVPVDSPLLPDQHIIFGGRRWKVTEIETEKKVIYVEATKGGQPPQFSGGGMSVHDAVRQEMLAIYREGDYRIAIGSKKVDYADTAARNLFAEGCSNFQRFKLQNECFITSGQHCYVIPWMGDKVVNTITALLIRCGFKANSFAGVIEIDNSSVASVQHALKEMLLSGLPSAFDLATDVPEKYLDKYDEYLPESLLAKGYGAKAYETEGTRIWLQKHL

SEQ ID NO: 11158 - protein, 121 aa, Klebsiella pneumoniae
MLSAPVFRISGIQDVMPGPSISAGRGQGAKDLRGISTITGKGNGQGGSHVQRKYPGIDFHRARILMPGQCLDDLPGLPVIKHVHNIAVTESMRRHGDRKMHAVSFSPLHRLVSASCALSHP

SEQ ID NO: 11159 - protein, 73 aa, Klebsiella pneumoniae
SMHAFIFLVLMTPSSGGGIWDITPMPNTDVCIKMLRVLEARGGRGYGSNTGECIEIKTREPLNSVMETLSEGG

SEQ ID NO: 11160 - protein, 773 aa, Klebsiella pneumoniae
RISAMSFNAKDMTQGGQIANMRFRMFGQIANIIFYVLFILFWVLCGLMLMYRLSWQTFVNGCVYWWCTTLGPMRDIIRSQPVYTIQYYGQSLEYTSEQILADKYTIWCGEQLWTGFVFAAVVSLVICIVTFFIASWVLGRQGKQQSEDENTGGRQLSDKPKEVARQMKRDGMASDIKIGDLPILKNSEIQNFCLHGTVGSGKSEVIRRLLNYVRARGDMAIIYDRSCEFVKSYYDPSLDKILNPLDSRCAAWDLWKECLTLPDFDNISNTLIPMGTKEDPFWQGSGRTIFAEGAYLMREDKDRSYEKLVDTMLSIKIDKLRAYLQNTPAANLVEEKIEKTAISIRAVLTNYVKAIRYLQGIEKNGEPFTIRDWMRGVREDRPNGWLFISSNADTHASLKPVISMWLSIAIRGLLAMGENRNRRVWIFADELPTLHKLPDLVEILPEARKFGGCYVFGIQSYAQLEDIYGVKPAATLFDVMNTRAFFRSPSREIAEFAAGEIGEKEILKASEQYSYGADPVRDGVSTGKEKERETLVSYSDIQTLPDLSCYVTLPGPYPAVKLALKYKPRPKITEGFIPRRLDTRVDARLSALLEEREAEGSLARALFTPDAPASGPADTDSHAGEQPEPVSQPAPADMTVSPAPVKAPPTTKMPAAEPSVRATEPPVLRVTTVPLIKPKAAAAAAAASTASSAGIPAAAAGGTEQELAQQSAEQGQDMLPAGMNEDGVIEDMQAYDAWADEQTQRDMQRREEVNINHSHRHDEQDDVEIGGNF

SEQ ID NO: 11161 - protein, 139 aa, Klebsiella pneumoniae
VMPAPSQTVFDGFQSCRHPIPAGLSYQHEPAVAIFPADVREPEEVERFWFAFSPDGTVFGSEAAELHQTGFLRVNRESELPQSALHGYTEAPGIVSFVEPDDDVIGVSDHYHIACGIATSPLMRPQIEDVVEVYVCQQR

SEQ ID NO: 11162 - protein, 289 aa, Klebsiella pneumoniae
AQEAVTDILQNHYSQVKNPNPVFTPREGKKTLPFCRKLMAKAEGFTSRFDFSIHVAFLRSLGKRHRMPPLLRRRAIDALLQAMCFHYDPLANRVQRSITNMAIECGLATESRSGNLSVSRATRALKFLAELGLITYQTEYDPQIGCNIPTDITFTPALFSALDVSEVAVVAARRSRVEWENLQRKKQKLKPLEMDELIAKAWRFVRERFRSYQAERKSHGRKRDTARRDASRQRHDIETRVRQQLTREYATGRFMGDKEALKREVERRVQERMLLSRGNNYTRLATVPL

SEQ ID NO: 11163 - protein, 93 aa, Klebsiella pneumoniae
TSRARLKTLLTGPFHSFFWGGLLYLVYDDYRDNGTATEEQLLMISHAIPCAGEDFRTALRNSQGPLTLRDAKKIAAKCNEKYKQLNSLNAISK

SEQ ID NO: 11164 - protein, 479 aa, Klebsiella pneumoniae
RSGALMANFNTLIKRKQYIWLGLILAGGAAAVGGGLYLSDLNMSSDEEAPAQGEPAPDMTGVVDSSFNSKVEQHATTEMQATAADLNKRFDSLQGEVDLLSKARSADQIRIDKLSSDNEAMQNQLKALGVKPAVSGGEPAPTPPSPPPGPEGEPQPASYPPQTGAAVPPPTAFYPGNGMTPPPQVSYQSVPVPNQIQRKTFSYDKGKKAKSLPYIPSGSFAKSMLIEGADANASVTGNESTVPMQLRITGRVEMPNSKTYDLTGCFVGLEAWGDVSSERAIVRTRNISCIKGDKTIDQPINGHVSFMGKNGVKGEVVMRNGKILGWAWGAGFVDGIGQGMERASQPAVGLGATASVGAGDVLKMGVGGGASKAAQTLSEYYIKRAEQYHPVIPIGAGNEVTVVFQDGFQLKTIEELEAEKNGQQQAQNQEAEPAPQADAHHQSGGGMNGFNTDEMLKKLGKLDPREFSPGAAPQGENNG

SEQ ID NO: 11165 - protein, 150 aa, Klebsiella pneumoniae
FNGANRHHQKFPPISTSSCSSWRWLWLILTSSRRCISRCVCSSAQASYACMSSITPSSFMPAGSMSCPCSADCCASSCSVPPAAAAGIPAEDAVEAAAAAAAAFGLINGTVVTRRTGGSVALTEGSAAGIFVVGGAFTGAGDTVMSAGAG

SEQ ID NO: 11166 - protein, 332 aa, Klebsiella pneumoniae
YPVAKRHAITAVAAVAQRSGARLQEFLPEACSIPSFQETRPKRCPQGVKLDQTNNRISLPKLGWIRYRNSREVIGEVKNVTVIQSCGKWYVSIQTEYEVPEQVHKAASMVGLDAGVTKLATLSDGTVYQPVNSFKASQRKLAMLQRQLSRKVKFSASWQKQKKKIQRLHSHIANIRRDYLHKVTSEISKNHAMIVIEDLKVSNMSKSAKGTAERPGRNIRAKSGLNRSILDQGWYEMRRQLEYKQLWRGGQVLAIPPAYTSQRCACCGHTAKENRQTQSKFVCQVCGYTENADINGARNILAAGHAVLACGGMIQSGRPLKQEPTEASQAPV

SEQ ID NO: 11167 - protein, 219 aa, Klebsiella pneumoniae
RSWANLIRVSSLRAQRRRGKIMAKSLITAVLSVLRWAHWLVKCAVVYPLAMMMLLVVLVFRTGPYTFGQTLVKTVESVQQEGYVIQDCTGPKELNSDAVNAPLPPLLQEDCTTVITDAAGYAAYIDQSYTHNILWLWLLMAVVFTGIAVVFRRTPVRRGIIRKNGVVVGESVLGSSGLILARSDVSQIKRVYDEMSPGEGDKFVRTIKENTQIRMNLKK

SEQ ID NO: 11168 - protein, 155 aa, Klebsiella pneumoniae
VAGAAVLTLCGDLLNLPPGINFTRLRAVRREGVNEHGPVQMSGGEREIFFGLMKRQRNGREKFIAKGSAVPWTARRVVLVSAPANGLKRVIRRQGKGAGTRRNDEERGRETALPCRVPAVLRRHGESGAAGTVAASAAVDPDLRHQTLAGRPETA

SEQ ID NO: 11169 - protein, 64 aa, Klebsiella pneumoniae
HQLLLQRNRAHNTQKERFTRTIFTDDKSEACTTVSNPLNILMESGDLIHAANLDMLNAYPWRYT

SEQ ID NO: 11170 - protein, 68 aa, Klebsiella pneumoniae
RFVYFYFIYIKRSYQIKIRISCPKVIDGKPDTMIFIFINVNFHTFKIPSLTLRNFKKDCFIWDVIFRN

SEQ ID NO: 11171 - protein, 139 aa, Klebsiella pneumoniae
DDPYYGEGIIQEALMKDYLCKKLFNRLSGTLVIRARCGNNITGLACCNILYPSPRYSGQLHIKELYVSQCDRNKGTGKAIMRFIARLALEQECLSLSWNAEKSNPGANRFYQALGGRINDHIVNYYLHGESLSKLASGI

SEQ ID NO: 11172 - protein, 216 aa, Klebsiella pneumoniae
QESLMKLMNLFMVMLLLTGRAVLAETSSVTDREWLKQQENLSEQLHQHPDKQLQQELEAQINRNPLPKSDRQFIDNLVSQQKAANQEKPAEGALYFVSFSIPEEGLKRMLHETRQYGIPATLRGLVNNDMKTTTDAVLQLVKDGVTDGVQIDPTLYTQYSIRSVPSLVVRCQAGYDVVRGNIHVKQALEKVAQTGDCAQVARQMLDAPSNAAGSQP

SEQ ID NO: 11173 - protein, 445 aa, Klebsiella pneumoniae
SGAYARCFDFSARNCMASLKIKYAAIIISSLIAGGLISVTAWQYVNSSQKTVQTEQKAPERKVLFWYDPMKPDTKFDKPGKSPFMDMDLVPKYADESGDESSGGIRIDPTQVQNLGLKTQKVTRGMLNYSQTIPANVSYNEYQFVIVQARSDGFVEKVYPLTIGDHVKKGTPLIDITIPEWVEAQSEFLLLSGTGGTSTQIKGVLERLRLAGMPEEDIQRLRSTRTIQTRFTIKAPIDGVITAFDLRTGMNISKDKVVAQIQGMDPVWISAAVPESIAYLLKDTSQFEISVPAYPDKTFHVEKWNILPSVDQTTRTLQVRLQVSNKDEFLKPGMNAYLKLNTKSQEMLLIPSQAVIDTGKEQRVITVDDEGKFVPKQIHVLHESQQQSGIGSGLNEGDTVVVSGLFLIDSEANITGALERMRHPEKTESSMPAMSDQPVNMHSGH

SEQ ID NO: 11174 - protein, 496 aa, Klebsiella pneumoniae
PVMYGEEKSDSLIVAAKQANNPKGAESVERRSGAKGNAEQPHMRRTQSRESMSQRLSRVREAAKQRKKERFTALFHLLTVEALEAAFLSLSRKAAAGVDGIRWMDYAGNMKNNITDLHRRLHQGSYRAQPGRRHYIPKADGKQRPLGIASLEDKIVQYALVKILNAVYENDFMGFSYGFRPGRSQHDALDALATGLVRTNVNWVLDADISQFFDRVSHEWLIRFTEHRIGDRRVIRLIRKWLTAGTSEEGQWRATEEGTPQGAVISPLLANIYLHYVFDLWAHQWRRRYATGNVVMVRYADDIVIGFDKRYDARRFRIAMQRRLREFGLTVHPEKTRLMEFGRFAAENRAIRGKGKPETFNFLGFTHISGKDRNGRFMLIRKTRRDRMTATLKAIKDGLRRRWHYSIPEQGKWLRRVVQGYLNYHSVPGNFPTMQKFRTHVTNLWRRALRRRSQKDDTTWTKANKLAAAWLPRVRVLHPWPVERFTARHPRQEPGA

SEQ ID NO: 11175 - protein, 258 aa, Klebsiella pneumoniae
ENVYLLVLIMSQGFRMKLNKVMAVMVVSSALVLSGCSAMGTAIKKRNLEVKTQMSETIWLEPSNNKTVYLQIKNTSDKDMSGLQAKIASAVTSKGYQVVSNPDTAGYWIQANVLKADKMDLRESQGWLSRGYEGAVTGAALGAGITAYNSSSAGATLGVGLAAGLVGMAADAMVEDVNYTMITDVQIAERTKTQVQTDNVAVLRQGTSGAKVQTSTETGNQHKYQTRVVSNANKVNLKFPEAQPVLEDQLAKSIANIL

SEQ ID NO: 11176 - protein, 183 aa, Klebsiella pneumoniae
TYIQAYLLSGDTATVRCFRGLHHYGRWPQHGFTSLKKLRPQSVTSRIQPGSDVIVCAEMDEQWGYVGAKSRQRWLFYAYDRIRRTVVAHVFGERTLATLERLLSLLSAFEVVVWMTDGWPLYESRLKGKLHVNSKRYTQRIERHNLNLRQHLARLGRKSLSFSKSVELHDKVIGHYLNIKHYQ

SEQ ID NO: 11177 - protein, 1058 aa, Klebsiella pneumoniae
ICIQGTEETTMIEWIIRRSVANRFLVMMGALFLSIWGTWTIINTPVDALPDLSDVQVIIKTSYPGQAPQIVENQVTYPLTTTMLSVPGAKTVRGFSQFGDSYVYVIFEDGTDLYWARSRVLEYLNQVQGKLPAGVSSEIGPDATGVGWIFEYALVDRNGKHDLSELRSLQDWFLKFELKTIPNVAEVASVGGVVKQYQIQVNPVKLSQYGISLPEVKQALESSNQEAGGSSVEMAEAEYMVRASGYLQSIDDFNNIVLKTGENGVPVYLRDVARVQTGPEMRRGIAELNGQGEVAGGVVILRSGKNARDVITAVRDKLETLKASLPEGVEIVTTYDRSQLIDRAIDNLSYKLLEEFIVVAVVCALFLWHVRSALVAIISLPLGLCIAFIVMHFQGLNANIMSLGGIAIAVGAMVDAAIVMIENAHKRLEEWDHQHPGEQIDNATRWKVITDASVEVGPALFISLLIITLSFIPIFTLEGQEGRLFGPLAFTKTYSMAGAAALAIIVIPILMGFWIRGKIPAETSNPLNRVLIKAYHPLLLRVLHWPKTTLLVAALSIFTVIWPLSQVGGEFLPKINEGDLLYMPSTLPGVSPAEAAALLQTTDKLIKSVPEVASVFGKTGKAETATDSAPLEMVETTIQLKPEDQWRPGMTIDKIIDELDRTVRLPGLANLWVPPIRNRIDMLSTGIKSPIGIKVSGTVLSDIDATAQSIEAVAKTVPGVVSVLAERLEGGRYIDIDINREKASRYGMTVGDVQLFVSSAIGGAMVGETVEGVARYPINIRYPQDYRNSPQALREMPILTPMKQQITLGDVADIKVVSGPTMLKTENARPASWIYVDARGRDMVSVVNDIKTAISEKVKLRPGTSVAFSGQFELLEHANKKLKLMVPMTVMIIFILLYLAFRRADEALLILMSLPFALVGGIWFLYWQGFHMSVATGTGFIALAGVAAEFGVVMLMYLRHAIEAHPELSRKETFTPEGLDEALYHGAVLRVRPKAMTVAVIIAGLLPILWGTGAGSEVMSRIAAPMIGGMITAPLLSLFIIPAAYKLIWLRRHKKSVS

SEQ ID NO: 11178 - protein, 151 aa, Klebsiella pneumoniae
YFHHAPRLAANVILLRPRSLSTDYSKNDNIVIILSPGKQRAFGKVSLSILWISFEPFTRSACTRSVMFKLKLLSISTIFILAGCVSLAPEYQRPPAPVPQQFSLSKNSLTPAVNSYHDTGWRNFFVDPQVNRLIGEALNNNRDLRMAALKG

SEQ ID NO: 11179 - protein, 100 aa, Klebsiella pneumoniae
CTHHLNTFDGGVSRLHGFKSQRGADYPFQFAMIAFNHVVPVLNLSVFNVRRAPAFAFEQSKRATIGGRFIRVDESRDLPLLHVVEDLSSPRAAEGSALCV

SEQ ID NO: 11180 - protein, 137 aa, Klebsiella pneumoniae
ANNQRMDMMLFFRKYGFLFIPPVYWLIYLGARLTYNGLAGEYSPDFFQGIRHEGIYIICSLCIFYFFCLEVEVSDGEFSANILFLIVFFHVVLLFITLLICLWQGAMLLDAIFMGQIIASMCLLFFIPVLSIIRRSF

SEQ ID NO: 11181 - protein, 142 aa, Klebsiella pneumoniae
LYLQIRDRLEYMSNTNANFEMTGILLGQEARKRKTPQEKIAIIQQTMEPGMNVSHVARLHGIQPSLLFKWKKQYQEGSLTAVAAGEEVVPASELTAALKQVRELQRLLGKKTMEVEILKEAVEYGQSRKWIAHAPLLPKDGE

SEQ ID NO: 11182 - protein, 270 aa, Klebsiella pneumoniae
IQCLSASVTPVAIIHKRVFAMRTIHAAMLAGCLCCALMPAFAKDAGWQWYNEKLKPRDEERKAAPAAPPPQMDILEKLATLQAATKRSLYEAILYPSSENFVKYFRLQNYWTQQAGLFSMSAKKAMLENPELDYNLQHSYYNGTVKNQLAADYAEQRQAISTLAQHYGVMFFYRGREAIDGQLVQVIKNFRETYGLSVIPVSVDGVINPMLPDSRTDQGQAEQLGVKFFPAMMLVNPKSGQVKPLSYGFISQDDLAKQFLYVSSDFKPNF

SEQ ID NO: 11183 - protein, 65 aa, Klebsiella pneumoniae
YGYQGKGAGTRRNDEERGRETALPRRVPAVLRRHGESGAAGTAAASAAVDFDLRHQTLAVRPETA

SEQ ID NO: 11184 - protein, 65 aa, Klebsiella pneumoniae; identical to SEQ ID NO: 11183

SEQ ID NO: 11185 - protein, 113 aa, Klebsiella pneumoniae
YGIQEQRAFSPLPAPAHQAIMLMTEPPWSYPVTCNPAGINIPQSRQGTMQAYWPCIPLCVFPGSSANHPVNRESHSPSVANTFLPSGSRFLIAFSSVKLAPGYTDSCSLILPG

SEQ ID NO: 11186 - protein, 1031 aa, Klebsiella pneumoniae
QFTQDTTMTMITDSLAVVLQRRDWENPGVTQLNRLAAHPPFASWRNSEEARTDRPSQESRSLNGEWRFAWFPAPEAVPESWLERDLPDADTVIVPSNWQMHGYDAPIYTNVTYPIAVNPPYVPTENPTGCYSLTFNIDESWLQEGQTRIIFDGVNSAFHLWCNGRWVGYGQDSRLPSEFDLSAFLHAGENRLAVMVLRWSDGSYLEDQDMWRMSGIFRDVSLLHKPSTQISDFHVATHFNDDFSRAVLEADVQMYGELRDELRVTVSLWQGETQVASGTAPFGGEIIDERGGYADHVTLRLNVENPKLWSAEIPNLYRAVVELHTADGTLIEAEACDVGFREVRIENGLLLLNGKPLLIRGVNRHEHHPLHGQVMDEQTMVQDILLMKQNNFNAVRCSHYPNHPLWYTLCDHYGLYVVDEANIETHGMVPMNRLTDDPRWLPAMSERVTRMVQRDRNHPSVIIWSLGNESGHGANHDALYRWIKSVDPSRPVQYEGGGADTFATDIICPMYARVDEDQPFPAVPKWSIKKWLSLPGETRPLILCEYAHAMGNSLGGFAKYWQAFRQYPRLQGGFVWDWVDQSLIKYDENGNPWSAYGGDFGDTPNDRQFCMNGLVFADRTPHPALTEAKHQQQFFQFSLSGRTIEVTSEYLFRHSDNELLHWMVALDGKPLASGEVPLDVAPQGKQLIELPGLPQPKSAGQLWLTVHVVQPNATTWSAAGHISAWQQWRLAENLSVTLPSAPHAFPQLTTSETDFCIELDNKRWQFNRQSGFLSQMWIGDKKQLLTPLRDQFTRAPLDNDIGVSEATRIDPNAWVERWKAAGHYQAEAALLQCTADTLADAVLITTVHAWQHQGKTLFISRKTYRIDGSGQMAITVDVEVASNTPHPARIGLTCQLAQVAERVNWLGLGPQENYPDRLTAACFDRWDLPLSDMYTPYVFPSENGLRCGTRELNYGPHQWRGDFQFNISRYSQQQLMETSHRHLLHAEEGTWLNIDGFHMGIGGDDSWSPSVSAEFQLSAGSYHYQLLWCQK

SEQ ID NO: 11187 - protein, 260 aa, Klebsiella pneumoniae
KIKQVKENNMRLASRFGLTHSIRQERPLTNDELVKVVPSVFSEEKHNSRSDRYTYIPTITLLDKLREEGFQPFFACQSRVRDEDKRGHTKHMVRLRREGANKGTEVPEIILLNSHDGSSSYQMIPGMFRFVCTNGLVCGTSFGEIRVPHKGDIVGRVIEGAYEVLGIFDKITEGVDVMKSITLTKEEQRLFGQAALTYRYEDENKSPVSIEQIIHPRRYEDKKYDIWTTYQRVQENLIKGGLPGRTEKGKKNNNPASKSN

SEQ ID NO: 11188 - protein, 116 aa, Klebsiella pneumoniae
SAKQTGVFMEEKKAYGLVMVFVGVFVLILVSIMSYSLWRDRQVNAFMTTNRAWGIQCDTVSQAAWVVRDGERVDLQINHLPLYCSGYRFEARDDAGKIQRQLDKYSVYQHLSRQSQ

SEQ ID NO: 11189 - protein, 189 aa, Klebsiella pneumoniae
HMEHGARQNTTRVIAVGFISLGTLLTLSLATNIIQGINNYRLQTEQKVAVTPMLFRAPFAVSQNQADASYIEQLGLSFVALRLNVTPETVDAQHQQLLRYVLPAAQNSLKVQLAEDAKRIKDNNVNATFYMTSIRAWPAENRVDIRGELKTWIGDSKPYSEIKSYVIQFSRVDGVSWLARFGEINNEKN

SEQ ID NO: 11190 - protein, 102 aa, Klebsiella pneumoniae
TPAHIAFCHRYLALMFTLRSLWFVMQQQQVMLAHYPVEPFGVHRWLSLCATLLAQDAPHASITITRHIADDVEDSRQYFFVCFVITPVTALVLPVGRTVNPQ

SEQ ID NO: 11191 - protein, 103 aa, Klebsiella pneumoniae
GEAQSRVSQRRASMNFTITSRKTGEIFSFYAPDSGGYVHLESPGHSGNTGAQICCGGGFMGSTLSCGASEDDLASVARKWYRQFVRERRKFLMMSGQYSEDNQ

SEQ ID NO: 11192 - protein, 80 aa, Klebsiella pneumoniae
LQIKIVINRLTALPTDLIHSGNLTVNEINRSAGFLINSFDLPGIGIFMGISARFLRIFRFALPGALAGIAFRTLLHLFIW

SEQ ID NO: 11193 - protein, 128 aa, Klebsiella pneumoniae
SSCLASRLFPPLSPSVCRSPVTDRKHVMTGDELKRYRFPETLTNQSRWFGLYLDELIPAVICLGWGFWTSKFIFGMAAAALVFWGIKKLKKGRGSSWLRDLIYWYLPTSLLKGFFHDVPDSCFRQWIK

SEQ ID NO: 11194 - protein, 115 aa, Klebsiella pneumoniae
RQILNNVKKWQIPRFINTDKAPAYGRALALLKREGRCPSDVEHRQIKYRNNVIECDHGKLKRIIGATLGFKSMKTAYATIKGIEVMRALRKGQASAFYYGDPLGEMRLVSRVFEM

SEQ ID NO: 11195 - protein, 114 aa, Klebsiella pneumoniae
RTFNMLPTRLSPVTVDNQYIVSLAVAFPTICCPSPFYFVIAQCEKRHHSGDAADGMMFIQGRKIGRYWLPAGRRAGQRAASVAGFKNAGGNLKIKLHTLRNFANFTQHASFRSQ

SEQ ID NO: 11196 - protein, 74 aa, Klebsiella pneumoniae
PPIKQDFRLLGKTSVDRLLKLSQGQAVKSNQLLPVSLVKRKTTLPPNTQTTSPRTLADSLMQLARQVSRLESGQ

SEQ ID NO: 11197 - protein, 86 aa, Klebsiella pneumoniae
KRGNIPLRHTQIQQKKKRYADITLLILNWRPVEVRPVRSAAGVANRLTGRRSLPGFSRGRTDLQSRVSSSQIVPSQTLNGASGAPI

SEQ ID NO: 11198 - protein, 64 aa, Klebsiella pneumoniae
LPCFTAMRAEIALMSGSAFAVTHHAFSSGAGRTSDGNGSHASTLKSPSYTKSVSWQHYQSSVLQ

SEQ ID NO: 11199 - protein, 126 aa, Klebsiella pneumoniae
KEINMNAVLSVQGSAVPEKTKPSFMSRVFNKKKALKAAKVALPVAAVAAFFPDAAMATTTATDLMKSGDATVKGTFGKQSSVVKWVVLAEVVAGGIMYMMTKNVKFLFGFAIISTFITIGMSVAGY

SEQ ID NO: 11200 - protein, 176 aa, Klebsiella pneumoniae
IRQKAASSLTLQQCLTIPFSCAALTTAIPNGCCEPFSTAAVTRKRDISPPGLRLIIPVTVGEPSVSVPVLSTTSVSTFSRRSRASAFLINTPAWAPLPTPTIIDIGVASPSAQGQAIIRTDTAAMRPCAILGSGPQTDQIKKATTAISITRGTNQPETLSAILWMGARERCASATI

SEQ ID NO: 11201 - protein, 245 aa, Klebsiella pneumoniae
KEKNMRAQHTFPGATDRWLHRLLTWAPGQTDMIKTVALVLMVTDHTGLLLAGNNEVMRLLGRGCFPLFGLAWGMNLARHAEIRQSQLNSLWGWALVAQVSFMLIGYPWYSGNILFAFAVTGQVLRWVSQPSWYYTLPAAGLLVAWIPLSTASYGMAGVGMLTASWLLCRAQHAQERLGYGVLWALMVLLMNMHDVSESVAGLAIALLTLMVCSSAGERVKRFWPRQFFVMFYAVHLAVLGIVVSM

SEQ ID NO: 11202 - protein, 247 aa, Klebsiella pneumoniae
IMKKINPLFISGCLLLVAPAMSATLSGTLAPTVVPLTNGGQANIAVSNTDPNLFTVPGDRITAINSLDGGLTNQEQTDSGGAILATVSKKPFTFIVETERGLNFSIRAVPRAGSGRTIQLVSELAGTPGPAKAWEESNPYESLLVSLNRAVRQGSVPDEYQSVPVTSEVLQVPAGLRATADRVWVGHHLKVVRYSLDNVSLSARMVRESDFWQPGTRAVMFSTPAGLLTAGGRMQIWVTTSDEGVER

SEQ ID NO: 11203 - protein, 117 aa, Klebsiella pneumoniae
PVKKEISRNPSFTPSPKLRAHLNSHREGVTERLNNIFDRYAHLVRACALPLDDDETQVLLNVLNGSVVEPAFIEYLAQEIRDSDDYLEGIPAAKSLYEKCQSATYPQLLATVERLER

SEQ ID NO: 11204 - protein, 146 aa, Klebsiella pneumoniae
ARKKTMKFIPAVSEASIVKIPLFTERCPAGFPSPASDYTESELDLNEYCIHRRHSTYFVRAIGNSMTDIGLYSGDLLVVDKAEQPRHGDIVIAEIEGEFTVKRLLLTPRPALQAMNPDFPSLYPDPETLQIFGVVTAFIHKTRRAD

SEQ ID NO: 11205 - protein, 208 aa, Klebsiella pneumoniae
NSEKITGRLPGILPGRSGSTFMHHGLKHRIQAMRDKLEGRAPVAEIQGSSQLFVTPSPECRRLVELADVRETDRILEPSAGTGAILQAIRDAVPRAKCDAVELHAGLARHLQAHFPEVRIWCGDFLEYHPERRYTRIIMNPPFHRGDDIRHIRRALTLLEPGGILTGICLDGPRQQKALESLADVWEPLPRGTFTYTQVATAILRITV

SEQ ID NO: 11206 - protein, 194 aa, Klebsiella pneumoniae
IARNIMKELMLLIPLGSALLLTGCAGTETEFQCNATTSDTCMTMEQANEKAKLKEERSDAKPAAAGLPRLADGNFRTTSPNSYPLPPQPVINPGRNTAPSVTVSNKPGFLNTVPVNYDDVLRTRTAPVYIRPVSLSTYTSPATIPGNYPRPLRNGEETTSLWIAPYVDADDVYHQPATVLFVVKPSAWGQPRLN

SEQ ID NO: 11207 - protein, 81 aa, Klebsiella pneumoniae
KSGKRKMQDPSLRTYRIAFLGRNASGNLPMFTRVQATTGKRAIKAFIERCEPVKGWFLGAPEDITDQVKKEEEEAGSKPQV

SEQ ID NO: 11208 - protein, 68 aa, Klebsiella pneumoniae
AAGKIMAKKIPRMGVSFVAYAGVLIARCINLWRAVPSILLSAHAGNIVITSPITEKLIVYSNPTQYSA

SEQ ID NO: 11209 - protein, 608 aa, Klebsiella pneumoniae
HTLKTEDASVCIRRVTVKNDNAVQHNNQTASEQTLSPDEGHVLHKVRDPVCGMAILPDRAHSSIRYQDHQLYFCSASCESKFKAHPDRYLTEDASEHSHHHHHDHHEVSPDQIKQPHNQAEKENSEGVWTCPMHPEIRRSGPGSCPVCGMALEPLVATASTGPSDELHDMTRRFWLGLLLAFPVLVLEMGSHLFPDLRNTVPPQYNTWLQLLLASPVVLWCGWPFFARAGMSLRNRSLNMFTLVAMGTGVAWVYSVIATVFPSWFPASFRNMDGLVAVYFEAAAVITVLVLLGQVLELRAREQTSGAITALLNLAPKTARRLDHDGHETDINAEDVLPGDKLRIRPGESIPVDGIVIEGKTTVDESMVTGESMPVTKTKGDPVIGGTINQTGSLIIRAEKVGDETMLSRIVQMVADAQRSRAPIQRMADSVSGWFVPLVILIAVVAFLIWSVWGPEPRMAHGLIAAVSVLIIACPCALGLATPMSIMVGVGKGAQAGVLIKNAEALERLEKVDTLVVDKTGTLTEGSPTVTGIISLSPGGEISLLRVTAAVEKGSQHPLGMAVVRAAHEKGIVRHCCKVSDEAAFCLIQRPYISKTLLTRRISPRGSP

SEQ ID NO: 11210 - protein, 72 aa, Klebsiella pneumoniae
RKMKVYGHQHSSEAFFRETSPSCFEPKAEKVIAFHGKDASYAYNVLADLKAAGASYTRRNIIADMFRRLGVK

SEQ ID NO: 11211 - protein, 131 aa, Klebsiella pneumoniae
TVMKNNTEQPVSTTSHTFRRISVIVALVLFALATSAFLSRVVLEYSTPRVVAFDMKKTLDSFMDSVSQKQLTEAQSKALSDRFNDALEKSLAEYQQQHHVVILVSPAVVQGAPDVTRNIQHDIARRMKGEQ

SEQ ID NO: 11212 - protein, 98 aa, Klebsiella pneumoniae
TTMKTPRSGGAEKEKHMDHNVLSPLVSLPDGTFTREQAQVVAAQYQNVAIEDDQGTHFRLVVRHKDDGSMIWRVWNFEPGGEDIMNRYIRDYGVRKTK

SEQ ID NO: 11213 - protein, 123 aa, Klebsiella pneumoniae
LIRKLKMRNSLKAVLFGAFSVMFSAGLHAETHQHGDMNAASDASVQQVIKGTGVVKDIDMNSKKITISHEAIPAVGWPAMTMRFTFVNADDAINALKTGNHVDFSFIQQGNISLLKSINVTQS

SEQ ID NO: 11214 - protein, 238 aa, Klebsiella pneumoniae
NPVEEAPMCSMDRIENTNCSQLDFFREMQLTVNLSSHPACIRLRDGSFSHFNHSFATTFLHNINVNIWFNRLEISSSLRLSALDAEVYSGDRKMLIEENLPINGNRWDFIIERMSFDGTEFTLWKFCHLQRGGFLLSPVRSGFIKKLNEFKNALGFLTDVQIETLALYSFGASHNQISEVLNIAVGTSKNRVNRILAALPIRTREEVFYFLFASGMAFSFCKVVTELIGSRVNKLLTK

SEQ ID NO: 11215 - protein, 137 aa, Klebsiella pneumoniae
KMTDSMKYLWLLLREDSSYIFMLMLVIVTTVVMSFFLQRLFVSWWGKSIILIMCIVVAITEVFGFLEPESTYKQIQTRKQDVIYTLKNCRISAFEAQQAGFLAKAKDAWSCPDGVTRYMDVRYRDKAEINKLSTEGK

SEQ ID NO: 11216 - protein, 87 aa, Klebsiella pneumoniae
PLYDDTYLFAENLGNFMAGKLLETIPSRISVYRSQQTFSILSLSAVGQERSFIRSSSMTASYIKLSLDFLTLQGNLACKEADLAGPV

SEQ ID NO: 11217 - protein, 174 aa, Klebsiella pneumoniae
YGHEWRRMSRQCTHYGRWPQHGFTSLKKLRPQSVTSRIQPGSDVIVCAEMDEQWGYVGAKSRQRWLFYAYDRIRRTVVAHVFGERTLATLERLLSLLSAFEVVVWMTDGWPLYESRLKGKLHVISKRYTQRIERHNLNLRQHLARLGRKSLSFSKSVELYDKVIGHYLNIKHYQ

SEQ ID NO: 11218 - protein, 174 aa, Klebsiella pneumoniae; identical to SEQ ID NO: 9228

SEQ ID NO: 11219 - protein, 71 aa, Klebsiella pneumoniae
PRDDHDQNNLHRFIDGHPEKMVQTGIHLQNAVTQRCRDAKDRAYNSENINRMAYRPVYAIANNGIECGAQS

SEQ ID NO: 11220 - protein, 678 aa, Klebsiella pneumoniae
CALECRREPAMKDKPYFMALPEMVRVEMKTVISVLTAHFFVLSAFIWLASPACADSGSDYKAGSDFAKQVQSNGLNSLKNFSGEQNLPGYTDSPDQTKYYGGVTASGDSSLKSDSALEFSQGDTGKAITESFTNRPPDQISQDAPFIQAAKDTESRADSIVGDTGQSCTAQVVNRSEFTNHTCERDLQVENFCTREATLKDNATTQKVNRTYQQVVTLNYARSTRQWSGNLTIPTNGRLLNASVDGEPLVIPWIEECDSEGKVRDSCKSAVSESLTLFERTFPIDVISWPRSESMCSGGQNTHCTKYTYDGKGKIHQSFGVDKAVNAGQNFSVSKTSRTVSSASQKPVQVTVTLVMEETETVYAPEVVWVESCPFSKDEGKKTGEECISPGGTRTITLGGGDYSFTEACWKYKDTWLTQPADNGSCESLMKNTACTLSSRQCAFSSEEGTCLHEYATYSCETRTSGKQMICGGDVFCLDGECDKATSGKSNDFGQAVSELAALATAGKDVAALNGVDVRAFTGKAKFCKKFAAGFSNCCKDSGWGQDVGLARCSSEEKALAKAKKDKLTVSIGEFCSKKVLGICLEKKRSYCQFDSKLAQIVQQQGRNGQLHIGFGGASSPDCRGITVEELQRIDFNMLDFTNFMDDLMKNQKIPENDVLTNKTKERIKEIMSQQSAQ

SEQ ID NO: 11221 - protein, 66 aa, Klebsiella pneumoniae
TLSERKSWGGNHPEATYQLWWFINRLKISFGYYYLSRLLLVFTSRLKFAYSECAFRNHKRMCIYSY

SEQ ID NO: 11222 - protein, 78 aa, Klebsiella pneumoniae
VSRFRAIAASCLSLADIGLPFRYARFAFVEEVVLSAERDIYRSPDTSEMSSERRILQNSQILQINNLLSICKRSFLKL

SEQ ID NO: 11223 - protein, 137 aa, Klebsiella pneumoniae
MISDANKAVNDLASIVPLLGGSSSRKDYEEARKLVEYLLEHDPGSPLVDMLTARIDAWEDNAVEFEEFNTRFEAGKNGVSLLRVLMQQYGLSQSDFENEIGNKSLVSRFLSGERSLTFDHMRALANRFQIPVSMFVD

SEQ ID NO: 11224 - protein, 165 aa, Klebsiella pneumoniae
QPGLRRLITETPPCGAAIRRLKMKTLLTLDVLKTMSSDELEDYRAAGEDFRRELSHAVMRDLTSPSGWSVNAEYRCEFGGFFPVQIRFTPPHGHFDVAVCSSGELNPRWIVVFVTRDSQPFSVVRVMDAFNPELITHTLDLIECLDAGGYSFASIISTLSQEGAQ

SEQ ID NO: 11225 - protein, 60 aa, Klebsiella pneumoniae
VPEESDPVCGLSVPDERGAARYDLQGNAVATVTAGEAQYASERMMKELLRTERMRSQSAG

SEQ ID NO: 11226 - protein, 87 aa, Klebsiella pneumoniae
GCRDSGAGELSEDVLATELCSGLVLLQSASAGRSEKTYHPGIELTGTFSANTQQLLADQLVEIEGQCNHLLLAQGKALLKSRSELLK

SEQ ID NO: 11227 - protein, 81 aa, Klebsiella pneumoniae
VNGDNEHPAKPNHRYKCTVYECITSVNSKIEFFRDGNHCQRTDHTNNKKNQAYTVKPCNVMSKYIVRFHFLIPYAAYFQIT

SEQ ID NO: 11228 - protein, 194 aa, Klebsiella pneumoniae
YDLDESKQTGSRMATKGSGSSSMACGAVHRQTPEAGARCVNRARRDLCGGYPVTGIPTATLFCGGRFYSSHLVAVVCNHLLFLQKQGNFRRIAASPENRYLIKCNILKYSAFILSGVIMNTGLRQVLRYAGVPVDAAEPVRRQFGSRLILIVTVALLPLLIVDVPLWLFVLSQIIWGSGMYIGISVASDKPDRR

SEQ ID NO: 11229 - protein, 87 aa, Klebsiella pneumoniae
LKMDKKYDFSLSYEALTRVCENAICEHIRRAGSLEGLGFALEYTKAYAILEVWSLLAAAGDTFPALIEKDRIYLLQLISGKNNIELH

SEQ ID NO: 11230 - protein, 802 aa, Klebsiella pneumoniae
QPPDSCPEAINRTPYFRKLENKKNKRRKCVIGGFNYNGEGATSSGLSSPSASDVANQFNSFGGTQIRASDVSNIRSDGNGGYMADIRGQIHTVSSEEGSTTVSGFDGVRSSSTGNGGSQGGQGPQGQSLVMHNGQMGYWENRSSGAGNNEHTTRAFVAVGPSEAEKAARAEKVAKEKQQAEEAAKAFAAKTAAASAAAEKERQNAISAAAAAGQHQTVPDARNNLNQATAEASRLKTVADNALNTAKNKRKEAIDAVPVATQAEKKYQDLQQSIKGLTLNNNGQYGTQKWEVISSNKEHDHWGYRFYPSGITKAQVDAAQNDAVNKRNAATSLASQATAAEQASLQASAAYNAAETRRQAAQAALASAEQAAAAERKRQEAEAAAAAAAEKKRQADAAAKAAEEARAIAEKAKALQARCTAADKLKSSEIQAVRGIPATAAPFAIPLTWSTASRGGFTLSADAAASLGAFISEALATLSVAVVANPVALTIAGLVLSKSVGVGSDMVPGRDISSMMPGDAFGLPDTAALNKAADQKTSVSMPVRGRLVMNDSGILDVQLVKTNTAGAVKVARAVLDKETGYWGYTLPAVADVPAQTIFVSPADALGANGPLTLSGPVPLPERILHTGDQISAPQATDKTVTPVADDLDFDDIILVFPPESGLKPLYVMYRSPRNMPGTVSGKGQNVGNNWMGGASTGDGAPVPSQIADKLRGKTFGSFDSSRRAFWKAVADDSALSKQFSEADINQMKAGRAPTADFLESVGKRVKIELHHEKEISQGGAVMDVDNIKALTPKNHIETHKGK

SEQ ID NO: 11231 - protein, 77 aa, Klebsiella pneumoniae; identical to SEQ ID NO: 9235

SEQ ID NO: 11232 - protein, 77 aa, Klebsiella pneumoniae
CCQLTDLVYDGDFKVLAWLPFPSDVLPAPLLKAWCVTAKALPDISAISALIAVKHGNYSSLTPPLSPVRTRKSLIWP

SEQ ID NO: 11233 - protein, 957 aa, Klebsiella pneumoniae
LSFWGESVMLEIYAIAGGDWLRGNLNAIAAFMGTSTWSTIEKMCIAISVLIVAGNWVKKHNVMDLIGWVFSLTLVSMLVVIRTPVQIIDYSNVAQVYEVDNVPIGLAIPASLTTRAGNALIQSYEMVFALPDSVTYSKTGMLFGSNLVAKSTDFLSQNPQITTLFSDYVQNCVMGDIFLNHKYSFEELLNSPDPYTLIFANPSPLRGVFDKNNQFQTCEEASRDLKSALVLDTQTGGKTWNYYVRQLFGGKPNPDLLFSQMIGDSYNYFYSSGQSAGQIIRQNVTMNALRSGIQSYAARSGDTASLVNMANTSSLEKQRLAQATMGHQALRTLPLMQTVIMGIMIGMFPIMVMAAMFNMMTLQVLKGYVFALIWLQTWPLLFAILNSAMAYYAKQNGVPVVLSELSQVQLKNSDIATTAGYIAVMIPPLSWGIVKSMGAAFSSAYSHFSSSGLSATSQAASGVVDGNYSFANMQMENVSGYSWGTNSTTSFGQMSRQLANGGMSTQTRDGSMVWDSGGAMSKLPVDINVGRQIASAQQQMAREADVQAESALHGYNSSVTSAWNSLQQFGTNKGNSASTTTGADTTESSQDSMARSKMWNAVVANAKANNISNEESFQQLMDDSAKSTQGVDLYGSGKWSSGDQLFGKLGKWGTGLSAEAGVKGSAGWTHSSGNTDNVGTSGRESNDSRHDTSSQAAKDFKEASDYFTSRKTTTSGNITDNNASSRVDQFAASLSSAKNSYDQYTSSRTRSHEYSEMASRTESMTGQMNENLTQQFANFVQHRAPQDAEAILTNTSSPEIAAQREALAREFVKEQVEPRVDAAYQQGRESIGQNMAGVSGGGDNGSVMADYRQNSGRIDAMTQDAGIKDNVDQKVGGMITENKQQQQETRENIQRQGAEVKNENTEMEKDHKTKANEFKGDYNERKSKVKSLPGADSPTELEAKAAKIQKDYLDGKR

SEQ ID NO: 11234 - protein, 1761 aa, Klebsiella pneumoniae
CRDWGELLMMSIGSVKSAGSAGNYYTDKDNYYVIGSMDERWQGKGAEALGIDGKAVDKALFTELLKGKLPDGSDLTRIQDGANRHRPGYDLTFSAPKSVSVMAMLGGDKRLIDAHNQAVTEAVRQLETLAATRVMTDGKSETVLTGNLIVAKFNHDTNRNQEPQIHTHAVVINATQNGDKWQSLGTDKIGKTGFIENVYANQIAFGKLYREAFKPLVEKLGYETEVVGKHGMWEMKGVPVEPFSTRSQEVREAAGPDASLKSRDVAALDTRKSKEAIDPAEKMVEWMNTLKETGFDIRGYREAADARAAELARAPAAPVNTDGPDITDVVTKAIAGLSDRKVQFTYADLLARTVGQLEAKDGVFDLARKGIDAAIEREQLIPLDREKGLFTSNIHVLDELAVKALSQEVQRQNHVSVTPDASVVRQVPFSDAVSVLAQDRLVMGIVSGQGGATGQRERVAELTLMAREQGRDVHILAADNRSRDFLAGDVRLAGETVTGKSALQDGTAFIPGGTLIVDQAEKLSLKETISLLDGAMRHNVQVLLSDSGKRSGTGSALTVLKDSGVNTYRWQGGQQTTADIISEPDKGARYSRLAQEFAVSVREGQESVAQISGTREQSVLNGLIRDSLRQEGVLGEKDTTITALTPVWLDSKSRGVRDYYREGMVMERWDPENRTHDRFVIDRVTASSNMLTLKDRDGVRLDLKVSAVDSQWTLFRAETLPVAEGERLAVLGKIPDTRLKGGESITVMKVEEGQLTVQRPGQKTTQTLAVGAGVFDGIKIGHGWVESPGRSVSETATVFASVTQRELDNATLNQLAQSGSHLRLYSAQDAARTTEKLSRHTAFSVVSEQLKSRSGETDLDAAIAQQKAGLHTPAEQAIHLAIPLLESQDLTFSRPQLLATAMETGGGKVSMADIDTTIQAQIRSGQLLNVPVAHGYGNDLLISRQTWDAEKSILTHVLEGKDAVAPLMDRVPASLMTDLTAGQRAATRMILESTDRFTVVQGYAGVGKTTQFRAVMSAISLLPEETRPRVIGLAPTHRAVGEMQSAGVDARTTASFLHDTQLLQRNGQTPDFSNTLFLLDESSMVGLADMAKAHSLIVAGGGRAVSSGDNDQLQPIAPGQPFRLMQQRSAADVAIMKEIVRQMPELRPAVYSLIERDVHRALTTIEQVTPEQVPRKEGAWAPGSSVVEFTPKQEKAIEKALSEGKTLPEGQPATLYEALVKDYTGRTPEAQSQTLVITHLNKDRRALNSLIHDARRENGETGKEEITLPVLVTSNIRDGELRKLSTWTAHKEAVALVDNVYHRISKVDKDNQLITLTDSEGKERFISPREASAEGVTLYRQEKITVSQGDRMRFSKSDPERGYVANSIWEVQSVSGDSVTLSDGKITRTLTPKAEQAQQHIDLAYAITAHGAQGASEPYAIALEGVAGGREQMASFESAYVALSRMKQHVQVYTDNREGWIKAIKNSPEKATAHDILEPRNDRAVKTADLLFGRARPLDETAAGRAALQQSGLAQGSSPGKFISPGKKYPQPHVALPAFDKNGKAAGIWLSPLTDRDGRLEAIGGEGRIMGNEDARFVALQNSRNGESLLAGNMGEGVRMARDNPDTGVVVRLAGDDRPWNPGAMTGGRVWAEPAPVAPVPQAGADIILPPEVLAQRAAEEQQRREMEKKAEQTAREMAGEARKAGEPADRVKEVIGDVIRGLERDRPGTEKTTLPDDPQFRRQEEAIQQVASERLQRERLQAVERDMVRDLNREKTLGGD

SEQ ID NO: 11235 - protein, 360 aa, Klebsiella pneumoniae
  UNSURE (212): Identity of amino acid at the above locations are unknown.
RRDCQMLMQHIGVGYFGYYRATAYAMKHSLMPEIAKLRMKALNFWDKHGIRAAADAFDVSTRTLYWWRRLLRTGGPEALIPRSKAPLVRRSRHWHPDVLKEIRRLRTELPNLGKEQIFVRLKPWCEARHFTCPSTSTIGRIIAGAHDKMRMIPVRLSARGKARLIKKRSVKPRRPKQYRPVKTGELIGMDAIELRMGDLRRYIITMIDEHSXYALALAVPSLNSDITSHFFSKATKLFPVAIRQVVTDNGKEFLGNFDKTLQEASIKHIWTYPYTPKMNATCERFNRTLREQFIEFNELLLFEDLNLFNQRMAEYLVLYNSKRPHKSLELMTPVDYILRESKNCNMWWTHTTVRGHTGVD

SEQ ID NO: 11236 - protein, 160 aa, Klebsiella pneumoniae
LPLCASWLRVALSSSRCVTDAKTVAVSLTDLPGLSTQPWPILIPSNTPAPTARVCVVFCPGRCTVSCPSSTFITVMLSPPFRRVSGIFPSTARRSPSATGSVSARNSVHWLSTAETFRSRRTPSRSFRVSILLLAVTRSMTKRSCVRFSGSQRSITIPSR

SEQ ID NO: 11237 - protein, 123 aa, Klebsiella pneumoniae
PCICQFEGTMTVSASGRSRSSQLSGTASGAGNQAKRHSPFRLRDSWEGRSVRASSLLRQLAKGGCAARRLSWVTPGFSQSRRCNTTASESVIIVIVVSCVNCYPLTFSHNIRAGHIECKAWGA

SEQ ID NO: 11238 - protein, 79 aa, Klebsiella pneumoniae
NEVWAMEHVKGKIQQGAGNAYFAGMQWRGITLGHADAAALNQFDIDISKAQAPEARTWLLQNKAEFIALILGIEVVKVG

SEQ ID NO: 11239 - protein, 137 aa, Klebsiella pneumoniae
KNSCELSVCGASQLAEYNRGEEMDFEARKQKALAIMASCKMWKSNYAPLLIRLLWRLGINIPPLPFAPFWQVFGVMAGSFSVGYGLWMYWMVWRAQGMPPLFACKISLIAGVLFGLTMALFHLWRRKVNKLPDWKDL

SEQ ID NO: 11240 - protein, 69 aa, Klebsiella pneumoniae
PAACPCQTCGWLVLDAKPSLLKKLFMSPLTSAAAVNDTPSNIPQSTDNGLRMNIRLSFFHFIFPSKVAV

SEQ ID NO: 11241 - protein, 141 aa, Klebsiella pneumoniae
VQCCLTTQMAKYKESRTMRYWLLVILMNVLFYFIVKHVAPEWYGSPCYYAGQIICTLIAAVITWRDPPDWLDGILLGVIKFGVLIAGIIFFVWGIGYKLAFWGQHDPNTIYASANDVILPNLALGTGVLIAGWVYIRYLKR

SEQ ID NO: 11242 - protein, 108 aa, Klebsiella pneumoniae
GPGCLRPRSNYAQRALTFTLGFSMVPGQKVGKGYASTRAAVFPFQAHTVNPPVIGEGLTFIPSSTKHLLQLTVTDAVFQVQAYGPQNDVTLIMPALNGFMCSSISKRG

SEQ ID NO: 11243 - protein, 104 aa, Klebsiella pneumoniae
GNRLHDINAFSYFIENSQNFVSTFDNPSHNITFMRYTNLTKRRTAHKAICAYKTEHTRDHLITGRSIMRVKKNDFGYFCSFIGPFTAKSYHMLSMPPFILIPYS

SEQ ID NO: 11244 - protein, 270 aa, Klebsiella pneumoniae
SRQCGAWATCWRSRMHSKPSRRPFSLALRLTFFISLSTILAFIAFTWFMLHSVEKHFAEQDVSDLQQISTTLSRILQSPADPDEKKVSKIKESIASYRNVALLLLNPRGEVLFSSAQGAALRPAVNSADFSEHSRARDVFLWTVEDPAGPMDTGSEMKMETYRIIASSGQAIFQGKQQNYVMLTGLSINFHLHYLDALKKNLIAIAVVISLLIVLIIRIAVRQGHLPLRNVSNAIKNITSENLDARLEPTRVPIEPGTTGYLVQSYDWKD

SEQ ID NO: 11245 - protein, 112 aa, Klebsiella pneumoniae
SEWCMKWRYSLRWKLPHRPCPGPRELISVVVEAGQAAPEEVMSRWVAGSGYAVCVDFLGQKQIQRWSDERKAAVRRRNMQARINRVAPLFADELIERELAARPEYFNGKSAR

SEQ ID NO: 11246 - protein, 341 aa, Klebsiella pneumoniae; identical to SEQ ID NO: 9238

SEQ ID NO: 11247 - protein, 255 aa, Klebsiella pneumoniae
DVDRHVRGSNFHHNEIRSLPGVFFELSRFSGAKEAKMEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGA

SEQ ID NO: 11248 - protein, 147 aa, Klebsiella pneumoniae
WRTRIMDNLNKIYSSIPVLERNKRLKLSRQKRFDVYYCLAFMFGFAGLFLWWGSHAFFNVFTDLLTPPEKLESANNIINQWNVLMYFVPFILFSLSIGCLATALLGVLIAELAFWFEYAFEKSFQRYLNRNLRRKNKMKEGEPDVHP

SEQ ID NO: 11249 - protein, 883 aa, Klebsiella pneumoniae
RNDRMSNNIIDTVTQAVNSLVSALKLPDESAKANDTLGSMNFPQFSRILPYKDYDSATGLFINNKTVGFMFEARPLPGADKSIVATLEHLLRSKLPRGVPVSFHLVSSKLVGNDIDYGLREFRWSGKQAKKFNAITQAYYLRAAETKFPLPPDLDLPLTLRNYRVYISCCVPRKKNSTTQIVEMENQIKILRASLGGAYIPTRILDASGLVELMRELINPDPHEMYRVPYKLDPYQDLNYQCVDDSFDMQVTAGHLKIGRLGRDGKECVTRVTSYHLESDPEMAFLWTAADNYANLLNPELSISCPFVITLTLMVEDQVKTQNEANLKFMDVEKKSKTSYAKYFPNVIKEMQEWGDIRQRLSTNQTSLVSYFFNITTYTADSTEASLAAEQQVLNSYRKGGFQLIPARYHHLRNFLAMMPFKCGEGLFKELQAAGVVKRAETFQVANLLPIVADSPLAPAGLLAPTYRNQLAFIDLFYEGMNNTNFNMAVCGTSGAGKTGLIQPLIRSVLDSGGFAWVFDMGDGYKSLCENMGGVYLDGDTLKFNPFANVLDDAHFDMSAERIRDQMSVMASPNGNLDEVHEGLLLQAVQAAWLSKRNQARVDDVVQFLQDAKDSDEYADSPTIRGRLDEMIILLDQYTVNGIYGDYFNSDKPTLHDDARMVVLELGGLESRPSLLIAVMFSLIIYIENRMYQSPRGLKKLNVIDEGWKLLDFKNEKVGQFIEKGYRTARRHTGAYITITQNIVDFDSPTASSAARAAWGNSSYKAILKQSAKEFAKYNQLYPDQFSKLEKDMINGFGSAKEQWFSSFMLQVEANCSWHRLFVDPLSRAMYSSKGPDFEYMQARRQEGVDIHDAVYGLACRNFKDEMAELESRIPVNDMEDKQ

SEQ ID NO: 11250 - protein, 140 aa, Klebsiella pneumoniae
TTLRTQRPSPGLIRQTHRKIRAASADGAYDTRLCHDELRRKKISALIPPRKGAGYWPGEYADRNRAVANQRMTGSNARWKWTTDYNRRSIAETAMYRVKQLFGGSLTLRDYDGQVAEAMALVRALNKMTKASMPESVRIA

SEQ ID NO: 11251 - protein, 247 aa, Klebsiella pneumoniae
RQVRVMKDINIMWNALSKNRIFDGNKELKEFIMTLTGTLIFGENSEITQLPARTTDQDLIRAMMEGGTAKIYHCNDSDKCLKVVADATVTITSNKALKSQISALLSSIQNKAVADEKLTDQEKGFISSTTIPVFKYLVDPQMLGVSNSLIYQLTDYIGYDILLQYIQELIQQARAMISTGNYPQSTMDMIMENLNQASVQIAAFQSRVQVQQDALLVVDRQMSYMRQQVSARMMTRYQNNYHFGGNL

SEQ ID NO: 11252 - protein, 324 aa, Klebsiella pneumoniae
IMKRAPVIPRHTTHTQSTEDTSSPAPAAPMVDSLIARVGAMARGNAISLPVCGREVKFTLEVLRGDSVESASRVWSGNERDQELLTEDALDDLIPSFLLTGQQTPAFGRRVSDVIKIADGSRRRKAAILTESDYRVLVGELDDEQMAALSRLGNDYRPTSAYERGLRYTSRLQNEFAGNISALADAENISRKIITRCINTAKLPKSVVALFAHPGELSARSGEALQKAFADKEELLKQQAETLHDQKKAGLIFEAEEVISLLTSVLKQSPASRVNLSSRHQFAPGATALYKGDKMVLNLDKSRIPAECIEKIEAILKELEKPGV

SEQ ID NO: 11253 - protein, 64 aa, Klebsiella pneumoniae
SDRRYEWDRGPSLIIRPTIQVEQWAQREYSGQLCFLACEKGNEVKGDNRRLKRVRIRLLVSQAP

SEQ ID NO: 11254 - protein, 236 aa, Klebsiella pneumoniae
NDISSQPGSMMKILIVEDEIKTGEYLSKGLTEAGFVVDHADNGLTGYHLAMTAEYDLVILDIMLPDVNGWDIIRMLRSAGKGMPVLLLTALGTIEHRVKGLELGADDYLVKPFAFAELLARVRTLLRRGNTMITESQLKVADLSVDLVSRKVSRAGNRIVLTSKEFSLLEFFIRHQGEVLPRSLIASQVWDMNFDSDTNAIDVAVKRLRAKIDNDYGTKLIQTVRGVGYMLEIPDA

SEQ ID NO: 11255 - protein, 90 aa, Klebsiella pneumoniae
AKYSHSPYLFCRTFNKGVAWKAERGQSPPGLLSSLNSKREASYEKGLFSMSGQTAFSSAGTEGKCSIPVRFLLYSQTEFSIVLNPNLFLL

SEQ ID NO: 11256 - protein, 392 aa, Klebsiella pneumoniae
RMFRMKLMETLNQCISAGHEMTKAIAIAQFNDDSPEARKITRRWRIGEAADLVGVSSQAIRDAEKAGRLPHPDMETRGRVEQRVGYTIEQINHMRDVFGTRLRRAEDAFPPVIGVAAHKGGVYKTSVSVHLAQDLALKGLRVLLVEGNDPQGTASMYHGWVPDLHIHAEDTLLPFYLGEKDDASYAIKPTCWPGLDIIPSCLALHRIETELMGKFDEGKLPTDPHLMLRLAIETVAHDYDVIVIDRAPNLGIGTINVVCAADVLIVPTPAELFDYTSALQFFDMLRDLLRNVDLKGFEPDVRILLTKYSNNNGSQSPWMEEQIRDAWGSMVLKNVVRETDEVGKGQIRMRTVFEQAIDQRSSTGAWRNALSIWEPVCNEIFDRLIKPRWEIR

SEQ ID NO: 11257 - protein, 261 aa, Klebsiella pneumoniae
RRWLLVCQHHQHAVTGRRTMIPSSSALVSLKPARSAALHAIMTVEYAPQLRARLPSMPHVRTFLPLLTGCSRINSDVARRIPGIHRDPKDRLSSLKQVEEALDMLISSHGEYCPLPLTMDVQAENFPEILHTRTVRRLKRQDFAFTRKMRREARQVEQSWLLRQNLLGQAVTELNFQSPETVCTWYTRWSDEFDAAELAAPFWRWQSRFASLKELDWLRISGEPLYAVMYEIPFIVRETPEHIRVAERWQVPNKLADRSGV

SEQ ID NO: 11258 - protein, 106 aa, Klebsiella pneumoniae
PSNSNEEVKVIPFNPGERALRRLRRKGRDFRGLSGGSLLLTLRGMFINYFSDTRELNTVAAKPYPLKTAQTPLYAVGVVPTRRQPQSGRISALAGRRAAYERVLNN

SEQ ID NO: 11259 - protein, 125 aa, Klebsiella pneumoniae
CCRLYPRNAFVNQLKLCVGSLAIEHTGIENVVTWPEQRHIWSGCFNNTGSVVSHNYRIACRGTDVSPAFQVPWVNRDRPDSDQKITPLGHGWVGKRQIFNNGCTFPGLPETNGFHSVSLKRSVTR

SEQ ID NO: 11260 - protein, 306 aa, Klebsiella pneumoniae
DPERSRGVRPVAKMDSARALVAKGRGIALVSRTMGVSRAQLSLRINRSADWQDKRCNRRNDEADEEILSAILDIISDMPSYGYRRVWGILRKQRRTEGQPPVNAKRLYRIMSEHNLLLLHDKPERPKREHKGKIAVAESDMRWCSDGFEFGCDNGEKLRVTFALDCCDREAIDWAASTGGYDSSTVQDVMLRSVEKRFGDRLPDTAVQWLTDNGSAYTAYETWRFARELNLEPCTTAVSSPQSNGMAERFVKTMKEDYIAFMPKPDVRTALRNLAVAFTHYNENHPHSALGYHSPREYRRQRTSLT

SEQ ID NO: 11261 - protein, 375 aa, Klebsiella pneumoniae
MIMSDNDTIPKKSTSQINKAVFFTSALLIFLLVAFAAVFPDVADKNFKLLQQQIFTNASWFYILAVALILLSVTFLGLSRYGDIKLGPDHAQPDFSYHSWFAMLFSAGMGIGLMFFGVAEPVMHYLSPPVGTPETVAAAKEAMRLTFFHWGLHAWAIYAIVALILAFFSYRHGLPLTLRSALYPIIGDRIYGPVGHAVDIFAVIGTVFGVATSLGYGVLQVNAGLNHLFGVPINETVQVILIVVITGLATISVVSGLDKGIRILSELNLGLALLLLALVLCLGPTVLLLKSFVENTGGYLSELVSKTFNLYAYEPKSSKWLGGWTLLYWGWWLSWSPFVGMFIARVFPRANHSRVCHRRAVCSRGFYANVDDSVW

SEQ ID NO: 11262 - protein, 85 aa, Klebsiella pneumoniae
LIKRPIIMKINFHKQHAIDFVLRLTLTIIIISPVIYFSWDAVKATSGSDYVESVVFIVAVGFFWFVSYLFFSSLAALLRKKTEEE

SEQ ID NO: 11263 - protein, 218 aa, Klebsiella pneumoniae
KKESLMFIRKPLSVLCGMLLGVSLTAAADVNGDMNNFFNKLGFASNTSQPQVWQGQAAGYASGGSLYARTQVKTIQLVSMTLPDINAGCGGIDAYLGSFSYINSEQLQRFAKQIMSNAAGYFFDLALQTTVPEIKTAKDFLQKMATDMNSMNLSSCQAAQGIVGGLFPRTQVAQQKVCQDIAGESNIFSDWAASRQSCTVGGKMDSVQDKASDKDKYV

SEQ ID NO: 11264 - protein, 256 aa, Klebsiella pneumoniae
RRAGEESGGVSAAASCGHSGFTCRGSGRARCDPQHPARHCPPDERRTVMIRLKDCLLAACLVSPLTQAADLGTWGDLWPVREQDMLQLITQRLQSLQSSGQWDQTMDAFKQRVIENSQRPAPVEGIKRAEKYEQRWFDPSIRLTEDLKDNEGRVFARKGDVVNPLKTVPFVQTLYFINGDDADQLAWMKRQVPETLMSKIILVRGSIPDTSAALDSRIYFDQNGVLSKRFGLTAVPARITPAPSGERLNIETFPVK

SEQ ID NO: 11265 - protein, 385 aa, Klebsiella pneumoniae
FENGCPERLNMPGAQFNVTDADRYPQLNASSGITYNGGLKGDKPTTQEYDAGLELSYELDFFGKLKNMSEADRQNYFASEEARRAVHILLVSNVSQSYFSQQLAYEQLRIARETLKNYEQSYAFVEQQLVTGSTNVLALEQARGQIESTRAEIAKREGDLAQANNALQLVLGTYRALPSEKGMKGGEIAPVKLPPNLSSQILLQRPDIMEAEYQLKAADANIGAARAAFFPSITLTSGLSASSTELSSLFTSGSGMWNFIPKIEIPIFNAGRNKANLKLAEIRQQQSVVNYEQKIQSAFKDVSDTLALRDSLSQQLESQQRYLDSLQITLQRARGLYASGAVSYIEVLDAERSLFATQQTILDLTYSRQVNEINLFTALGGGWVE

SEQ ID NO: 11266 - protein, 293 aa, Klebsiella pneumoniae
TDVGILNLTSACPLRMAQNISWYGMIAPEESQFRVVNVKPVTLYDVAEYAGVSYQTVSRVVNQASHVSAKTREKVEAAMAQLNYIPNRVAQQLAGKQSLLIGVATSSLALHAPSQIVAAIKSRADQLGASVVVSMVERSSVEACKAAVHNLLAQRVSGLIINYPLDDEDAIAVEAACANVPALFLDVSDQTPINSIIFSHEDGTRLGVEHLIALGHQQIALLAGPLSSVSARLRLADWHKYLTRNQIHPIAEREGDWSAMSGFSQTMQMLNEGIVPTAMLGCQRSDAVGRIAR

SEQ ID NO: 11267 - protein, 172 aa, Klebsiella pneumoniae
GYSGIWHGGEFMKGAAFGIILSLIPLSSMAADCFDMAGRDYKIDPDLLRAISWQESRFKIDAIGRNPVTGYGSGLMQIDSQHFNELSRYGIKPDHLLSDACLNIYTGAYYLAQAFKKWGVSWDAVGAYNAGFKKTPRQAARRYEYAKKIHYYYTAIKASKRTSSKDQKIAMN

SEQ ID NO: 11268 - protein, 79 aa, Klebsiella pneumoniae
VSGGSIGIIYFLATYCYAVITFPIDSEHFLTNGIMNRHTSPTKLWWLTAFGCLYIDNFFLCLDLCHFPAPPTEDDVLVW

SEQ ID NO: 11269 - protein, 139 aa, Klebsiella pneumoniae
ISPGISLCVSRDMTGSDIAINNLYSNKDEKIPPKAATPHRCTNKLRNCSPFRSGIHRLFDELILTHQKGDASMARGPGRGIESLQNISDRFCQLVFKNRLGFRELEVNFISVRDDASLVFVLITRFSTCLHFCAGCSLT

SEQ ID NO: 11270 - protein, 88 aa, Klebsiella pneumoniae
RQPGRTSVCPPGFMNEGCHHAENLQRFRIRVQGREVRVHRLQGWPRRQKQAFYRKFTLNFRDNNIPVPRLFCFIHDQQIAGIEANISH

SEQ ID NO: 11271 - protein, 87 aa, Klebsiella pneumoniae
SFQGQVLSQVNRNGGFVNTTFVSSNTNHRRKRIFSTAQSCTKYIPHVIDLLDGITNALLNSSTGFHIRVRQPASFLGISDSLRRNPN

SEQ ID NO: 11272 - protein, 429 aa, Klebsiella pneumoniae
NPEGRLMFALADVNSFYASCEKVFRPDLRGKPVVVLSNNDGCVIARSAEAKLLGIKMGTPWFQLKEAQFPEKLYVFSSNYELYASLSNRVVALLEELSPRVEQYSIDECFLDARGIGHCMDLEDFGRQLRGHVLSGTGLTIGVGFGATKTLAKSAQWASKEWPQFRGVLALSPENPRRTAKLLSLQPVEEIWGVGNRIAKKLHVMGITTALQLSLTNPTFIRKNFNVVLERTVRELNGESCISLEEAPPPKQQIVCSRSFGQRITTYEEMRQAVCQYAERASEKLRGERQYCRHISTFIKTSPFAVNEPYYGNVATEKLNTPTRDTRDIIAAAVRSLDRIWLDGHRYAKAGIMLNDFSPNGVAQLNLFDDVQPRPHSDALMKVLDGINHSGLGKVWFAGRGIAPDWQMKREMLSPAYTTRWKELPVARF

SEQ ID NO: 11273 - protein, 98 aa, Klebsiella pneumoniae
KLIFMIIGLFISQHGLLRGLLTHDFLNSFLGLIGENIVFRYFLIFHQVVHKIGEIKHVKVDPLELFNRNPPTVRTAGAAKTDMQLTISSLLLNDLRQF

SEQ ID NO: 11274 - protein, 122 aa, Klebsiella pneumoniae
RLIISAGQLSGVLMVGILMFEFKAVCISISHMEEGDIRVLQVLSSTTNYLTCDSYLEWIHDTPYGCVIRMYDFKRHLLALKRGGVSKFLRKNLILMHREGGYLLFHFDSDADYYPGIDAVDF

SEQ ID NO: 11275 - protein, 777 aa, Klebsiella pneumoniae
RMILRLYIMELLNFLAAIFVIYLLFFRKKKRKSPKSYASDPVKAPPKEWLADIKKKEAVVRNDDSEDDNLATFTLSGGRGVELRVTTNHYRNTSKSAGALARWVLPGEMITVAGVAISGGHIYVGQRMKPSGQESGGYYDDGSEASLIDDTCKIKPTSYLYEDSSLGYWPSFSSLSPEARGAYVSWLASDRSDPSCPIGYVFIYLYGLERKALVDSTDPKFPDAEFRNLFNEVARLRSIFIENRSFRGYSTQLLEAMSILRPNMGLATELDSNSGFSNSMQFKLALAKTVHEGVPVSAELALNWVINHTEYSLRTPARRCAKEFAALFKRRYTLKYGEGMVVKANKTRLRLDYTPASPSLRGVRLPVPDLPDPSALKSPVQKIMALADICTDELDAYSRYLGRKGTSVNDTAAIMLLPSEIVNESAEKILSSFKRWADEAILVKEGLVSVADFWAHMNASCPNKINKKEADLMQAFALKMGYGLAPDPYYHHVKADVDGTLVLFPAAEGGRFSPSPEFISAVMTLRLGAMVALIDDSLDQAEQKVLENAINNNPGFTDDEKRSLHAYLTWQLHTPANMTGMKSRIELMGAAEKAAVGKVIVSVACSDGTIAPAEIKQLEKIYSSLGLDPSSVSSNIHQHSATEHDLVSSVPTDQPAAGFTLDANVLARHESATDDVRKLLNTIFTEEEPEEPESAPASSTEAGGLDSAHSQLYRSLLEKEQWSRKEATELCGNLNLMLGGALEVINDWSYAVVDAPVLDDADDDIWVDLEIAKELEG

SEQ ID NO: 11276 - protein, 99 aa, Klebsiella pneumoniae
ERNICVPFLLLLNLRMSQWNIASFSKEEQDKVAVDKVAADVAWQERMNKPVMPELVEREQPEHLREYFHERFRVHRLNSQQLPRANAPEYNKPGDDQQN

SEQ ID NO: 11277 - protein, 133 aa, Klebsiella pneumoniae
GMDMAKIQAYVSDEVAEKINAIVEKRKAEGAREKDVSFSSVSTMLVELGLRVYEAQMERKESGFNQMAFNKVLLETVLKTQFATNKILGISCLSPHISGNQKFEWRFMIDTILEDTKEVVDTFFPESEDGEEE

SEQ ID NO: 11278 - protein, 106 aa, Klebsiella pneumoniae
SVRMSLMFAAVTLLTGINLFFIPFQPVPALWGAILAVAFVLINVVADKLRLWSGIAWIIVAGIIITLMLKGKEPGDEFRVLITVFAFLASIWYSVAQFRKENKLRS

SEQ ID NO: 11279 - protein, 117 aa, Klebsiella pneumoniae
NSLMKRLQAFKFQLRPNGQQERDMRRFAGACRFVFNRALALQNENHEAGNKYVSYTKMASWLIEWKSHPDTQWLKDTPSLPLQQSLKDLERGYKNFFQKRAAFPRFKKRGQNDARKA

SEQ ID NO: 11280 - protein, 71 aa, Klebsiella pneumoniae
VSIIIQWSDVHPQYICSHVNVAVVQHHLETNRLTGFNTLKFHCWLNTLLNDFYHLNHWVNFNCDLLLTLAI

SEQ ID NO: 11281 - protein, 185 aa, Klebsiella pneumoniae
VGVITQAQLSKEDRIYVKKSIRWLTLKRPGNLTPAEQKALEVVKQAIPALAMAYDFKEAFFCIYDEPDKQSAQNAFEAWKNSLPPYGMEPFKKLVKTVHNHYDDIFAYWDAPFSLTNGYTEGLNGLIKMSNRLGRGYSYEIIRAKTLYSKEARKVGSGIRAGRGKVEYGPHIPTLLKQAEGGELD

SEQ ID NO: 11282 - protein, 89 aa, Klebsiella pneumoniae
AVTMILNEKVVTASILDASMFRMLSTASAPTFTETDSGIIDLKRIDKRAVIIATMANNVALNHSFLTVCFRIHFQREIILHSSYCGRDK

SEQ ID NO: 11283 - protein, 84 aa, Klebsiella pneumoniae
VRHIVQRQVSADDFMCFTVNGEMQLTPDTAAFLAMLFDFPLAFTEDLQPGGINYQVCDFTPGGRFETDINRLCLPADTAVIRAA

SEQ ID NO: 11284 - protein, 682 aa, Klebsiella pneumoniae
EVSIMSATESKVKTAPKTSKKTLKSAEAEALKVALDAAQVEYVPVSALVKSPLNVRTIPYPAEKVCSMADSIEAIGLLQNLVVHNLPDGRCGVAAGGRRLKALQLLQSENRIDAGYQVMVKKVPDELAVAASMAENEQQMAMHPSEQIAGFRTLAEQGKTPAQIGDLLGFGTRHVQRMLKLTELAPEILAALAKDEITTEHCQALALESDQKRQVEVLESARKRSWNNEVSVSSIRNLITSEEVSTNGDKFRFVGEAAFSPDEIRVDLFSSENRGYVKSASLDTALLEKLQNIAEHLREAEGWSWCDGRLDPISHYGKDTKIWRLHAVPPVEYTEAESERLAELEALEAKYEDENPSVNDDVVAGALEAVWEEQQTIAHRAKHRAWTDEMKQSAGVVVSWTGQEVKVQRGVVLCADEKMEEKDASTDQAPEKVDPLDAVSVPLLTRLSSERTLAVQAALLQQPQKAVALMVWKMCNSVFHTTTSVKEPFCISVSVSHYALTREAPDGENSVAFQAIQSEKERLEALLPENWRKDMTTFFTLDGATLMALMAFCTACSIDGVQGKDEFGRKHQNSLDGVENAIQFDLRDWWKPTADNLFSHMKLPHIVQALSQTGLAGAAQDAAKMKKKDAAEHAEHFLSKIRWVPEWMTSADNQKQLAAKSELSLATSQNDTDVDAGDRHRP

SEQ ID NO: 11285 - protein, 80 aa, Klebsiella pneumoniae; identical to SEQ ID NO: 10772

SEQ ID NO: 11286 - protein, 105 aa, Klebsiella pneumoniae
HLKIILRHIKENKMAGNKISDFTEEEFTAFVSKIIAADFPTDKENDDAIYSFAQLTEHPAGWNLIFKPKVGEDSSAKGIVKTVKEWRAANGKPGFKNRDWMCGFR

SEQ ID NO: 11287 - protein, 179 aa, Klebsiella pneumoniae
KVKMMITNKLLIEEVEELKNLLSQGKTEIPSFWKCLWPGVVLVAWNMLCAVISVDAVYLTGKYIFHVLVFPVGVSIIMLLGIASSRSLFLSVPKNFREKSNIYRFFSKKVLIYAVVYMAVIMLLAICNRVVYDTPFSFAFMVILTSVFFGFVMNLDFGRYQLSLLTSAINSFRAEKLGG

SEQ ID NO: 11288 - protein, 76 aa, Klebsiella pneumoniae
LLKISITQKIRPVVILFHYGESWNLLRADQRLIFAKSWPRASRYQQGHQDLFILRSDLPSQVFIRRKVRRVMLPTY

SEQ ID NO: 11289 - protein, 339 aa, Klebsiella pneumoniae
GDRMKAVGFWQPGESTSVIEDLSLPHPSMPKGRDLLIRVRAVAVNPRDLKSRRNISPSAGNPVVMGYDASGVVEATGPDVTLFRPGDHVFYAGVLDRQGANAEFQLVDERITGIKPAALSFEAAASVPLTGLTAWEMLFDRLQLSVNGDADQTLLMLGGAGGVPCMAIQLARTLSRVNIIGTASRQESVRAVRGFGAHYVLDHSCALAPQVASLAGLPPITRIFSTYTTPSAWENMAEIIAPQGRIGLIDDPEPLDLRLIKFKSVSVHWEAMFTRPMHATADMSKQHDILNKLSCMLDSGKLKPPLLAEYGRLNAKALRRAHEDMENKNVNGKIVFSGF

SEQ ID NO: 11290 - protein, 188 aa, Klebsiella pneumoniae
LLLIWPLMSEEKRPVLSLKRKPAENSTAPAEATPAPGVVRRKKVVVVSSPPAWKAKKEKLEKVKQAAEAAARNAAPVPVKAVKTPPPVRYLRLLPPEQAIMTLKAFWPQLFDGNSPRLLATGMREQLFADIVNRDLPLSHKQVIKCLKSLTRSAGYLSRMKEEPPAMICRGTPSRPSLQGKRSTPASA

SEQ ID NO: 11291 - protein, 66 aa, Klebsiella pneumoniae
LSAISVCVTKLVMGVLISCAISAEKLGLAGKDFLNLSNHMIERDNQLFQVQWERVSVPVAHQDSRR

SEQ ID NO: 11292 - protein, 326 aa, Klebsiella pneumoniae
PLKMKIMTNHKEENRLLSLYSMGILDTKYEERFDRLTRIATKLFDVPIALVSLIDRDRQWFKSCYGLKIKETDRSDSFCTIAVDLSEPLIVPDASLDPRFKENKLVKNDPYIRFYAGHPVRLPDGEIAGTICIIDTEPRVLTRDDFLLLKDLAEIVEDEFRIINEATTDPLTGICNRRSFALMTDESLRKAKKKKKTFCVLIIDLDNFKPINDNFGHSEGNEVLCNFADMLEDLSSSKSVVARLRGDEFGVLLPHSTYAEPYEFLPLLRAWITSYNLNSQKKYNIDFSAGIIEYDEKIHTECSAIMQDAHERMYEIKKGKRYYMKK

SEQ ID NO: 11293 - protein, 341 aa, Klebsiella pneumoniae
PLRIKMTSENNSLLLNLQEVDKTTGEVVKLDVNSTSTVQPVALMRLGLFVPTLKSTGKSKANRKNVTDATEELVQLSIAKSEGYTDVKITGSRLDMDTDFKVWLGIIRSMSEYGVKSDTLELSFVEFVKMCGFNSRRSNKKMRDRISNSLFKLASVTLKFQSETKGWTTHLVQSAYYDITEDIVEIKAEPKLFELYHMDRRVLLRLKAIDALQRKESAQALYTYIESLPQNPAPISMKRMRDRLNLTSNVYTQNHTVRKAMEQLRDIGYLDYTEFKRGRATYFSVHYRNPKLISGPVKVPRKAEEEKAPEQNYDEVIKALKAAGIDPLKLAEALSAMKPEN

SEQ ID NO: 11294 - protein, 103 aa, Klebsiella pneumoniae
IRHFADWRKCRMKYKTLSQVHTEAMNDHEYSAAFEAEEASELLRETLATWRKEAGLTSAQVAERMGIKAPTISRMEKNASRMSIQTLVRYARACGVNFKIQQV

SEQ ID NO: 11295 - protein, 80 aa, Klebsiella pneumoniae
GVNFMIVSIFSPSAGAVKPRRHSRILRADITAPEIDPALRAFGRHIARSHRKGRGVHIPAMKNSALGQVLRTLELKRAFN

SEQ ID NO: 11296 - protein, 189 aa, Klebsiella pneumoniae
GNTVKKMNRTLHKCCLSGLISLALCAPVPAVYAASIETGYSPEGTALQLVLKTIDSAQQEIRLMGYSFTSPEVAGALVRAKRRGVDVKVVLDWKANTGKQNQASLAAMNLLVNAGIPVRTVSQYKIMHDKVIIADGRNIEVGSFNYTRAADRVNSENVLVVWDDPVVAQRYLQHWLTRWSQGTDWKRAY

SEQ ID NO: 11297 - protein, 90 aa, Klebsiella pneumoniae
LTDFIFQQLSFLFCCKLMKALREIPQGYRGVPGRKSRSALFSSVSCLTCTSWHYSNSPKNRKTAINPRHYWLHGGSEQKNDPLRIWFYPQ

SEQ ID NO: 11298 - protein, 335 aa, Klebsiella pneumoniae
NKDVSVKTLTLFLSALMLWGYSLSAAADPSCEGRFVNPITDVCWRCIFPLSLGSVQVGKGDLPDTSNPGSPLQLCPAPPPIFVRPGLAIGYWEPMAMTDVSRSPGCMVNLGGFSINLGKTGMGTARKDDKQVNGAFYHVHWYKYPLTYWLNIITSAGCLEGGDMDIAYLSEIDPTWVDSSLTTILNPEAILFANPIAQGACAADAMASAFHMPLDILFWCAGSQGSMYPFSGWVSNESSPLQSSLLVSERMAYKLHRQGQIMESIGKDKAVCYEYPSPIIPKERWRYQMVNMYPDSGQCHPVGRSVMRWEAGKNPPNTRKNYGYLMWRKRNCVFL

SEQ ID NO: 11299 - protein, 85 aa, Klebsiella pneumoniae
IRCFTYSPAPGYFPGFRTVIIKLRNGDSLRHFMTSTYALVECFHEFHSEHPLIIALRFFIKSCNLLQSNNKIAKCTKKCKVNRIG

SEQ ID NO: 11300 - protein, 84 aa, Klebsiella pneumoniae
VRNVVQRQVSADDFMCFTVNGEMQLTPDTAAFLAMLFDFPLAFTEDLQPGGINYQVCDFTPGGRFETDINRLCPPADTAVIRAA

SEQ ID NO: 11301 - protein, 94 aa, Klebsiella pneumoniae
GACVASISIRCPSCSATEGVVRNGKSTAGHQRYLCSHCRKTWQLQFTYTASQPGTHQKIIDMAMNGVGCRASARIMGVGLNTVLRHLKNSGRSR

SEQ ID NO: 11302 - protein, 67 aa, Klebsiella pneumoniae
YGIVFTLVTPFSMSKLKRFHRSGVNTTTISGSFYTYIRKMWRVTVKTWPISLKGLLRICFSSQPIPG

SEQ ID NO: 11303 - protein, 94 aa, Klebsiella pneumoniae; identical to SEQ ID NO: 9277

SEQ ID NO: 11304 - protein, 90 aa, Klebsiella pneumoniae
NKAVKRAEADGVHFSIPVTPHTFRHSYIMHMLYHRQPRKVIQALAGHKDPRSMEVYTRVFALDMAATLAVPFTGDGRDAAEILRSLPPAG

SEQ ID NO: 11305 - protein, 151 aa, Klebsiella pneumoniae
YTEVSMKKVVLMALALGLSLPAMASEKVIDMYKSENCGCCSLWGKAMEKDGFEVRTHVMNDQALSALKEKHAIPAGLRSCHTAVAGNLIIEGHVPATTIHKAMQSGSGIYGLATPGMPAGSPGMEMGARKEAYDVIAFSPDGSKKVFQRIE

SEQ ID NO: 11306 - protein, 143 aa, Klebsiella pneumoniae
GVLFVRLLLLKSRVEVQVRRMTTRPALGPCVSFKLDEDTHLKLVNAKERSGRSKAGEVVLRVKDHLLRYPDFYPTVTYKSVSFGPVVMARFDEDTNKKLIAAKNKSNRSKSHEVYLRLKAHLFEFPDFYSSEVEVIRRSVSET

SEQ ID NO: 11307 - protein, 73 aa, Klebsiella pneumoniae
TALFVCNITLLVAADNYSAPSRDGIDESSRKNLESLKMCPYLRGLECHLALIQHSAADMCYVQVDTVLKIRSR

SEQ ID NO: 11308 - protein, 162 aa, Klebsiella pneumoniae
TASFPCKIQQNASLFLPTAPAVDFATAVALRRMATSTGATPAYLLAPEVSALLWYMPDQRHHMLFATMWNTGIRIGEARTLTPESFDLDGLRPFVRVLSEKVRARRGRPPKDEVRLVPLTDASFVRQMESWMVTTRPRRREPLWPVTDETMRNWLKQGGEAG

SEQ ID NO: 11309 - protein, 63 aa, Klebsiella pneumoniae
QSTFYIPQSIQTDVKASYSACWSDPGISFGSHYDLLGINYWIETLNNSDTRPEAPHQVSRTLA

SEQ ID NO: 11310 - protein, 743 aa, Klebsiella pneumoniae
AGESGIKDERSCLMDLYICEKPSQAKDLAGVMKASQRGDGFLHDGGNRVITWAFGHLLELYMPDDYDERYKSWSLETLPIAPESWRYNVRKSAFKQYKIVEGLVKKASTIYISTDYDREGEAIARSLLDRFRYSGPIRRVCLTALDESSIKKALNNVKDGKDTVSLYYAALARQRADWLVGMNVSRLYTVLARDVGFNHTLHVGRVITPTVALVCQRDREIAGFTPSPYWTLGVNVSVQNGQFAAQWIPPEECSDEQGRCVNKAYAEQVASQVNGANAVISKAETKPGKESAPLPFDLTSLQQYASKRWGYTAQQVLDAAQALYETHKATTYPRTDSRYLPESQKEDIPDILQALILSDQNVSGLVAGADPHRKARVFNDAKVTAHHAIIPTPARTDITAMSEIEFNLYDAIRRFYIAQFYSEFEFTKTSIEVQCGRHLFAASGKTPTKQGWKVLFASDSESSPKDEGEDTDAPVEQEKLPRVSQGEPALLNGAELANKMTRPAPHFTEATLLAAMENIARFVTEEKFKQILKDTAGLGTPATRASIIQGAVDKGYFKRQKKVLLATDKAHALIAVLPPAIKSPGMTAAWEQELEKVASGSGNMSVFMKQISTWICQMVEQLKVAAPVLTKEGGAMAKAFEGAKPPSHECFNCGGEMHRIKGKNGFFWGCQNEACKKTFPDNRGKPEKRIAAEDCPDCPDCGSPMRLRKGKAPGKKRASKFWGCTAYPDCKGTMPFKKSDFMD

SEQ ID NO: 11311 - protein, 240 aa, Klebsiella pneumoniae
GARSHRSVLYRHGRRHLPRYRGRCWPSGRHHRDQRNQATNSFHRGNQEMKNLNILTRKGSSRGEAQKEQAVRSAKMLGVGAALLILSGCSTFNIGKDEYSCPGMPNGVQCMSARDVYAATNDGNVPRPMKPEEVEAKAEADGEGSSNVSANSSSSGDPVIDNYVAPRLPDRPIPIRTPAQVMRIWVAPWEDTNGDLIVTGYVYTEIEPRRWVIGDGTPQSEPVLRPLQTVQHEPKSETTK

SEQ ID NO: 11312 - protein, 257 aa, Klebsiella pneumoniae
PDTLRMPKGARKYAQDKASNRADGGAGLSARQHRRAGLGRQEAITTAAKAAGYYVAGIYREKASGARADRPELLRMIGDLQPGEVVIAEKIDRISRLPLPEAERLVASIQAKGASLAVPGVVDLSDLAAEAQGVAKIVLEAVQIMLFRLALQMARDDYEDRRERQRQGIELARQAGRYKGRRADPKRRAQVVALRKSGYSINKTAELAGYSAAQVKRIWAEVSQAEAKQHGAFVEDALTEADALAAVGQDERQEERA

SEQ ID NO: 11313 - protein, 149 aa, Klebsiella pneumoniae
TYHPLLLMELHMNPFKGRHFQRDIILWAVRWYCKYGISYRELQEMLAERGVNVDHSTIYRWVQRYAPEMEKRLRWYWRNPSDLCPWHMDETYVKVNGRWAYLYRAVDSRGRTVDFYLSSRRNSKAAYRFLGKILNNVKELADPAIHPHG

SEQ ID NO: 11314 - protein, 389 aa, Klebsiella pneumoniae
KACPNLLKPPKAKKGKEVLTVPVDDVVSKVQVRKRFRNIEELAGTLLTEGHNLRSSGFPKNEKGQVRHSKRGTGFGKRGKHLGFENMDLGGGRIRSRTNLDETAGELIENIQRDDLTPVEIAEALNLFIEEGWKQKDIADRLGKNITFVSTHLSLLKLPDCVRELYDNEVCSDTETLNNFRLLFDLNEERCRAVCAVAMSDGITRNQSRELLNDAKRIKDEMEKGPLTGSHQNDELGAGNTDEQSLNSGGDGTSEQTGNDDLNLAQEELEGGKNSNGQDDDDEDPLRDEEGEHKDPVKQPDNSGKDKDEEGGDALPPLPKDKEWKNVRADSLIFAVNVNLDGETKRGVIMTDRVALVPSTVWVKTLDGEGKEKHVHVPVSDIELLSVEG

SEQ ID NO: 11315 - protein, 476 aa, Klebsiella pneumoniae
PMLPIVSPSVVTKQLAFNRVGDKRKVRVSSNFLDVMGFKPGMGIAVEPGEGMGGFSVIPATDELQTHQVYQRRYQPKSRSNNPLETVIEFSGQGLIDKCFPRYTERFHVEMRKGRVVFTPVANRAFAIADRFRKTSPFRAFVALTGGVDIHVMEALGWKAEIVLEHRPVEARDRASGRNLSEVHALNTLVNSSPRILLNEDIHHLELDRLGALLAECPPIGLAHYSLGCDDHSNAKSPRDKERSLEDLSTMLDMVYPALKQIEVVNPAVVLVENVPNFKASGAGAMMGTTLRRMGYFLTEMVLNGLDFGAYQGRERYYMVASVFPGFVPPKPEQRAGGRLWPVIEKHLGDCADVTALKSIQARESTSRRMPAFLTRESTSCPTILKSQDRGVKDAVYIQDGGRIYKPSVDLVQELMSIPDSFDVSWMAKEQATETLGQSVDYRLHSAVMAAVRDHLNVNCGRHTVVQHGIRSKEGR

SEQ ID NO: 11316 - protein, 343 aa, Klebsiella pneumoniae
GQAFIRRTIMENIALIGIDLGKNSFHIHCQDHRGKAVYRKKFTRPKLIEFLATCPATTIAMEACGGSHFMARKLAELGHFPKLISPQFVRPFVKSNKNDFVDAEAICEAASRPSMRFVQPRTESQQAMRALHRVRESLVQDKVKTTNQMHAFLLEFGISVPRGAAVISRLSTLLEDSSLPLYLSQLLLKLQQHYHYLVEQIKDLESQLKRKLDEDEVGQRLLSIPCVGTLTASTISTEIGDGKQYASSRDFAAATGLVPRQYSTGGRTTLLGISKRGNKKIRTLLVQCARVFIQKLEHQSGKLADWVRELLCRKSNFVVTCALANKLARIAWALTARQQTYEA

SEQ ID NO: 11317 - protein, 815 aa, Klebsiella pneumoniae
MIVTIKKKLEETLIPEHLRAAGIIPVLAYDEDDHVFLMDDHSAGFGFMCEPLCGADEKVQERMNGFLNQEFPSKTTLQFVLFRSPDINQEMYRMMGLRDGFRHELLTSVIKERINFLQHHTTDRIFAKTNKGIYDNGLIQDLKLFVTCKVPIKNNNPTESELQQLAQLRTKVESSLQTVGLRPRTMTAVNYIRIMSTILNWGPDASWRHDSVDWEMDKPICEQIFDYGTDVEVSKNGIRLGDYHAKVMSAKKLPDVFYFGDALTYAGDLSGGNSSIKENYMVVTNVFFPEAESTKNTLERKRQFTVNQAYGPMLKFVPVLADKKESFDTLYESMKEGAKPVKITYSVVLFAPTKERVEAAAMAARNIWRESRFELMEDKFVALPMFLNCLPFCTDRDAVRDLFRYKTMTTEQAAVVLPVFGEWKGTGTYHAALISRNGQLMSLSLHDSNTNKNLVIAAESGSGKSFLTNELIFSYLSEGAQVWVIDAGKSYQKLSEMLNGDFVHFEEGTHVCLNPFELIQNYEDEEDAIVSLVCAMASAKGLLDEWQISALKQVLSRLWEEKGKEMKVDDIAERCLEEENDQRLKDIGQQLYAFTSKGSYGKYFSRKNNVSFQNQFTVLELDELQGRKHLRQVVLLQLIYQIQQEVFLGERNRKKVVIVDEAWDLLKEGEVSVFMEHAYRKFRKYGGSVVIATQSINDLYENAVGRAIAENSASMYLLGQTEETVESVKRSGRLTLSEGGFHTLKTVHTIQGVYSEIFIKSKSGMGVGRLIVGDFQKLLYSTDPVDVNAIDQFVKQGMSIPEAIKAVMRSRQQAA

SEQ ID NO: 11318 - protein, 61 aa, Klebsiella pneumoniae
GGETGDLSVPLTNKSDGWGDNPANVKSVVEADISGQHCVEAAHVHAYQPVSALPCQCGVVE

SEQ ID NO: 11319 - protein, 98 aa, Klebsiella pneumoniae; identical to SEQ ID NO: 9193

SEQ ID NO: 11320 - protein, 213 aa, Klebsiella pneumoniae
GEPTMKKPWLLVAWLLVIELLAILLLIPGDWTDRAIKRESVLVEQSLGVEARDWIQNKASTWFRSSVIDSGFYEGMYQTLIPSEEERQKSKGMQDMGKGWFVWVKGRMEAFVNVIYQFYTRLALLAAWAPYMLILFVPAVYDGMMTWRIKRTNFDYASPVLHRYSVRGTMYLMAGLFIAFFIPIALDPVVIPMTMMTCCVLVGLTFGNLQKRV

SEQ ID NO: 11321 - protein, 199 aa, Klebsiella pneumoniae
RVRTFLSRCDRVGRWCGLHPHYLFCFHTASDVRIPQLFQAAYLLKSKASNTRTQNSHWATVLLPKRNWTIQRGIMKVTKKIQLLALGMFMAGTAIAVPDVLNDDAKLKNLEKVCPDCEMVAKDVLNLRVENCQLKDTSSAMMIGTMQSDPMFSFMLAVHTAAGGEAYKTVVGAAATHVDCENPLNWIKLTQQAIKGGKA

SEQ ID NO: 11322 - protein, 63 aa, Klebsiella pneumoniae
TGGTADRNRSHWSTSKTPSYTKSVSWQHHPRNRWVCTIGITPKRPFGVITNTIHVVARIINSL

SEQ ID NO: 11323 - protein, 223 aa, Klebsiella pneumoniae
MIFAPAFQPIKDVGTGSFVAAEVLARWYDECRVLTPSSLSSPPHWGLVDMEVARFIHDNLHLCQDRYPTLFLNVSEQTLYSGVIFKAWARVIQSIAENHSSRLVIEITEGIQDASLASRWAALTEIGVELALDDYGDKNSSLERLSRYDWHYCKFDARRLRSLEDYPAILHCRRKGIQLIAEQVESFPLGESAKLLGLSWQQGFYHGKPAVMEKHLNYVKALP

SEQ ID NO: 11324 - protein, 447 aa, Klebsiella pneumoniae
ASIAAGRCPMIKRFWTQLDPNKKRWVSIAGGVFVLFAVVTMFSGEPKKEEKRGRQETIKHVLTDKNTREIGIDSLSADVKMVSRENSDLKKELERVKKELEETKTTAGKSSDVGREMTRLRQDLDRLTQKNMELAKKVETGAAGGKTSSSSEDARADVNGASGGDGQFMEKKLDYKDPASFFRDAPLPDSKGGAPATGKGDGRDATKPGIQIVSYSQKAPEVEEKDNKDDESIYLPSGSILTGVLINGMDAPTSQGARRDPFPSTLRIQKEAILPNRFRADVRECFLIVSGYGDLSSERAYLRGETFSCVRDDGGVIEAKLDSYAVGEDGKAGVRGRVVSKQGQIIAKSLMAGFLGGVSEAFDVNPVPVVSTNPGSNTQYQSVFSDQMLQGAAVKGASKALDRIAQFYIDMAEGIFPVIEVDAGRQVDIIVTKGTKLQIRSTGGTKK

SEQ ID NO: 11325 - protein, 71 aa, Klebsiella pneumoniae
IRAASLFDLRCSPYNTIKQLRSFVMLQGNTNTNKRIPLAAFMKWPLAKRQDFIDREMSGCPDFIKTSLLRH

SEQ ID NO: 11326 - protein, 326 aa, Klebsiella pneumoniae
GSHAPKLFWSSSSAKKRTGESMKNNAKLSLLALSLALGTSMAYASDDIPVVPASVMKKDVPAPVTSGQSSHEVVGSMNENPVLTMKPGVNQIIPIAVGHPNRIVTPFSNPEIVSTSLTGATDNGQCGEVCIKENVVYVATDKQYPVTMFITEKGSEAQALSLTMVPRRIPPREVFLKLDGGVGITGAFANTKAETWEQSQPYVETIRSVFRKIALGEVPQGYTLNRIPAGAAVPSCAHPGVKVDFSKGQYMMGHHLNVFIGVAQNVSDQPIEFKEALCGSWDVAAVTTWPLNVIEPGQKTEIYVAKKQKRGLAPTSKRPSLLGGAQ

SEQ ID NO: 11327 - protein, 1007 aa, Klebsiella pneumoniae
EHVATRNTIGIWSTYMLKALNKLFGGRSGVIETAPSARVLPLKDVEDEEIPRYPPFAKGLPVAPLDKILATQAELIEKVRNSLGFTVDDFNRLVLPVIQRYAAFVHLLPASESHHHRGAGGLFRHGLEVAFWAAQASESVIFSIEGTPRERRDNEPRWRLASCFSGLLHDVGKPLSDVSITDKDGSITWNPYSESLHDWAHRHEIDRYFIRWRDKRHKRHEQFSLLAVDRIIPAETREFLSKSGPSIMEAMLEAISGTSVNQPVTKLMLRADQESVSRDLRQSRLDVDEFSYGVPVERYVFDAIRRLVKTGKWKVNEPGAKVWHLNQGVFIAWKQLGDLYDLISHDKIPGIPRDPDTLADILIERGFAVPNTVQEKGERAYYRYWEVLPEMLQEAAGSVKILMLRLESNDLVFTTEPPAAVAAEVVGDVEDAEIEFVDPEEADDGDDQEEGEAALNDDMLAAEQEAEKALAGLGFGDAMEMLKSTSDAVEEKPEQKDAGPTESSKPDAGKKGKPQSKPGKAKPKSDTEKQPHKPEAKEDLSPQDIAKNAPPLANDNPLQALKDVGGGLGDIDFPFDAFNASAETTSTDATNSEIPDVAMPGKQEEQPKQDFVPQEQNSLQGDDFPMFGGSDEPPSWAIEPLPMLTDAPEQTTPAPDMSHTDKPSLDEKDAKTLLVEMLSGYGEASALLEQAIMPVLEGKTTLGEVLCLMKGQAVILYPEGARSLGAPSEVLSKLSHANAIVPDPIMPGRKVRDFSGVKAIVLAEQLSDAVVAAIKDVEASMGGYQDAFELVSPPGSDASKNKSAPKQQSRKKAQQQKPEINAGKAAPEQKAKAKDSQPQPKEKRGDVASSVEEQKRKPVQEKQNVARLPKREAQPVAPEPKVEREKELGHVEVREREEPEVREFEPPKAKTNPKDINAEDFLPSGVTPQKALQMLKDMIQKRSGRWLVTPVLEEDGCLVTSDKAFDMIAGENIGISKHILCGMLSRAQRRPLLKKRQGKLYLEVNET

SEQ ID NO: 11328 - protein, 265 aa, Klebsiella pneumoniae
GLSACRLTIFLSYFSSLHALKTPLDRTHAYLSNLGSLRNQLSIPPLLEWAHRQFLMRNDTMRQLIAILGVAILAGCASNAPEQKPQPQTAPAENDKPARVSRELSMAWDNMGRGGAALRQPGYIHVLGDGNVSATMNKIKDGSAGSDKTPAGIKQHGDVNEAINTFKSMNKGKGYSLYELSRWERYCDGGKGMDEHDWRFVEAEGTTNIPKDVVTGCIPPTHTYQDYLNAWTHFCTSQAVTDADRRIVRESVRPYSVVNPCKALK

SEQ ID NO: 11329 - protein, 98 aa, Klebsiella pneumoniae
SSRAICKARRKSMICTASSTILATPWASAARSDRSTTPGTARLAPLACIEATRRSASGKGRRLMRSIFSAMTTSPGCRSPIMRSSSGRSARAPDAFSR

SEQ ID NO: 11330 - protein, 139 aa, Klebsiella pneumoniae; identical to SEQ ID NO: 11171

SEQ ID NO: 11331 - protein, 73 aa, Klebsiella pneumoniae
PMDLDQKQEPWISVNDKMPVVGVPVHCQLKGCWSGKIVEYDLIHVQEDDCSWRTADDNSEVSYDFDVITWRPI

SEQ ID NO: 11332 - protein, 105 aa, Klebsiella pneumoniae
GGNHFVSPDVFVSTPVRFNGDHTIYQNDVTRQCRFNIIVNILPSVDLHETNLLWNNLVDEAPKAGVRRSIAERQLTVMLFQHTVQLCSEELCRHFSRQRLQITKP

SEQ ID NO: 11333 - protein, 221 aa, Klebsiella pneumoniae
SQIHRSIKEGEIWGGIMFFDNKVESHSLVIGASGKGKSVFSEQVRKNARLRGDLLVDTEMYREGRGLKPYEHEYARRLVLGLSGPLPRELRGKPVTVISDVSRPKKVKRQPKQFVKTVNGVTLERQLVADAREQLEMQTGVWLKQPQLIELMEESGIDETLAEFGEAETQIREMLADSLAMKLVGHSWPKCGALYNAAEKSDVNFSSELDAAAKEAGYMVR

SEQ ID NO: 11334 - protein, 415 aa, Klebsiella pneumoniae
TGCLQTHHHHHPAVAVHHIDIASFWPGYTVIAQALSANHHTLFTLEPRADLLPRCRRCLQPTPLIHDQRIRRVRERDLFDRQVWLQLPVRRVDCLRCGRVSEHIDWLPSGSRLTRRMQCWIEALVQYLPIRHVSQLTGVGWHTIKEIDKRRLQTSVGTIELGEVRRLVMDEFALHKGHRYATVIMDAERTRVLWVGHGNSRAAIRPFFEQLGERCQQIEAVAMDMNTAFDLEVKQHCPQAEVVYDLFHVVARYGREVVDRVRVEQANALKSDKPARKVVKSARWLLLRNRAKLSEKQDVKLQELLAANQPLAMVYVLKEGLKGIWYAPSVWEGWRRWRSWMRQVKESGLAPLQRFGRNLSKYMRGILASANYPMHTSVLEGVNNKIKVIKRMAYGFRDSEYFFLKIKAAFPGKPR

SEQ ID NO: 11335 - protein, 166 aa, Klebsiella pneumoniae
MKAQAYPPSVIRKGAVLYAALYYISDDDKAKVEVTEWIVRSIQKRRNSTSDQRYVNLAQKLDGITWGKRSRKNGDFGWLPSIPSWCLKQFREGGELPFGVYTTRLAALKFAKVSLQEEVQYCEAELKKPQTEDDTQELQEELAENQRLLKAAGAMVKREQNKKKRG

SEQ ID NO: 11336 - protein, 185 aa, Klebsiella pneumoniae
VYHHRLFATVPEILRLATSIKQGTVTASLMLRKLGSYPRQNGLAVALRELGRIERTLFILDWLQSVELRRRVHAGLNKGEARNALARAVFFNRLGEIRDRSFEQQRYRASGLNLVTAAIVLWNTVYLERAAHALRGNGHAVDDSLLQYLSPLGWEHINLTGDYLWRSSAKIGAGKFRPLRPLQPA

SEQ ID NO: 11337 - protein, 130 aa, Klebsiella pneumoniae
AGRQWLCELPLRLVMQRCPTGTKLKSWLSSLWYKGTEMSKRYAVVPHPKLKREYKGRLVRTTRVLKNGWGLIPLGAVATVTHQSPKGSALTFEPCDCCGLKAIISHVSMDSIEFIEPITEEEDGREQAQH

SEQ ID NO: 11338 - protein, 62 aa, Klebsiella pneumoniae
RYGHEFSSFNDSKHSFCDVLGQWIENAGVCRINLSNEQYLRTAHNSKAIPTRNNKSYDFRRQ

SEQ ID NO: 11339 - protein, 103 aa, Klebsiella pneumoniae
MDAKELNHMIAEAYSRDLQKPELVSFKEVSRWGRKYGFPVVCTLADESEEKQIHWAASLLIQVAGTWPREDMPELLTPERGSALFNDAMQLLANGLGAANQLR

SEQ ID NO: 11340 - protein, 80 aa, Klebsiella pneumoniae
RQIKGLLDTEGTLTHSAFLVGEADYFCHTHLYFGFSQVIKTTPKLSHVKDCSDHKMILQYLIMVLLKQTLNKKTAMKAAY

SEQ ID NO: 11341 - protein, 434 aa, Klebsiella pneumoniae
SQKKTDTPEAMTIINATQYLKQLLSSSELNRIGKFTGFCQRLRDIQPARLLPALLSGLGCDKVDGIAGLHRHFNALQLHDTDQIAYKPFHNQLRKQGFPLFMRALVERAIALRLKECLPDAHGLAGFEQVLLQDGSSFALHPQLAEHFPGRFNKHSPAAVECHMTMSLLDQSPISMSITADTESERKHLPAANSLNNKLLLADAGYISREYFADVTKAKGSYLVRGSQNLNPKVQAAYRQDGREMPKLLGKKLKDIDRRSCRAEVLDLDVSSGKYKYRLIRRWFAEEKRFCIWMTNLPRERWPAEKVMALYRCRWQIELLFKELKSHNRLKAFATRQKAIAEGLIWASLLALLVKRRLALTLIGSAELSMLKIAKNSALWLMPILASIIHGAWQEITEKLEWAMVYLSKNGKKSRQRKSKQNNTLDGIINSLAA

SEQ ID NO: 11342 - protein, 174 aa, Klebsiella pneumoniae; identical to SEQ ID NO: 9228

SEQ ID NO: 11343 - protein, 376 aa, Klebsiella pneumoniae
AGGELPIGGECQITWTVMATRFLSREACCHGETFELRKGLTMIQKILRIMAVSAVFWVSSVSADPGCQNAEVIGGKLITDICWSCIFPIKVAGVPISGGGGSYPSDAVTSPLCACDDNLGVPRPGVTTSMWEPARLVEFQRVPGCSSVLNGTRFPFDRTNQGHHGMGDMDGGDGSFMHYHYYAFPLLIMLDLFIKQTCNADGYMDLDIMYMSELDPTWNNDELAFFTNPEAAAVANPIAAAACTADAVSSTAGKPLKQLFWCAGSWGTLYPFSGNQNGGKGVIRDSSLLSARVLAALHRRGLAWKTMGSEAMCRGVISPTLPKTQYKFTLLHPVPETNSSHVMGESTLTWGLARTIPAIGQDPIYTIWRWNDCCNN

SEQ ID NO: 11344 - protein, 77 aa, Klebsiella pneumoniae; identical to SEQ ID NO: 9235

SEQ ID NO: 11345 - protein, 61 aa, Klebsiella pneumoniae
SFLCFLLCGQHVIVQSCFTFLLVVTVIGFLRINELNLSVLNITNNFRSNSRRRLSRKHQVV

SEQ ID NO: 11346 - protein, 63 aa, Klebsiella pneumoniae
LFTWFGFCFADNSIGTIDLGGYLLGIGLIDAPALLVTALFWWYPLGGKLSILYGHVHTQSPVW

SEQ ID NO: 11347 - protein, 271 aa, Klebsiella pneumoniae
NGRWRNVRTSSTGKCPVAPTLSRRLCFGIKAIRQESKEPRFGGVLRFYLLNVSSEQTGALMSPETQQLTSKALSLIEQSRYRMGTSRFVEAFIDQWAYLQTGLYPAKEEIPEELQPVAFELSHVLSAAIKRDPTSDVLGYVLSMSGFHKKGTNYFPTPPEIGRLMSLIVGSQSSADFYEPCCGSGINAIHWMENLIENHGPEALREASIYLEDIDPLMVKCCMIQLFHYFESRNTTPKTLSIVGIDTLSRRTKNIAYYAEKPPATAATVAA

SEQ ID NO: 11348 - protein, 150 aa, Klebsiella pneumoniae
KFGCSNHVLKKCTNRGKTVKKIIMALATIMLLSGCDNHQDGMITTHDAYRMSQELFPTPIREKLKTILEDSKTFGMAEYQELDLAIQKNCDGTDYTWRDYASLLPTKIIAFVIPGWNSFAVMSSPEILLVRQIDAANTCVFNPLTKYIAE

SEQ ID NO: 11349 - protein, 241 aa, Klebsiella pneumoniae
PSGWIPAPHDLLGRVHHDQGQISQESVCPEVFALNLKKYLKTWEGTQTENKWGRIFQGGLIAIVFLLVIQVFSKETIVTIQPFTLTEEAWVTKSNASQSYKEAWGFAFAQLLGNVTPGTVDFVKERITPLLSPSIYQDVIDAIEIQAQQIKNDRVTMRFEPRFVEYEPKSDKVFVYGYSYVKGASSDEERSERSYEFAIKISNYAPVLNYIDTYVGKPRTKTVLEQLKRKEENRRKHEEQR

SEQ ID NO: 11350 - protein, 144 aa, Klebsiella pneumoniae
KTARRLGSASSCPFLLALILADSGQGIGFRQCVLHERAVLLRFGLADLGPYPFHLGRTVPGQLGGLVDAVAGLAQRDNLGAALRISTAALVPPGLAGQLNALALAFAPVLVVVAGHLQGQAKKHDLHGFQHDLGDALGLGRQVG

SEQ ID NO: 11351 - protein, 60 aa, Klebsiella pneumoniae
FIGRRDHRKTAHPLPWLNGDAHTWLEPHNIQKVGRNPNLAFIAYSIERKLFGYYGGGDDR

SEQ ID NO: 11352 - protein, 66 aa, Klebsiella pneumoniae
TSNRHKRLFNDPALNRRPGRICFRISAIHPLIITYSGVATGNDSNLLIVFYVQIMPDDFVMQLHRF

SEQ ID NO: 11353 - protein, 422 aa, Klebsiella pneumoniae
KMIRSLAAHIPCSKSVLVALMFSVAGGAYAQESPLTEQDKALIEQGKQIAQKAQKMEMPSLLQNQHMDEAQAEAKAFFKQLQSTNPTLKEMHRKQAEKGIYTDHRILVFASLSLGDQGLDDVLTAVSGQPDAVIVFRGIPEGMNLGQGVKAIQALAAKKDPVPNIIINPTLFKTYNITAVPTIVMLEDEPLPGEQPNVVAQVSGLSDPVWLAREVDNGEKGDLGVKGPVEKISEPDLIDVAKKRLANIDWEEKKKQAVERFWTKQNFNELPRAPKSRTREIDPSVMITSDISTPDGTVFAHAGDVINPLCDPKEVCKPGTRPFTQAVVVFDPLDKKQMELLAKKLPEIKQEPGVQRITYIATEFDKDKGWDSYKSVTDNFDAPVYLLTPDLITRFELEHTPSIITARGKKFVVRELAEEGGE

SEQ ID NO: 11354 - protein, 105 aa, Klebsiella pneumoniae
RRPSQRGWVCQEQVNMKISQDMKRKFALVNALSKTEKPSLQDLHKATNIPESTIKRQLSALRDEFGMNILFVRESTGERGATGYYMLTDWGILDRSSFLNRYGKL

SEQ ID NO: 11355 - protein, 105 aa, Klebsiella pneumoniae
LTARCLLHPQAIAELHNSRDDLFCMFQSGRHDGFHYGRGVVQAHTATDTHSERHEALASDTANNADQDHRTRNDSTQCTLCPILESFPYIVKGTTASTCVGLIRH

SEQ ID NO: 11356 - protein, 191 aa, Klebsiella pneumoniae
VLGLHCLSRLQRHYAFQKVGLYGLIEEISMFGTIILTAMLTTSSVSAEDAGTSIASDLATASASQIGQVIVPTLAIGSAIAKSAGKGMVSGLAAATASYIPHDELSATRSYQNPEAVDMAKGLGTLKEVPDFLYVITDVNANMAVKCKRVWEPQSLALSQLIVELVELRKTNNKGSYEQALSHLDCSIFSD

SEQ ID NO: 11357 - protein, 225 aa, Klebsiella pneumoniae
RRQSLMSKSDFFFGEVYDGSGGATLRLSDLEPLARKVSAEFFTAQLNRMLKEHDGQLTLSDGTSYPSFWSFIDKVVPEQVGFVEIYARQDVNDNVEATLACDIVLVNGVITVKPHWCAYKDIRADEVISTLLVPLHLKALQGKAYIRWDDGETEPLLQNDDYQAELENVFSVSKYPSAMSWGDTADQKVKQYKMDLECATDVGCRGVSSEQAWDAYRELRYNRTV

SEQ ID NO: 11358 - protein, 64 aa, Klebsiella pneumoniae
SIKRRLLRDDDKLFGGSMSAQAHVRESESSSGSFISWQFLVWQVMFVIGVVAGMNLEHAFNFLG

SEQ ID NO: 11359 - protein, 200 aa, Klebsiella pneumoniae
PSKSRAMCDKKYRDYEVAIMVDVNPFDRVMNELKSRGRKNAHILSILQFDWPASEAIIEKLSCYITDGIKANQEPVIYPIIEEALHRYSQLVFHEQREKYEDPARIGAFLETLITETCRALEVQIVDSGGDSWSVDSGESFSLWLSSHPGELSINPQPHEDETSLRGLLYELITCESVKTVLRRTDYEEAVVAGRMAAGY

SEQ ID NO: 11360 - protein, 99 aa, Klebsiella pneumoniae
EKKRVAMKPVKIPRRVDEPPHLLLWSADELAPMLLGLTIGVIIGKALICFLGGLLVTNLYRRFRDNHPDGYLLHMIYWAGFIMTKAKSLKNPFVRRYLP

SEQ ID NO: 11361 - protein, 68 aa, Klebsiella pneumoniae
MGFGVDKIDRQSWLVKFRRAKCQDTLDTMRDAAIRNYEGNIRVIADIVLAHEARETEIEKGMFCRIVR

SEQ ID NO: 11362 - protein, 111 aa, Klebsiella pneumoniae
RMDGGVIVVTEQTNKKLMLDESPDMPLQFKWRKFGGAIFTATQTMDHVKEGRKLGPTPAGMLPQEVWLNRLIAMEETLPRGKFFDRFRRRDKNEQYDLAADHLRLVGQKKR

SEQ ID NO: 11363 - protein, 124 aa, Klebsiella pneumoniae
GNQGRDAKPSAGCITRETVMDIKSIAIAAILGAAGGFGGSYYVMSEQTASIHQRLNQTPPVVVVDFAKVASAYPAGASQAEVERLMVKTNDAILKLKDAGYLVLDASAVVGAPSDVYLPDEVLK

SEQ ID NO: 11364 - protein, 80 aa, Klebsiella pneumoniae
APGGKGMKKPNQDDEPFFITEEIAAEMIAGGYEFELPPIPCTIRLRDVLERMTDAELALQPGEIADQERERCRRKPCSTS

SEQ ID NO: 11365 - protein, 100 aa, Klebsiella pneumoniae
VSWGLRRMKRTLPMAKGKAARTECVAQSIGGRNNSATSFWDRILTVEETATLIGVRISELKDAVRYQKLLKGKAAPEVHSVSGTGKLFFDGRSIKAFIEG

SEQ ID NO: 11366 - protein, 272 aa, Klebsiella pneumoniae
FGRGSNVQTGHRLSRFEQNQARDHKAGALSVWVNRGICQFFHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSARNPAAGHLDQAGHGDGLADAQETRQLPAPERLGRRAARVGPHRAHAVHPRLAAKRRATPPRACRAEQGRGAQCAGPCRVLQPPW

SEQ ID NO: 11367 - protein, 278 aa, Klebsiella pneumoniae
KFGGGLDHLRETKIEVGMAKVISFANQKGGVGKSTLCIQQAFYLALQKIKKVLVLDMDGQGNTSSRLAPRRELEDGDYEPILTGTKTAELFAYELDGIEVMHCPCGADLIHTPKNDPDLFEMEAVPLDQAMNPARHLAELFENYDYVLIDCPPSLGRKLVAALVMSTHVACPVKLSGFAVDGVEGLLNTIIGVREAYNQDLEILGIVINDMDRSVNHDKALKSLENTVPDLLFENKIMHRPPLDTATTDGIPVWELRYGHVAAKEVEAVLEELLEKVG

SEQ ID NO: 11368 - protein, 180 aa, Klebsiella pneumoniae
RQVIWRVYVRTSSRQRKRKLIWFIHLLAVPCLAGDVRYRCCCRDEPGTRIQFSRLMGGSVNLNKQFFWFLMNAVLMCIFIVPVAVAFWLSAFAAGFDWSQWVKLAADTANRAASDPAKALGTVQTYWGILSFFLLAAYSLMFKFKANANKEVKTLGVARPANEVSVAASEKHSEAVPQNQ

SEQ ID NO: 11369 - protein, 131 aa, Klebsiella pneumoniae
EMFLMNANQLANASSKNNALFLFLGLMVVVFLLMPDQAHAGTGGGAFDDVWETLKDWTQGTLGRIVAGAMILVGVVGGIARQSLMAFAMGIGGGMGLYNSPTVVESIMSATLEHAEKVIPTVVQLSNGLGV

SEQ ID NO: 11370 - protein, 238 aa, Klebsiella pneumoniae
GIDMRTKLLGALMAFGIITGTAHASSKLEITDPRAAKIEDIVKLPIKGVRAVQSDGQIMFLSENGRFVISGQIYDLWSKKPLNTMSQMRDVAERIHFKSMGMDVDTLNTVSMGHGDKEVVVFVDPRCAVCHHLMDDAKSLVDEYTFKFIVIPALGAESNRLAKDLYCAKDKTHALDALMNNTLGSLPSKETCDPGQYDQTLLTAHFIGIEGVPFVVAPDGRVSKGRPKNLKSWLESAE

SEQ ID NO: 11371 - protein, 622 aa, Klebsiella pneumoniae
NMTMSYDPLAYEMPWRPNYEKNAVAGWLAASGAALAVEQVSTMPPEPFYWMAGICGVMAMARLPKAIKLHLLQKHLKGRDLEFISIAELQKYIKDTPDDMWLGSGFLWENRHAQRVFEILKRDWTSIVGRESTVKKVVRKIQGKKKELPIGQPWIHGVEPKEEKLMQPLKHTEGHSLIVGTTGSGKTRMFDILISQAILRGEAVIIIDPKGDKEMRDNARRACEAMGQPERFVSFHPAFPEESVRIDPLRNFTRVTEIASRLAALIPSEAGADPFKSFGWQALNNIAQGLVITHDRPNLTKLRRFLEGGAAGLVIKAVQAYSERVMPDWEAEAAAYLEKAKNGSREKIAFALMKFYYDIIQPEHPNSDLEGLLSMFQHDQTHFSKMVANLLPIMNMLTSGELGPLLSPDSSDLSDERQITDSAKIINNAQVAYLGLDSLTDNMVGSAMGSIFLSDLTAVAGDRYNYGVNNRPVNIFVDEAAEVINDPFIQLLNKGRGAKLRLFVATQTFADFAARLGSKDKALQVLGNINNTFALRIVDGETQEYIADNLPKTRLKYVMRTQGQNSDGKEPIMHGGNQGERLMEEEADLFSAQLLGMLPNLEYIAKISGGTIVKGRLPILTQ

SEQ ID NO: 11372 - protein, 179 aa, Klebsiella pneumoniae
GAEMKFPLKKYFVKKESWKRFGVKAGVTLLVLWAAGAAFASRYRIGIDPQQEKCLPGYTFFLIDLNDQTLERGAVYAFHAKNMQPFYKDGTRMVKILTGMPGDKVEINDKWKITVNGDVVGEGLQLAGKLHLPESHFYGKATLKENNYWFMGKSPFSFDSRYWGTVKNDQIIGRAYPLF

SEQ ID NO: 11373 - protein, 155 aa, Klebsiella pneumoniae
GGVMSYSVFSQDGVHQCDIPLNVYQVIRRQSLSVLWLYWAQSLNLVKVLIACIGKVFFVMPVMWFWVLVVCRLVEPERISDVSGLFSPDVIGWAAGVAFTLIIFSVFTRPAMYGYHNFFKQHICSRVKQVTPELRTVTGPLFFYRNEIGRYREEL

SEQ ID NO: 11374 - protein, 74 aa, Klebsiella pneumoniae
LAEIKRQTTVLKKGTQSTNNGSTSRNADTKFQQKSMHLISCFHLILNQGFTDTMQSSHCLLRFGSGLHETHRWT

SEQ ID NO: 11375 - protein, 165 aa, Klebsiella pneumoniae
HGEIEVENTMRSHNHFMRAVASLLTVTMSVLPIHSYANGSQDPDITAVGKEAQAFGQNLSNSFKSSSGTVQNGTISMPTLKDGQFQMNGGSQINVNDLFPGTSGSNNKPDSYYFPDANKPDVGGLQGIYDSGDNMDSVGNNAKGSLWSDANSANPSISGVMLPTY

SEQ ID NO: 11376 - protein, 133 aa, Klebsiella pneumoniae
NDAVKVICMPKQANHLRLKKPCANCPFRKEGAIELAPGRLEGIINDIVENDMTTFHCHKTVHSKSGGEWDEEGNYAPSGQESMCAGAAAYLMKIGRPTVAMRIAFAFGDAKVSDWDEAQELVIEPLVQGDRNE

SEQ ID NO: 11377 - protein, 94 aa, Klebsiella pneumoniae; identical to SEQ ID NO: 9277

SEQ ID NO: 11378 - protein, 219 aa, Klebsiella pneumoniae
IMAVIYYGEGTHDAGFVGFRVARTVGVADDYRQEYFSLREYSYATAHRLAYSLDRKWEAEAEEVKRQNKTCKRRRNSGPNIIAEGLRAYISIENRSRMGVKKTYFAPCFLVTKPGYGNGDIAFRISTHGYAEAYEKAVEKYCEIHDLTDEQYVELLERMPSTEVFTGYLLNALLMRGHRATKAEILSKLGAEKNEEDIANGKGKSGQNRVRCPEYRWAQ

SEQ ID NO: 11379 - protein, 136 aa, Klebsiella pneumoniae
VFRVVKGGKFMPVPLWEAQRMLHKEGEQAIRFSVHKYNPYNNERKTTLEEAVRCLAFQSRFAGTHSFVDSETKEPMHLQIDIASKTDVPMLGMFLSVYISDGKEKYLSQFIVSESRSHYFFLDFSLAAAKAKSIEV

SEQ ID NO: 11380 - protein, 1858 aa, Klebsiella pneumoniae
PPALGSCNSKRMENAMINFKPKIPALLGALAVLTAGAAHAELLEYTFKAPDGTQRSLTPNANYANPTGNISFALSAGIDRKVKISVIRSDGTVVSTATSHLLGATDRITVGGKSYYGAELQLPAPSEGVYKLRAEILASDGSSVQTDEYPLQVDTTAPSLANVTVKGEWNRALSDGTLLRGPNRFSGIDVSASDAGSSVSSIQAYAVDSKGKRSPVVSVNYANGQGQLLNWSTVFPNGEDLYTLHFEALDKAGNKGSIAYPIAWDSVGAKSGENPEPVAVYDPKNPQASTFKVNGQALSGFAPYQNGMTIYSDTYRVLYRIPKTNSYPSSPYGAQSGNWCDYKNCIEGNIIAEDGTYDYRQTQADVFQQHGTKTKSFIIYDWVMNSLGNTSVSVKADPSVSLAPIGKYVEYLRDDGQWVRGETINMSSVNHYKKLRFHVEPRPYAQELWGSWLPTTKIPANASYAEVDTDISFSGRSCSWPGYWSRPEGKPELPSDRIGATFCYDLNPPEIAGLERNGRIFKAHFREPDSFDGWGVNQWVISNNSSASAITSTGEERPLSRTEVLRSSTNDWFFTFSAENLSEGTYTGISLVAKDAFGNEVKQVFTGSQYAMSIDNSAPTLTVSISDGAPIQSLDDVVITLTDTADPSPKLTSIALVGGPADDKVQLSWREESKGRFRLEYPVMFPSLKEGESYTLTVSGEDAQGNAVQKAVGFEYKPRQVMLADGMDGKVMVPAVTHEFVHADGKRIIETKPLTLSDGAVVTGSYDVFATLRSDAKVPLVVNGVRIEPGQTMGIMSQHDFGASGGRLSIPVKPAVPDVVGSSSLLVMTSAPNSPILVVDINTWKGTAKLSAESWTIRQVIDPVKIYALPESGVPCRFTTKEDVAMAADPIRDPVCLLQWDRTPDEAEQTTQDNNGMKVAGLVGQAVSIGEQPVEYSLYLFSGDGSKVKVGSGSQNLTVTTAYGSVGYTPIDDIAQVNRVIEDFDVNFKQSKGPDCSITLSADRAKNEAANKAVGSASRTCLFEWQQIPDGLVQDPLSESPSLSGSLAENGDHPLGWRVSIFTRNGTRVTLNDETFNVEAVDPPAPTVELASDYNFKDNIYMVPMTGNYLGDAIINSERADLDIAISRNSDVLESETFTPGWGATNKVYRRINTDERALWEETTYKVNAAYSKVPDVKTEVVYRAISAPSKSIRPIVEVEGDTAIDTKALPVRVIIRDQYKPDGDYDVNTMGVWKVRLIQQKVYNETVALTDYAEASNGEAQFSVDLSGVDTASVRIAAEAVLDSPIEGYNRTELSIRPAFLTVLRGGAIGAGVEARKLSGEAPFTTVFKLSLDDRQDLRATGQVVWETSKDDGKTWEQFIPEDRYKYQLVKTFDKGEYQVRAKVVNVNSGAEKYTEAVSVVAYDKPDITIVGPTTLFVGSEGKYTANLTLNDEPISGGNAVVEWSTDGGKTYSQEGNSITLSSDEENRYRLWARVRSTSAPADDGYAYEVDKTSVDFVVVKAPRPYVTGPKVIETGKKYVFKAEASLPYRGMDVKLNGFFTLPDGSIVQGDTAEYVPSDTDLNQATVETKYTTWIEGYRDQGAEASHSLRSRVWQYVWPKFGMQIRMNADVAPATITASVRPIAFNGKLEEPTYEWVLPNGAVIQEQRQDIVRSFVINEPGDYNIKVTVRDARGHETVIEQPLKIGQAEPYAIDLQYSGSNKYEREPLDVLLRPYISGGHPRDRISTRVYSVDGTPLESSGYYGRATLGAGEHSIKLKITSEMGHEAEGEVNINVAENKLPACSLSSRETVGSWIVYANCEDTDGRMKSYEWTIAGELQSISSDRVTISKGTYETMPTISLVGVDDSGGKSEAVTMN

SEQ ID NO: 11381 - protein, 207 aa, Klebsiella pneumoniae
VFVPLSVRPLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSAAGSGSPVRPVP

SEQ ID NO: 11382 - protein, 188 aa, Klebsiella pneumoniae
TYHPLLLMELHMNPFKGRHFQRDIILWAVRWYCKYGISYRELQEMLAERGVNVDHSTIYRWVQRYAPEMEKRLRWYWRNPSDLCPWHMDETYVKVNGRWAYLYRAVDSRGRTVDFYLSSRRNSKAAYRFLGKILNNVKKWQIPRFINTDKAPAYGRALALLKREGRCPSDVEHRQIKGSDAQWNENSR

SEQ ID NO: 11383 - protein, 245 aa, Klebsiella pneumoniae
TYHPLLLMELHMNPFKGRHFQRDIILWAVRWYCKYGISYRELQEMLAERGVNVDHSTIYRWVQRYAPEMEKRLRWYWRNPSDLCPWHMDETYVKVNGRWAYLYRAVDSRGRTVDFYLSSRRNSKAAYRFLGKILNNVKKWQIPRFINTDKAPAYGRALALLKREGRCPSDVEHRQIKYRNNVIECDHGKLKRIIGATLGFKSMKTAYATIKGIEVMRALRKGQASAFYYGDPLGEMRLVSRVFEM

SEQ ID NO: 11384 - protein, 520 aa, Klebsiella pneumoniae
HCFPSGYGGRNQGVINVAILSAIRRWHFRDGASIREIARRSGLSRNTVRKYLQSKVVEPQYPARDSVGKLSPFEPKLRQWLSTEHKKTKKLRRNLRSMYRDLVALGFTGSYDRVCAFARQWKDSEQFKAQTSGKGCFIPLRFACGEAFQFDWSEDFARIAGKQVKLQIAQFKLAHSRAFVLRAYYQQKHEMLFDAHWHAFQIFGGIPKRGIYDNMKTAVDSVGRGKERRVNQRFTAMVSHYLFDAQFCNPASGWEKGQIEKNVQDSRQRLWQGAPDFQSLADLNVWLEHRCKALWSELRHPELDQTVQEAFADEQGELMALPNAFDAFVEQTKRVTSTCLVHHEGNRYSVPASYANRAISLRIYADKLVMAAEGQHIAEHPRLFGSGHARRGHTQYDWHHYLSVLQKKPGALRNGAPFAELPPAFKKLQSILLQRPGGDRDMVEILALVLHHDEGAVLSAVELALECGKPSKEHVLNLLGRLTEEPPPKPIPIPKGLRLTLEPQANVNRYDSLRRAHDAA

SEQ ID NO: 11385 - protein, 320 aa, Klebsiella pneumoniae
NVRPLNKTKGCLIANFATVPLDRYSVLQFRGDIAMHTRKAITEAIRKLGVQTGDLLMVHASLKAIGPVEGGAETVVAALRSAVGPTGTVMGYASWDRSPYEETLNGARLDDKARRTWPPFDPATAGTYRGFGLLNQFLVQAPGARRSAHPDASMVAVGPLAETLTEPHELGHALGEGSPVERFVRLGGKALLLGAPLNSVTALHYAEAVADIPNKRWVTYEMPMLGRNGEVAWKTASEYDSNGILDCFAIEGKPDAVETIANAYVKLGRHREGVVGFAQCYLFDAQDIVTFGVTYLEKHFGATPIVPAHEAAQRSCEPSG

SEQ ID NO: 11386 - protein, 110 aa, Klebsiella pneumoniae
MPGTGDTMTRRPRRNHSPAFKAKVALAAIRGEQTLVELSQQFDVHANQIKQWKDQLLDGATGVFGDEAKAEPAGPTVDVKTLHAKIGELTLENDFLAGALGKAGLLGGKK

SEQ ID NO: 11387 - protein, 101 aa, Klebsiella pneumoniae
RPSTMIIWINGPFGAGKTTLAERLRDRRPKSLIFDPEEIGFVVKETVPIPASGDYQDLPLWRGLTIAAVSEIRRNYSQDIIIPMTLVHPDYQRWLGKSAQR

SEQ ID NO: 11388 - protein, 107 aa, Klebsiella pneumoniae
LANAVSRWVLRFNHLALQILANGVPGQAASSGYFPNRRTIAKMPASNCAQYRHVYHSLISPAISRRETVSYVGQISTQIFTLSWGADKILDYFRSSSCIRMKIAFEP

SEQ ID NO: 11389 - protein, 169 aa, Klebsiella pneumoniae
SRRAQDHHDRCDLSQGPPHGFQLAGKKGGAGRLIGRTKGGMNTKLHAVTDASGRPISFFITAGQVSDYTGAAALLDELPKAKWLLADRGYDADWYRDALQAKGITPCIPGRKSRKKTIKYDKRRYKRRNRIEIMFGRLKDWRRVATRYDRCPMAFLSAIALAATVIFWL

SEQ ID NO: 11390 - protein, 230 aa, Klebsiella pneumoniae
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSANF

SEQ ID NO: 11391 - protein, 147 aa, Klebsiella pneumoniae
SGDHSHPLRHEAWCSCRLSCVQSGGPRPLFYPQAGSRAVGLEIGRIDHDGLVLCGFRHGQTFHHLDKYALVAPAFPAVIKRLRRAIFLRRITPTQPVAVDEDDAAQNASIINALAAMALGEIGLKTSHLLVRQPKQITHQSGSYTPI

SEQ ID NO: 11392 - protein, 68 aa, Klebsiella pneumoniae
KSRHNSDNKGWVKIQCKSRVKFGCKSTDIDNLSRNQDIAVGLQVILKPRARPTPTWTSMPERTLDFEF

SEQ ID NO: 11393 - protein, 219 aa, Klebsiella pneumoniae
IIGHRKTVTLICLLNRKFVIIDMSCPIFDLRYIFMRLFGYARVSTSQQSLDLQVRALKDAGVKANRIFTDKASGSSTDREGLDLLRMKVEEGDVILVKKLDRLGRDTADMIQLIKEFDAQGVAVRFIDDGISTDGDMGQMVVTILSAVAQAERRRILERTNEGRQEAKLKGIKFGRRRTVDRNVVLTLHQKGTGATEIAHQLSIARSTVYKILEDERAS

SEQ ID NO: 11394 - protein, 99 aa, Klebsiella pneumoniae
EVIKMTLTMQDTFIYMALCFGMYVYLKLFRMYHSITEDNCTFKDAFTASFSDERYFGIRNNILAFAALAFASFGLFVCYKFVTQEITYSKIGTVANSRW

SEQ ID NO: 11395 - protein, 169 aa, Klebsiella pneumoniae
LDCLARILSSPVVKTGKQAHGGDFVQGIFHGTVAQVVPMLHAVNTQHGLQRIGPSAIARLGIKRLDDFHHVLPWQNLLHAGEENLFSGLTALSAEFTIGEGELMAHDVPLGCAPDEYDDLISGTCSHLPLLFLSVHNKPYTNWEIYHERLAFSCYRNSWRSNRNIRIKI

SEQ ID NO: 11396 - protein, 454 aa, Klebsiella pneumoniae
LSANQDYRPNRDLGRNRRISPPLFGGLIAMVRPIALIDGNNFYVSCERVFQPHLLGKPVIILSNNDGCAVARSEEAKALGIKMGAPLFKIRELVKEHGVKVLSSNYTLYGDMSRRVVDAVSQFSPHYEIYSIDENFVDLSGFGDRYEAIAVDMRATVRQVTGIPNCVGIAETKTLAKLANFAAKKNPIFGGVCDFTQPAVLAWCLDRIPVAEVWGIGRQTQIKLASQGIATAAQLRDMPRTLARQLGTVVLERTVAELQGIRCLEIEDIAPQRKGMAVTRSAGAPMRDLEAVMQALTAHASRAAEKLRLHGLVAGQITAFFHTNSFSKNAAQHSVSRTVKLKPMTNNTFDLVQAVNRCARAGWHPKAHEHGYSYTKAGVMLDDLLKAEDAPKMLFDIVQPRDARLMEAMDAINDRYGKRKVVIGAQGFQNKHEAKADMRSPRFTTRLSDLPVIC

SEQ ID NO: 11397 - protein, 203 aa, Klebsiella pneumoniae
VLTLAHIKPEEPEVLGLLALMELQCSRLLARQDRQGLPVPLDRQDRGLWDRLLIRRGLEIVERACRMSSPTGWYLLQALISACHARAASFRDTNWREILARYDALFLLSPTYVVALNRAVAVSWAMNPAAGMAVLKGIEDEWDVETYPLFHATRADFLSRLGFQDQAAAAYQAAAVLSTNLPQKLFLVTRAEECLAGSRTDVG

SEQ ID NO: 11398 - protein, 175 aa, Klebsiella pneumoniae
YTKNTEQQRDPEMHQTKKGNQWHFGMKAHIGVDAKSGLTHSLVTTAANEHDLNQLGNLLHGEEQFVSADAGYQGAPQREELAEVDVDWLIAERPGKVKTLKQHPRKNKTAINIEYMKASIRARVEHPFRIIKRQFGFVKARYKGLLKNDNQLAMLFTLANLFRVDQMIRQWERSQ

SEQ ID NO: 11399 - protein, 79 aa, Klebsiella pneumoniae
RSYLIQIMRSAPCHQEDEMRKDQIPDFVDEIFATGCPITAVGQDCYVLQRAICWQKTSTVLVRWSIKSASDKESVTICC

SEQ ID NO: 11400 - protein, 279 aa, Klebsiella pneumoniae
PTGDVIHPGQPVSGGPNDTSVGEISVKTGNNARNGGKNSLNRLIRCVCGKKIGPDPRNFNQRVSLGRNDLLIRTFPKEQDAQRARGSIDAFAQERGLSICNYYAENESGARLDRPELFRLLSDCQSQDILLIEDVDRLSRLREADWQNLKAILRDRQIKIVAVNVPTTWQSLKADQTEFDARMFGAINDMLLDMLAAIARRDYEQRRARQRQGIDKAKSNGKFKGRTPDLKRYEAINKMLASGNSWTTIQQTLNCSRSTIAKAVNYKLTKESTNKIRGD

SEQ ID NO: 11401 - protein, 73 aa, Klebsiella pneumoniae
CRSERVDHQRAGGHGSWGNRAEDEPFARPSAKTNYSSVGLLYAHLNHSRQFKSMGPDPRAYEMMCCLSLVLSW

SEQ ID NO: 11402 - protein, 130 aa, Klebsiella pneumoniae
TDGCDSDGRIGARLMSNLFWLTDEQMARLQPYFPKSHGRQRVDDRRVLSGIIFVNRNGLRWRDAPKEYGPAKTLYNRWKRWGDKGVFIQMMEGLAVPEAAEHKTIMIDATYLKAHRTASSLRVKKGARAA

SEQ ID NO: 11403 - protein, 1060 aa, Klebsiella pneumoniae
PKSRIKMYLKSNIGQLMSIITNLRFNRHINVTVLRCPIIYNISYGWKNVTKCPSGREADMPVDFLTTEQTESYGRFTGEPDELQLARYFHLDEADKEFIGKSRGDHNRLGIALQIGCVRFLGTFLTDMNHIPSGVRHFTARQLGIRDITVLAEYGQRENTRREHAALIRQHYQYREFAWPWTFRLTRLLYTRSWISNERPGLLFDLATGWLMQHRIILPGATTLTRLISEVREKATLRLWNKLALIPSAEQRSQLEMLLGPTDCSRLSLLESLKKGPVTISGPAFNEAIERWKTLNDFGLHAENLSTLPAVRLKNLARYAGMTSVFNIARMSPQKRMAVLVAFVLAWETLALDDALDVLDAMLAVIIRDARKIGQKKRLRSLKDLDKSALALASACSYLLKEETPDESIRAEVFSYIPRQKLAEIITLVREISRPSDDNFHEEMVEQYGRVRRFLPHLLNTVKFSSAPAGVTTLNACDYLSREFSSRRQFFDDAPTEIISRSWKRLVINKEKHITRRGYTLCFLSKLQDSLRRRDVYVTGSNRWGDPRARLLQGADWQANRIKVYRSLGHPTDPQEAIKSLGHQLDSRYRQVAARLCENEAVELDVSGPKPRLTISPLASLDEPDSLKRLSKMISDLLPPVDLTELLLEINAHTGFADEFFHASEASARVDDLPVSISAVLMAEACNIGLEPLIRSNVPALTRHRLNWTKANYLRAETITSANARLVDFQATLPLAQIWGGGEVASADGMRFVTPVRTINAGPNRKYFGNNRGITWYNFVSDQYSGFHGIVIPGTLRDSIFVLEGLLEQETGLNPTEIMTDTAGASELVFGLFWLLGYQFSPRLADAGASVFWRMDHDADYGVLNDIARGQSDPRKIVLQWDEMIRTAGSLKLGKVQVSVLVRSLLKSERPSGLTQAIIEVGRINKTLYLLNYIDDEDYRRRILTQLNRGESRHAVARAICHGQKGEIRKRYTDGQEDQLGTLGLVTNAVVLWNTIYMQAALDHLRAQGETLNDEDIARLSPLCHGHINMLGHYSFTLAELVTKGHLRPLKEASEAENVA

SEQ ID NO: 11404 - protein, 292 aa, Klebsiella pneumoniae
FFSRSARQSGIAGRKEMIDRTHKLSVARQARLLGFSRGSVYYSPRQVSDGDLDLMRRIDELHLDYPFAGSRMLQGLLRGEGTDVGRLHVATLMKKMGIEAIYRRPNTSKPAPGHKIYPYLLRKLAVTRPNQVWAMDITYVPMARGFVYLCPVVDWFNPRVLFWRVSIPMEADSCSKAVEDAMARYGKPEIFNTNQGSQFTSIDFTAVLKKAEIAISMDGKGAWRDNVFVERLWRSIKYEEVYLHAYKTVSEARAGIGRYLAFYNSRRPHSSLDRQTPDQAYFNALAPMMVAA

SEQ ID NO: 11405 - protein, 111 aa, Klebsiella pneumoniae
RQARSAITPVLPPCLMNFPRPNGCWPTVAMMPTGIVTLYRRRGSLPAFQVENPARRPSNTTNAATNGATGSRSCSGVSKTGGVSLRVTTGAQWPFSPPSLSLRPLSSGYEQ

SEQ ID NO: 11406 - protein, 309 aa, Klebsiella pneumoniae
CVGLCRYGAHNCCLFARPIPIVEVAAEADAMVTVFGILNLTEDSFFDESRRLDPAGAVTAAIEMLRVGSDVVDVGPAASHPDARPVSPADEIRRIAPLLDALSDQMHRVSIDSFQPETQRYALKRGVGYLNDIQGFPDPALYPDIAEADCRLVVMHSAQRDGIATRTGHLRPEDALDEIVRFFEARVSALRRSGVAADRLILDPGMGFFLSPAPETSLHVLSNLQKLKSALGLPLLVSVSRKSFLGATVGLPVKDLGPASLAAELHAIGNGADYVRTHAPGDLRSAITFSETLAKFRSRDARDRGLDHA

SEQ ID NO: 11407 - protein, 290 aa, Klebsiella pneumoniae
KRKSMSIQHFRVALIPFFAAFCLPVFAHPETLVKVKDAEDQLGARVGYIELDLNSGKILESFRPEERFPMMSTFKVLLCGAVLSRVDAGQEQLGRRIHYSQNDLVEYSPVTEKHLTDGMTVRELCSAAITMSDNTAANLLLTTIGGPKELTAFLHNMGDHVTRLDHWEPELNEAIPNDERDTTMPAAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 11408 - protein, 67 aa, Klebsiella pneumoniae
TSAGCAGAIISGCTSTVRTCFLCAGRITYERRLSGYASTPLKASRGQSAMTIIPYSDHAIGALPSGG

SEQ ID NO: 11409 - protein, 157 aa, Klebsiella pneumoniae
PLFIICSCSVANGNSMILSPVSVAYEGQTVILSSIVVPAGFPSPASDDLEDEIDPIAWIVPHPSATFWWRVSGDSLVDEGIHDGDLIAVDRSGKARVGRIVLAVVDGSITLKKLAKRDGQYWLDPKSKGNNYQPIRITDQTEIWGVIAGSVRRYSVD

SEQ ID NO: 11410 - protein, 121 aa, Klebsiella pneumoniae
YEIIIFIRSASQRDIMSHQLTFADSEFSTKRRQTRKEIFLSRMEQILPWQNMVEVIEPFYPKAGNGRRPYPLETMLRIHCMQHWYNLSDGAMEDALYEIASMRLFARLHHGAGQNARQTVQ

SEQ ID NO: 11411 - protein, 264 aa, Klebsiella pneumoniae
GEPMMQHEGHVRILKSLKLFGMAHAIEELGNQNSPAFNQALPMLDSLIKAEVAEREVRSVNYQLRVAKFPVYRDLVGFDFSQSLVNEATVKQLHRCDFMEQAQNVVLIGGPGTGKTHLATAIGTQAVMHLNRRVRFFSTVDLVNALEQEKSSGRQGQIANRLLYADLVILDELGYLPFSQTGGALLFHLLSKLYEKTSVILTTNLSFSEWSRVFGDEKMTTALLDRLTHHCHILETGNESYRFKHSSTQNKQEEKQTRKLKIET

SEQ ID NO: 11412 - protein, 128 aa, Klebsiella pneumoniae
ACIISPTQIGRYIMKGWLFLVIAIVGEVIATSALKSSEGFTKLAPSAVVIIGYGIAFYFLSLVLKSIPVGVAYAVWSGLGVVIITAIAWLLHGQKLDAWGFVGMGLIIAAFLLARSPSWKSLRRPTPW

SEQ ID NO: 11413 - protein, 85 aa, Klebsiella pneumoniae
SVTIPVGIIATVGQQPFGLGKFIKQGGSTGVIADLACRYEEADRATTRIRYGMKLGVHAAFRASNQAARAPFFTRKLEAVRWALR

SEQ ID NO: 11414 - protein, 87 aa, Klebsiella pneumoniae
HDGVSDQPQCAQLIFLTVGISFSYLTFLTVTDGSGNGMATFSPIKLGQNAPAVIFIINIIKQIQRFVDAPHFNDCLSQSGRTFTFQQ

SEQ ID NO: 11415 - protein, 200 aa, Klebsiella pneumoniae
RTLVRFREGGRRHAGLVRIKLHYEAAVHTAPGERMDSEEPPNVRVACSGDIDEVVRLMHDAAAWMSAKGTPAWDVARIDRTFAETFVLRSELLVASCSDGIVGCCTLSAEDPEFWPDALKGEAAYLHKLAVRRTHAGRGVSSALIEACRHAARTQGCAKLRLDCHPNLRGLYERLGFTHVDTFNPGWDPTFIAERLELEI

SEQ ID NO: 11416 - protein, 77 aa, Klebsiella pneumoniae
ATQVRVAVEPQLGAPLRSRGMAASLDQRGADTPARMCPSHRELVQICGLPLEGVGPELGILGRQGATADDAVAATRD

SEQ ID NO: 11417 - protein, 202 aa, Klebsiella pneumoniae
FMYSYEDRLRAVRLYLKLGRRMSATLRQLGYPTKNSLKAWLAEFERNQDLRRGYQRIKRQYTDEQKQRAVDHYIEQGYCLSHTIRSLGYPSREALRAWIRDLRPEFARTVVGSSAPTVARSRLEKQQAVIALNLRVGSAKDVADTVGVSRPTLYNWQHRLLGKVPLKPMTKKKGDTSLEQRHEALLRELAELESQNQRHCCK

SEQ ID NO: 11418 - protein, 77 aa, Klebsiella pneumoniae
RMRSRNWSRTLTERSGGNGAVAVFMACYDCFFVQSMPRASKQQARYAVGRCLMLWSSNDVTQQGSRPKTKLTPKEVS

SEQ ID NO: 11419 - protein, 106 aa, Klebsiella pneumoniae
FLPSSQDQCRSLCGRLCRPRRPAPARGGQRRHRSRRPSPSCRRRPLSRRRPIPARRASIAGTPPAPRQWPEHRRKRWWTTPSRRCPASDGRRGRSRRTGSPAPGRH

SEQ ID NO: 11420 - protein, 245 aa, Klebsiella pneumoniae; identical to SEQ ID NO: 11383

SEQ ID NO: 11421 - protein, 148 aa, Klebsiella pneumoniae
HQGPILGALALPHDDRAVIEIQILDPQLQTLTDPHARSIQKLGEQTMLAFQKTEDANHFIRGQHHRQAPRRPRSSDLLKPGQIRAQHLAVEEQQGRQCLTMRGDRNLALVRQPGQKCLDFAAAQGCRVTHTVETDEGTNPVDISLFGS

SEQ ID NO: 11422 - protein, 383 aa, Klebsiella pneumoniae
EGMPGAAVLLWQPSISRAGRIMIQYIRIQNFRSVKDIALELGPLNIVFGPNGCGKSNIYNAIHLLTAAAEGRLSGFISEEGGLENMMWSGERSPLDRHPRRLQIACRTDSFDYELQIGFPEKLPYPTQFMLDPIVKEENIWLAGYSRRPSSRVLQRKNQAAFLVDVTGEKSTFTESIYENESVFGQLGEPHRFPEVSRVRETLRRWRFYHEFAIGRHSPLRQPAVGYRSPVLDSDGQNLAAAFQTIVEIGAEEILHEILADAFPGCQFYCENEHSRFALKMRREGIRRPLLAAEMSDGTLRFLCLAVALLSPRPPAFLAINEPENSLHRDMLPALARLIIEASRYSQIWLTSHSAELAELIAAGAPCQRYALENRGGETRIVE

SEQ ID NO: 11423 - protein, 269 aa, Klebsiella pneumoniae
AQALDIMRVAVTIEISNQLSEVLSVIERHLESTLLAVHLYGSAVDGGLKPYSDIDLLVTVAVKLDETTRRALLNDLMEASAFPGESETLRAIEVTLVVHDDIIPWRYPAKRELQFGEWQRNDILAGIFEPAMIDIDLAILLTKAREHSVALVGPAAEEFFDPVPEQDLFEALRETLKLWNSQPDWAGDERNVVLTLSRIWYSAITGKIAPKDVAADWAIKRLPAQYQPVLLEAKQAYLGQKEDHLASRADHLEEFIRFVKGEIIKSVGK

SEQ ID NO: 11424 - protein, 225 aa, Klebsiella pneumoniae
SQVTSAISSSLPVPSRSFVMTEQQLREEMVQIGASLFSRGYATGSAGNLSLLLPDGNLLATPTGACLGELQAQRLSVVTLQGEWISGDKPSKEVTFHRAVYLHNPACKAIVHLHSHYLTALSCLQGLDPHNCIRPFTPYVVMRVGDVPVVPYYRPGDDRIAQALAGLAPRYNAFLLANHGPVVTGSSLREATNNTEELEETARLIFTLGNREIRYLTADEVKELR

SEQ ID NO: 11425 - protein, 313 aa, Klebsiella pneumoniae
ISKTPGYSYLSLLYSPLSALTQGCIVVMRYIRLCIISLLATLPLAVHASPQPLEQIKLSESQLSGRVGMIEMDLASGRTLTAWRADERFPMMSTFKVVLCGAVLARVDAGDEQLERKIHYRQQDLVDYSPVSEKHLADGMTVGELCAAAITMSDNSAANLLLATVGGPAGLTAFLRQIGDNVTRLDRWETELNEALPGDARDTTTPASMAATLRKLLTSQRLSARSQRQLLQWMVDDRVAGPLIRSVLPAGWFIADKTGAGERGARGIVALLGPNNKAERIVVIYLRDTPASMAERNQQIAGIGAALIEHWQR

SEQ ID NO: 11426 - protein, 71 aa, Klebsiella pneumoniae
FIDAQDDAGKAQVTELHREAQPIGWPAPLSDDREVGIVECVMSDQVVLGVRQRQQAFPLGGGQDGTTWHIY

SEQ ID NO: 11427 - protein, 520 aa, Klebsiella pneumoniae
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSAVEAYIERVSRANRFEYGKVRVAGCVGWALCASITGVLFGIDPNITFWIASGFALVLGLLLWLSRPESSNSAQVIEALGANRQAFSLRTAAELLRMPRFWGFIVYVVGVASVYDVFDQQFANFFKSFFASPQRGTEVFGFVTTGGELLNALIMFCAPAIVNRIGAKNALLTAGMIMSVRILGSSFASSAVEVVILKMLHMFEIPFLLVGTFKYISSAFNPRLSATLFLIGFNLSKQLSGVVLSAWVGRMYDTVGFHQAYLILGCITLSFTLLSFVTLRGGNRLLPTAETQSPA

SEQ ID NO: 11428 - protein, 99 aa, Klebsiella pneumoniae
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTT

SEQ ID NO: 11429 - protein, 869 aa, Klebsiella pneumoniae
IRNQSRNPVSILENGSVNMPRRSILSAAERESLLALPDSKDDLIRHYTFNDTDLSIIRQRRGPANRLGFAVQLCYLRFPGVILGVDELPFPPLLKLVADQLKVGVESWNEYGQREQTRREHLSELQTVFGFRPFTMSHYRQAVQMLTELAMQTDKGIVLASALIGHLRRQSVILPALNAVERASAEAITRANRRIYDALAEPLADAHRRRLDDLLKRRDNGKTTWLAWLRQSPAKPNSRHMLEHIERLKAWQALDLPTGIERLVHQNRLLKIAREGGQMTPADLAKFEPQRRYATLVALATEGMATVTDEIIDLHDRILGKLFNAAKNKHQQQFQASGKAINAKVRLYGRIGQALIDAKQSGRDAFAAIEAVMSWDSFAESVTEAQKLAQPDDFDFLHRIGESYATLRRYAPEFLAVLKLRAAPAAKNVLDAIEVLRGMNTDNARKLPADAPTGFIKPRWQKLVMTDAGIDRRYYELCALSELKNSLRSGDIWVQGSRQFKDFEDYLVPPEKFTSLKQSSELPLAVATDCEQYLHERLTLLEAQLATVNRMAAANDLPDAIITESGLKITPLDAAVPDTAQALIDQTAMVLPHVKITELLLEVDEWTGFTRHFTHLKSGDLAKDKNLLLTTILADAINLGLTKMAESCPGTTYAKLAWLQAWHTRDETYSTALAELVNAQFRHPFAGHWGDGTTSSSDGQNFRTASKAKSTGHINPKYGSSPGRTFYTHISDQYAPFHTKVVNVGLRDSTYVLDGLLYHESDLRIEEHYTDTAGFTDHVFALMHLLGFRFAPRIRDLGDTKLYIPKGDAAYDALKPMIGGTLNIKHVRAHWDEIRHCCKVSDEAAFCLIQRPYISKTLLTRRISPRGSP

SEQ ID NO: 11430 - protein, 99 aa, Klebsiella pneumoniae; identical to SEQ ID NO: 9315

SEQ ID NO: 11431 - protein, 175 aa, Klebsiella pneumoniae
LLRLFLHCARTNNGQARCVSAWLQPAVCHSGNCHGVYGSFYGACDTQVGQPKCLANGNGMPDSWSSIACHHRNMGFAVRVRLYCSDVASGYWCRHSGICGTQWRSSRIRPCCWNGHGSLLLLGRCTARKHRNVDHFAVAAQHGLAGCRVLFDPCNSRARSVLCFPSEGLSRPGGA

SEQ ID NO: 11432 - protein, 91 aa, Klebsiella pneumoniae
PLQQSCSVCLVFPERRALAARGSMMWSRYKVRKVRQIPIVERMWQAIAQQIAAADPKPLRGFGRLSSGVRHHEGSGDHRNFEPTIRGAKRH

SEQ ID NO: 11433 - protein, 115 aa, Klebsiella pneumoniae; identical to SEQ ID NO: 9318

SEQ ID NO: 11434 - protein, 121 aa, Klebsiella pneumoniae
ESTKYRTLSGVAVCRSPRPPVPAVRQRYMPSREELVHPIIKVMLVGGKADGLLVSVADDATEVSVTPAQYGALSGQSLSYRIVSQTIDDERYFFGVFSDAHQDSDKLTRVALTRGMKKMFC

SEQ ID NO: 11435 - protein, 260 aa, Klebsiella pneumoniae; identical to SEQ ID NO: 9577

SEQ ID NO: 11436 - protein, 339 aa, Klebsiella pneumoniae
QAMKTATAPLPPLRSVKVLDQLRERIRYLHYSLRTEQAYVHWVRAFIRFHGVRHPATLGSSEVEAFLSWLANERKVSVSTHRQALAALLFFYGKVLCTDLPWLQEIGRPRPSRRLPVVLTPDEVVRILGFLEGEHRLFAQLLYGTGMRISEGLQLRVKDLDFDHGTIIVREGKGSKDRALMLPESLAPSLREQLSRARAWWLKDQAEGRSGVALPDALERKYPRAGHSWPWFWVFAQHTHSTDPRSGVVRRHHMYDQTFQRAFKRAVEQAGITKPATPHTLRHSFATALLRSGYDIRTVQDLLGHSDVSTTMIYTHVLKVGGAGVRSPLDALPPLTSER

SEQ ID NO: 11437 - protein, 63 aa, Klebsiella pneumoniae
KMMKEKRGIVNQQNAGLFLFVASLLAFIGPHSRMYCGYALYSPVYYLPVSHPAAGGTRQPAAA

SEQ ID NO: 11438 - protein, 115 aa, Klebsiella pneumoniae
KPPLRRYHRCVRSRFWTSCVSAYATCITAYEPNRLMSTGFVPSSVSTVCVTRQPWAAAKSRHFCPGWRTSARFRSPRIVRHWRPCCSSTARCCARICPGFRRSEDLGRRGACRWC

SEQ ID NO: 11439 - protein, 437 aa, Klebsiella pneumoniae
ILLLYESAAKSFVQGDGFVRSKNFSWRYSLAATVLLLSPFDLLASLGMDMYLPAVPFMPNALGTTASTVQLTLATYLVMIGAGQLLFGPLSDRLGRRPVLLGGGLAYVVASMGLAFTSLAEVFLGLRILQACGASACLVSTFATVRDIYAGREESNVIYGILGSMLAMVPAVGPLLGALVDMWLGWRAIFAFLGLGMIAASAAAWRFWPETRVQRVTGLQWSQLLLPVKCLNFWLYTLCYAAGMGSFFVFFSIAPGLIMGRQGVSQLGFSLLFATVAIAMVFTARFMGRVIPKWGSPSVLRMGMGCLIAGAVLLAITEIWASQSVLGFIAPMWLVGIGVATAVSVAPNGALQGFDHVAGTVTAVYFCLGGVLLGSIGTLIISLLPRNTAWPVVVYCLTLATVVLGLSCVSRAKGSRGQGEHDVVALQSAESTSNPNR

SEQ ID NO: 11440 - protein, 72 aa, Klebsiella pneumoniae
RHLRHTRIHAGHGPGGRPIARSARRHVAWVAGYLCVSRFGHDRCICSSVAILARNPGATSYGLAMVAAATPR

SEQ ID NO: 11441 - protein, 126 aa, Klebsiella pneumoniae
RRNSKAAYRFLGKILNNVKKWQIPRFINTDKAPAYGRALALLKREGRCPSDVEHRQIKYRNNVIECDHGKLKRIIGATLGFKSMKTAYATIKGIEVMRALRKGQASAFYYGDPLGEMRLVSRVFEM

SEQ ID NO: 11442 - protein, 427 aa, Klebsiella pneumoniae
TVRRDNMQLGVIADDFTGATDIASFLVRNGMPTVQLNGVPTRDLPLTSEAVVISLKTRSCPAEMAVSQSLAALRWLQAQGCQQFYFKYCSTFDSTAQGNIGPVLDALLAELGETRTVISPALPVNGRTVYQGYLFVGEQLLNESGMRHHPVTPMEDAHLGRLIERQGRGKAALIAWPIVARGPEAVAAALAAVNDPAVRYVVLDALSEQDLLTQGVALREMKLVSGGSGLAIGLARDLAQRHGARGESAQAGMPLVGPAVVLSGSCSVMTNSQVAAYRQQAPARAVDLSACFTDLESYVRTLTDWVDAQRDAPLAPMIYATTEPQTLQRIQAQYGDKASSERVEQLFAALAAALKAKGFTRFIVAGGETSSIVAQTLGVEAFHIGPTISPGVPWVRDTRQPLSLALKSGNFGDIQFFARAQQEFRHD

SEQ ID NO: 11443 - protein, 144 aa, Klebsiella pneumoniae
AHSGTANFQHMRVNHRRRDVGMAEQILHGSNVVTAAEQGRRERVAEGVRCGGLRDACLFYGTFEGALKGLVIHVMATHDTAPWIGRMRVLRKNPEPRPGMPGARILPLKGVGKRNAAAALGLVLQPPCPCTRQLLAQAGCQALG

SEQ ID NO: 11444 - protein, 192 aa, Klebsiella pneumoniae
HFAGNSMTGQRIGYIRVSTFDQNPERQLEGVKVDRAFSDKASGKDVKRPQLEALISFARTGDTVVVHSMDRLARNLDDLRRIVQTLTQRGVHIEFVKEHLSFTGEDSPMANLMLSVMGAFAEFERALIRERQREGIALAKQRGAYRGRKKSLSSERIAELRQRVEAGEQKTKLAREFGISRETLYQYLRTDQ

SEQ ID NO: 11445 - protein, 80 aa, Klebsiella pneumoniae
CRSIGITALPLPFFHTRRHHPGYGPGDTRCCYRALPLFLGYFRARIAVVQPLSACEFFIFMWVIRDNSHINSHDNALFYH

SEQ ID NO: 11446 - protein, 341 aa, Klebsiella pneumoniae; identical to SEQ ID NO: 9374

SEQ ID NO: 11447 - protein, 256 aa, Klebsiella pneumoniae
DKTMPKFAANLSMLFTELPFLERFAAAARAGFEAVEFLFPYEYAAGEIRQRLQENQLQLVLFNTPPGDVNAGEWGLAAIPGRSAEARRDIELALEYACQLGCPQVHIMAGVVPPGADRAACEAVLIDNLRYAAECFARHDKRILIEALNPQTKPGYLYHSQYQTLAMVKRVDRPNLAVQLDLFHAQKVDGNLSHLITEYAGQYRHIQIASLPDRHEPDEGERHCCKVSDEAAFCLIQRPYISKTLLTRRISPRGSP

SEQ ID NO: 11448 - protein, 309 aa, Klebsiella pneumoniae
LTNVHKETSMAAHTNVCVIGLGSMGMGAARACLQAGLNTWGVDINPDNCRALLAAGANGAGPSAVPFAAELDAVVLLVVNAAQVRGILFGESGLAAHLKPGTVVMVSSTIASADAQAIAEALAEYQLLMLDAPVSGGAVKAAAGDMTVMASGSDAAFARLAPVLDAVAGKVYRIGSDIGLGSTVKIIHQLLAGVHIAVAAEAMALAARAGIPLETMYDVVTHAAGNSWMFENRMQHVLDGDYSPKSAVDIFVKDLGLVNDTARALTFPLPLATTALNMFTSASNAGFGREDDSAVIKIFNGITLPGHKQ

SEQ ID NO: 11449 - protein, 160 aa, Klebsiella pneumoniae
GSIVKLSLMAAISKNGVIGNGPDIPWSAKGEQLLFKAITYNQWLLVGRKTFESMGALPNRKYAVVTRSSFTSSDENVLVFPSIDEALNHLKTITDHVIVSGGGEIYKSLIDKADTLHISTIDIEPEGDVYFPEIPGSFRPVFSQDFVSNINYSYQIWQKG

SEQ ID NO: 11450 - protein, 205 aa, Klebsiella pneumoniae
KLAVPECAHRLMRCRPSLVRGRAAQVNPGGFTTPARRPSVPHRTAGCGKSSLRPLMAGSSPSLPDGSNPSAAIVQSASDVQCSRLLKTTMEVVAEGVETPDCLAWLRQAGCDTVQGFLFARPMPAAAFVGFVNQWRNTTMNANEPSTSCCVCCKEIPLDAAFTPEGAEYVEHFCGLECYQRFQARASTATETSVKPDACDSPPSG

SEQ ID NO: 11451 - protein, 113 aa, Klebsiella pneumoniae
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEDKNRQASKGFP

SEQ ID NO: 11452 - protein, 140 aa, Klebsiella pneumoniae
WKTLGRLSIFILSSRRNSKAAYRFLGKILNNVKKWQIPRFINTDKAPAYGRALALLKREGRCPSDVEHRQIKYRNNVIECDHGKLKRIIGATLGFKSMKTAYATIKGIEVMRALRKGQASAFYYGDPLGEMRLVSRVFEM

SEQ ID NO: 11453 - protein, 136 aa, Klebsiella pneumoniae
LLWKSRLSTKGSSMGKKVHIICGKCGSDEMNFVINEHCPDDPQNVASMSCSNCCELTGIAEWSEFNGRELKGEAVALSTPANVNALLGLLRQAMDSVEYRLYGGDMSLSGNDAAELIDLQERAEKVLSVLRSDQHE

SEQ ID NO: 11454 - protein, 216 aa, Klebsiella pneumoniae
VFACSFGQAFRAARCIWEAGIGIWRDWFGGPEAPTNAWIFDKTCALGRKIIMSMLEARYFVAKISDAQAVLCDEELATLERLIRKVDDGRRANGKSSLTCVVVEEDWPNWQQTVDSVLSLADGKDNDWTNATPEQIKAFWVDDSVWKTLDGRDKWIEDLDLLVDGSPVASEWEPFGLESGQSVVIRGGWIEGNALSDDGVPLVQAFVAWKQGQDNH

SEQ ID NO: 11455 - protein, 173 aa, Klebsiella pneumoniae
TSRSELRRSCLFFGVISMSDLYEPLEFVFCGFRKGDAGLFISVATLRDGVLGREMYFSKGKSKRRWVVGGIYSGASFSDNGAKGLDDAHYVKAWEVQGDKIEWQAKSEQAEALARSEKLEADDRKRNELEELMLPIRKQYGALTKRRDRAGAAALEEAVLRALRAPIRKAEEK

SEQ ID NO: 11456 - protein, 67 aa, Klebsiella pneumoniae
GELMDEKITYEEMLEQLDQKGIRVTNGARRLYVALNNGVKAEVLGNCGPATISLVDGMIVVEEQTLH

SEQ ID NO: 11457 - protein, 116 aa, Klebsiella pneumoniae
KGEMTMKHVLNIALMAVVILGLAMLEATNWGYAVLAIPAVIWAKSVLNLLHKLPVLAAAFWILVAVFAWQAALVGILFYGVLATPKAPANTNGKKSRKANLMGTYSYDFKTGECFS

SEQ ID NO: 11458 - protein, 344 aa, Klebsiella pneumoniae
VRHSWMNGERWPTADWWYPSARQSKSSITMSYQQLTEGQRYQLSVLRAQGMSILATARAIGVHRSTLYRELRRNAGPQGYQPDNAHQHATHRRASAAKSRLSADVIQFVELTLAWWWSPEQISAVGKQIGLMVSHEWIYRHVAADKARGGQLYRHLRQGHKRYRKGASSLRSPIKEARSIDERPAIVDSRERLGDWEADTVLGKQGTGALVTLVERKSRLYLVKRVASKQAGVVRDAIIEMLTPYIEQVHTITFDNGGEFAEHKAIEEALGAETYFAHPYSSWERGLNENSNGLLRQFIPKGTDLREVTDEDVRRAEQWLNLRPRKCLGFRQPVKVFEEYCQAA

SEQ ID NO: 11459 - protein, 111 aa, Klebsiella pneumoniae
KRSSNNALFVWLTTQFKGWQTMDKCQLIDIPSDPEKKREWIKYKLKIQGLSLAALGRKHKTSRQVVSTALYKPSPCWEHEIATALGVKPSEIWPERYDEEHEIPLRHKEAS

SEQ ID NO: 11460 - protein, 119 aa, Klebsiella pneumoniae
FSGSWPCWSWSRLDFPMSFHFSINQEFIMKKLFASLALAAAVAPVWAATQTVTLAVPGMTCAACPITVKKALSKVEGVSKVDVGFEKREAVVTFDDTKASVQKLTKATADAGYPSSVKQ

SEQ ID NO: 11461 - protein, 535 aa, Klebsiella pneumoniae
SIPPPRRKADQHVPLDTKEAHHSPDVFVVGGIMKQLPPDTPEQSLITQYKGPRLVVKAYAGTGKTTTLVKYAHNNLDSRILYLAYNRAIRDEAREKFPANVDCKTSHQLAYATIGRGYQHKLSGNLRLTDIAQAVNTKNWTFAKDILDTLNAFMCSADMRILYTHFARADTGKVLTSKQERYQIQVVEGAELIWKRMTNVQDPFPTVHDCYLKQYQLGMPNLSRRYTTILFDEAQDANPVTSSIVLQQNCKVILVGDRHQQIYRFRGANNALDSKELMNADQLYLTHSFRFGPNVSLVANALLELKGETRPVVGRGPADQVVMFLPGDVGHRAILHRTVMGVIETALSATESGAQVFWVGGIDAYQINELQDLYWFSMAEPDRVKNKKLLDEYEDYFEYQEVAKATKDPEMMRAVKIINSYDEIPERLTTLRRNTVKEEFGADITVSTAHRCKGLEWDFVQLYDDFPDVLDPELDPMARDDEINLLYVASTRAMRILALNSAVEMVIRYITQKRMVEKQMKMAAEATEVEEDTTK

SEQ ID NO: 11462 - protein, 245 aa, Klebsiella pneumoniae; identical to SEQ ID NO: 11383

SEQ ID NO: 11463 - protein, 158 aa, Klebsiella pneumoniae
PRPPWQKRQWSGFPNYFPYRLTPYMSTEVRLRYPIQIQKGQRMSEPQNGRGALFAGGLAAILASTCCLGPLVLVALGFSGAWIGNLTVLEPYRPLFIGAALVALFFAWKRIYRPVQACKPGEVCAIPQVRATYKLIFWIVAVLVLVALGFPYVVPFFY

SEQ ID NO: 11464 - protein, 340 aa, Klebsiella pneumoniae
NVRPLNKTKGCLIANFATVPNQRLRMENAILEKASELIKKDMGINPLELTSREKTKVVDALRVTFPLANLLCGLKLARSTYFYQRLRQTRPDKYTQVREVIRTIFEDNYRCYGYRRIDSALRLGGMRVSEKVVRRLMAQERLVVRTPRRRRFSAYAGDPTPAVPNLLNRDFHASAPNTKWLTDLTEIHIPAGKVYVSPIVDCFDGLVVAWNIGTSPDANLVNTMLDHAVRTLRPGEHPVIHSDRGSHYRWPAWIRRTENAQLTRSMSKKGCSPDNAACEGFFGRLKTELIYPRNWQHVTLKDLMTRIDAYIHWYNERRIKVSLGGRSPIEYRHAVGLMSV

SEQ ID NO: 11465 - protein, 370 aa, Klebsiella pneumoniae
TADTKLRNATYRGAASSSQNMGFASRCGRTSEVTLHDTNNDKEELVSHAKVNVPAEQTIRGELLPSSSSLRNIQDNPAVAYLVSLGSKRSRQTMSSFLNIVAKMIGFQNLRDCAWSSMRRHHILAVLEMLGDAGKAPATINTYLSALKGVALEAWTMKQIDTDSFQHIKQVRSVRGSRLPKGRALERHEIRSLFFTCESDSSAKGLRDAAILGVLLGCGLRRSEIVALDMESMIYKDRALKVLGKGNKERMAYVPGGAWKRLDKWVEEVRGTHEGPLFPRIRRFDDVTGERMSDQAIYHILETRRVEAGLEKFAPHDLRRTFASSMLDNGEDIVTVKDAMGHSSIATTQKYDRRGDERLKRASQRLDIAD

SEQ ID NO: 11466 - protein, 68 aa, Klebsiella pneumoniae
FCHTSTRHPLPSNGMSEPVVETADGDRVRYIKTNLLSEKEVVKLWHRYQSIRSGQVKTSCSCGGKFHM

SEQ ID NO: 11467 - protein, 302 aa, Klebsiella pneumoniae
SVRTNPHIGGNMAKNFISEQFSAMCRDLTNLSSLIKRLPPRYAKVAAIPPTRKGMENEPVNKIVVTEQTGREALELAAHSYRDLHINPDYSQKSARRTVGVLWFSPSRIGVADEIAATVERINAAKAGIEEFIISTYPTRQERFEALRADCPGVMTLHLYRQIRCYTNGDIDSIRFTWQRKDSLKKPVKEELLQRIREELERSGPDYQLPLEQLIQKIASTPEPYLRERREVKVQPVANVMAAGVLKTVTAPMPLIVLQDKEVQLKLLRSFDASEQRKTRSDKAASEILGTFGGVTIESFPG

SEQ ID NO: 11468 - protein, 165 aa, Klebsiella pneumoniae
FGMTEQSYGDSIKFFSDWQKDPAKRTGLNVQHTLTRGEYPTVSIEIAPIRASGSSPDWKSKITVQLTRGELTAFCSVLFGLRSKAEGSYHGDSKNKSFAVYNNGKAGVAIILSERGNQLQNFINDDDRMELAVFAVRQLSNAWKVTPSDAIALLRQSAWMDRNLS

SEQ ID NO: 11469 - protein, 98 aa, Klebsiella pneumoniae; identical to SEQ ID NO: 9193

SEQ ID NO: 11470 - protein, 100 aa, Klebsiella pneumoniae
LRHAMTRSALLIPLTTAAIALNAISPVYASDTHSIDDTVKQVETTLGAKVGIAVLDTGSQRAWFHRADDRFPMASTSKALTCAALLDKGQSFMNKEREFR

SEQ ID NO: 11471 - protein, 151 aa, Klebsiella pneumoniae
LICAEVAMLDFVFLVFLGLGISTVLVRRSSRKGMDLELTWLQSLKVVLVRGAVALGLGFGIGRLVLMGMQYGFLSESVLREHALVSVAVVLICGLGSFVAFQWIIGRISGRSISVVSVIKAVMYESGYFVLSMLILLVILVLFGLAYETFF

SEQ ID NO: 11472 - protein, 207 aa, Klebsiella pneumoniae
CAGARNNMYKSLEDLMAGIYEMAAPDGIICNEVSKFLAANQVKPEDISSGIWFFLWLKSAPKDAKPIQKEIPGFGVVLNMPTYGGTLNEAITGLIENECRQIQLAEGHPSLEAWVESVLAGRDDGEENEAAANIVDLLNGCHDLLDTAIINYLFKVGKINEQEILSLIYYGELCDHSLVGTPFSTLHIPSENNVHERNIIPIKKGAS

SEQ ID NO: 11473 - protein, 308 aa, Klebsiella pneumoniae
QTAARDAPTRFRLPVGCAGRVDLPLPSADSRRRAGRDDRRCLPWRALGCCRARADRLVRSGRNAAAARLPGRIMTSSQPAGWTAAELAQAAARGQLDLHYQPLVDLRDHRIAGAEALMRWRHPRLGLLPPGQFLPLAESFGLMPEIGAWVLGEACRQMHKWQGPAWQPFRLAINVSASQVGPTFDDEVKRVLADMALPAELLEIELTESVAFGNPALFASFDALRAIGVRFAADDFGTGYSCLQHLKCCPITTLKIDQSFVARLPDDARDQTIVRAVIQLAHGLGMDVIFRRRLHQLIGRNGCCAASS

SEQ ID NO: 11474 - protein, 290 aa, Klebsiella pneumoniae
GVVAVDEYPIIDLSHLLPAAQGLARLPADERIQRLRADRWIGYPRAVEALNRLEALYAWPNKQRMPNLLLVGPTNNGKSMIVEKFRRTHPASSDADQEHIPVLVVQMPSEPSVIRFYVALLAAMGAPLRPRPRLPEMEQLALALLRKVGVRMLVIDELHNVLAGNSVNRREFLNLLRFLGNELRIPLVGVGTRDAYLAIRSDDQLENRFEPMMLPVWEANDDCCSLLASFAASLPLRRPSPIATLDMARYLLTRSEGTIGELAHLLMAAAIVAVESGEEAINHRTLSMAC

SEQ ID NO: 11475 - protein, 401 aa, Klebsiella pneumoniae
LVVLKTLLFTVSFYNTVNHKNNPVKKKERLMLRRENQGDLFDDQVVLPSLESVLTGISSSQRCDDRTTYFSAPDVDLSLYDHIIVCLSGGKDSIAAYLRLVDMGVDKSKVEFWHHDVDGQEGSSLMDWAFMRDYCRQLGEELGIPMYFSWLEGGFEGEMLKDNAYSHPHRVETPEGLLVLPTDHKRSKPGTRLRFPQQSPSLQTRWCSSALKIDVGRRALNNQERFKGKKILFITGERREESANRSKYNQLEAHACDRRYGKTARLVDAWRPVLHWTEEEVWEVIERHRILAPVPYRLGWSRSSCMTCIYNSQRIWSTIRHYWPERAGKIAQYEQTFGVTVSRKKIDVIDLGSAVAPIQISDVEALEQVSREDYTLPIFVPEGQKWVLPGGAFGREACGSD

SEQ ID NO: 11476 - protein, 72 aa, Klebsiella pneumoniae
HRVLHTKLLAEHPSQGGLLAFATRCKSGKSTGINLELIKASIGVPVVHLTFSNSTFEVCGQPGDHCISIVRN

SEQ ID NO: 11477 - protein, 144 aa, Klebsiella pneumoniae
WAPYDMKDHEEFSTLSAAERRELIIAELKRKSRIRTLLRGLPLDEVREIIDRMKGVLNELEEEYKKREEEEKEKRAQAERIMSDMESCGVDIGLLNEMFTSRSEPDNAKYSKDGVSWSGQGRRPDAFKGLGAVELERYRIPQKK

SEQ ID NO: 11478 - protein, 388 aa, Klebsiella pneumoniae
ASHLPASVFSDGSSGSIDNAGGMDHQLESIDGTIMSKRTKDKDLEKLDVIKDSPQMSLFEIIESPAKKDDYSNTIEIYDALPKYIWDQKREHEDLSNAVVTRQCTIRGQHFTVKVKPAIIEKDDGRTVLIYAGQREEILEDALRKLAVNGKGHIIEGKAGVMFTLYELQKELSKMGHGYNLNEIKEAIQVCRGATLECISDDGEAFISSSFFPMVGLTTRGEFRKKGGNARCYVQFNPLVNESIMNLSFRQYNYKIGMQIRSPLARYIYKRMSHYWTQASPDSPYTPSLISFLTQSPRELSPRMPENVRAMKLALEALIKQEVISDYDANQIKDGRRVIDVRYVIRPHENFVKQVMASNKRKQQTELRAIKHGMIDHDIIDEPQRKGR

SEQ ID NO: 11479 - protein, 61 aa, Klebsiella pneumoniae
DLVHGVFQPLTSFEPRNVGRRDLDVLSSLGIPPGSRCAFLNVESTKPSERYCPTRFKLLCH

SEQ ID NO: 11480 - protein, 234 aa, Klebsiella pneumoniae
CTHHLNTFDGGVSRLHGFKSQRGADYPFQFAMIAFNHVVPVLNLSVFNVRRAPAFAFEQSKRATIGGRFIRVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSARFRYSE

SEQ ID NO: 11481 - protein, 155 aa, Klebsiella pneumoniae
IVAQLKHNRFVMLGSLVATVVAAANGLSFLTLMAGGMTLLQFMAWKQQDAVRSRFKAAKDAFEALNVIAFDKHWVGSTATVAKVSNMITPPERLDKPWAVQVLAVTKGGTWFAVDLQVTGTDKVQMLSLHQLSEKAAKTMLAFDLEVYEKFFGKT

SEQ ID NO: 11482 - protein, 178 aa, Klebsiella pneumoniae
VYHHRLFATVPASGTRNDRPGLAACLKSLREGDVLVVWKLDRLGRSLAHLVNTVKDLSDRNIGLRVLTGKGAQIDTTTASGRMVFGIFATLAEFERDLIRERTVAGLAAARARGRKGGRRFALTKAQVRLAQAAMTQRDTSVSDLCAELGIKRVTLYRYVGPSGELRDYGKRVLGLVP

SEQ ID NO: 11483 - protein, 115 aa, Klebsiella pneumoniae; identical to SEQ ID NO: 9318

SEQ ID NO: 11484 - protein, 98 aa, Klebsiella pneumoniae
PRKQTGITMNKSELIMKVAEDADISKAKAEAAVNALINSVTEELKAGGTITLTGFGTFHVKERAARTGRNPQTGENIQIAAANIPGFKAGKGLKDSVN

SEQ ID NO: 11485 - protein, 206 aa, Klebsiella pneumoniae
RGPHMKTIKRFIVWVNYGLEGWSIFGSSDDWDEAVSIRSEAIDECNIDEEDIILAENKNELVVKPAAKQMTEWHRELEAVLMTLDDCQMECDGMTWAVSHLLNEAGVPHDCMYGFVRNEQTKDIVTPHFWVVLDDGWLVDLRLRMWLGDHDNIPHGVFHPDNEPGLFYKGDPVQNHKGMRLGKAVLDIMTDGKLSHVKVPERQDGE

SEQ ID NO: 11486 - protein, 122 aa, Klebsiella pneumoniae
LTQQRDGIRRGNFPCVGELANCEDCELHTVVIIDEILELVSSLAQDDRNTGLAVVVNRKALILRVPVIGTLSLATQAKENAAKRRQFATSELHRDLAFPVWAGPRSPDRRNLDADRRILTSG

SEQ ID NO: 11487 - protein, 133 aa, Klebsiella pneumoniae
CRGKLEVKSKGVDMKHVVNILLLGMVLLGIAMMADTPWGLGVALAPFGVWGARFLFLVHKSLWAAVIFWGGIAYFQWQVALVVGALFGLTCFIRVARSAYKEAPPTRRRKKQTGGFQDSYDFDQRFHIGAGDE

SEQ ID NO: 11488 - protein, 407 aa, Klebsiella pneumoniae
FYLNRIGSMHFTKLKTVVIAALLSATVSSFTLPAYSADLIGFWDTQRKGGNSFNKTPPDEAYFKTLAATGATWVRLTFSKWRGEDRDFLIGNADHYRSLREKDLQILRKTLDAAQAAGLKVVLTSVSLPGARWTQQNGGKFDDRLWESPEYVEQAVKFWTDLAGELKDHPAIAAYNLINEPAPEKTTGLKENASMEVLEEWQKEHQNGTRDLRAFYQQLIEGIWKVDPATPIMVDSGYYANARSLAAWPAPLADTKVLYAFHMYEPYDATSAPNMKRKVPLRYPGVKTRYSGSEVIWDRKTVAAHITLPFEWARKNGLSTNRIVMAEFGCMRLWPDCSAYLTDVMDAAEKFQAHRAFYAFREDEWDGMDYELPASLRPGQFYWLTEQGKQNKIPRNGELMKLLKKRM

SEQ ID NO: 11489 - protein, 101 aa, Klebsiella pneumoniae
GREKERGKLMARKAKYSEEWRHRAAALQTKIEEAMTLAASSIGDYRWLHRLHSWVTEVAQGKAPDWWTDLDCEVSLPREEKRISTFLSTQKKRITLQMCLS

SEQ ID NO: 11490 - protein, 91 aa, Klebsiella pneumoniae
PVGKSLRADDAAGMGGQRRLLLTAGQLRRFAPAAPAFPNCHAGHGSLPAHTQRGHHRGTGALADGGGHRRRGERRGSDQPSHTQHGLLSCI

SEQ ID NO: 11491 - protein, 184 aa, Klebsiella pneumoniae
KFLNDKTESNSVEFDYDKSVSNAHLEAAGWGMDAFNHSNPFESHVIYVRDYRNDHIRLFTIKQADFDTIKLPLHLTSDMLASVIAEFVSKAAKGKLNTKESDTLAPALVGYAKSTETYRSWRRVSGATERLHMVINIYAGSELLRPFIARAPETVLTTQELLVFSSQVKSMDVSNHPEWFRGRR

SEQ ID NO: 11492 - protein, 106 aa, Klebsiella pneumoniae
VVLNAHFLQGARPVIFDVRATFEVALQTDTHLVLIDLDQGASVTNDADAVIAWLAANLEGGIGKRKVYYRDTDGRFDELKVNAGTFAGFAPCSEGQQTALAGMLGQ

SEQ ID NO: 11493 - protein, 182 aa, Klebsiella pneumoniae
MNNLPLLLDAREAIDYYHQHPGMTDAEKAYVVAFLSGEGRSNSQIREDLGIEKVYTVTHLKRAGTLSEEELTLWLRNPRKITLGHVRAVAKLPFSKREKLLRDLLHTRTPVHKFEAIAKGKEVDRDADIKRLETLMSDATGRPIKVRYNPAKRSGELTLGFFTLDDLDDVCKALGFDPSEQM

SEQ ID NO: 11494 - protein, 290 aa, Klebsiella pneumoniae
EQFDMTEQSTKSLRLGVVAAILLGLVGTGFGIYQFVKEKDLAQEIANVKSTVNQVKDAEGVTFKSKAEFEAAVAESINKFVAQKQQADIDQKYAQFEAAPEKVEEGKHIYGDLGARFTLVEFSDMECPFCKRFHDTPKQIVDASKGNVNWQWKHMPLDFHNPAAHKEALAAECIAEQKGNRGFWVFVNDIFHHTQGNGGGVADLASVVTGVGADLDAFRECLGSGKYEDKVEADIQKAKSYGVNGTPATFVVDNHTGKSQLLGGAQPAQAIMAVMRKMMIESQQDDSANQ

SEQ ID NO: 11495 - protein, 98 aa, Klebsiella pneumoniae
GIADLARPASPCSDAINGQETFPFRAWQAHTSSDSTVSMRAKSAIFSRTSLSLCSARLLASSQWVPSSSRNSSAISSRLNPSRCADFTNFTRTTSASP

SEQ ID NO: 11496 - protein, 581 aa, Klebsiella pneumoniae
KTADRATRRPTRIRNDGMSTLKITGMTCDSCAVHVKDALEKVPGVQSADVSYAKGSAKLAIEVGTSPDALTAAVAGLGYRATLADAPSVSTPGGLLDKMRDLLGRNDKTGSSGALHIAVIGSGGAAMAAALKAVEQGARVTLIERGTIGGTCVNVGCVPSKIMIRAAHIAHLRRESPFDGGIAATTPTIQRTALLAQQQARVDELRHAKYEGILEGNPAITVLHGSARFKDNRNLIVQLNDGGERVVAFDRCLIATGASPAVPPIPGLKDTPYWTSTEALVSETIPKRLAVIGSSVVALELAQAFARLGAKVTILARSTLFFREDPAIGEAVTAAFRMEGIEVREHTQASQVAYINGEGDGEFVLTTAHGELRADKLLVATGRAPNTRKLALDATGVTLTPQGAIVIDPGMRTSVEHIYAAGDCTDQPQFVYVAAAAGTRAAINMTGGDAALNLTAMPAVVFTDPQVATVGYSEAEAHHDGIKTDSRTLTLDNVPRALANFDTRGFIKLVVEEGSGRLIGVQAVAPEAGELIQTAALAIRNRMTVQELADQLFPYLTMVEGLKLAAQTFNKDVKQLSCCAG

SEQ ID NO: 11497 - protein, 174 aa, Klebsiella pneumoniae; identical to SEQ ID NO: 9228

SEQ ID NO: 11498 - protein, 105 aa, Klebsiella pneumoniae
RRSDVMARTLDQMLATEKPEVVAKAQKAATEMLLNIHLAELRDRMNLTQGEIAASLGVRQPTVSEMEKPGRDLKLSSIKRYVEASGGKLRLDVELPDGTHYGFAV

SEQ ID NO: 11499 - protein, 104 aa, Klebsiella pneumoniae
LKGEDVGDLHVMRFDMWVRCTKAGPEPLDIWELCTIDEAEQRLTDQDKPKKAVKMTLIVHKVITRTQKEAKSYPHFLCINGVLVYGNAARSYVGTLHGAKNDQN

SEQ ID NO: 11500 - protein, 186 aa, Klebsiella pneumoniae
RWGERTYRARLPGARLVTAGGLHHGRLRRVRRCGLATAVLRARGLRGGYRPGCPGAAVPCARRSGRRTSRSAACRAAPVGRAAARGVGPSGRATGLHASRAGARGGIAVNAPDKLPPETRQPVSGYLWGALAVLTCPCHLPILAAVLAGTTAGAFLGEHWGVAALALTGLFVLAVTRLLRAFRGGS

SEQ ID NO: 11501 - protein, 221 aa, Klebsiella pneumoniae
TTVDRVPAPSGCRSKHRRSPGRPVLAAPGSRSMQEWRPARRRRAHRARFVVQTYVGPFEFGLDSVTLLPYSCTESSDMENNLENLTIGVFAKAAGVNVETIRFYQRKGLLREPDKPYGSIRRYGEADVVRVKFVKSAQRLGFSLDEIAELLRLDDGTHCEEASSLAEHKLKDVREKMADLARMETVLSELVCACHARKGNVSCPLIASLQGEAGLARSAMP

SEQ ID NO: 11502 - protein, 81 aa, Klebsiella pneumoniae
VVHETLSELAGVAQMLVERLHFLLEVLYPLRSVRENVIERKLEGIALGVGCYSPKELDNLIRVNEGKRTAEQIYTTATSFP

SEQ ID NO: 11503 - protein, 77 aa, Klebsiella pneumoniae; identical to SEQ ID NO: 9235

SEQ ID NO: 11504 - protein, 136 aa, Klebsiella pneumoniae
MIKWTASFNKKLNRILKFAVQVCSAVDWNEAEHSRSFNLSAIFVLSLHPLLEQFHEFAISRNFVLLTLFCQPVKLAGTQTCRQFVIHAVPLVFPKCIKCTVSLKLLGCIHYIGQIGAAVWPEAHTTEFGHHYSIGA

SEQ ID NO: 11505 - protein, 202 aa, Klebsiella pneumoniae
TARWMKQGSVGPRLYRLGKKSNLDGVIMRLGFVKNTGVSAFLVAMLVVAPQVWAETFTAKVVGVSDGDTVKVLTEQSCDSGKDCRSGKIQYRVRLAEIDTPEKKQPYGSKAKQALSDLVFGRMIKVEQIDKDRYGRLVANLYVDGKWVNAEMVRSGSAWVYRQYAKTPELFKLEAEAKADKRGLWALPESERTPPWEWRRKH

SEQ ID NO: 11506 - protein, 111 aa, Klebsiella pneumoniae
EIFRKNLMLHEDNVMEKVKSVDAVEFTAADKKAMTHAAYAQCFFILAQVMAFPSLGVAGAMVAALCGMMPWLTKFAKEAPSKAFGMVMASLCLAPVYGKLCELVVHAIQGA

SEQ ID NO: 11507 - protein, 341 aa, Klebsiella pneumoniae; identical to SEQ ID NO: 9238

SEQ ID NO: 11508 - protein, 156 aa, Klebsiella pneumoniae
RCCRPARCAARRSPACARRPCAAVPEPVAPFPATVGVGAAARPSRRAARRRSGSRTARTASARPTPGCAPGRRRSWPGGCGGTSRRSSTCHCWSGQPAAGWACVACLATHKGLPAGSAPRLRADSRSSGRREGAGCARPPEDGPSPGPPAAGGTGR

SEQ ID NO: 11509 - protein, 247 aa, Klebsiella pneumoniae
ERSRTRMSGERSSGSTYDLGNVSDSGSLSRYSKSTVRRHRRVSHFEVEFAEALIKKADLDEYAPVTSGIVGKKVSAADLCSITMRTSDNTAVNKVLEILGGPQAVTAYLRKTGDNITRLDRNEPDLNEGTPGDVRDTTTPRAILETLNKLVLGPTLGSDERKQLTTWLESNEVGDPLLRAGVPSDWRVADRTGAGGNGTRGVIAVMWPPKHAPIIAAIYITQTKATMEERNAAIASIGKAIAAEVLE

SEQ ID NO: 11510 - protein, 132 aa, Klebsiella pneumoniae
RDQRAGNIPLSCMAGAHEFRQHGFHARQVGHLLAHVLELVFGQAAGLLAVGAIVEPQQLGNLVQTEPQPLCRFHEFHPNHVRLPIAADAAVRLVRFPQQALALIEADCLHVDPGRLGKNANGQVFQIIFHIA

SEQ ID NO: 11511 - protein, 196 aa, Klebsiella pneumoniae
RRQRTTDRRAGSGPGSGRTDPDGRTGDSQPDDGAGTGRPVVPLPDDGRRVEARGADLQQGCEAAFLLRRVRTRRCAMSAYTVSQLAHNAGVSVHIVRDYLVRGLLRPVACTTGGYGVFDDAALQRLCFVRAAFEAGIGLDALARLCRALDAADGAQAAAQLAVLRQLVERRRAALAHLDAQLASMPAERAHEEALP

SEQ ID NO: 11512 - protein, 181 aa, Klebsiella pneumoniae
GGKLMKNKAKALVLSAALLSSTANAIDLSGTIFDKAAKAYNLDPLLVYSVALAESASGRGNGSISPWPWTLRVPGLPFYAKSEDQAKAKLAEFQQQYGRAIDVGFMQVSIRWNGHRVSSPADLLDPETNVMVGAEVLSEAIQSSPNDLELGVGRYHAWEDEIRARNYGSRVLAIYRNLRDL

SEQ ID NO: 11513 - protein, 189 aa, Klebsiella pneumoniae
ELDRNWEGIEVSLPTERWLDLLDPKLEEERSEITEDLLEAEGREFVAEVRSKLDHALAVLAVEAQQEADMYWNAHKSAREEASEDEQGRVGTRVRILGVSLVAEWYRNRFVEQVPGQKKRVLSTHIKKGRGHAYSMSHFKKEPVWAQELIQQVETRYAVLRQRATALAKIRRALNEYERQLNKTHSDEV

SEQ ID NO: 11514 - protein, 293 aa, Klebsiella pneumoniae
RINSMNDEELELARAEAMKADRCFSKGRLRDEFRMKPKPGVEPVSFYKNGYGGQFGVYRIADCQPMRRRGCSPASQKQIRAQSILSVKARMRSNLAKASVLAQRWVALEPLVLDTETTGLGERDQVIELAVTDIRGAVLLCTRLRPTVEIDPQAMGVHGINEAELSNEPTWNQVAPALARLLSGRHLVIFNSSFDSRMLRQTASAFGDQLSWWQEQNCLCAMKLAADAFGSTNRHGTISLADATCEAGVSWKGRAHSAATDAIATADLVTEIAKVQRDLVVQLQELQSKGNLE

SEQ ID NO: 11515 - protein, 370 aa, Klebsiella pneumoniae
NALSALNGRLHLPNFTPPTSTISSMGKYVRETMKKSPLNLLLLAALTLGASHQAWAQDGTRPGFYERKEEGWFWYKEEPKEPEKKPEKPKPKPVAEAKPTQPKPAAPLPSGPEMFSAEWFRENLPKYKDLAWNNPTVENVRTFLYLQRFAIDRSEQFSDATELAVVGDPFLDEITRRPAATFASQQVDRDAGNAKNMLLKSVADRVGIFFFYKSDDDYSDLQAPLIKMLEQGEGFSIIPVSMDGKPLPSGLFPHYKTDEGHAKQLGIVTFPAVYLASPDGQFAPIGQGPMSLPELNHRILVAAKRNGWVTDEEFNRTRPVLNLENNIAERLASPELGSDLKQLSQASGDKDNFVPPEQLMKYIRDKLQEN

SEQ ID NO: 11516 - protein, 207 aa, Klebsiella pneumoniae
QPGRVNTPGIEKTATVSTGTWEVEMNIGNSGTLGRWVTARHMALAGYITKIIMIETGLTYKQVRRLYQDLERDGYTLERKSRTFRGGATLIHSHTSKIQASLLMQLYFNIGGEAVLRSVNIKALNKAFRMYHAIRKEVPGMKGARWAPFDITDAWCLASELRSGDAMLEVCDNCKCTYFTSVNQRTCVECPFCKEQGRHGGGEKECA

SEQ ID NO: 11517 - protein, 77 aa, Klebsiella pneumoniae
PIFGICQISLYLSGILMLLFFHSLFTYESIFKDSRYIGYGIKDSKCLFTTVSRCWRASGSRCEGKVCLSEPIRAAFP

SEQ ID NO: 11518 - protein, 1207 aa, Klebsiella pneumoniae
GAIGMGAFSIHSIGDSAFLEQILIAVSMITGTGDFEKMVSIGLLLGVLMICIQSVFQGAKQINLQQVLVGWILYACFFGPTTTVTIEDAYTGQVRVVANVPIGVGFAGGVISNVGYTITNLFETGYGVIVPNVTESHFSETLKLLNDVRRRAYDTGVFTALNSANGGGYVDVRRSWNNYIRECTLTKVDLNLMSLDELMNRSTDSALRFNSQLYGTRLYLSTSNPDGADYTCTDGWVAISTATANLSSPVVVDALNSLLGIDTSTGDNAITKLTDSLQAMGATTTSSIDYLKAAVLEPLYYEAAAGRYQDLQDYGSALMINQAIQQRNTQWAAEQSMFMTVVRPMLTFFEGFIYAITPIIAFIIVMGSFGLQLAGKYVQTILWIQLWMPVLSIINLFVHTAASNEMSSLSAGGLNSMYALSSTGDVLQHWIATGGMLAAATPVISLFIVTGSTYAFTSLASRISGSDHVDEKMQTPDLLKQGPVMQSQPAYNHNQFSGAIANGAESMISTFSLGSTLASGVSSAQALQSQKSEAFQSTLGRGFSDGVSQDQAYSRLSNIGRNVSSQNTAQSQLINQQAKNFMDKFQVDDSHSDAVKGAFAMQATGTLDVDQAASMLMPMVGKARAAMKAAAGVTSKSTALVPSGEGKSGNDDDVLDIKARAIGSSESSTNDSSSWSASDVSQFMKGVSYSQTDSQALTNQLAQGFSRSGSESFKQTWGDNLSQNLSKSASELVSASDTFTTMSQLQNQMGSMTNTDFKTLGGAVAQTPAAMNQLNDYFRNAAPQSVKDEAASLQQRYQAYGMSPQVAQAAARMTAMTNSKNYEPGKELGGYQAALQAINTASGRNGAFSGDAYGNNGIKGPNVQGLPGQVQGAVGSGPNIPTGFRENVAGIAGTNPASEAGQLPTNSPLVQNEHAAGTSALNNQAQQTERNVSAPELKKAQDNLMNSLPEMSWSASAWGAWDNSSDWMGRRAEQAGGALIAGGQAGADAFSRAMDQMRTMTPEQRDQFIAATQRGDQAVQEEFGWAGDAMVGMAKLGRNVMGAAASGYDAAKEWLTGKSDLSEAAKGMSIEERGAFYAAALSSAAEAGGGAAQQFMNQYGDEFKETMQSIAQSRYGLTESQAAVYAESFDTNEGRMNQAVQNLKMEYAERNPDGSPMMQGGQPVLSQQNEEFTDKLVNVLQNSTEAGDRSGSYLTAVRGYNIANQRF

SEQ ID NO: 11519 - protein, 63 aa, Klebsiella pneumoniae
GFCGKKRGSVWITVDKIQGYVGTLHGNLWERCTATYGFVARNKYENTSNINVLSGDLERLTCL

SEQ ID NO: 11520 - protein, 279 aa, Klebsiella pneumoniae
ASGGMVIEFLLQQIFSTQRPTSWLGQRCYQKPFSHLQMTWSLALAAITPGKTKSEPETMVAESWLSIATFVICEGGGMLELDIIGAWDARAVNLDQEEADRNVYEFDLTLWNLLSTLAKERPDDAASQFSLGMDTVQKLSLATPSQLEALASGVLISFKLETAEQNIITRLSGDYDPVVFINHSVDEFDAAYWLLFNRVASRDPEMAKEVFGVSRELAELVAKATDSQLRHMSGTTVTHFTLRFAPSIIEEILDDSREELTHPVLKKLQQSLQGRGRWR

SEQ ID NO: 11521 - protein, 488 aa, Klebsiella pneumoniae
STSGTNYRRTKMVTHKILKRSLLALSVAASLVMAPTGAIAANGLQSQMDKLFNEMSNTTPPGVYESQRRGVLAGGRFTAKTRIFDENLVSFAPPSWKAGCGGVDLFGGSLSFINADQIVQLLRAVAANAKGYAFQLALDNVFPDGAKWIENFQKKVQALNQHLGNSCQLAQGFVNDLTSGMDLKHKTDASITATTSGLYEDFFGSKQETSGKSPLEELKANKPDEYNKMIGNIVWKQLKSNNANTWFQYGDNTLLEAIMSLTGTVIIGDLVNDPNSTGTGAKTTPLTTLPGNKITLSDLISGGSVEIYSCDSDTTNCLSAGSSNKTVVLKGIKNQITDMLLGTSSTPGVIYKYATNSGTLTDPEKAFVSNLPGGIGTIVRNLSVLSQDGANLFATESSGAIALTMMYSFSEEFFRAARIAMANSKSPYKKEALELLAQSQQQIRAEYTILSSQYGDLASQIEKYNNLLDNIRKQKYMLATLSNPPSTN

SEQ ID NO: 11522 - protein, 177 aa, Klebsiella pneumoniae
RHQGQRTEADQGHRRRRLSVQRQAVSQQANDNSESRFMGLMTRIADKTGALGSVVSAMGCAACFPALASFGAAIGLGFLSQYEGLFISRLLPLFAALAFLANALGWFSHRQWLRSLLGMIGPAIVFAATVWLLGNWWTANLMYVGLALMIGVSIWDFVSPAHRRCGPDGCELPAKRL

SEQ ID NO: 11523 - protein, 334 aa, Klebsiella pneumoniae
RVLGTDNRNMQKEKLMAENKEIPWEKELIEKYMFTLHKEQVKDRRWRTMLRVLRASGFVLLMIGFIILASNPGGMPWQSAKAGAPHTAYINIRGEIAAGTLADADHLIPSIQAAFDNPNSQAIVLRINSPGGSPVQAGRIYDEVKAQRALHPEKKVYAIIDDIGASGGYYIASAADEIYADRASLVGSIGVISSGFGFTGLMDKLGIERRAITSGEHKALLDPFSPLTSDMKKFWEGVLSKTHQQFIERVKAGRGDRLKDDPEVFSGLLWNGEQAKDIGLIDGLGSLNSVARDVIHQSNLVDYTPTEDIIRRLTQRAKLEASSFVQELSAVKVY

SEQ ID NO: 11524 - protein, 122 aa, Klebsiella pneumoniae
GESMELQEAKEALDSLHPHKASAPLRLVIHQPGGIGGTPTVGVKAIHAGFDWDSNTILIYPEEQLTRLTPDEVAAITKSVSKGQSWHSYQQFKKYREQLAEATEEINRLRAELGRYQNNGRG

SEQ ID NO: 11525 - protein, 116 aa, Klebsiella pneumoniae
YEIIIFIRSASQRDIMSHQLTFADSEFSTKRRQTRKEIFLSRMEQILPWQNMVEVIEPFYPKAGNGRRPYPLETMLRIHCMQHWYNLSDGAMEDALYEIASMRLFARLSLDSALPD

SEQ ID NO: 11526 - protein, 105 aa, Klebsiella pneumoniae
TRHIATRCDNMTASVAATELAKLGKCEAMIKKVASHPRPALSKRPQSPQGTDSTLRGEFAHFRYEAAALRFMSGTAGAKRRIYQLVFSATVAAGALTMLAAWTTS

SEQ ID NO: 11527 - protein, 154 aa, Klebsiella pneumoniae
VGSITKNEKLITLIVAAAASCSSVYAVTLPTSEVDAYILAMNTMSPITAKYTIQYKQAVEQKCNTALSVEQLNSKAFTNVVQAMVSSETVDRMGLDAAGGSLQDTLSVIGKNVTCSDLNAPFKALLDDKDFTRKHQHLSKVLHTWDEVVSQSKP

SEQ ID NO: 11528 - protein, 577 aa, Klebsiella pneumoniae
SAPISTMLNTRVHQSEVSMATDTPRIPEQGVATLPDEAWERARRRAEIISPLAQSETVGHEAADMAAQALGLSRRQVYVLIRRARQGSGLVTDLVPGQSGGGKGKGRLPEPVERVIHELLQKRFLTKQKRSLAAFHREVTQVCKAQKLRVPARNTVALRIASLDPRKVIRRREGQDAARDLQGVGGEPPAVTAPLEQVQIDHTVIDLIVVDDRDRQPIGRPYLTLAIDVFTRCVLGMVVTLEAPSAVSVGLCLVHVACDKRPWLEGLNVEMDWQMSGKPLLLYLDNAAEFKSEALRRGCEQHGIRLDYRPLGQPHYGGIVERIIGTAMQMIHDELPGTTFSNPDQRGDYDSENKAALTLRELERWLTLAVGTYHGSVHNGLLQPPAARWAEAVARVGVPAVVTRATSFLVDFLPILRRTLTRTGFVIDHIHYYADALKPWIARRERWPSFLIRRDPRDISRIWVLEPEGQHYLEIPYRTLSHPAVTLWEQRQALAKLRQQGREQVDESALFRMIGQMREIVTSAQKATRKARRDADRRQHLKTSARPDKPVPPDTDIADPQADNLPPAKPFDQIEEW

SEQ ID NO: 11529 - protein, 355 aa, Klebsiella pneumoniae
TLQIKRNVLMARKLVEFDDVAAAAQKLKDAGKRPTVIAIRDIIGKGSFTTISTYLKQWSEEHSLDEEPVEVVLPESVMSDAELFLQKIYTVAKASADEQLERERELLRQKELEYQEDMQQAVDMANDATERAELLEEQLEALTNKKTELDAALGKAENSLSLKSAELERSLADIDKLEKRIVELEGKLEAKAADLTRAQDHLEQAESENRSLSQKLATTEGELEVQKGKSIEQTEKLRAAQEQNTSLKEQLENVQAKLAQSQDSLATAKAHGESAERECQRLSGEVEKLDAKLSSAEAEARALVQDKGMMAGQLQEKDQQAKSLEQRLNDALTKISGLEQELVKAGKGGKKKEEN

SEQ ID NO: 11530 - protein, 144 aa, Klebsiella pneumoniae
ELMIKITTKLGCLLAGLLVLSACSSVPQPNNEYAKALDDTKQVCAACALVGNDLLVALNKSCDTPMTPETLTSVMNSNPMFAAMMAINSIGGTDFYQVYRDAAIDTLRCNEMDSWPDRTKVRFQQPDMQKALALRVSARQQKAN

SEQ ID NO: 11531 - protein, 178 aa, Klebsiella pneumoniae
EGPMKKVTFISQSEAERLEPVAGAAMISITDPDKSPAALGQWEQLYRDSFYDGGYSENTIHTMKAAFRMNYASYIDSSQAEKLSTFLDGLVGTGIDQIFVHCYYGESRSGAVALYLQNKHGFTPNKPITKPNRTVYELLCNPTKFEPLIQSYETQHIEELPLHLKIWDLLLVAVGLRR

SEQ ID NO: 11532 - protein, 320 aa, Klebsiella pneumoniae
ISRITINALSRIWETPFAGPVILSLQSNSMPRGKNMQIRDYMTKLFDAFGDVEEVTREMLLEQAELIHTISDKCQSTGLFLDSQVRFNQFVQEIEADDKVEDRLLHAWCWVMDRIVKAPTSFHMDGAVILTMPLVARYLPPVEQEPETIVVNLDEDYKAPVGNQTLCELVMERRHWPQGATCATQEADGGVLYWDAPVDVVEEGRKVAGKHGMMAEIGLKHQVDAWYADMDETRLATDWNTAVITPHCLLLSYLDVLQKNKVPFDEGVQLAAEWVKQLGGEFREDTEEAPEAEASVLSLGRATAHCFKPYPDTKNFYYEA

SEQ ID NO: 11533 - protein, 100 aa, Klebsiella pneumoniae
GEGMRLSSTQKDVLFILYAIEAGGKAEPVPGVKILEMINSARQSGIHGTNFRTSCHTLVENGLLNKYRNASLKLAFRLTDDGRERAGEIYRKRLEEEQEK

SEQ ID NO: 11534 - protein, 100 aa, Klebsiella pneumoniae
EVVVAGSKWDGKISNLNISEQAFPELYRELSQMQHKARSDRLRALALLGLYSLRFSGNIGSFEQQSSESQPAQHQNSPVQTDAKLNSQRDSLKGKLMGSV

SEQ ID NO: 11535 - protein, 94 aa, Klebsiella pneumoniae; identical to SEQ ID NO: 9277

SEQ ID NO: 11536 - protein, 101 aa, Klebsiella pneumoniae
TYPVLVERNDVQRFKRILRSFKPAPDSILLLPSHELEKGHSTSHKGEKTQAIGGSYDRRYQGPQHDEAVMFKLGHYSPPIPTSVQDFSKMQPRLAAQFGQP

SEQ ID NO: 11537 - protein, 98 aa, Klebsiella pneumoniae
GPEVVMKPVLWIFVLIIAPFVIAKVDQWRKRGIGDTWAWWKSENMPYELRSATLFLSEQDISTTQPVPMHGRVDQVYQTQEWGSHSLGHQAAPGKPHL

SEQ ID NO: 11538 - protein, 152 aa, Klebsiella pneumoniae
REGVMLKRGIINLAASYIIVDALLRNAAIWIFGLSFSVGGTYVTGEASTWVVYLATSGAMTLCSVVTAYLLVTYHRWGLMTARVWLLLSACLNGYAVYLSSHNIQLVVALLSSLFIALWMLKTLEQPAVKGTYKVIADLHRQLWGMLKGQTQ

SEQ ID NO: 11539 - protein, 334 aa, Klebsiella pneumoniae
KQSLEDFMSQFVLGLDIGYSNLKMAMGYKGEEARTVVMPVGAGPLELMPQQLTGGAGTCIQVVIDGEKWVAGVEPDRLQGWERELHGDYPSTNPYKALFYAALLMSEQKEIDVLVTGLPVSQYMDVERREALKSRLEGEHQITPKRSVAVKSVVVVPQPAGAYMDVVSSTKDEDLLEIIQGGKTVVIDPGFFSVDWVALEEGEVRYHSSGTSLKAMSVLLQETDRLIQEDHGGAPGIEKIEKAIRAGKAEIFLYGEKVSIKDYFKKASTKVAQNALIPMRKSMREDGMDADVVLLAGGGAEAYQDAAKELFPKSRIVLPNESVASNARGFWFCG

SEQ ID NO: 11540 - protein, 560 aa, Klebsiella pneumoniae
CCLSINVTTIANKLPTGALLSRMPHIRRQPCVFSGHRLLRNLKLQKINSLKKLKINYLLIGIVTLLLAAALWPSIPWSGKPENRVAGIIARGELRISTINSPMTFATMNNKAFGLDYELAKQFADYLGVTLKITVRQNISQLFDDLDDGQADMLAAGLVYNQERVKNYQAGPTYYSVSQQLVYRVGNTRPRTLAALTAEQLTIAPGHVAINDLQTLKAEKYPDLAWRVDEKRGTTALMQAVIDGKLDYTIADSVAVSLFQRVHPELAVALDITDEQPVTWFSARDDDNSLSAAMLDFFNNINEDGTLARLEEKYLGHGNDFDYVDTRTFLRAVENILPEVQPLFEKYAREIDWRLLAAIAWQESHWDPQATSPTGVRGMMMLTRNTAQSLGLTDRTDAAQSIDGGMRYLQDMMDKVPDSIPKDERIWFALAAYNMGYAHMLDAMALTRKQKGNPNSWADVKLRLPLLSQKPYYSKLKYGYARGHEAYAYVENIRKYQISLVGYLSEKERQQQQTLALAEDYPAVLPNELEQPQETTLPFFKFRADKQMDNARMKLPGHLY

SEQ ID NO: 11541 - protein, 378 aa, Klebsiella pneumoniae
RGRFFMHNQAPIQRRKSKRIYVGNVPIGDGAPIAVQSMTNTRTTDVAATVNQIKALERVGADIVRVSVPTMDAAEAFKLIKQQVNIPLVADIHFDYRIALKVAEYGVDCLRINPGNIGNEERIRMVVDCARDKNIPIRIGVNAGSLEKDLQEKYGEPTPQALLESAMRHVDHLDRLNFDQFKVSVKASDVFLAVESYRLLAKQIDQPLHLGITEAGGARSGAVKSAIGLGLLLSEGIGDTLRVSLAADPVEEIKVGFDILKSLRIRSRGINFIACPTCSRQEFDVIGTVNALEQRLEDIITPMDVSIIGCVVNGPGEALVSTLGVTGGNKKSGLYEDGVRKDRLDNNDMIDQLEARIRAKASMLDEARRIDVQQVEAK

SEQ ID NO: 11542 - protein, 570 aa, Klebsiella pneumoniae
KRKSRSVGGHHMSIFEAHFRRLHARYGAGQTHELQMHEIAAIFGCSVRNCRIALKKMHQEKWLDWQPQRGRGKRSRLHLLTSPEKLFSQNVNKLLEKQDYGDVLRFIGNDKYLLDRLSLWRFGVQDKSSETRVRIPYYRNLDPLNPLVPLRRTERHLLRQCLSGLTRYDAVQGRVVPDIAHYWIHNEDFTRWEFWLKSTARFADGSELDASTVQRCLLAASQSPQFAPLFSPIKTITADAPWHLVIETHHPVRRLDCLLATQPTMLFDYQHGHIRCTGAFHLQEHSDNFMVLRRNQHWHQARPGLDEITIFTWAPEHISMSFIPLLRGEEAQDDRPLNERSLEQGCCFVLLDSDGAFADEAGRRFINYLLQPVELLSQTQLPDEYARILSVAQGMLPQWNHRPVDYGGITAPFNLRQRVIISTFQQPELVELAGAIRILLERWHIRAEIRIDPFDHFNSQPRLPADIWLSNFMLDTLSVPAFLEWLASTTLFTRLPEAQRQNLNTLLPTILNSDNEQAFATIAAFFHEMTHQRYVIPLLHHWMEFATEKSFTWRDLNTLGWPDFSQLWLE

SEQ ID NO: 11543 - protein, 446 aa, Klebsiella pneumoniae
EIVSMATTPSVPSLPELPSVPTTILPAIAELTAALGIPRNVLASDEEISFAWQDLPRELRLIPSDLRGELVARMCVAVSAGLFDGAMNYIWNAAILQIRQKVRNFGLPIVSQMLQSDFEEKHLIDLQDSKLLELALKLNLVNEDGYFFLDHCREMRNNFSAAHPTIGNINDREFTTFLNRCVRYALADASSPRGVNVADFIASIKSARFTGQQCAIWIQRINDTHAAQRQILIGMVHGIYCDPNTSEPARLNAIDLCSAISEQFTAAIRSDLINKHAEYAAKGDEQRHTASTQFFEKLGQIRYLSEADQHIIFYRAIERLWNAHNGMNNFYNEPPFAERLCELATHGAVPETVQEYFVQVVVACAIGNGYGVSHGALSYYTEMIRTFSPREIATMIRLYSDRTNIVGYRIATYSRGRERFKEYLRTLDPASISSGVRSDYDRILRE

SEQ ID NO: 11544 - protein, 1312 aa, Klebsiella pneumoniae
RPFPPLAHPESFEDERLMMEILRGSPALSAFRINKLLARFQAANLPVSAIYAEYIHFADLNAPLSADDRERLARLLQYGPSLSSHTPTGKLLLVTPRPGTISPWSSKATDIAHNCGLAQVVRLERGVAYYVEASTLTEAQWAAVAAELHDRMMESVFDALEAGEKLFAHHHPTPVTSVDLLGEGRQALIDANLRLGLALADDEIDYLQDAFTRLGRNPNDIELYMFAQANSEHCRHKIFNADWIIDGEQQPKSLFKMIKNTFEKTPDYVLSAYKDNAAVMEGSEVGRYFADHQTGRYDFHQEPAHILMKVETHNHPTAISPWPGAATGSGGEIRDEGATGRGAKPKAGLVGFSVSNLRIPGFEQPWEEDFGKPDRIVTALDIMTEGPLGGAAFNNEFGRPALNGYFRTYEEKVTSHNGEELRGYHKPIMLAGGIGNIRGEHVQKGEITVGAKLIVLGGPAMNIGLGGGAASSMASGQSDADLDFASVQRDNPEMERRCQEVIDRCWQLGDANPILFIHDVGAGGLSNAMPELVSDGGRGGKFQLRDILSDEPGMSPLEIWCNESQERYVLAVAPEQLPLFDELCRRERAPYAVIGEATAEQHLSLSDSHFNDQPIDLPLDVLLGKTPKMTRDVQTLKAQGSALDRQPIILADAVNRVLHLPTVAEKTFLVTIGDRTVTGMVARDQMVGPWQIPVANCAVTTASLDSYYGEAMAMGERAPVALLDFAASGRLAVGEALTNIAATQIGELNRVKLSANWMAAAGHPGEDAGLYEAVKAVGEELCPALGLTIPVGKDSMSMKTRWQEGSEQREMTSPLSLVISAFARVEDVRHTVTPQLSTEDNALLLIDLGKGHNALGATALAQVYRQLGDKPADVRDVAQLKGFWNAMQALVAQRKLLAYHDRSDGGLLVTLAEMAFTGHCGVEADIAALGDDHLAALFNEELGAVIQVRAANREAVEAILAVNGLADCVHYLGKAVEGDRFVLTAGGQTVFSESRTTLRMWWAETTWQMQRLRDNPACADQEHEAKANDADPGLNVKLSFDINDDVAAPYIATGARPKVAVLREQGVNSHVEMAAAFHRAGFDAIDVHMSDLLAGRTGLGDFHALVACGGFSYGDVLGAGEGWAKSILFNERVRDEFATFFHRPQTLALGVCNGCQMMSNLRELIPGSDLWPRFVRNQSDRFEARFSLVEVTQSPSLLLEGMVGSRMPIAVSHGEGQVEVRDSAHLAQLESKGLVALRFVDNFGKVTETYPANPNGSPNGITAVTSESGRATIMMPHPERVFRTVSNSWHPENWGEDSPWMRIFRNARKQLG

SEQ ID NO: 11545 - protein, 120 aa, Klebsiella pneumoniae
KANPWTRFKMPKIVFLPHQDLCPDGIVVEAETGETILDAALRSGIEIEHACEKSCACTTCHCIVREGFDSLAESSEDEDDMLDKAWGLEPDSRLSCQARVTDEDLVVEIPRYTINHAREH

SEQ ID NO: 11546 - protein, 401 aa, Klebsiella pneumoniae
IICPSERDSMQLRKLLLPGLLSVTLLSGCSLFNSEEDVVKMSPLPTVENQFTPSTSWSTSVGDGIGEFYSNLHPAFADGVVYAADRKGTVKALNADDGKEVWSVNLAEKDGWFSRTPALLSGGVTVSGGHVYIGSEKAQLYALNTSDGTVAWQTRVAGEALSRPVVSDGMVLVHTSNGQLQALNETDGAVKWTVNLDMPALSLRGESAPATAYGAAIVGGDNGRVSAVLMQQGQMIWQQRISTATGPTEIDRLNDVDTTPIIVNGVVYALAYNGNLTALDLRSGQIMWKRELGSVNDFIVDGNRIYLVDQNDRLLALTTDGGVTLWTQSDLLHRLLTAPVLYNGNLVVGDSEGYMHWVNPEDGHFVAQQKVDSSGFLTDPVVADGRLLIQAKDGTLYAITR

SEQ ID NO: 11547 - protein, 808 aa, Klebsiella pneumoniae
KRIPRLLCGCFLLPEESVMKQACIDAVANTLGRQPKADEIKNIEDRIKDAVRVIARRNAREGKTGIPDAETYRQAAELAAAQAVHAVFKKRQRVAQNAIAIAKVRDTLNKAIPENEQTPIALQQFIFSGRRGRDKQPDINVVSAEEMATGAYQDWTRQLSAELTAAGDDVQKFFYQSQALGEQRLRNLLPFDREASRSGQLQILKEIYGEDTGNPAAKKIAKVWGDVTSRARQEMNDSGFDIGLRDDWHLPYVDDAELIRAAGRDEWLSSLPLNERAAAIATGLQPPQDFARQAWVDDVWNTQDRSQYVNLDGSPMNDIEYRQALEAIYETKVTEGANKIDPGAFMGSGGIKNRGSQSRVMSFKDAQSHFAYMERYTQQPVVGVMMSHLQSSSRDLGVVKAFGPDAASNFKLLMDQIYQRATSTTGGGHDIGTMNDQRQLVERMFNSMAGLNGVASSSVFSSAVGGLRNLMTSAMLGTSVFTAASDQAIMRANAQALGFDRNGMRLSANTLRNLFNGDAKRANAELGLLVDTHAAVVSKMGGFDLSRGITGWFAEKTLKWSGLIAMDRANKASFGLLMFKNIGELSRKYKSLDALTDSDRTVLANKGWTPEDWAIMSAAELRPLTPDGHKGMTPDAIYDVPDETIRNILADRIEKVRAGSDQALAALGDMTDAKRKTLKQAFDAEVEQTISRMVRNARAEAAQHLLGITHGEMTSAVTTATGLDTFARDTSGDLLKSFMLFKTTPMAGMRQLVTRAQDLETLPAVKYLASYIAGTTLAGMFANQMNALLSGNDPLDMTKPQTWLQALV

SEQ ID NO: 11548 - protein, 223 aa, Klebsiella pneumoniae
KLPPRLRPGGGVGREKPPGNLSLFWLPRRKTWKVQVPLQVFQPGWHKNFLIRHERRLMRATAAHNGRGLKQIFQHFKTQAASRYLGASTRQVRSSSARNGRPVGIRRGNRRKRWLFYAYDRLRKTVVAHVFGERTMATLGRLMSLLSPFDVVIWMTDGWPLYESRLKGKLHVISKRYTQRIERHNLNLRQHLARLGRKSLSFSKSVELHDKVIGHYLNIKHYQ

SEQ ID NO: 11549 - protein, 227 aa, Klebsiella pneumoniae
RMNPIVINRLQRKLGYTFHHQELLQQALTHRSASSKHNERLEFLGDSILSFVIANALYHRFPRVDEGDMSRMRATLVRGNTLAEIAREFELGECLRLGPGELKSGGFRRESILADTVEALIGGVFLDSDIQNVERLILSWYQTRLDEISPGDKQKDPKTRLQEYLQGRHLPLPSYLVVQVRGEAHDQEFTIHCQVSGLSEPVVGTGSSRRKAEQAAAEQALKKLELE

SEQ ID NO: 11550 - protein, 116 aa, Klebsiella pneumoniae
DRNPMKKIDAIIKPFKLDDVREALAEVGITGMTVTEVKGFGRQKGHTELYRGAEYMVDFLPKVKIEIVVTDDIVDTCVDTIIRTAQTGKIGDGKIFVFDVARVIRIRTGEEDDAAI

SEQ ID NO: 11551 - protein, 178 aa, Klebsiella pneumoniae
MHDPEVTMDYFTLFGLPASYTLSLEQLAVRYQDLQRQYHPDKFASAPAAEQLAAVQHSATINQAWQTLRHPLTRAEYLLSLHGFDLASEQHTVRDTAFLMEQLELREELDEIGQAKDDARLEGFIKRVKALFDTRQQLMVDQLHNESWEAAADTVRKLRFLDKLRSSAEELEEKLLDF

SEQ ID NO: 11552 - protein, 303 aa, Klebsiella pneumoniae
SQRPLAFFIGMTTMAEPQPLFDYTGYLPECPTWSEAEKALYWADIMECEIHRYDIRSGEHQVLQFPEEVGCFALREKGGFIVALRSGIWLTDAHGLLRRKVCDNPSNPELARFNDGGTDRDGRFYAGTFWGPGDYNGALLMRVDNDLQPKVIQCDIHGANGLAFSADRRWMYTSDTPNAVIYRTPLDEQGEPGRREVFRRFQPGEGIPDGAAIDVEGCYWSAMFDGWRIARFSPQGEELESYPMPVRCPTMVCFGGADMKTLYITTTRENMEDDELAQYPLSGAIFTLPVAVAGMKKLPFREC

SEQ ID NO: 11553 - protein, 449 aa, Klebsiella pneumoniae
RGTPDKTDCSLCWSNITMTESSITERGAPELADTRRRIWAIVGASSGNLVEWFDFYVYSFCSLYFAHIFFPSGNTTTQLLQTAGVFAAGFLMRPIGGWLFGRIADRRGRKTSMLISVCMMCFGSLVIACLPGYAVIGTWAPALLLLARLFQGLSVGGEYGTSATYMSEVAVEGKKGFYASFQYVTLIGGQLLAVLVVVALQQVLSDEDLHAWGWRIPFALGAVLAIVALWLRRQLDETSKQETRALKEAGSFKGLWRNRRAFAMVLGFTAAGSLTFYTFTTYMQKYLVNTAGMTASTASVIMTAALFVYMLVQPLFGAFSDKVGRRTSMLCFGVLATLFTVPILSALQKVSSPYAAFGLVICALLIVSFYTSISGILKAEMFPAQVRALGVGLSYAVANALFGGSAEYVALSLKSAGIEHAFYWYVTVMAAIAFLVSLMLHRKGKGLRL

SEQ ID NO: 11554 - protein, 166 aa, Klebsiella pneumoniae
GARPARHLAGAALYRRRHADWPDTRDYHRVPVPAAQQTGECAMMIYCARITAIGLFVADGLTDKMLITFDSNGPKDCLDYSQSLEPSFREESLMILPGDRLLLAGHDYLVTAVGKGAQQALFELGHLTLVFNGDLNPCHVGAVHLSGPVPKLHDLHGNLVIEEGRP

SEQ ID NO: 11555 - protein, 417 aa, Klebsiella pneumoniae
NVLTDTKLKNLKPQGKMYKVSDRDGLYVAVLISGTISFRYDYRINGRRETLVIGQYGRDGITLAEARDELIAAKKLLNAGQSPAAAKRDGIKRIRGAETFTVHTDAYMKHVVLADSTRAMKQSVIDRDILPVLGNKMMSEITTPMVLDLCDRIVERGGRATAVQAREIISSVYRYANDRGHGLFNPAADIKPSAIAMFKPRDRCLQPEEIGVLFRSLDTVSTLPTLKLAVKLILITMVRKTEFIMATWKEVDFSKGTWTIPPDRMKGSRSHVIYLPPQAQDLMVGLQMCAGGSDYLLPGRYSTSKPLSNAALNSVIDRAVAAAVDAGESLQPLTVHDLRRTASTLLHEAGFPSDWIEKALAHEQKGVRAVYNKAEYSRQRAYMLQQWANMVDAWINGEHYDLVPFSPSAFEKWMNEQ

SEQ ID NO: 11556 - protein, 106 aa, Klebsiella pneumoniae
NVLTDTKLKNLKPQGKMYKVSDRDGLYVAVLISGTISFRYDYRINGRRETLVIGQHGRDGITPPEARDELIAAKKLLNAGQSRAAAKRPGIKRICWSGRSRQVRHT

SEQ ID NO: 11557 - protein, 256 aa, Klebsiella pneumoniae
VQEFLSARLLRMSQSKFALPRNGFTFKRFFVAHDRCAMKVGTDGILLGAWAPIAGVKHVLDIGAGSGLLALMLAQRTGDDVHVEAVELDEEAAAQARENALASPWASRIEVWQADIHQWQPSQTRRYELIISNPPFFAEGVPCATSQREQARYTTTLDHASLLTCAAEHITEEGFFCVVLPVDIGNAFIERARAMGWHLRLRTDVAETELRPPHRVLLAFSPTAGECFSDRLAIRGPEQQYSEGFTALTEDFYLFM

SEQ ID NO: 11558 - protein, 332 aa, Klebsiella pneumoniae
RMNTEATQDHQEANTTGARLRHAREQLGLSQQAVAERLCLKVSTVRDIEDDKAPADLASTFLRGYIRSYARLVHIPEDELLPMMAKQAPIRAAKVAPMQSFSLGKRRKKRDGWLMSFTWLVLFVVIGLSGAWWWQDHKAQQEEISTMADQSSAELNGGDANSQNVPLDTSAPAAPTADSAANSAPTDTASAPTTSAPAQTPADNNAVVAPSQANVDTAGTTPAAPATTPASPLPTDQANVTTPAASAQDLVMNFSADCWLEVSDATGKKLFSGLQRKGGNLNLSGQAPYKLKIGAPAAVQIQYLGKPVDLSRFIRTNQVARLTLNAESSPAQ

SEQ ID NO: 11559 - protein, 412 aa, Klebsiella pneumoniae
SENTADQPVNADPPQTADQFSHFHRIVGDTLQIPIMFHYRGVGADELQLFLPHGPQLPLWIVDQNGVFQIEPPGARVQVVASEQHPLIVNPHAFQVVAVIVILPQADDQLIGIDIILQPAEETPQVDLIQIGKGADDFKRLIFRNVEIVSRFIADNNLHLFSVAQQLDDISYQYGREVEVGGADRQLVFGTGHQVKDGFIQQARFTQAYQRGDGEFFVTSGADKMVAAVAELLTVLANVVFDFRASWPIRSVETVNAAPLNQIVVDPVEHDVRHFAVTDALIAIIAILIMLMQINIIQAGAAVEDAVINNKAFEMENAERLPGVNRHAVNGDIYPWIFIGHPTIPVGIGIRGGGADTATLSAVPVHQNADIQFRTLAFGVIKGLQNSFSAIILLQIERNNAYTLSGVGNPGQ

SEQ ID NO: 11560 - protein, 375 aa, Klebsiella pneumoniae
SRDTSPGTERLKGGLTMQIGFIGLGAVVETAYLPALRRLGDVIDRCQGYDLDCSRALPGIQRCSSLSALLAEPLDTLFITTSSLQHLPVLERALASGISRIVVEKPIVANLEQAARLRALLAPPEQAARVLALDHWMARGVALNAPGPLWRAEGEASGLPPPHLSAQDIVWLEGSLQEPSGFNSAGEPVALNFATGELDTRQLRHPDGVILDIGTHVLAMLRETLHASGSDTALSLSLRVAKDRLGHDIAPGDTSTAEGVAHLQGTLGTIPLNIWLNKYAGPAGGQKGMRIGLRDGQIITLDRAPEGEVVTLQDGERVQRWTRPGAIYTHCLDEQILGADNLFIRAPDSVAGLTQRRLEEVEWLLRLQQQLRGPH

SEQ ID NO: 11561 - protein, 178 aa, Klebsiella pneumoniae
VICTLRSNCRRWFSHKRTWRSANLCITFKSHVSHNELIMNTLRYFDFGASRSLLLLIARIAVVILFILFGYPKLLGFDGTVQYMAASGAPMPTLAAIIAVIMEVPAAILIVLGFFTRPLAVIFIFYTLGTAVIGHHYWDMTGDAVLPNMINFWKNVSIAGAFLLLAITGPGAISLDRR

SEQ ID NO: 11562 - protein, 76 aa, Klebsiella pneumoniae
CASTDTEQRQTSRRARRIQRRKSTLKADREKQNKRLTLNEENVLYGTSRQSAKARRNCSLTIYQTICVGTQSDMDS

SEQ ID NO: 11563 - protein, 264 aa, Klebsiella pneumoniae
IRSTFFLSCSEQLTDRRHDYSWIMNNENNLRTFLRLIAWRIVARWITKGGPKMNMPSINIQIIITLNSMHKGKTMSVQPVEISKAYRLLQVGSTTMISAKYDGVENVMSAAWVGLAGERKVVAYIGTQAFTRQLVEKSGYFVVQIPVVSQMATVFYAGGRSYADAPDKNDTIPFFYQPEFDLPLVAGCAGWLVCKVMPYPDIQQQHNLFMGDIVAAWSDDRVFRNGHWIFDDAPDELRTVHYVAGGQFYAIGKGSKFDHGPGQD

SEQ ID NO: 11564 - protein, 287 aa, Klebsiella pneumoniae
RVYTGGKMKQLHHSGLPLYLDDDGVMALKPPLNYLGFGRKSAGQMAVVLPEFTEAQRDELAYDVYRGLSFAEDQERLAADQYQYDITIIMPGTIGKERKKTSGHYHGYNDTRRNTHPEVYEVIKGTAAYILQKSPDFAVAPKDLLVDDLIVAVVKEGQSIIVPPNYGHCSINIGDGPLVFSNLAYKPCAVHYDTVQFYHGMACYIVEENGQLCVRKNHYYPRIPRIKFATVKENPHLGITFDTPLYLRYRAAPERFHFLGHVDNYVREITGMLQYEDDLFPLFQEDA

SEQ ID NO: 11565 - protein, 101 aa, Klebsiella pneumoniae
RAHTVLHPAGGLAGNVPGIQSRQSSQIMSGSGMPSARQRREIPVAGSPAGDRQNQGLSAHLPHPQYLSAVSRVSKKGGTGWDKWYTQGWCGLQRPTLENLV

SEQ ID NO: 11566 - protein, 102 aa, Klebsiella pneumoniae
ICITPPPRRLARRTEKREVTMKGALGKKELLAAVPVSMSTIDRMEKNGEFPKRFWITDKRCAWNSEEIERWLDERQQNGTTEFAGKKPPVEQRVFRPVGNAA

SEQ ID NO: 11567 - protein, 397 aa, Klebsiella pneumoniae
RVITRPENIMSEQIVTPDTAALTVPNKDAKINLLDLNRQQMREFFKNMGEKPFRADQVMKWMYHYCCDDFDEMTDINKVLRSKLKEVAEIRAPEVVEEQRSTDGTIKWAIAVGDQRVETVYIPEEDRATLCVSSQVGCALECKFCSTAQQGFNRNLRVSEIIGQVWRAAKIVGAVKTTGVRPITNVVMMGMGEPLLNLNNVVPAMEIMLDDFGFGLSKRRVTLSTSGVVPALDKLGDMIDVALAISLHAPNDTIRDEIVPINKKYNIETFLNSVRGYISKSNANQGRVTIEYVMLDHVNDGTEHAHELAALLKDTPCKINLIPWNPFPGAPYGRSSNSRIDRFSKVLMEYGFTTIVRKTRGDDIDAACGQLAGDVIDRTKRTLRKRMQGEAIDVKAV

SEQ ID NO: 11568 - protein, 160 aa, Klebsiella pneumoniae
FDATRRTLPGLDIHRTFQRWIGAFGNCETGAAWLSSARVVKCWVKSRNERNPYPLLPAVRPGTQRRLPVINWRKVGMTSSHHGPYDQGYTRATMAYTKRSDLARASGPHKVCRSPDWSLQLDSMKSESLVIVDQNATVNTFPGLVHTARHTMGVGCKRSR

SEQ ID NO: 11569 - protein, 262 aa, Klebsiella pneumoniae
SSQTMSDTKNELETLLEKAATEPAHRPAFFSALLEATVWVPGRAADGEQIVEDSALDLQHWEKDDGTSVIPFFTSLEALQQAVADEQAFVMMPARTLMAMTLGESLFLNPKLPSGKEFTPREISHLLGEEGSPLSTQTVLEGGEALLLSEVAEPPAQMVDSLTTLFKTLKTVKRAFLCSIKERADAPANLLIGIEAEGDIEAIIQTTGSVATDTLPGDEPIDICQVVEGEKGISHFMIAHITPFYEKRWGSFLRDFKQNRII

SEQ ID NO: 11570 - protein, 842 aa, Klebsiella pneumoniae
KELTMPTVPQYQRQSQTQTAPVMTSNLRVPENPLVQGIQQAADTSINMMADAKRKADVALSQDALLQFNQFGDDQFNNPDNGLITKQGKAALGQSDVVMQNMQQKAQDLLGTVPDGEARQQLSFQLQQSMQSFHNQARRYEVSQFQQFQDQQFSAIKQNVVTQSQGLYGDDTAFVNTVKMGFDAIEQYAAAHGWSQEQVIAEKEKLKEQAADSALSTAASQQYIQFMQQNGEPGDNEGAPRVTAHGNSSAARGLRNNNPGNIEAGSNSWDGQAGSDGRFAKFVTPEHGIRALGKNLLSYQRQGYDTVSEIVNRWAPASDGNNTEAYIAALCKKLNVTPNDQLNMSDINTLRQLCAGIIQHENGKQPYSEDQLNTGVSAALGLTTLESPKRYSGNQAFDAASPQQQAAYLRQSMELRNQARTQFKAQLVDQVQDATAAYLKGIQFDNPPSQGDFINAFGYREGTQRFNDFENLRVAGQYIGSFRTMPTASIQQYVSDLKNQVGNGEGLAGRAAAFDHVQAAAQRIISQRQSDPFQSAVDIGAYKPISNSTPDAIASEVKNRYAAQDQLKAIGITPPLLSKQESQVLTDAVRNSTDVNQAISLLQGLGRTLPPKALRSVASSIAPGSPGTAYAALLLGQQDNQYDNRSGIIPYSQFVSYKPTLDKYDVAKTVLAGDQMLNPTKAMKDAGISAVSIPSDEKLKTYFDKEVGNAFAYSAQARQVAWGNFRSAYAALAYQSGDASKTNTVSPDSDIAEKAAQYATGGVYKGLNGSDVVMPFGMDKTTFRDRYTAAGREAMTQAGLNPSSLENFKAVNVGNNQYRLVNGSGRWATDPRTNQPVTVRVE

SEQ ID NO: 11571 - protein, 245 aa, Klebsiella pneumoniae
LVMTKLIVPQWPMPGSVAACSSTRIGGVSLPPYDSLNLGAHCGDNLQDVEENRRRMFAAGGLPSYPVWLEQVHGTEVLTLDGGPYPSKRADASYSRTPGTVCAVMTADCLPVLFCNRDGTEVAAAHAGWRGLCEGVLEATVARFADKAENIMAWLGPAIGPQAFEVGPEVRDAFMAKDENAHRAFRPAGEKYFADIYQLARQRLANVGVEQIFGGDRCTLSEKDDFFSYRRDKTTGRMASFIWLI

SEQ ID NO: 11572 - protein, 98 aa, Klebsiella pneumoniae; identical to SEQ ID NO: 9193

SEQ ID NO: 11573 - protein, 311 aa, Klebsiella pneumoniae
SMKTIYTSQSTRENLDLLYAQACIYDNVKNWNKLNFTFSIIIPLLLSVLTVYNRSLKFVDIELLSSLLGLYGLLVLTLNIAVSSHIASLRRKAASVQEMYDCRVLGIRRNELKVEEIPRDEICRAAERFKNNQAKANKRFGDEGWYVSKVYDAPHSVMALLCHGKNLGWDRSLREVMHVFYLSAFIIAPVAMIIYGIVMKSGMNEILFYIVFTMPVIRYFLLQFLDNRSSMKRSEKLKKYVEKEISSIRVSGRIEEEKLGYTLRNIQDEIFSYRVSCPPVPNCIQRLMKGKNERIYDDYFESNLKMMHLSD

SEQ ID NO: 11574 - protein, 102 aa, Klebsiella pneumoniae
TRPAGSQFRRRPAPDPDGGWRQSAPDALRPAGQRWSPASGDGERTAFRPLPARRRRSPSCGRAAPPPPRPTALRSGLRLQRNTPRRAQDAQPAPDRSCERYR

SEQ ID NO: 11575 - protein, 973 aa, Klebsiella pneumoniae
ANHAFQQQGWALRHFHQAKARFKAVRLVAHKARPQVAARDQLAQVGHHLTAVAHAERQRLRTMEEGRELIAHALVEQNRLRPALARAQHVAVGEAAAGYQGMEIAQTGPAGQQVAHMHVDGVKAGTMEGGRHFNVGVHPLLAQDGHFRPRAGGNVRGGDVVVNIKRELHIEARVGIIGFRLMLLIGAGRVVAQTLHLPGGFRPPHAQRGAAFAEHRLTAGGQHEAIALNRFTEVMHAVRQAVNRQNGFHRLTVCGADLNHRPQLFVEQRGQMVVAQRGDIRFHAAVAGKGHFRQGHQQTAVGAVVVGQQFTLRHQGLHRIPEAFQLRDIAHVSRLVAELAIDLRQRRRAQRVVPFTEVDQQQGVIFRRKLRRDGMTDIFDTGEGRDDQRQRGGHLALLAAFLPAGFHRHRVFTDRNGQAQRRAQLFAYRFHRLIQASVFTRVAGGGHPVSRQLHAVQLANLRGGDVGQRFTDRQTARGREVQQGDRGALAHRHRFAIVAVEAGGGHRTVGHRDLPRANHLVAGDHTGHGAVADGDEEGFLGHRRQMQNAVNRIGKDNRLAIQRATLSFQSLHVAGHFRRFAEQDVQRQVDRLIVKVAVAQAQMLLSGSFADNGIRRALAAAQFVEQRQLLRGDRQNITFLRFVTPDLQRTHPWLIAENIAQLEFTAAAAVAHQLRHSVGETAGANVVDKEDRVGVAQLPAAVDHFLTAALHFRVVTLYGGEIEIGIGLAGGHRRRCAAAEADVHRRAAQHDQLRADGNLALLHVLTADVADTTGQHDRFVVATQLFAIVAGDFLFIGAEVAVQRRTTKFVVKRRAAQRAFGHDVQSGDNTIRFTEIFFPRLFEARDTQVGNREAHQARFRLRAAAGGAFIADFAAGASCRARPWRDGRRVVMGFHLHQNVRRLLMEVVAPGLMVGEIAPDFRPFHHRSIIFIGRQHVVRRFFKGVFDHFEQRLRLLFAVDDPVGVENLVATVL

SEQ ID NO: 11576 - protein, 282 aa, Klebsiella pneumoniae
QGVAMAANIVSPAQSGRFYYGCAGAAGLLAGLAIVFWFPALASWWPSDLVRVYHAMPYVMRFGVASVADIPLVAYATLTLSGFVLAFCHPGHSKLPIVAWAVHNQPSPREMVDWILRSWVLQFGFLVIIFWRFAFMGKLSSDRLMQIVGIFNDVCYLATLVLAGILLRDGWRDFQGVAAPAGNIRIPLIFALSFYLPFQLVWILLSAQQYELPLWGWLLLVPAMVGVLLARLATVGIALCFRRWLGTQGCLRWRGPLALFSGLTVLCIGGNAVIRQILNMIK

SEQ ID NO: 11577 - protein, 197 aa, Klebsiella pneumoniae
FIPALSGGRMMETQSVAGVACSDLNQAMSRIDGAALARLEQAIAEANAIFVFGAGRSLLMLKAFAMRLMHIGLKVHVVGDVVTPALQEGDLLLLASASGETASLVNVATKAKKLGGTVALLTIFPESTLGKLAEVVVRIPAYTDKLPDGPDNVKGILPGGSLFEEAVMVLGDAMIVNLAQSTGYRLTKGFALHANLE

SEQ ID NO: 11578 - protein, 235 aa, Klebsiella pneumoniae
SSTAYQALTIAEYWKRVSGMQKEKLSALMDGETLDNELLNELSRSSEMQKTWESYHLIRDTLRGDTAEVLQFDISARVMAAIENEPVRQTAPLIPESQPAPHQWRQMPFWNKVRPWASSLTQMGVAACVSLAVIVGVQHYNGQSDSAQQPEAPVFNTLPMMGKASPVSLGVPADASAGSGQQAQVQEQRRRINAMLQDYELQRRLHAEQLQFGQAQTQQAAVQVPGYQTLGTQSQ

SEQ ID NO: 11579 - protein, 347 aa, Klebsiella pneumoniae
SGCAAGGYGAGQLFCPEGDPDMSVIFTPRARSSRWKALWPLALLLAVSIIGGIWLWRAWPQVLMQSAVWQRSLNLELSRLLQAVAENPAAAGLSLLGFSFVYGVLHALGPGHGKIVITTWLATHPAKLKSSIGLTLAASLLQGLVAIALVVVVLALLQLPARQLHLSSFWLEKGSYLLVGALGLLLCWRALKKLRLLLRRPTFTAFTPHHVHNEHCGCGHQHLPAPEQLQAGDDWRARAAIVLSMGMRPCSGAIMVLLFSKVIGVFGWGMAAALAMAAGTSLTITALALLVHGFRQLAIRLSRHQAPALWKQVSWATLALAGGVILLAAAGVMWLSAVPAGGGIRPF

SEQ ID NO: 11580 - protein, 103 aa, Klebsiella pneumoniae
PFSAGRPNSLLNAAPPSGPSVMMSRAVTIRSGLPKSSSHGCSKPGIRRLETEKPTRPAFGFAPRPVAPSSRISPPEPVAAPGHGEMAVGWLWVSTFIRMCAGS

SEQ ID NO: 11581 - protein, 123 aa, Klebsiella pneumoniae
RPSADSGVILPELLTDGNELLLQPASASGSIKSIIARLVDPLLRFSLIGFFLLFVMLTGFIIFCFAVCLRLRIPGVVLSVTVNIPCYNASGHQSSKHRHDKQLFPVRFHEFRDHDASTFLADR

SEQ ID NO: 11582 - protein, 110 aa, Klebsiella pneumoniae
CCSAASGDAMTYCLSEEEREERAADELKRQQLRRENELNDLRLICGTEHGRRFIWRLIEQAGVWRTTYTGEALSAAFAEGKRNTGLKVFSDVMEACPDQYLAMAKEASEE

SEQ ID NO: 11583 - protein, 621 aa, Klebsiella pneumoniae
FSEAIMALLQISEPGLSAAPHQRRLAAGIDLGTTNSLVATVRSGQAETLPDHQGRYLLPSVVNYHASGLTVGYDARLNAAQDPANTISSVKRMMGRSLADIQNRYPHLPYQLQASENGLPMIQTAGGLLNPIRVSADILKALAARATEALAGELDGVVITVPAYFDDAQRQGTKDAARLAGLHVLRLLNEPTAAAIAYGLDSGQEGVIAVYDLGGGTFDISILRLSRGVFEVLATGGDSALGGDDFDHLLADYLREQAGFSDRSDNRLQRELLDAAIAAKIALSDAEAAHVEVGGWQGDITRSQFNDLIAPLVKRTLMACRRALKDAGVEAQEVLEVVMVGGSTRVPLVRERVGEFFGRTPLTSIDPDKVVAIGAAIQADILVGNKPDSELLLLDVIPLSLGLETMGGLVEKVIPRNTTIPVARAQEFTTFKDGQTAMSIHVMQGERELVQDCRSLARFALRGIPALPAGGAHIRVTFQVDADGLLSVTAMEKSTGVEASIQVKPSYGLTDGEIATMIKDSMSYAEQDIQARMLAEQKVEAARVLESLTSALAADAALLSAAERQAIDAAAEQVRAAAAGDDADAIKEAIKNIDTQTQEFAARRMDQSVRIALKGQSVDEV

SEQ ID NO: 11584 - protein, 232 aa, Klebsiella pneumoniae
RRRALPRICAHFWVNLPGIISQEKDYVETFNNENDQVDALKRFFAENGKALAVGVILGIGALVGWRYWTSHQQDTARDASLAYEKATSALKSNTPEVLSGAEKFAADNKNTYGAFASLELAQHFVEQNDLPNAEKQLQQGLAAASDDNLKSVISMRLARVQLQMKQADAALKTLDSIKGEGWTAIVADLRGEILLSKGDKQGARAAWEAGVKSDASPALSEMMRMKMNNLSI

SEQ ID NO: 11585 - protein, 225 aa, Klebsiella pneumoniae
RRAATSCKYSRYRGRNMDINEFQKAAGVSLALATRWHPHIVAAMKEFGIIKPLDQAMFIAQAGHESTGFTQLVENFNYSVAGLAGFVRAGRLTQGQANSLGRRQGEPSLPLERQRAIANLVYSKRMGNNGPTDGWFYRGRGLIQTTGLNNYRDCGAALKVDLVKQPELLEQDEYAARSAAWYFVKYGCLKYTDDLMRVTQIINGGQNGIDDRRVRYLSAKKVLAS

SEQ ID NO: 11586 - protein, 201 aa, Klebsiella pneumoniae
QFQAKKIEMKSIYDIRRDNLNEIIRKDFDNTQLRFAERIKKSANLVNRWSKGTKNIGANAAREIESFAGKGRFWLDIDHLSDTPTLPEIIDPQEWSVEKQAAFTLGVWMGQHPDLNSEKKVSEAAGIGQATVNRILNCEGSTSIGVLSAIARAFGRDAYELILPPGNAGLIDYDHHEYAGLPQEEKNKITAFIKFIVSQNQ

SEQ ID NO: 11587 - protein, 70 aa, Klebsiella pneumoniae
CRQANSVLSTRPADASTNLYQLKIFSNPPKHLRRCKVKPHGSLVPVSSTHRCAYTPGLSTSSSSTFLQET

SEQ ID NO: 11588 - protein, 498 aa, Klebsiella pneumoniae
LYEAFNMIPVVALVGRPNVGKSTLFNRLTRTRDALVADFPGLTRDRKYGRAEVEGREFICIDTGGIDGTEEGVETRMAEQSLLAIEEADVVLFMVDARAGLMPADIAIAKHLRSREKPTFLVANKTDGIDVDQAMADFWSLGLGDIYPIAASHGRGVTSLLEQALLPWVDEVNPQEEVDEDAEYWAKFEAEQNGEAEEEPEDDFNPQDLPIKLAIVGRPNVGKSTLTNRILGEDRVVVYDMPGTTRDSIYIPMQRDEREYVLIDTAGVRKRGKITDVVEKFSVIKTLQAIEDANVVLLVIDAREGISDQDLSLLGFILNSGRSLVIVVNKWDGLSQEVKEQVKETLDYRLGFIDFARVHFISALHGSGVGNLFESVREAYDSATRRVSTAMLTRIMNMAAEDHQPPLVRGRRVKLKYAHAGGYNPPIVVIHGNQVKDLPDSYKRYLMNYFRKSLDVMGTPIRIQFKEGENPFANKRNTLTPNQMRKRKRLIKHIKKSK

SEQ ID NO: 11589 - protein, 178 aa, Klebsiella pneumoniae
VQEAAMFLVSLAEGFIHLFQAAGKIFLDMMTGLIPMLICLLLAINFLMKLVGTVRIEKIAALLGRSRILTYGVLPVLGWFFMSSPGALTLGKLLPEKSKPGYEDALGTTAHPLTSLFPHVVPSELFVWLGVAAGVKALGLPVTSLALRYIAAAMLIGLIRGIITEYLFLRLSKRGNAP

SEQ ID NO: 11590 - protein, 108 aa, Klebsiella pneumoniae
NFRAFNMTPGSVPRWGPVVLFTQEDVMVTIRLARHGAKKRPFYQVVVTDSRNARNGRFIERVGFFNPIANGAEEETRLDLDRIAHWVGQGATVSDRVAALIKAANKAA

SEQ ID NO: 11591 - protein, 519 aa, Klebsiella pneumoniae
ATRASRAKTGIGVGCWLNKKEKQYNVSRPLLQPLQHIQIDVVLYSATFVLCVAAATDRFHLRRETMFDNLTDRLSRTLRNISGRGRLTEDNIKDTLREVRMALLEADVALPVVRDFISRVKESAVGHEVNKSLTPGQEFVKIVRNELVAAMGEENQTLDLAAQPPAVVLMAGLQGAGKTTSVGKLGKFLREKHKKKVLVVSADVYRPAAIKQLETLAEQVGVDFFPSDVGQKPVDIVNAALKEAKLKFYDVLLVDTAGRLHVDEAMMDEIKHVHAAINPVETLFVVDAMTGQDAANTAKAFNEALPLTGVVLTKVDGDARGGAALSIRHITGKPIKFLGVGEKTEALEPFHPDRVASRILGMGDVLSLIEDIESKVDRAQAEKLASKLKKGDGFDLTDFLEQLRQMKNMGGMASLMGKLPGMGQIPDNVKAQMDDKVLVRMEAIINSMTLKERAKPEIIKGSRKRRIAAGCGMQVQDVNRLLKQFDDMQRMMKKMKSKGGMMKMMRGMKGMMPPGFPGR

SEQ ID NO: 11592 - protein, 134 aa, Klebsiella pneumoniae
ITHFDIGKGMLDSPRRERQEVKFMTMNITSKQMEITPAIRQHVADRLAKLDKWQTHLINPHIILSKEPQGFIADATINTPNGHLVASARHEDMYAAINELINKLERQLNKVQHKGEARRAATSVKEAGFVEEEE

SEQ ID NO: 11593 - protein, 67 aa, Klebsiella pneumoniae
HAVYFTIKSNAINLPRVSFSARKTPFPFAFCLAVTTADKKIVRFLTDRCYCELNVFSKLNKDNEYHS

SEQ ID NO: 11594 - protein, 63 aa, Klebsiella pneumoniae
SKSYVYSSYLELIMPYEYHEAAVLCLTFFNPKTPHSTLHPRNQEMLLDPAYPQKLWRCNRKGK

SEQ ID NO: 11595 - protein, 80 aa, Klebsiella pneumoniae
YHYYPLMWSTIAVSVARLSLIQGQRQADNPIFQLNIDGESQLSGEAYHASVIRHRNTIKALQAMALRIGDQLFQQPSPQA

SEQ ID NO: 11596 - protein, 473 aa, Klebsiella pneumoniae
PADLKFDLAHMLPSQSPAIFTVSRLNQTVRLLLEREMGQVWISGEISNFSQPSSGHWYFTLKDDNAQVRCAMFRNSNRRVTFRPQHGQQVLVRANITLYEPRGDYQIIVESMQPAGEGLLQQKYEQLKAQLTAEGLFEQKHKQALPSPAHCVGVITSKTGAALHDILHVLRRRDPGLPVIIYPTAVQGDDAPGQIVRAIALANARQECDVLIVGRGGGSLEDLWSFNDERVARAIFASQIPIVSAVGHETDVTIADFVADLRAPTPSAAAEIVSRNQQELLRQLQSGQQRLEMAMDYFLASRQRRFTQLFHRLQQQHPQLRLARQQTALERLRQRMRIAVESQLKRAEQRQKRTVQRLNHYNPQPRIHRAQSRIQQLEYRLAEIMRGRLSERRERFGNAVTHLEAVSPLATLARGYSVTSVSDGTVLKQTKQVKTGDLLTTRLKDGWVESEVKQIAPVKKTRARKPSPTKPAE

SEQ ID NO: 11597 - protein, 524 aa, Klebsiella pneumoniae
ADRYLIMKRAPFLCKQSPDRTLEVVILAGSLAWETSREWRKDPDQEDDVPPVVLGPDELADLDNLTIIRPDTLYARVFRTGDIREEDLLKIAVKLAHAGVQMARLMTPDGEVLENWTGQLERLRQERPSDILPDHFRLDEEALWFDKLTERRDGESDIQPQRICSPLRVTAITCDSHDGSYGRLLEWHTTTGQLRRWAMPMAMLSGNGEELRRILLENGLTYISTRPALRSLLCEYISRSRPGRRVTCVEKTGWHNGVYVLPDEVIGPDGDSVILQGSHYLTGGFAQAGTLAEWQEQVAALCAGNSRLVFAVCCALAAPLLRLTGTGGGGFHLRGESTDGKTTVMKVAASVCGGTDYWHSWRATGNALEGIASRHNDALLPLDELREVDPREAGMIAYMLANGQGKGRARTDGEVRNRRHWTLLLFSTGELSLAEHTERAGERLYAGMDVRMVQIPSDTGQHGAFEQLHGFASGQQFADALCDRVARFHGTAFRAWLAFLTSNLDASTTLARELLRRYQTALTP

SEQ ID NO: 11598 - protein, 308 aa, Klebsiella pneumoniae
PTGYGEGRSMMNNVGSMDRTKYLGGSDVAGILGISPWRTPLEIYLDKVQPRIKPIDPGKQRVFTRGQRMEPYVIDLLAEETGLEIIHRGNRYIHRDYGFIAAEIDAEAATGENIEIKTVSPFKAKEWGEVQTDAIPVHYTAQAMHGLMVTGKQVCVFGVLIGGDDFRIYRVERDEETIQAILEKEVSFWDRVINLNPPEATSVSDISLMFEKDAGTSIEADGKALSLYNDLRDMKSRCKALEAEIAVSEEKLKIYMQDNSILTLDGKPICTWKSQVSNRFDQKLFQAEHPALYEKFKTATTSRVFRMK

SEQ ID NO: 11599 - protein, 90 aa, Klebsiella pneumoniae
GILYQCSASPSGKANSAGTSPAAAQSNRFSEKQKKVGEKIRNYLVTAEREARGHAVFTERQGPVQSADRSARPIRSRSRHTGRRRSRQAW

SEQ ID NO: 11600 - protein, 515 aa, Klebsiella pneumoniae
RRAQEIEMKRFNLLQMLQSIGRSLMIPIAMLPAAGILLAFGVSFQDLNIVASLPFLAADWLVHVLKLMAEAGSAIFANLPLLFAVGVAVGLSDDQGIAGLSAIAGFLIMNVTIGQFLGITPESVAQVRDYTMVLGIPSLQTGVFGGIIIGIIAAWLYKRYYRIQLPSWLEFFSGKRFVPIVTSFVALFVGLVMAVVWPPVQHLINGLSNTMTVQGPGVSAFLFGFVERLLIPFGLNHVWWPTFWLQFGEYVNKAGQVVHGDQLIFFAQLKDQVPITAGTFMAGLTPIKMFCIPAIALAIYRCASPENRARVKGIMLSGAITSIVCGITEPIEFSFLFVAPVLYGIHAVLAGLVFLLMEWFSVHIGLSFSGGLIDYLFFGVLPRAPHWYMVFPVGLVMGALYYVLFTFAIRRWNLLTPGREVEESAVTQESEQNDLVSGIILAYGGLENMTSIEACMSRLRIDVTDKTLVDKALLKQLGAAGVVEVGNNIQSVFGMKSDRLKEAIRAANAYTQEAK

SEQ ID NO: 11601 - protein, 129 aa, Klebsiella pneumoniae
PADQPYSLTISPASTGLFSGSAMRTILVIASLLLTGCSHMANDAWSGQDKAQHFLASAMLSAAGNEYAQYQGYSRDRSAAIGLMFSVSLGASKELWDSRPAGSGWSWKDFAWDVAGATTGYAVWQLAHQ

SEQ ID NO: 11602 - protein, 461 aa, Klebsiella pneumoniae
NARHQGCNHQDQGKHVRHANSLGLFAVFTNVQNGEERFLRQLNVTDLLHTLLTFFLLLQQLFLTADVAAVAFRQDVFTQLFHRRARDNVVTDGRLNRDIELLTRNQIFHFFHQLAAAIRRVIVVGDQRQRIDALTVDQHIDAYHVRRLEAFEVVVQRRIAAGGGLQAVEEVENHFRHRNFIGQRHLFTVVNHVGLHPTLLDTQGNHVAEELLRQQHVTLGDRLAQLLNIIQRRQLGRAVDVDNFFGGGLYFVDYRRRGGDQVEIVFTLQTLLNDLHVQQAEEAAAEAEAQRGRAFRLVEQRGIVKAQFAQRVAESFIIIGAHREQAGIHLRFHLLKARQRFVCRVAGGGQGIAHRRAEDVFDRADQPAYLAAFQLGTVNLFRGEDAQTISVIDLAGAHDLDLVALAHGAVFNPHQRHHAEVVIEPGVNNQRLQRRVRIAFRRWDIAHQTLQHVGHADAGFC

SEQ ID NO: 11603 - protein, 253 aa, Klebsiella pneumoniae
RGRHGAGRRHDSESGAVDGISFNQRFCATRQPRIVIRHKETNMKLQLALDELTLPEALAFIDKVVDDVDIIEVGTPFLIREGVNAIKAIKEKYPHKEVLADAKIMDGGHFESQLLFDAGADYVTVLGVTDVLTIQSCILAAKEAGKQVMVDMICVDDLPARVRMLEEAGADMLAVHTGTDQQAAGRKPIDDLITMLKARRKARIAVAGGISSQTVKDYALLGPDVVIVGSAITHSADPADEARKISQVLLQQH

SEQ ID NO: 11604 - protein, 309 aa, Klebsiella pneumoniae
SCRLSVSCSLQERKKVDRIQAMQMFMRVAEAGSFVRAAETLSLPASTVTSTIKNLEKYLKVRLLNRTTRRVSLTPEGMQYLAQCREILALIEHSESTLSESVARPQGRLRVDMPAGIAHFIVMPHLPDFYRRYPDIYLMIGVSDRQVDLIQEGVDCVIRTGELNNSSLVARPLGRFRWVTCASPDYLREYGVPPSPEALTQHRAVHYFSGQARRADEFRFVRHGETFSVPVSGNAAVNETGLYIKMCLAGFGLAQLAENIVADHLQEGRLVEVLTDWQPPPVPVTLLYPHQRFLSPAVRAFAEWMSEVV

SEQ ID NO: 11605 - protein, 64 aa, Klebsiella pneumoniae
HPCHLRDNNVPAQRRIHAPGAHQRDLRRQNRLEPEGKYHEKTQVRQLSVERAGQAPGVTQEQHP

SEQ ID NO: 11606 - protein, 404 aa, Klebsiella pneumoniae
AQRHPARPLISCQQVSNGTHAKPGGARRPLLNGRFAVGCRTVDMQPTLMVVFHEVGQEARRGAGAGRIGRAAGVVQVSKVGRQLVAVELGQRQTPEGFVFRLSARQQAIRQRIVKAEQRVVIIAQRGFRRAGQGGGVDDQLWLLRRGVNQAIRQHQAAFRVSVHDFNGFAVAIMNNIAQFEGVTADQVVGAAQEQLHTFVQTAGNGESQRAGDSRRTAHIGFHRIHKGALLDAVAAGIKGDAFAHQAGVYRRLFIAGRVVVQRQQDRRALGAAAHGMQTKIALLAQIFAFGDAIANLLTRHAAQQVDSALRQLLRTQLFRRRIDGVAHPVDDRQAVIQLAALRVVKGWPFDLTLTFRPFIAGPKGPGAIGVPAFAAQGDVLDAHAVNFARRALDKPEVVFTVEM

SEQ ID NO: 11607 - protein, 117 aa, Klebsiella pneumoniae; identical to SEQ ID NO: 8757

SEQ ID NO: 11608 - protein, 461 aa, Klebsiella pneumoniae
NGKQDSLMPLFLTTREAWRHHPFHPAHHLHHAAFRLHLLHHALHVVELLEQTVHILHLHAAAGGDTALTRTFDDFRLSALFQGHRVDDRFHTHQHFVVHLRFHVVRDLPHARQLAHQAGHAAHVFHLAQLLKEVGEVETVAFLQLGGQLLGLRAVNLALDIFNQRQHVAHAEDTGSDAVRMERLQRFGFLADAEEFNRLAGNMANRQRRAAAGVAVHFGQHHAGQRQRFVKGLRGIRRILTGHRIDDEQGFNRVNGGVDVLDFVHHRFVNVQTTGGIHQQHVVEFEFRFFQRRVDDINRLLPDIRREEIDADLLGQGFQLFDRRRAVNVCGNDQHFLLVLLAQEFPQLTDAGGFTSTLQARHQHHGRRLRGQVERLVLFAHRRHQLVADDFDELLTRGQAFIDFMADRALFDAADEITDHRKRNVRFQQRHAHFAQGVFNIVFCKASAAANVAQRTRQTIG

SEQ ID NO: 11609 - protein, 811 aa, Klebsiella pneumoniae
PLEQTMTVSTQVSRNEYTGNGATTQYDFTFRILDKSHLLVQTMDTSENIVTLTLGTDYTVTGVNRYNGGKVVLTSALPAGYKISIERSTPVTQEASIRNQGGFFPEIHEDALDKLTMLVQQAYGWWSGLSLRKPSWLANYYDALNNRIRNLRDPSQAQDAATKNYVDNSIDGSNAHADDLFKKTLRFPDYVETMSGVPGRRDSLQGFNNIGKPVPVFSFTETADLSLKLSDTDGLQYIGQCPDINTLRSTEFSSVNQQIFVAEHTTGTEQGGGIFYCHSLTNDDGLIDDNGFQIINNFGQVIRRKDRSRMSAEMFGAIGGQDVMPVLLNIRKASITFNRAVCYFPPPANGINYLHTGGFVVDVTQGYGLCIVCESTDEIDVPFDHIGDNIAFTFKRDNAAAGTAFYKQSGITGALIRGRNSDNTAAGNGGFAVRVSDIIKAKVNVFVNGYTNTAGAAISLYNDTGYTEKSRIKATIRGCCNGVLIHRNAAEGATSTNSFMGTHLDIEYQAGVPGKANKGVVVGNIDGTTTSNTFDINFYASNISLKYWAEAGSITNGIYVGSKAIVPESTTVDLISDGYGFSTSDTDTTTIAATNLIRVENGGIFRAKCMDQSMQTGLSHRLNQLQRLRNSIFSFQDDTYKVPYTDARPYINPVGMSCICSGTIDVATQQAGSSWLISGLPMGMRIKVTINQYLEGESVTSVQEVWEVLVRGDAQSVICTPLVTNDVLTTTAGLAVINSSFATASFLKSVAAAFGKFWQGDSTRTRLTVRNNNDDNSLTTGASDGRKFRIFLPINASANSILHYSVKLEVV

SEQ ID NO: 11610 - protein, 338 aa, Klebsiella pneumoniae
PARQSGDRGGAAMNTVLIPPGPGGYGKGLWLPVGSGKKVLSLTGREIHPVAIEIGALTESEIVNGFADIPPDNDILCVVINCAGSLRCGLYPQKGIPTINVLPTWRAGPLAQFINEDNYVSGVTMEQLVLVVTAEAPDGEPESVPVAAPQVISTPPPPRGAEKLVSMVEQTGTAVGHVIALLFAASREAVDVSLRNIIPFMAFVSLLIALVQETALGSLIAHALTPLANSLWGLVLLSLICGIPFLSPVLGPGAAISQVIGVMIGTQIGSGAISPAFALPALFAINVQVGCDFVPVGLSMQEAKPETIAKGVPAFLLSRQLTGPLAVIVGWLFSLGLF

SEQ ID NO: 11611 - protein, 88 aa, Klebsiella pneumoniae
MHLKEITLRCKWFFNTFPRSSYNMKNLHHKPEKKSDDTERGVIAQSLVSCGANRLRKILCQDLLSQNDSAILWAVVQSDRLFRPKFYC

SEQ ID NO: 11612 - protein, 416 aa, Klebsiella pneumoniae
NMPKQLKPLTNVEIAGAKPRSTDYELRDGEGLYLLVKTSGRKAWHFEYYHPVTKKRTKTSLGPYPVVTLAMARETRTKYRRLLWQGIDPRQHLAGIAEEKRIQNECTLEKVAEQWLKEKKRTSDLSEDHAKDVWRSLEMHVFPSLGSTPVTEIRPKMLKEHLTPLEEQGILETLRRVISRLNEIFRFAISEELIEFNPADNLVARFKKPKKQNMPALPPSELGRLMLALQNASIRKETRCLIEWELLTWVRPGEAVSARWCDIDMKKAEWRIPDTFMKMNRSHTVPLSKQALRVLQIMEPVSRHRPWVFPSIRKPLEHMHQQTANAALIRMGFGGELVAHGMRSIARTAGAGHFPREVLESALAHQKEDEIEAAYNRSDYLEQRRPLMQWWGNYVDAARRQALLGAEEPLRIVEGE

SEQ ID NO: 11613 - protein, 427 aa, Klebsiella pneumoniae
YHAKPLIYVYCANNSQQVFQKSPKQIIMLEFHNVPLKTILRRAIMSLPTNFNNILRLFEKDYDTAKEDNALSARGQFLQLYPLNRLKKMTLDDYVIGKGTASFCACVEVKTRTWANMQGATALKFGIYYGKSKSDPTVRYRFTQKFGDDDSTNKEVFANVKDALLDLIQSGKELDFRAIDENPLSQMFKAKILSLYFPEHFINICSKDHLKEIAMEMGIKEQQFISKYQHLLFKKKLEHKITRNWSNPKYMSFLYAQFIRKDLSSTPAVIVKKPQKRNHPEVNFEEITDNRDLIGKKSEEYALNWEKNRLIGLGYSKLAEEIDDRRNRPTYGYDFLSFNAPGDERYIEVKSIGRDGKEGAFRFFLSGNELTVSNLSNHRKNYYFYLVQYGKDGEPCNLYVKHAQDLYTKSEMSPCAYVVRFDLEEPA

SEQ ID NO: 11614 - protein, 122 aa, Klebsiella pneumoniae
ITNKVKIMRKTLQALGRLKAGQMNKTETAYAQELELRKRYGEIAWYRFEGIKLRLADNTFYTPDFAVMLANGQLEMHEVKGGYWTDDARVKTKVAADQYPFRIIGVTKLPAKAGGGWKVEEF

SEQ ID NO: 11615 - protein, 452 aa, Klebsiella pneumoniae
RVLNLLLNSTFQWPRAVYRIVTIGAQQLQRLIGHLHFISALFQTFIQTLQLDLGNRGNMFLAQRMEDHHFVDTVDELRTEVLADYPQHQVLHMSVVQLAEPFLNKIGTEVRGHDDYRITEVDRSPLPVGETPVVEYLQQNVEHIRVRFFHFIQQDDGIRTTAHRLGQVTALFIADVSRRRTDQTRDGMFLHKLGHIDTHHRVVAIEHKVSQRFTQLGFTDPGWTEEQERTNRPVRIGQPGAAAANGVGYRFNRLILANHPMMQLLLHTQQFVTLAFHHAGDRDTGPASQHFGDFSIRHFITQQTHGFPFGLSGSRQLFLQFRNFAVLQLGHPRQIADAARLFDGDFRLLQLSFDGLGAGERRFFRFPLFFQHRVLPFFIRQLLVEHIETLQARLIRLFLQRLLFQFQLDNTPIETVQLFRFGVNLHTDAGCRLIDEVDGFIRQLTVGNIAMR

SEQ ID NO: 11616 - protein, 62 aa, Klebsiella pneumoniae
VSVLISIRCAQLNSAQLTSKYLLLSTQQARSKVEVFFIAIRLLMTMGLLMITDFRLSIISAR

SEQ ID NO: 11617 - protein, 129 aa, Klebsiella pneumoniae
TCAKHSGLLINFPLRSAGISLELQPGGLSLAVVDGGQRVERALLHGFSCQVQCVTARQVGAVSSQCIGLLSGNPPGLLPLLVCLVISCIDSVAGGLLLSVGVSVRQRGISAACLNLTVSAETASNCGYG

SEQ ID NO: 11618 - protein, 116 aa, Klebsiella pneumoniae
HPAKDGTFHHPCFARFAGHFFREATMKFGEALEAVKSGAKIYREGWNGKGQFVIKAGGYTVSEPRPGSDYAKAGITGEFTIAPHLDLKNAQGIMQPGWVPSQGDLFADDWLATPID

SEQ ID NO: 11619 - protein, 299 aa, Klebsiella pneumoniae
NADNSVMNNKTEAPMSTSFFVAADWLAEHIDDPEIQIIDARMAPAGQEALRDMAAEYRAGHVPNALFFDIEALSDHTSPLPHMMPRAEAFAVAMRELGVCSDKHLVVYDEGNLFSAPRAWWMLRTFGVEKVSILAGGLEGWRRDELPLEQGMPEVAEGEFDVRFDPQQIKRLTDVLLVSHEGSAQIVDARPAARFNGQADEPRPGLRRGHIPGALNVPWTDLVINGELKTVDELNDIFLRQGVDFERPIIASCGSGVTAAVVVLALTTLGVNGVCLYDGSWSEWGARSDLPIEPAPAAP

SEQ ID NO: 11620 - protein, 183 aa, Klebsiella pneumoniae
MCCNGWSRGLLTLYCFSFLFSQQPTPMPVFALLALVAYSVSLALIIPGLLQKNSSWRRMAILSATIALICHAFALEARIFPGGESGQNLSLLNVGSLVSLMICTVMTIVASRNRGWLLLPIVYAFALINLAFATFVPNEYITHLDTTPGMLVHIGLSLFSYATLIIAALYAVAAGVDRLPAQV

SEQ ID NO: 11621 - protein, 81 aa, Klebsiella pneumoniae
TGSNFPSLPFLDLRRQRMEDPDAALQQMYRKVMPGRTFDLLQVIAANAVLVWTEPTTVDKFCPYVEACSKAIGLIHKLSIV

SEQ ID NO: 11622 - protein, 116 aa, Klebsiella pneumoniae
IMSNIIKQLEQEQMKQDVPSFRPGDTVEVKVWVVEGSKKRLQAFEGVVIAIRNRGLHSAFTVRKISNGEGVERVFQTHSPVVDSIAVKRRGAVRKAKLYYLRERTGKSARIKERLN

SEQ ID NO: 11623 - protein, 603 aa, Klebsiella pneumoniae
LTLNMKNIRNFSIIAHIDHGKSTLSDRIIQICGGLSDREMEAQVLDSMDLERERGITIKAQSVTLDYKASDGETYQLNFIDTPGHVDFSYEVSRSLAACEGALLVVDAGQGVEAQTLANCYTAMEMDLEVVPVLNKIDLPAADPERVADEIEDIVGIDAHDAVRCSAKTGVGVTDVLERLVRDIPPPEGDPDAPLQALIIDSWFDNYLGVVSLVRIKNGTMRKGDKIKVMSTGQVYNADRLGIFTPKQVDRTELKCGEVGWLVCAIKDILGAPVGDTLTAARNPADKALPGFKKVKPQVYAGLFPVSSDDYEAFRDALGKLSLNDASLFYEPESSTALGFGFRCGFLGLLHMEIIQERLEREYDLDLITTAPTVVYEVETTSKEVIYVDSPSKLPPLNNIQELREPIAECHMLLPQEFLGNVITLCVEKRGVQTNMVYHGKQVALTYEIPMAEVVLDFFDRLKSTSRGYASLDYNFKRFQASNMVRVDVLINGERVDALALITHNDNAPYRGRELVEKMKDLIPRQQFDIAIQAAIGNHIIARSTVKQLRKNVLAKCYGGDVSRKKKLLQKQKEGKKRMKQVGNVELPQEAFLAILHVGKDGK

SEQ ID NO: 11624 - protein, 1667 aa, Klebsiella pneumoniae
RIINVTNCIRLIGRGVRRMKPFRLAALSLALLTAFSLTGCDDSGTPQASAPAPAADSNPGATAKPDRAQLAALAEKSQGKALTLLDASEVQLDGAATLVLTFSVPLQPDQDFSRSVHLVDKKSGKVDGAWELAPNLKELRLRHLEPKRELIVSVDPTLTALNKAMLDKPFEKTLTTRDIAPSVGFASRGSLLPGNVVAGLPVMALNVDNVDVNFFRIKPESLSAFVSQWEYRNSLSNWESDELLKMADLVYSGRFDLNPARNTREKLLLPLSDIKPLQQPGVYVAVMNPAGRYSYSNAATLFTLSDIGVSAHRYHNRLDVFTQSLENGAAQSGIEVQLLNAKGQTLAEAKSDSQGHVTLQTDKEAALLLARKEGQTTLLDLKLPALDLAEFSIAGAPGFSKQFFMFGPRDLYRPGETVILNALLRDSDGKPLAEQPVKLEVVQPDGQVIRSVMSKPVNGLYQFTYPLDSGAATGMWHIRASAGDNQPREWDFHVEDFMPERMALNLTPQAAPVAPDADVTFGVSGAYLYGAPASGNQLQGKLFLRPLRDAVAALPGFQFGDIAEENLSRSLDEVQLTLDEKGHGEVTTSSQWQDSHSPLQVVLQASLLESGGRPVTRTVKQPIWPAEALPGIRPQFTLKDVYDYRTDTTMKQPVVDENSNAAFDIVYADVKGEKKAISGLQVRLIRERRDYYWNWSDSEGWQSQFDQKDLLEGEESLDLQAGQIGKVSFPVEWGSYRLEVKGPDDVVSSVRFWAGYSWQDNSEGAGAARPDRVTMKLDKPSYKPGDTIRLHIAAPAAGKGYAMVESSEGPLWWQEIDVPAEGMDLSIPVDKTWNRHDLYLSTLVVRPGDKSRSATPKRAVGLLHLPLGDENRRLTLALEAPDKMRPNQPLTVKVKASVKEGEAPKQVNVLLSAVDSGVLNITDYATPDPWNAFFGQKRYGADIYDIYGQVIEGQGRVASLRFGGDGDELKRGGKPPVNHVTIVAQQAQPVVLNDQGEGTVTLPIGDFNGELRVMAQAWTADDFGSSEDKVVVAAPVIAELNTPRFLASGDTTRLALDLSNLTDKPQTLQVHLTASGLVTLTDGQLPPVQLAPGARSTLFIPVSALAGFGDGQVNATISGLSLPGETFAPLQKQWKIGVRPAYPAQTVNSGAVLQPGENWQPPAAQSQGFAPQTLQGQLLLSGKPPLNLARYIRELKAYPYGCLEQTASGLFPSLYTSAAQLKALGISGDSDEKRRAAIDVGISRLLQMQLENGGFALWDREGPEEYWLTAYAMDFLVRASEQGYSVPVNAINKGNERLLRYLQEPGLMTVRYSDDAQASRFAAQAYAALVLARQQKAPLGALREIWSRHDQARSGLPLLQLGIALKTMGDAPRGDAALKLAVATPRQDENRWLGDYGSPLRDNALKLVLLEENKLLPEVQNQLLSTLSEEAYGQRWLSTQETNALFLAGRTLADLPGSWQAQTSLQAEPLAGDKAQTRNLDGDRLAALQVSNTGSQPLWLRLDSSGYPQSAPQPGGNVLGIERTIFDTQGQQKSLSSLRSGELVLVKLEVTAKRNVPDALVVDLLPAGLELENQNLANSSASLQENGDAVQNLLNQMQQADIQHIEFRDDRFVAAVAVNEGQPVTLVYLARAVTPGTYQVPQPQVESMYAPQWRATGAASGPLTVTP

SEQ ID NO: 11625 - protein, 561 aa, Klebsiella pneumoniae
PSPKSPRTTVWAPDFFARPCVGRFIYSVSLASELASMTENIHKHRILILDFGSQYTQLVARRVRELGVYCELWAWDVTEAQIREFNPSGIILSGGPESTTEENSPRAPQYVFEAGVPVFGVCYGMQTMAMQLGGHVEGSNEREFGYAQVEVVNDSALVRGIEDSLTADGKPLLDVWMSHGDKVTAIPADFVTVASTDNCPFAIMANEEKRFYGVQFHPEVTHTRQGMRMLERFVRDICQCEALWTPAKIIDDAVERIRQQVGDDKVILGLSGGVDSSVTAMLLHRAIGKNLTCVFVDNGLLRLNEAQQVMEMFGDHFGLNIVHVEGEQRFLDALAGESDPEAKRKIIGRVFVEVFDEEALKLDDVKWLAQGTIYPDVIESAASATGKAHVIKSHHNVGGLPKEMKMGLVEPLRELFKDEVRKIGLELGLPYDMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEVNGISRVVYDISGKPPATIEWE

SEQ ID NO: 11626 - protein, 250 aa, Klebsiella pneumoniae
GSQNVMTRMKYLVAAATLSLALVGCSGSKEEVPDNPPNEIYATAQQKLQDGNWKQAITQLEALDNRYPFGPYSQQVQLDLIYAYYKNADLPLAQAAIDRFMRLNPTHPNIDYVIYMRGLTNMALDDSALQGFFGVDRSDRDPQHARDAFNDFSKLVRGYPNSQYATDAYKRMVFLKDRLAKYELSVVDYYTDRGAWVAVVNRVEGMMRNYPDTQATRDALPKMENAYRQMQMNAQADKVAKIIAANSKNT

SEQ ID NO: 11627 - protein, 299 aa, Klebsiella pneumoniae
SNKNSVSHEPDGSSGAPMNCLTRIRQRYPTLAASDKKLADYILSQPDETRHLSSQQLAAEAGVSQSSVVKFAQKLGFKGFPALKLALSEALASSPDPHSVPVHNHIRGDDPLRLVGEKLIKDNVAAMHASLDVNTEETLREAVTLLRNARRVIVTGIGASGLVARNFSWKLMKIGINAVSEQDMHALLATVQAMSSDDLLLAISYSGERREINMAAGEALRVGCKILAITGFSPNALQQQATHCLYTIAEEQATRSAAISSTSAQMMLTDLLFMGLVQQDLERAPERIRHSEALVKKLV

SEQ ID NO: 11628 - protein, 160 aa, Klebsiella pneumoniae
HHRNISATCHVATHNQRLVMNTVCASCQALNRLPDDRSADGAKCGRCGHDLFDGDVINATGATLDKLLKDDLPVVVDFWAPWCGPCRSFAPIFEDVAEERSGKMRFVKVNTEAERELSARFRIRSIPTIMMFKNGEVIDMLNGAVPKAPFDSWLNEAGQQ

SEQ ID NO: 11629 - protein, 170 aa, Klebsiella pneumoniae
NAGNQVQRIVARFALLAVAGEMATLQGITGWQEGTAYEAVQICLHAWLNERGHIANQEDEGVLAQIKRFITAHQYSRFASWDGPDRPLNMVGFRRVEKDPLTGEEHTLFFILPEGWREMCRGFSPARAARLCLEAECLLPGSDGKYQSQVRLPEIGKTRVYRLTSRILSI

SEQ ID NO: 11630 - protein, 456 aa, Klebsiella pneumoniae
TRPNNFALSENILTGCHRVARLLRRIMIMTEAMKITLSTQPADGRWGEKATWSINNDGIALHLNGKDDLGLIQRAARKIDGMGIKHVALSGEGWNTDRAWAFWAGYKGPKGQRQVEWPSLDDAQRSELDNRLTIIDWVRDTINAPAEELGPEQLAQRAVDLLCGVAGEKISYRITKGEDLREQGYLGLHTVGRGSERPPVLLALDYNPTGDKEAPVYACLVGKGITFDSGGYSIKQSAFMDSMKSDMGGAATITGALAFAITRGLNKRVKLFLCCADNLISGNAFKLGDIIHYRNGKTVEVMNTDAEGRLVLADGLIDASAQKPELIIDAATLTGAAKTALGNDYHALFSFDDALANRLLASAQAENEAFWRLPLAEFHRNQLPSNFADLNNTGSAAYPAGASTAAGFLSHFVENYHQGWLHIDCSATYRKSAVEQWSAGATGLGVRTIANLLTAD

SEQ ID NO: 11631 - protein, 88 aa, Klebsiella pneumoniae
KSKNRRTKRPEKLQVEVDRLKAELEAYKGKEEQWLRRWQQIAFHVRQKGIQMASVDKTSTQRAELPYNTETAQTHRPFDKEIPPSGRI

SEQ ID NO: 11632 - protein, 458 aa, Klebsiella pneumoniae
TEKKRTVMLSKFKRNKHQQHLAQLPKLSQSVDDVEFFYAPAEFREALLTRIAHATQRICIIALYLEQDDGGKGILQALYDAKRQRPELDVRVLVDWHRAQRGRIGAAASNTNADWYCRMANENPGVDIPVYGVPINTREALGVLHFKGFIIDDCVLYSGASLNDVYLHQHDKYRYDRYQCIRNGKMADIMFDWVDNNLVQGRGVNRLDRPDRPRSPEIKNDIRQYRQELRDRSYHFVGTAGDEELSVTPLVGLGKSSLLNKTIFHLMPCAEHKLTICTPYFNLPAVLVRNIIQLLRDGKQVEIIVGDKTANDFYIPEDQPFKIIGALPYLYEINLRRFLSRLQYYVNTDQLIVRLWKDDDNSYHLKGMWVDDEWMLLTGNNLNPRAWRLDLENAILIHDPKRQLGAMREKELKLIRTHTTVVKHYRDLQSIADYPVKVRKLIRRLRRIRIDRLISRIL

SEQ ID NO: 11633 - protein, 402 aa, Klebsiella pneumoniae
HIRKHAMLDAQTIATVKATIPLLVETGPKLTAHFYDRMFAHNPELKEIFNMSNQRNGDQREALFNAIAAYASNIDNLPALLPAVEKIAQKHTSFQIKPEQYNIVGSHLLATLDEMFSPGQEVLDAWGKAYGVLANVFIGREAEIYQQNASKTGGWEGTRAFRIVKKTPRSQLITSFELEPVDGQPVADYQPGQYLAIWLKPEGFEYQEIRQYSLTRKADGKGYRIAVKREEGGQVSSWLHNHASEGDVVYLAAPAGDFFLNVKPQTPVTLLSGGVGQTPMLAMLDALAKSGHQGQVNWFHAAENGDVHAFADEVKALGAALPAFTSHVWYRTPTEADRQAGRFDSEGLMDLAAVADNIRDPQMQYYLCGPVAFMQFAAKQLVELGINKDNIHYECFGPHKVL

SEQ ID NO: 11634 - protein, 227 aa, Klebsiella pneumoniae
RPGKPGGIIPFIPRIIFIMPPFDFIFFIMRCMSSNCLSRRFTSCTCMPQPAAIRRLREPLMISGLARSFRVIELMIASIRTSTLSSICAFTLSGICPMPGSLPIRLAMPPMFFIWRSCSRKSVRSKPSPFFSLEASFSACARSTLLSISSISDSTSPMPRIREATRSGWNGSSASVFSPTPRNLIGLPVIWRIDSAAPPRASPSTLVSTTPVSGSASLKAFAVFAAS

SEQ ID NO: 11635 - protein, 72 aa, Klebsiella pneumoniae
KPYLKTEVREVMQNLESIDWSTYVKFYVGVHFSTLFYTLSTIANVFTQPALRADGEIATSFVKRLWSCVAIR

SEQ ID NO: 11636 - protein, 254 aa, Klebsiella pneumoniae
HGTESLFRRDGSVSRSVSGNGQRGQRGIAMNLFERLMYRRLCNEQPADGGAAPAASEPSPTPAAEQSEAAQQPAADPEPSPADGDKPEPTGDKPAPSAEPSVPEKYELTAPECTELDSKAVELFEPVARDLGLSNDQAQKLAGLWPQLQEQIQNRQAESWGQQVEQWAADTKADKEIGGDKLTVSVGHAQKALDTFASKEFREFLDSTGLGNHPEMVRAFAKVGKLMSEDSFVTGQGNGSPKNDLVEAFYPSKK

SEQ ID NO: 11637 - protein, 207 aa, Klebsiella pneumoniae
LVDDMASVINICNIALARIGNSRTINSLTEKTKEAYTCNLFYESMRDAVLADNDWNFAMSRVVLADLGDPAPGWLFRYQYPTDCARIAAILPKWFTGSHIALQDKPVFEVGSNEDGTGRVIHTNESQAVLLYVKSITDPTMFDALFADALSWRMAAEIAMPIAANASLGQQAMANYQQVLTAAMQRSLDEAHEPQQAMSDLASARIC

SEQ ID NO: 11638 - protein, 166 aa, Klebsiella pneumoniae
PMCEPATAALAVTAVAGGLSAYSQIQTGRANAALANANADAQEQAARDTINTANDQAYQQRQQARRVAGQQTNALAANGADLTSGNALDLTTETMQQGTLDALTTINNGQRQAAGLQFQADTSRAQGKIDKQSGMLGAGSTLLNSTLTGLNAYKTLGGTWKPLSAK

SEQ ID NO: 11639 - protein, 330 aa, Klebsiella pneumoniae
RGGELLARDARKSPDYAPAHRLLGVYSWNKQQDATHALAYLQRAVALEPDNARFLFELDFLQKLLARPVHERLTTLVERKAVVLKRDDLTAELLSLWNASGHYADAAAILDTRVFHPWEGGEGKITGQYLLNQLHRALQFIERGAFKQATDCLKAALRYPDNLGEGRLPGQTDNDIWYLLGYCAEQAGDAQQAAEYYQLARQGGSTLDAGRYYNDQPADYLFWQGIALRKSGNPAQAEQHFRHFIDWAAQHRDDVPQVDFFAVSLPDLVVLDVSAQQRHQQHCLFIEALGHLGLGNVSACQQRMQQLLQINPAHDKAHLIRHALQSGIFS

SEQ ID NO: 11640 - protein, 134 aa, Klebsiella pneumoniae
PTTELWNISASIPACVCVWKPVVHIRSACICRISPIRWWVTRSMAAGRVRRRARRRNSLPRCVNSTARRCMPPCCACITRSPALKWSGTRPSRRIWSSSSRRCAPILKPIRTILTGYDETDCTAVANARQRGGL

SEQ ID NO: 11641 - protein, 560 aa, Klebsiella pneumoniae
SMAELSPKQHYLKHLGQLKNERTSFEEHWRELAEFIDPRSTRFLTTERNNGSKRNTRIVDPTASKAARTLQSGMLSGITSPTRPWFKLATPDPEMMQYGPVKRWLDVVMTRMNDVMNRSNVYQSLPIIYRHLGVFGTAAMAVLEDDEDVIRTHPLPIGSYYLSNSHRLSVDTTYRVFSMTARQIVMQFGLDNVSNAVRGAWDNANYEAWFDVVHLTEPNIDRVNGKLNSRNKAFKSVYFELSGDGDKLLREAGFDEPPILSPRWEINGEDVYGSNCPGMMALGTGKALQLEQIRKANAIDKLVNPPMVAPTGLKNKLINLAPGGVTYVDEVDATKLVRPAYAVSPQLNDMLGSIADDRQMIEACFFSDLFNLFSTINTRSMPVEAVAAMQDEKLLQLGPVLERLNDEFLDPFVDRTFNIMARRNLFPEPPEELQGTPLKVEYVSILAQAQKSIGISSVERFVGFVGNLAKANPAALDKLNIDQTIDEYGNMLGVPATIVNSDDEVQATREQRAQMEQQQQMMAMAQQAGATAKTLSDTNTADPSLLKTLSDAAQQPAVTQ

SEQ ID NO: 11642 - protein, 74 aa, Klebsiella pneumoniae
LHGDTHPLAQAFQGGLLAGQAQLWMLLLQAMEQLGKTALATGEEIVHRHLQPLLSGLQLAQQLLLVAADDFRGG

SEQ ID NO: 11643 - protein, 141 aa, Klebsiella pneumoniae
PTGEVNHSAITNNQLRFCRYSFPAAIYFLAFVERNQVCVAKCAAWLKTELSTLHNRPEEAGLVTGRQFWDLADLCSSYARKAVGCHVLWKSQRHLSLNFWICEQASQSGWFIAMLRDLVSCRCCLKCVGRHVFSLLHSEYA

SEQ ID NO: 11644 - protein, 171 aa, Klebsiella pneumoniae
ARVEPGHFLCERAVDADSKHAADQRLRQMNIELIAEPLLITERSASEDLEAVDQAGDSQPQAAIVRVTVADRVGGFEQHKQQREEKRFSDMGRSADPTLPVADNLLRQGELGGGLSPALLFLIEVRRVSPVMFEQTVLQVQAQKLHVAAVKLAIERPRAAVHQRLQIGIIV

SEQ ID NO: 11645 - protein, 626 aa, Klebsiella pneumoniae
IMSDLFSLVPEGQAWLDNQAMEKPSRPEDFEPSAFQGGASAFFRGAGEGALGLAQSAVGFSKRLISDPAFTDNVAPTINMFRVMFPDADKALNESYDDFGKQLSSAREYIKPEAGSQGIAAQVIHGLGQFAPAIGASVIGGPVVGAAAAAGSTYEQAYQDALAKGVDEQTARAVAAEQSGFNAVGMGLPAAVGGRLATRLLSGVGINAAFGGLNRFAVGETLEENGYADMAKQYRVFDSQAILIDSVLGAAFGGAHHFAARGNSVDARADAPPTVDEGTTPPQDATVTAETAHAQESGVVPGADTSTPGATYDSRLAELQQLAGQVLSRGDRKALTDEIYRAEYEIARIGEQRQALRDQRVGNSSSRRIRNRELAALEQRVQEIQSRIEPSRQALADSTPGGRFYDARSDLSRLEQGIIPESMRGLIPESSAKPSDIDAAHTLNEGLHYDIESAPVLHGSEASINSHVAAMDEAARQLMTGQPVNVSMQARGLDGVVRPDLLADASEQRAAMEQVYRENGIPLAQREAVSESPARMTDNSAFSGKEDTSQVSVDPDTGETISSGSYDLMAARDLAGVESDITVAHPDTGQPVKLSEVLADLDNQIATVKNESRAYSVAASCFLRNP

SEQ ID NO: 11646 - protein, 484 aa, Klebsiella pneumoniae
HRPELMIETTSLKRLSLFPRSLRQLVTLSFVLILLPLLVLAWQAWQSLNALSAQAAHINRTTLVDARRSEAMINAALEMERSYRQYCVLDDPTLARVYQNQRQRYSQMLDAHAGVLPDEKLWQALRQDVSDLAQLQCKNSGPDAQAAARLEVFASNNSDMVQATRAVVYSRGQQLQQEIAERGQFFGWQALVLFLLSLALVLLFTRMIIGPVKGIERMINQLGAGKSLDDAALFTGPRELRSVGKRIIWLSERLAWLESQRHQFLRHLSHELKTPLASMREGTELLADRVAGPLTPEQQEIVEILDSSSRNLQKLIEQLLDYNRKQADGPVAREAVDLVDLVENVVAAHSLPARAKLMHTELTLQARRCLAEPALLISVMDNLYSNAVQYGAESGNIRIHSYRHGEQVRIDVANSGEPIPAAEKNMIFEPFYQGSHQRKGAVKGSGLGLSIARDCVRQMQGELSLVDAPAGQVCFRITLPSAPE

SEQ ID NO: 11647 - protein, 492 aa, Klebsiella pneumoniae
PVTDAALSPEEQLIDDIASFTHDPLGYALYAFPWGEDGTELAHASGPRQWQADAFREIGEHLQNPATRHQPLMISRASGHGIGKSAFISMLINWAMSTCEDCKVVVTANTDNQLRTKTWPEIIKWSNLAITKEWFTCTATAMYSNDPGHDKRWRADAIPWSEHNTEAFAGLHNERKRIVVVFDEASNIADLVWEVAEGALTDEDTEIIWVAFGNHTRNTGRFRECFRKYKHRWKCAQIDSRTVEGTNKQQLQKWVDDYGEDSDFVKVRVRGIFPDASELQFIPTGLTDEAMKRVVTAAQVAHAPRIIGVDPAYSGVDDAVIYLRQGLHSKVLWTGNKTTDDLIMAKRIADFEDQYQADAVFIDFGYGTGLKSIGDGWGRTWQLVPFGGASADPQMLNKRGEMFNACKTWLKLGGALDDQETADDLSAAEYKVRVDGKIVMEPKEDIKERLGRSPGKGDALLLTFAYPVTKRSDFPAAGGKQPNVISEYDPYA

SEQ ID NO: 11648 - protein, 184 aa, Klebsiella pneumoniae
KDQDRAPRAQTTQQLLSPAQCIQVPLVHIFLEPMVQQKELAYRQSAQVYHHQLAKVLDLLLVVALLQIAQPQESGMVRMLLELLHHLQAAHCTNADTSDAQINSSLFLAGLFGHCQILIGTRFHHVGKDFQSRVTFSFGEGCRERLTGISRTPHASLLNQAPDETAAVFCPADEAQVIKFVLAP

SEQ ID NO: 11649 - protein, 261 aa, Klebsiella pneumoniae
TVKDGAMWIGIISLFPEMFRAITDYGVTGRAVKNGLLSIESWSPRDFTHDRHRTVDDRPYGGGPGMLMMVQPLRDAIHAAKAAAGEGAKVIYLSPQGRKLDQAGVSELATNQKLILVCGRYEGIDERVIQTEIDEEWSIGDYVLSGGELPAMTLIDSVSRFIPGVLGHEASATEDSFADGLLDCPHYTRPEVLEEMEVPPVLLSGNHAEIRRWRLKQSLGRTWLRRPELLENLALTEEQAKLLAEFKTEHAQQQHKHDGQA

SEQ ID NO: 11650 - protein, 191 aa, Klebsiella pneumoniae
NQRDICNLNTELLMVTTHVFIAVSLDGYIARQDGDIDWLLKRDDPTEDHGYAAFIADKDWITMGRGSFEKVLTFDEWPYDRPVLVLSRQLTNTPVPEALKGKVQFSCRTPREALTDLMEKNVHRVYIDGGQLIQSFLREGLVDDIVITTVPVLLGSGKPLFGVLPHDIDLTLLSSRSFPSGLVQSHYRLTS

SEQ ID NO: 11651 - protein, 74 aa, Klebsiella pneumoniae
TRMERSKMCISKPKVSSPQVQAAPQVSDSAVQNAADSDRRRRAAAGGQKSTILTSSQGVTQPSGGTQGKTLLGA

SEQ ID NO: 11652 - protein, 247 aa, Klebsiella pneumoniae
RNVDGWQRAFVLHSRPWSETSLMLDVFTEESGRVRLVAKGARSKRSNLKGALQPFTPLLVRFGGRGEVKTLRSAEAVSLALPLSGITLYSGLYVNELISRVLEHETRFSELFFDYLHCIQALAGASGSPEPALRRFELALLGHLGYGVDFLHCAGSGEPVDDTMTYRYREEKGFIASLVIDNNTFTGHHLKALASREFPDVDTLRAAKRFTRIALKPYLGGKPLKSRELFRQFMPARKARADNTNND

SEQ ID NO: 11653 - protein, 73 aa, Klebsiella pneumoniae
RMTDLSRPAGPTYPFDTGTLRRSPRLACVQQLFSGYQFIPGFGGRDTVTTMLTDNQRLPAAVDAVIVTKRDGA

SEQ ID NO: 11654 - protein, 451 aa, Klebsiella pneumoniae
VKADALPCPRRGHCLSLAETLTGTYQMMTVIEPPSALSSPQRRSQVLLMFYLPGQSVTTERLGRINLVDETTARQDIEETGREIQRYHRLTLQSQVDGSYRIEGAALDQRLCLLHALRRGLRLCPQFVNHHFTPALKTQLKQEGIARTLYDDTNLQALVNRCARALNRQFDCRDVQFLRLYLQYCLLEHHRGYSPDFNEEQQRWAQTAAEFTLAQEIVRHWQRRVGAPPHVGEPFFLSLLFMLLKTPDPVRDGHPHDRRLRLAISGLIHRFQILAGRAFSDEQGLSDQLYIHLSQALIRSVFAIGIDSTLTEEVTRLYPRLLRTTQAALSEFEEAWHIRFNEEETGLIAVIFGAWLMQKSDLHEKQVLLLTDDNPAIEEALEQQLRELTLLPLNIKYQSVERFQKEGAPKGVTLIVTPYATALPLFSPPLIHAENYFTERQQQHICAMLED

SEQ ID NO: 11655 - protein, 423 aa, Klebsiella pneumoniae
LSQEMRMLKREMNIADYDAELWQAMEQEKVRQEEHIELIASENYTSPRVMQAQGSQLTNKYAEGYPGKRYYGGCEYVDVVEQLAIDRAKELFGADYANVQPHSGSQANFAVYTALLQPGDTVLGMNLAQGGHLTHGSPVNFSGKLYNIIPYGIDESGKIDYDDMAKQAQEHKPKMIIGGFSAYSGIVDWAKMREIADSIGAYLFVDMAHVAGLIAAGVYPNPVPHAHVVTTTTHKTLAGPRGGLILAKGGSEELYKKLNSAVFPSAQGGPLMHVIAAKAVALKEAMEPEFKVYQQQVAKNAKAMVEVFLNRGYKVVSGGTENHLFLLDLVDKNLTGKEADAALGRANITVNKNSVPNDPKSPFVTSGIRIGSPAVTRRGFKEAEVKELAGWMCDVLDNINDDAVIERVKGKVLDICARFPVYA

SEQ ID NO: 11656 - protein, 107 aa, Klebsiella pneumoniae
SREEKTMTGHDLLLIANALICGGIALRVMFFQRNGSRHRRWGGWIAYFLIVAAASIPLRTAYSYLYHFPMTADLSEVVINAVMFAAVLKTRGNVVQIFKISRSQHGH

SEQ ID NO: 11657 - protein, 141 aa, Klebsiella pneumoniae
RLVLRYGMRADELEVSHAAGSNQLGVRQQTGSKNGNGYGGEQVNIQQINNLKKIMNNIDGDYQLNQMLYERHVELIDAIKFHQLQKPFYELERKGVRSEILEELMMSSEFEECLAAYQRELTGIIAKWDLADQLDTARDAA

SEQ ID NO: 11658 - protein, 239 aa, Klebsiella pneumoniae
RFSLATPMTDNAVLRLRAERLARATRPFLARGNRIRRCQRCLLPLKQCLCATLTSAQAASRFCLVMFDTEPMKPSNTGRLIADILPDTEAFQWSRTEPPQALLDLVAHPDYQPMVVFPASYAGPDRQVLSAPPSGKPPLFIMLDGTWTEARKMFRKSPYLDALPIISVDLSRISAYHLREAHADGQYCTAEVAIALLDLAGDAPAAAALGEHFTRFRTRYLAGKTQHKGSITAGQVENV

SEQ ID NO: 11659 - protein, 526 aa, Klebsiella pneumoniae
SFPLNRCWRLAADVIHHAGDTVHFIDDTVGDAAEEIVRQVCPVRGHEVDGFHRTQGNHPVVFTAIAHHADGTNRQEHSERLADFVIQISFVQLFDEDSVRTTQQVAVLFLHFAQHAHAKAGARERVTVKHVVRQAQFQADLTYFVFEQLTQRLNQAHLHLFRQAAHVVVRFDDVRFTGGGSSRLDNVRVDGTLRQPFDVVQLQRFFVEHFHENATDNFTLRFRIAFTRQRVEETLLAFNVNNVQAKVVAEHLHHLLRFVQAQQTVVHEYAGQVFADSAVQQHRGHRRVHTAGEAEDHFVVANLLTDTLNGVVNDFRRGPQRFALADVAHEALQHTHPLTGVGHFRVELHAVEAFFFVGHNGERAVVGASDGYEVRRDSGHFVAVAHPHVQQRFAVCGQGIFDTAHQRAVVNHFNLRVTKLTLVRTFYMAAQLHRHGLHAVADAKYRHAGFEHILRRARAVLFGGAFRAAGKNDAAWIKFADLCFRDIPCPQLTVDAQLTHATRHQLSILRPEVEDEDAMFMNVFRH

SEQ ID NO: 11660 - protein, 127 aa, Klebsiella pneumoniae
MMALTKKQRAELRMKFGGRCAYCGCELGDKWHADHVEAVRRNISNGYAMDRPENDTVSNMVPACIPCNLFKMCSTVEDFRNRIATQVDVTRRASRSYRTAESFGLVQPTNAPVVFWFEKYQEEGANQ

SEQ ID NO: 11661 - protein, 85 aa, Klebsiella pneumoniae
GNFCANPVGKPVKELGLSMFYGGEAKKGLSSRGAFPFPPPPPALTGGEAFINTNPCGPSKTPFTLKRRMGETALVLTQSQVYVSH

SEQ ID NO: 11662 - protein, 351 aa, Klebsiella pneumoniae
SAGCFPWAYSEDSMMNKIRAAVVGAGIYGRHHMNAYRHNPDTVLVAICDTDTERCDDLAMAYGVIGYTRLDALLQEEAIDVVSVATPDPYHTESILTALRQGKHVLAEKPLATSVRKCELIVEMAQQRDLLVGVDFHKRWDPAVMRIKAELEKPEAGRILRGHISMDDVISVPTEWLNWAGASSPVWFLGSHCFDLVRHLSGQEVVSVYAVGQKRLMAECGLDTFDSVQSLLTMADGSSWVVENSWVLPEGFPKDNDGRIDILCEATYIRSTSQHRGLEITTPGMTLTPNSYFINYRNGVASGFGIDPINDFIRAVRNRSPYPVTAEDGLAVSRICEAVHRSLESGKPEDV

SEQ ID NO: 11663 - protein, 126 aa, Klebsiella pneumoniae
ATYCSGPKRNQITMRCKTLTAAAAVLLMLTAGCSTLERVVYRPDINQGNYLAPNDVAKIRVGMTQQQVAYALGTPMMTDPFGTNTWFYVFRQEPGHQKVTQQTLTLTFNSGGVLTNIDNKPALTSQ

SEQ ID NO: 11664 - protein, 72 aa, Klebsiella pneumoniae
PPNCIEIKVMSEILTFGLMVGQPALRNLCLAGSPRTLLAMSALRSQRTFILGNLLASCLERTLLKSTRYMQP

SEQ ID NO: 11665 - protein, 164 aa, Klebsiella pneumoniae
DMRLTSKGRYAVTAMLDVALNSETGPVPLADISERQGISLSYLEQLFSRLRKNGLVSSVRGPGGGYLLGKDAGSIAVGEVISAVDESVDATRCQGKGGCQGGDKCLTHALWRDLSERLTGFLNNITLGELVNNQEILDVSGRQHQHETQRNARTQDAIDVKLRA

SEQ ID NO: 11666 - protein, 412 aa, Klebsiella pneumoniae
NAQCSRNIVKGVKCMQRTGFNNARVRQANKSIFLSHLWREKQLSKSQLSQLTGLSIPAVSNILAELLSEGLIGHSTEHLSKRGVNSGSYQIPEHGAWTLCMNITPTSIEYQLADARLLAVDGHQHLPVNAPTPQALLEAIVECWRHIHRRYPQHSINLALGVHGQVDPITGVSQTMPQARWKTPIEIKYLLEERLGVQVRVDNDCVMLALAEKWQHQGTQQDFCVINVDYGIGSSFVINDHIYRGSLYGSGQIGHTIVNPDGNACDCGRYGCLETVASLSALKKQARMWLKTQPEATLAPEQLTTASLIEAWKEGDVQIRAWVDNAANAIGLSLYNFLNILNINQIWLYGRSCAFGEQWLESIVKQTGFNPFDHRDTPRAHATQIGFGQLTRAQQLMGIGYLYVEEQLQTLV

SEQ ID NO: 11667 - protein, 207 aa, Klebsiella pneumoniae
RDECEKNAEKFMSSKEQKTPEGQAPEEIITEQHDDVEAVEPEVSAEQVDPRDEKIANLEAQLAEAQKREREVMLRAKADEDNLRRRTEQDIEKAHKFALEKFVNELLPVIDSLDRALEVADKANPELAPMVEGIELTLKSMLDVVRKFGVEVIADTNVPLDPNVHQAIAMVESEDVAAGNVLSVMQKGYTLNGRTIRAAMVTVAKAK

SEQ ID NO: 11668 - protein, 75 aa, Klebsiella pneumoniae
ATECRVDAYTGEKSCRQSSAYCRWQSHTYRIESALFSCHGACGLFVNTLCQSILVGLLVGAACRRRCADHRSANN

SEQ ID NO: 11669 - protein, 126 aa, Klebsiella pneumoniae
PTGWRLQPPRRRLVMPKSPAERKAAQRARQSAAGERKIELVLDEQEQEMLARNCAARRPGRDPYEMAEYIALLIRQDDARVRGRINAISKRRCGKCGDQLPVASCPCTGDSQCWATLGWHETKLPL

SEQ ID NO: 11670 - protein, 128 aa, Klebsiella pneumoniae
LNPRMIVLFKYTVFLCEVIMGFPSPAADYVEQTLTVSRLCQYDANCRALETAAGYAIVDVCRRPKQGDHVLIAYAGKTEFAVVRGQALITDDGEALEGDALDDVEVRGVVTYLINRAGWVSDDDIPIM

SEQ ID NO: 11671 - protein, 159 aa, Klebsiella pneumoniae
AEYRSRDYWPCGDERPERGGGGNEASDAGSARLMAILGLGTDIVEIARIEAVIARSGDRLARRVLSDHEWSIWEQHQQPVRFLAKRFAVKEAAAKALGTGIRNGLAFNQFEVYNDELGKPKLRLWGEANLLAERMGVSAIHVTLADERHYACATVIVES

SEQ ID NO: 11672 - protein, 161 aa, Klebsiella pneumoniae
QSHRALSEHKTLSISWSHYQNRPPLNATDKDAFNRPRGGNMMNTGAIIQDLIDWIDNHLDSRLDIDTVARRAGYSKWHLQRIFKEHTGQPLGEYIRAKKLQKSIERLAHSNEPILNVAIALGFDSQQSFNRSFKRQYGKAPGVWRRSISRSVAQTSRQRSA

SEQ ID NO: 11673 - protein, 106 aa, Klebsiella pneumoniae
GIGRLIPERGLADGGAALLPLTDFSSIENHQSGREVDGAGKVGVFNQAVNRRFTHRQKLDHLPHTHIAAFGKSIVAVSTGFHDCTSREQSVEAVIARKGGERYRSG

SEQ ID NO: 11674 - protein, 434 aa, Klebsiella pneumoniae
NLSRSSSHSFLPSPDREAIRRIRKNAKTNNKASHPGGLFYLITTKATSMTEENPLLALRDKISALDEKLLALLAERRGLAVEVGKAKLASHRPVRDIDRERDLLERLMTIGKRHNLDAHYITRLFQLIIEDSVLTQQTLLQQHLNKINPHSARVAFLGPKGSYSHLAARQYAARHFEQFIESGCAKFADIFNQVETGQADYAVVPIENTSSGGINDVYDLLQHTSLSIVGELTIPIDHCVLVSTSTDADKIQTVYSHPQPFQQCSQYLSRYPHWKIEYTESTSAAMEKVAQANSPAVAALGSEAGGALYGLQVLEHCQANQTQNITRFLVLARKAVNVSDQVPAKTTLLMATGQQAGALVEALLVLRNHNLIMTKLESRPIHGNPWEEMFYLDIQANLDSLPMRKALKELADITRSMKVLGCYPSENVVPVDPV

SEQ ID NO: 11675 - protein, 109 aa, Klebsiella pneumoniae
FPARDAARCCGYTLPHREYQCARRCPSGSPPAAPTSFPPPTNCRRPSSAGSARCRRCRGRIQPSAASARRRTPTPPPVRKDGAPGQSSASRETTPGSLRPPSSATPSAR

SEQ ID NO: 11676 - protein, 66 aa, Klebsiella pneumoniae
GAHRLQMGHRVAKPFTPLAEAATHNFRQPVFQLLDPRLRAVDPWLRVVVIQTLNGALLPLFCALKL

SEQ ID NO: 11677 - protein, 62 aa, Klebsiella pneumoniae
LCDRGERAQPTPRRSKRRGLYLQSISGHSETASSQIPGSIDNYVTGVREGSQQCCGVKDAGD

SEQ ID NO: 11678 - protein, 256 aa, Klebsiella pneumoniae
CARRAGLFSHYASLSAGIIQLMNQYRGTMSQFLAWRRSLSGWLLSGIACLTLAGCSAGFSPHTAEGTAAPGQAQHQVADFVAVDCADIWAHSSDASDKNPLYWLRGIDCADRLAPAQARAEAKRHTDDSWQDAFRRGILLADAKITPEERRDLVARLDTFSPQIAVQVRPLYQLWRDGQTRQLQLVEERARYAKLQQSSDSELETLRQQELALREQLELTTRKLENLTDIERQLSSRKPGGNFGSEKVPEVIHDDP

SEQ ID NO: 11679 - protein, 108 aa, Klebsiella pneumoniae
GRRRHDSRVSDLHVVVQLITFFQTAQNRDGIFYRRLGNEHFLEATFQRGVFFDVLTVFIKRRRPDAVQFTTRQRRLQHVTRIHRAVGFTSANHGMQFVDKQNDVTFLF

SEQ ID NO: 11680 - protein, 74 aa, Klebsiella pneumoniae
GARRRKALPLVTAPQKQQSQAQGLALFRNEAVPYSTFRPMSDKARLLSGVGRQAPVCASFDVYVARPEGADIRR

SEQ ID NO: 11681 - protein, 71 aa, Klebsiella pneumoniae
EPARRKPCGLFCALNLSRAVQRELIKSAPFRPIDRHNEKLWYFHVTDTPLAPLSELDLPRHSHNPLTFRPR

SEQ ID NO: 11682 - protein, 112 aa, Klebsiella pneumoniae
LVLRRPPAKSLPVSPEACKPMPEYKVAKRSFINGRLHEPGDIVTYDGEPGSNLVSVDASLSEKIVPVSAEELTEIDDLRKQYEEMFGEAPHFNTKAETLKAKIAERRKELGV

SEQ ID NO: 11683 - protein, 63 aa, Klebsiella pneumoniae
ELMRALAESSSRPARTPNSVCVRPALTLEILSLLPITATIHPIKHTKIIPFLAKPIFKTYIEN

SEQ ID NO: 11684 - protein, 115 aa, Klebsiella pneumoniae
ITMRCNTWRALIVSRLTILLHELNILLRCCSTQRAICRLLFQLFFFRYNLFLAPSMGSGVLLYRIKPHFYRINKRCIITIEPLRLGYHVLLDSGELLILKLLELAHLIPAGLVVK

SEQ ID NO: 11685 - protein, 238 aa, Klebsiella pneumoniae
KGVREHRHQGDGVQRRRKDWAAGRQRIGGGAGRSGDNQAIGSLRERKDFVDIDFELNHMRHFAGVQHHFVDGGADTFLAILLTHLGLQQKAFLGDVVAFQHVGELLQGVVRVKVGEKAEVAAVNADDVNVVTGQGPRRAEHIAVAAHHHRKIGLLANLRQRAGFHVAELKFMGDLLFNQHFIPFAAQPAPEHFMCGQGGGVTRMSHNADTLEMVLHDLDVLALNEIVTICPLPLKPGN

SEQ ID NO: 11686 - protein, 125 aa, Klebsiella pneumoniae
SLPRCMRLQLAWIDYQLKYKKLAFSSEMPPLMSIERKMFHITQVGVVLLTLTLCSGLFYMHNLFSSENIDKAVLSIIAWFVYIVLLWGHYHEGWRGRRVVWFSVAGAGLLTLAYFGSRVLQQFVS

SEQ ID NO: 11687 - protein, 69 aa, Klebsiella pneumoniae
LIQRFVGIREHDAEHVDGRCDIVGKCRVTYQSLAKSYGRLSQAQSPLSGAAEKCRRATLKCRRFEVFRA

SEQ ID NO: 11688 - protein, 72 aa, Klebsiella pneumoniae
LNQRLQLLLNVQITYPHQLLGACQLAKAYLGGVRSRRIPVVKGVETRLFNDTFQPLLTEGAAAPVKPDLINI

SEQ ID NO: 11689 - protein, 64 aa, Klebsiella pneumoniae
WMKRVRRQPPALPCNNQGKFVVGGLCFQYSSYFNKMLPSSVGRGGDAHYNARQAIQSYVQQQNI

SEQ ID NO: 11690 - protein, 83 aa, Klebsiella pneumoniae
TLRRTKSRRLSPRTARTPEPDSSIANGSHWLPFFYTFPDELKRFSAGLTHQIWPALSGSTSKISLLPALSHKMNLLTKSDNKM

SEQ ID NO: 11691 - protein, 93 aa, Klebsiella pneumoniae
AARRASPTKIWSLRSRVTPSTTHASTNMALKWTDSREIGEALYDAYPDLDPKTVRFTDMHQWICDLEEFDDDPNASNEKILEAILLVWLDEAE

SEQ ID NO: 11692 - protein, 65 aa, Klebsiella pneumoniae
ILRRFPAPAASVTLGLSHHVLSMRLYVAQYGADTNNVAEHGRDFCGGAGYIMPVSIEFAEQLHHH

SEQ ID NO: 11693 - protein, 442 aa, Klebsiella pneumoniae
TCGREAPGFIFVYIKRINVAKNIQAIRGMNDYLPGETALWQRIEGSLKQVLGSYGYSEIRLPIVEQTPLFKRAIGEVTDVVEKEMYTFEDRNGDSLTLRPEGTAGCVRAGIEHGLLYNQEQRLWYVGPMFRHERPQKGRYRQFHQIGAEVFGLQGPDIDAELIMLTARWWRELGISEHVSLELNSIGSLEARANYRDALVAYLEQFTDKLDEDSKHRMYTNPLRVLDSKNPDVQALLNDTPALGDYLDEESKAHFAGLCALLDDAGIRYTVNQRLVRGLDYYNRTVFEWVTTSLGSQGTVCAGGRYDGLVEQLGGRATPGVGFAMGLERLVLLVQAVNPEFKADPVVDIYLVASGTDTQSAAMRLAEQVRDALPGVKLMTNHGGGNFKKQFARADKWGARVALVVGESEIADGNVVVKDLRSGEQTTVTQESVAAHLRTLLG

SEQ ID NO: 11694 - protein, 602 aa, Klebsiella pneumoniae
RLQLFQYIKHQARLVEKIVLIFTAASLLDKKPVYTVRKHSIGFSYRKAAMLAQLTISNFAIVRELEIDFHSGMTAITGETGAGKSIAIDALGLCLGGRAEADMVRRGATRADLCARFALKDTPAAQRWLEENQLESGRECLLRRVISADCRSRGFINGTAVPLSQLRELGQLLIHIHGQHAHQLLTKPEHQKTLLDGYTGEYALTQRMSEHYRQWHQSCRELAQHQQQSQERAARADLLQYQLKELNEFNPLPGEFEQIDEEYKRLANSGQLLSTCQHALTVLADGEDANLQSQLYTAKQLVSELVGMDSKLSGVLDMLEEAAIQLSEASDELRHYHDRLDLDPNRLFELEQRISRQIALARKHQVMPEELPAVYQAMLEEQRLLDDSAGSLESLSQQVVEHHQLALETARQLHALRQASADELTQLITESMHSLSMPHGVFAIEVAFDERHLTADGADHIEFRVTTNPGQPLQPIAKVASGGELSRIALAIQVITARKMETPALIFDEVDVGISGPTAAVVGKLLRQLGESTQVMCVTHLPQVAGCGHHHFFVCKETDGEMTETHMQPLDKRARLQELARLLGGSEVTRNTLANAKELLAA

SEQ ID NO: 11695 - protein, 65 aa, Klebsiella pneumoniae
RHKLNLSTVVERENASVASDTVLLLQPCFSSLKKQCIRKRSYKTQDLDHADIFDDIDLFSNRSWR

SEQ ID NO: 11696 - protein, 331 aa, Klebsiella pneumoniae
TKKLYMAQRVQLTATVTENQLGQRLDQALAELFPDYSRSRIKEWILDQRVLVNGTIGDKPKEKVLGGERIAIDVEIEEEARFQPQDIPLNIVYEDDDIIVINKPRDLVVHPGAGNPDGTVLNALLHYYPPIADVPRAGIVHRLDKDTTGLMVVAKTIPAQTRLVESLQLREITREYEAVAIGHMTAGGTVEEPISRHPTKRTHMAVHPMGKPAVTHYRIMEHFRIHTRLRLRLETGRTHQIRVHMSHITHPLVGDQVYGGRPRPPKGASEEFITALRKFDRQALHATMLRLYHPISGIEMEWHAPIPQDMVELIEAMRADFEAHKDDIDWL

SEQ ID NO: 11697 - protein, 275 aa, Klebsiella pneumoniae
RAGSVLVRKVSGRRSQPMTKSTITRDELNEVIATYGKHHIAHRMANLLLAAMDSEPDCKERKLFCSTDTARMRKVISVSAGTGDAPLYRHAQPVPVVSADLLHTAASAIEDLLTTKDRTGTCVWFDLPFRLRSAANAQPAPVVQEVDADDNFYSWFGREWRENYQHNQYTTAAKQMLGVIAESAWKAGCRAAMLAAAPQSPGSEPATVPGKWIPVSERMPEDCAQVILWDAEIGEVTSGHYSHKTHTFYHCGDAIENEITHWMAPPAAPQEVSDA

SEQ ID NO: 11698 - protein, 145 aa, Klebsiella pneumoniae
LNLRHGCRPLSKGGSFGIYGDFLFQDHTQYGSSIAGILGGPVLGFAEQLSKTVLTNSQKAMAGEDTTFTADALKTARMITPFANLWYTKAITNHLILQQLQEMANPGYNARVRDRAMREFNTTSWWEPGEETPRRAPDLGKAVGK

SEQ ID NO: 11699 - protein, 404 aa, Klebsiella pneumoniae
RAISRQEHLAPAGVYRQTIATIREEIMVLHSTRWLALSYFTYFFSYGIFLPFWSVWLAGNGLTPETIGILLGAGLVARFLGSLLIAPRVSDPSRLIAALRVLALLTLLFALAFWAGSHVAWLLAIIIGFNLFFSPLVPLTDALANTWQKQITMDYGRVRLWGSIAFVIGSALTGKLVSLFDYRAILLMLSLGVASMLLGMLLKPSVMPQGESRQQQGAGMAAWLTLVRQSWRFLACVCLLQGAHAAYYGFSAIYWQQAGYSASAVGYLWSLGVVAEVVIFALSKKVFRRFSARDLLLLSAVCGLIRWGLMGWTTALPGLILAQILHCGTFTVCHLAAMRYIAARQGSEVIRLQAVYSAVAMGGSIAIMTVFAGFLYQHLHQGVFWVMALLTLPAMAIRPKAVAA

SEQ ID NO: 11700 - protein, 124 aa, Klebsiella pneumoniae
LRWLLAGSSKSWPLTWCRRSLRAPKRFTVPANIRVEVAYALPEKQYLQRVTLDEGATVEQAIIASGLLALRDDIDLAKNKLGIYSRPVKLHDEVHDGDRVEIYRPLIADPKELRRQRAEKSAAK

SEQ ID NO: 11701 - protein, 78 aa, Klebsiella pneumoniae
VAARLRGAGSEDGGRMNIAEEASLIRQLEEARAIINQRNGEIIHLQREAARYREQRDSANAMVKFLRGLFENSSKATQ

SEQ ID NO: 11702 - protein, 164 aa, Klebsiella pneumoniae
IQGSTMIKEWATVVSWHNGVAQVHCDVKASCSSCASRAGCGSRVLNKLGPQTSHTISVPCEQPLAAGQKVELGIAESSLLGSAMLVYMAPLAGLFVMASIFQVLFASDIASLCGALLGGVGGFLVARGLSPRLAARQSWQPVILNVALPPDLLRVDTPSSDMGQ

SEQ ID NO: 11703 - protein, 309 aa, Klebsiella pneumoniae
WGGRALVQNSSGLIAHPVHPNLMSPQGVKMALVSNPHSAYSPRLPWLGGIAGLLAGGAILYFWPQWNRTWLSLVPAPVSVYTRFLGVTLEDVPLVTYCHQALLGFLMVLLAPGYGKSTLAAWMMHNPASSRRWPGEVFRAWVTKFGLLVMVFCNLFFLSRVPSGTLALYIFILQHVSVAAAVASGVLLLRDARRLARTFDAQLADLRLLMILTLGFQTILPAQIALMSARGVNTPLGWYIVIAQMAGVLLAFMLVGGLVAALRSLLGEERCRAWRGDMALFNGIVTLCVTGFLLYHMVSAYPRIFAALH

SEQ ID NO: 11704 - protein, 1768 aa, Klebsiella pneumoniae
RPTRERKNNGYAAGSKSPFMCGRKAYRWLVWIKPLLKGLSCLIILKPRRHTGLLIKKFHLQGEYKMSLEIKKQSNPFSTGGGGVNFETRVQAAFALSLLTKSCVPCLSNYMRAKELKFQNKYDGVNTDDFVLTATDNSNNESKIFAQIKHEITISGSSNSVFAEVIHSAWADFKNVGFKSERDSIALITGNLPKTDINNTLPLLEWAKFSSNSEDFIKKSQTQGFTSEAKLERLGIFRDQLTHANNGVAISEEELWSFLKSFQILPFDLDAEHSIVANLLCSLIQCYSDVLPSLVLARLVSCVQSFNQNAGVLTQNNIPEDVKGLFNKSSHLYFEDDLIKLYERSQHIFEGISTTINGLHVDRTEQLAALSNCYSDSEFVFVTGARGAGKSGVVKDFITTKNLDIPVFYLRAEDLDKSNLNEVFTSMGITSSLGEIESHFSLLHEKVLVIESLEKVLELNYPNTFVELLQYIRKQSGWTIIATGRDYAYQQLLFNFLQPCSINFSSMNIEGLEDSQVEQVCEHIPELKSLVSNNSLVELLRIPFFIEIAVRAIKNGAQFGIGDTEEDFRDTVWRTVVAKEADRKSGMPDRRRATFIKIAIERAKKMLFGVRASGFDPEVIAKLEEDNLIYRDQKSSCVSPMHDVLEDWALEEFIDREHFDNSHNVASFLLNIGNEPAISRAFRLWLYRKLKFDDTTNEFVEGLLSSDEIESYWKDEAISAIMQHDSPGIFFNSLKRQLLKDDCALLTRFCFILRITCQRPISLHNGLLIKDKKSGLLKSLFLKPYGEGWEALFHFIYQERDDLSSPVRTQVIELIDEWTGLINIHDELPKASEKVGFLSLWLLEKVKDSYRGEGQRKKILNALLKVSTAIKDDFDELMKQDVFTSKIKPRRLSYVDELSSLALIGFNVPMLCKFYPDFVVKLSMHEWLLEESEENDYGYGSYRVDVEESFGLDTERDFFPASGAKGPFKYLLQFKPRLGLDFIIRLCNLTAQKYSESDFSKTQDNKEDTIYAFETVAKQVDITLNDGTVVKQYASPHLWKGYRGQSTLPYLLQSALMALENWLVEYVENCGKNNEIDWIFDYVLRSSNSVMPTSVLSSVATGFPNKVGKAAFPLLKTADLYHLDLIRMTQEMGGNEMHFFGLNRDALSKIYLEERREAALRPWRKESLETLLTRLQFVNELRDDILKIVDELKNEATASNEKSLRYMVHRVDTRTWKVVEDKENDRVLFQSSSELPEDLKLDQQEFNEKHAMDNTVTSLNLWGKKLFDEQLLEEKYFSSYQDALIATKGLLSALQKGEVHNFADMAVGTITTVAAVCVRDVLLELSYEDKKWCLEIILESIFMHADNMNGTAAHDKTDYYGSGACAFVLPKLFDLDLDSEQIEYLKFALATALTHENLNVSACAAKGVREFLWSRDAELASRCIGGIVEYARLRREDSEVRRFYHLQGAELQAALEKWNDLLTSFRNDLIEGKFKLSVNDISLESHCSWFIHLPMLMVPYCTKDEIQIQLVNRLMSFVFDTEYQNHRSSDDEKINHEIKKQIQDCLSEHVVSSRKNNFMPFKDLLVLGCTKAPGFIYSLTLSYHVAVEKEGDYDAIWALWCLLAPEAHKIALNDVNDRYIGLQNDLNQLLRGMMYADCPWQGHENEEKDMKRGAKYLLDFARQSAHNSHVFEALSSLIYNFYNVFFEEGILILAEHYSANRHIIGKQVNTAFYIEMVVGRFLQIENRGTLNRKMYDICLLLLTGIVETGSARAYYLREELIRSRKISA

SEQ ID NO: 11705 - protein, 105 aa, Klebsiella pneumoniae
FLQRVDNMQAIGFMEYVVVVLFQWAAIMAGLESWWGLHWIIAAPIAFIVSYIPLVGSIVGMIGAMDVWRWEWWQAGLLFFGGLIFAIACGGMSSLFEWLSFRKRA

SEQ ID NO: 11706 - protein, 270 aa, Klebsiella pneumoniae
TGKSMLNTLPDLHRSFAEQLKLKLQSDSRIHSLLAGGSFIHGGFDQYSDLDFVVVIDPLYYDEIMAQRMAFAGTLGHLLHAFTGEHVGEPRLLICLFGPELLHVDLKFITLDMLTQRVEEPAVLFTRDNDALKRQLAKFSAHWPNMTPEWFESRAWIWLHYAVVKLGRGELFEALGMLSFFREQVLGPMLFRRANLPQRGVRRIEALGIDPDGLLTSTLATHDRHSVGIAIRRAADAYINLRADALPDDIADDAARRAVLAMLDAYSDKG

SEQ ID NO: 11707 - protein, 460 aa, Klebsiella pneumoniae
KRKSMTTCTSRAAWLNLLRRLHFYIGLFIGPFIFVAALTGTLYVATPQLENWLYHDALHGLAEGTPQPLSAQIAVAEEATQGNLRLLAVRPAPALGETTRIMFADPGLGESESRAIFVDPIALRVKGDMTVYGTSGILPLRQWIDYAHRSLLLGDSGRLYSELAASWMWVAALGGIALWAMTRPKRRLNNALQNHRRLHVTLGWGLLVGMLLFSATGLTWSQWAGGNVDKMRAAFGWLTPQVNTQLHGEMPMTHDPHAGHHMDAMAMAQHQPALQLAQFDQALAAARQAGLNASRLEIRPPVSDDRAWTVNEIDRRWPTQVDAVAIDGATMQVVDRTRFADFPLMAKLTRWGVDFHMGILFGLANQLLLVGFGCALCVTIGVGYRLWWIRRPPQAAWDPAHSLLQAWLSLAWPARSLVLGLAFALGLAMPLMGASLLLFIAVDYLRWRAATAMRMMKSSD

SEQ ID NO: 11708 - protein, 79 aa, Klebsiella pneumoniae
KNMSDVQKFDFKRCWLDLSPAEREEFASDAGTTSHYIQVHLTGRRRIPRKPLLERLFKACKSRKWITAKSDLVLWFHER

SEQ ID NO: 11709 - protein, 88 aa, Klebsiella pneumoniae
SFFGLLQNYRNHNQSETGTMEIITRVEAAKAGLKRYYTGKQCKHGHDSERWVYNGHCVECTLETNRRRHAEIKRLMHEASRGNAVEVI

SEQ ID NO: 11710 - protein, 122 aa, Klebsiella pneumoniae
FALGILWHGKHPENNYLLGNNTMPPAMLHDRNIIITHPPGPVYQVGNDTPHFNIVQGVPFQRLTIISDQRLPADNSEFSFPGICDKNMITLLWPAADIDDGITGGSLQGATVGVILTKAGNG

SEQ ID NO: 11711 - protein, 827 aa, Klebsiella pneumoniae
QRIGDIDSCYCNFYFVLFSGGIMYGSVKVWQEIISLPTWTTGAEDPNPMFLEKRVYQGSSGSVYPYGVIDTLTGEREMRDYQAVWMENDFLRVMLLPELGGRIHRAYDKVKQRDFVYYNEVVKPALVGLLGPWISGGIEFNWPQHHRPTTFKPVDFSIQQGENGAQTVWMGEAEPMRGLQVMAGFTLYPDRALIEITGKIFNGNATPRHFLWWANPAVKGGDAHQSVFPPDVTAVFDHGKRDVSAFPIATGTYYKVDYSAGVDISRYKNVPVPTSYMAEKSDYDFVGAYHHDERGGLLHVADHHVSPGKKQWSWGYGDFGQAWDRNLTDENGPYIELMTGVFTDNQPDFTWLAPYEEKVFVQNFLPYSELGMVQNANTQLALKLVRESGQLQLGVYAIAPLNHIVVELSADHQPLYETQLTLKPGESWQQTLPENGVGRLTLKVKTAENQPLLDYQEHITQQTPLPEPAIAPALPEAIHNGDELYFIGQHLEQYNHASRYAGDYYRRAVELDPQDYRNNVALGTLAFNSADWALAEQCARAALQRAHRLNKNPRDGEASMLLASVLERMGDDAGAWDHYYKASWSGNCRDAAWWSLARLAMKRGDVADALEKVNTSLRFNASNPLAMGLKALALANSGQKKAALEFIFASLEQYPLSYPLHCARWMIERSDDAREALLRITGRRGVNASLLAGWLLSIGQTSAVKEVLAVLDSQEALPMLWRASLSDDANERQQFIAAAEHCHAHNVRFPNSLDEVQMLQSLGDSAFARYLLGCFWYSKRRYDEAVSCWRETLENLPIMRPLIVCWAFTPGINSRMQRMRWLICSAP

SEQ ID NO: 11712 - protein, 336 aa, Klebsiella pneumoniae
CRSGRGRKLPAVWCYLRCRLPLYPAQRPGNERYHPRSAGRAAGAASYGRECGEAGADALMAEEWILENAHLRMCVSSLGGKVQSLFSRQYQAPVLYENPAGGMFPMLPLANRVAGNRFIFHGQEIILPRHHADEYFFLHGDGWLQRWDIIEYGAEYCVLQLRRQHACGFDYLAQLRYQLLRNQLIAELTLTHYGEVPALYGCGFHPFFPFDERSKVQFQVSGYWPEGENHLPLNWQGNLPDYANFSVAQFGEDRWLNVGYSGWGGRARVSNDVMSITILSQTPWLMLFRMQGESFLCLEPQSHPVNAHNMDGQPGLRVLGAGEKLNFSLKIIIEGA

SEQ ID NO: 11713 - protein, 134 aa, Klebsiella pneumoniae
TLPGRHQMITGIQITKAANDDLLNSFWLLDSEKGEARCLCAKGGFAEDDVVAVSKLGEIEYREIPVDVKPEVRVEGGQHLNVNVLRRETLLDAVEHPEKYPQLTIRVSGYAVRFNSLTPEQQRDVIARTFTESL

SEQ ID NO: 11714 - protein, 159 aa, Klebsiella pneumoniae
PVPGWSKKMKNEVEQIAQQNDMSIEFVTWFFNEKKVGCGNVWFMMMAAMWEGWKGRSIEMDKLAAENVVLKQFPEQIVQFIGGLGTSEIGIDTKEKIGLAAIRIKTPVTDAYLAGIKADGVESGIKTIMTMLNHQAPGVSDAINVLRVHSSELREGADK

SEQ ID NO: 11715 - protein, 114 aa, Klebsiella pneumoniae
RSAGEKAGLSRKWAYNARPVCVVSETFLMALLITKKCINCDMCEPECPNEAISMGDSIYEINSDRCTECVGHYDTPTCQKVCPIPNTILKDPAHVESEEQLWDKFVLMHHADKI

SEQ ID NO: 11716 - protein, 239 aa, Klebsiella pneumoniae
PRRGQGRASAFTQDCWRSSQNFSREEQMNRVKQCTSAAFFMVLSWSAAAHPHSFISLQSEPVVKDGLLSAFKMRWTMDEITSSDLLYDAGNAKPGSEVWKKLAAEVMANVLGQHYFSELWHNGQRVKFDNRPDGYGLERDGLQAVLTFTLPLATPQPIAGQTFTFSTFDPTYYVDMFYDKDSDFSLPAGLRAACKATVMTPKPNDKMLSYAQSLDKADAPPEDMALGSYFAQKVTLTCQ

SEQ ID NO: 11717 - protein, 414 aa, Klebsiella pneumoniae
CLPGRNHMNKDFSQTPRPTFKRALRRISVISVVISMTLVWLLLSTASIFTLKQYAQKNLELTAATMGRSLEAALVFGDSAAAEETLASLGKQGQISQAIVLNGQMQHFAAWRHEPLANKEQVSGLISKWLFPEPTVQPIWHQGKQIGELRLTALDELISHFLGISILVLTGSILLASFIALLLTHSLHRGIVAALQSITEVVHDIRENRHFSRRVPEERIEEFHLFAQDFNSLLGEMEDWQRQLQAKNAQLLRSSLHDPLTGLANRAAFRNALAELMQNEVDHQTSALLFLDGDNFKLINDNWGHAAGDKVLMEVASRLMTFAGKRHLAWRLGGDEFAVLLREVRSEAEVQALCQALTEQFLPPFNLHNGHSATLSLSVGYALAWEHATAESLQELADQNMYRMKNQRIQQTLK

SEQ ID NO: 11718 - protein, 887 aa, Klebsiella pneumoniae
KETGMSQRGLEALLRPKSIAVIGASMKPQRAGYLMMRNLLAGGFNGPVMPVTPAWKAVLGVLAWPTIESLPFTPDLAVLCTNARRNLELLEALGQKGCKTCIILSSQPEQYPALLECAARYQMRLLGPNSLGLLAPWQGLNASFSPVPIHRGKLAFISQSAAVSNTILDWAQQREMGFSYFIALGDSLDIDVDDLLDFLARDSKTSAILLYLEHLSDARRFVSAARSASRNKPILVIKSGRSPAAQKLLHANSGMDPAWGAAIQRAGLLRVQDTHELFSAVETLSHMRPLRGEKLMIVSNGAAPAALALDELWLRNGKLAALSEETRDALRQALPVGVEIANPLDLRDDASSEHYQRAVNVLLNSQDYDALLVIHSPSAAAPGTESALALIDALKHHPRGKYVTVLTNWCGEFSSQEARRLFSDAGLPTYRTPEGTITAFMHMVEYRRNQKQLRETPVLPDSLTANTSEAHALLQQAIEDGATTLDTHEVSPVLRAYGIHTLPTWIAADSAEAVHIAEQIGYPVALKLRSPDIPHKSEVQGVMLYLRTAAEVQQAADAMIDRVKLAWPQARIHGLLVQSMANRAGAQELRVVVEHDPVFGPLIMLGEGGVEWRAEDQAAVALPPLNMNLARYLVIQAIKNKKIRGRSALRPLDIAGLSQLLVQVSNLIVDCPEIQRLDIHPLLASGNEFTALDVTLGLAPFSGDSESRLAIRPYPHQLEEWVVMKNGDRCLFRPILPEDEPQLLAFIAQVTKEDLYYRYFSEINEFSHDDLANMTQIDYDREMAFVAVRTSAEKSEILGVTRAISDPDNIDAEFAVLVRSDLKGLGLGRRLLEKLIAYTQSHGLQRLNGITMPNNRGMIGLARKLGFTVDIQLEDGIVSLSLPLNQG

SEQ ID NO: 11719 - protein, 79 aa, Klebsiella pneumoniae
IRSGGDRSYDRRWHSGRADQPSPDQAYPYGGASDGQTGGDPLPNYGTFPHPYPPASASGNRSYTSDPRAYVAYHPSAGG

SEQ ID NO: 11720 - protein, 90 aa, Klebsiella pneumoniae
GNGGTSSVSVAINKHINFSFNYVRHSNSKPTITSCCVIRVPATDKRTSYTTLFIESCSCCRIVTFKSECNVIANVVKRYIYLICRLTYNT

SEQ ID NO: 11721 - protein, 61 aa, Klebsiella pneumoniae
PAVGWPPVRGRSLSLIHGSIDNYVTGVNARSQRRDGRKDEVCISKVFQVTARRRVRKSPGA

SEQ ID NO: 11722 - protein, 840 aa, Klebsiella pneumoniae
TAAGDVRPCQCEDLLMAYSLVQPSLAGGEISPSLYGRIDLEKYQTSLRRCRNFIVRQSGGIENRPGFRFLGSAKYADRYCRLIPFQFSVSQTYALELGDHYFRVWSNGALVADGGVPVEVATPWPVSVISELKFTQSADVMTVCHNDYPPLEIRRYGEADWRTAAVTTTSGPFQDLNTDDSVTVYASGRTGSVTLTANSSIFKSQHVGKLFYMEQKAVDSVGRWETDKDIGIGDECRYQENFYRCVDGGSNGTTGTVAPTHTTGDSWDGWGLGGRNGVLWRYLHSGFGVCRITAVAGDGLTATADVVPRQDGEIELPAQVVGSTFATYKWAHYAWNDTDGYPGTVTYYQQRLIFGGSRAFPQTIWCSRTGDYHNFYRSNPKVDDDAITYNYAGRQLNKILHLLDVGQLIVLTSGGEFKVTGDSNGNLTGTGGFAMSGQSFNGSSDLAPINVGSVALYVQQKGSIIRDLFYSFDQDSYQSSDLTLLASHLFNGYSIRDWALSVQPFSVAWCARSDGMLLGLTYLREQQVYAWHPHPMTNGYVESICSISEGQEDAVYALIRRTVNGSTVRYVERLNTRQFTEQQDAFFVDSGLSYSGENTDSSRTMTIGSTGGWTYQDEFTLTCSSAIFDSSSTDYEIHIPYTEGGVSKSMRLSIAGVISSTVATVLANRDVPTALRNTAQSTWSIARRIFAGLSHLEGQTVSILADGNVEPQQVVSGGEVTIENHSSVVHIGLPVAAVIETLDVNVAGQSTLLDKTKLINQLCVMLNSGRSVWAGTDDAHLLEYTQREWEFYDDPVGLKTGIIDMNLDANWERNGRVVISHSDPLPLGILAIIPRVTVGG

SEQ ID NO: 11723 - protein, 317 aa, Klebsiella pneumoniae
GGAGCRRTGAEKAGAGMSEEKSYCGFVAIVGRPNVGKSTLLNKLLGQKISITSRKAQTTRHRIVGIHTEGPYQAIYVDTPGLHMEEKRAINRLMNKAASSSIGDVELVIFVVEGTRWTQDDEMVLNKLRDAKAPVILAVNKVDNVQEKADLLPHLQFLASQMNFLDIVPISAETGTNVDTIAAIVRKHLPEAIHHFPEDYITDRSQRFMASEIIREKLMRFLGAELPYSVTVEIERFVSNERGGYDINGLILVEREGQKKMVIGNKGAKIKTIGIEARKDMQEMFEAPVHLELWVKVKSGWADDERALRSLGYVDDL

SEQ ID NO: 11724 - protein, 166 aa, Klebsiella pneumoniae
NNKGLIMIRKYFVPALMAAALLTGCQAPQGKFTPEQVAAMKSYGFTESNGDWSLGLSDSILFDKNDYRLRPDSRQQITTMASRLAATGITHSRLEGHTDNYGEDSYNEALSLKRANSVADAWAEGAHVPRSNLVTRGLGKKYPIASNDTAAGRAENRRVTVVISTP

SEQ ID NO: 11725 - protein, 267 aa, Klebsiella pneumoniae
RLEGFLMSNVFAAIQNRDAGALARMMGPDNHQAQQDNVVNISAERLVDALFKQLKQLFPAAEQTNLKTAQQETDAKRQWIAAFAEGGIRTREQVSAGMRHARASESPFWPSPGQFIKWCKDSKMVLGVSIEDVMGEFHRYAKEKSLQPGGPEQFPWRHPVMYWIVCDTRRAMYQRQLSEIEVEKHARKLLDEWASKVAAGHQIPDPILSIQANPEPINTPPDPGGNTYHPPGRSFGCMPNAATLGGITPAQWLMEEYRRGKAAGLIK

SEQ ID NO: 11726 - protein, 75 aa, Klebsiella pneumoniae
AARGGRQMSNRIPNFGWNRLKLATLTYEQLAQLEEQVKAEHACKNGIHLFDKAGQRKLDALSWAVYNKQKAERAA

SEQ ID NO: 11727 - protein, 78 aa, Klebsiella pneumoniae
TLRGMVMELDCPLCHAPLDVKGSSAHCAQCERVFTLEARCPECHQPLEVLKACGAVDYFCQHGHGLISKKRVEFIPLV

SEQ ID NO: 11728 - protein, 261 aa, Klebsiella pneumoniae
CRGGDLMARIRTIKPEFWTDEDMAEVSEPACLLAIGLLNYADDEGYFNANPKLIKAAVFPIREPSVPIPVLIRELSNCGYLSMFSTPDGKHFGVITNFLKHQVVNKPKESKIKCLPLVPYEYGTDTVQVPLGMDQGSGIREIKTPLSAREVIQVPPVVVDGIGEPIGKFTMHENWKPSEDFVMRARTWGHALPADGYKKSDLIEFITYWMAEGNVMQHVQWEQKFARLLMNRKKRAAGKRGESSDDEVPHWNSPEGWKDFL

SEQ ID NO: 11729 - protein, 216 aa, Klebsiella pneumoniae
DKGGSLQHTERRVVFFDLDGTLHQQDMFGSFLRYLLRHLPLNLLLVVPMGPVILAGLAVSGRAARWPMSLLLWATTFGRREAVLKRLEAEFVGWFRHHVTAFPVVHARLTAYLTSTDADVWLITGSPQSLVEQVYRDTLWLPRVNLIASRTARRWGGWVLTLRCLGHEKVVQLEKKIGAPLRLYSGYSDSEQDNPLLGFCQHRWRVTPQGELQQLE

SEQ ID NO: 11730 - protein, 204 aa, Klebsiella pneumoniae
RRMGIGFGETLPRMSEQLTDQVLVERVQKGDQKAFNLLVVRYQHKVASLVSRYVPPGDIADVVQESFVKAWRALDSFRGDSAFYTWLYRIAVNTAKNYLVAQGRRPPSSDVDANEAENFESGGALKEISNPENLMLSEELRQIVFRTIESLPEDLRMAITLRELDGLSYEEIAAIMDCPVGTVRSRIFRAREAIDNKVQPLIRR

SEQ ID NO: 11731 - protein, 501 aa, Klebsiella pneumoniae
TSMGGLGPPEPYCSLRFPYRGIIMNNAQTHLKMGYVWTICLVAACGGLLFGYDWVVIGGAKPFYEAWFSITDPAQSGWAMSSALLGCIFGALISGWCADKLGRKLPLILSAVLFSASAWGTAVASHFDMFVVYRIVGGVGIGLASALSPLYIAEVSPAEKRGRFVAVNQLTIVIGVLAAQLINLMIAEPVEPGATQQMIVDSWNGQMGWRWMFGAELVPALAFLVLMFFVPESPRWLMKAGKPERARAALERIGSADYADRILREIAHTLEKDNNKVSYGALLAPQVKPIVIIGMVLAIFQQWCGINVIFNYAQEIFASAGFDINSTLKSIVATGVVNLVFTIAALPLVDKIGRRKLMLLGASGLTLIYVLIAGAYAMGIMGWPVLLLVLAAIAIYALTLAPVTWVLLAEIFPNRVRGLAMSLGTLALWIACFLLTYTFPLLNAGLGAAGSFLLYGVICAAGYLYILRNVPETKGITLEALEEQLAQRHTGVNAAKQEQMR

SEQ ID NO: 11732 - protein, 174 aa, Klebsiella pneumoniae
VVVGLALDNSGTDCIHRQLYTTGWIYRGNDWGHGRMALGVVAGWSTFLWWSNLCYRLWGYVFIIRMAIIQKESVTCHSNKQAAFAALIITDRRGGSQQNGRHSVSHQLQYHQDAGSYQRKPVRKNPETTEQTALRMLFSFSLTMCRPLNRGFMIVALCSDFIHQKARYAGFLTK

SEQ ID NO: 11733 - protein, 148 aa, Klebsiella pneumoniae
LLTGLAIRHCTQQVLSFLLHVLHDDIALPERSLSLLRYQTIVRIVELVITELIKLQQSILTKRDISLALCISHHIDRRISSLLDALHQRIFRHTKITRHHRRGLRLALALILRNGWHSQLLLLSGKRLPGTAQRLVCIKTGQRGVEQC

SEQ ID NO: 11734 - protein, 180 aa, Klebsiella pneumoniae
AGRGGYRVDKVNLRSGLPNSSLFSRGAVPDRPAANALPVTYSNVEPSDFVQTFSRSNGGEASSGFWQLPKGETKADGIRLTERQETLGDVTHRILMVPIAQDQVGMYYHQSGLPLATWIVPPGQYFMMGDNRDNSADSRYWGFVPEANLVGKATAIWMSFEKQEGEWPTGVRLSRIGGIH

SEQ ID NO: 11735 - protein, 73 aa, Klebsiella pneumoniae
DFFIKSSEFDENLAHSSNGKVLFMSVFGKLPVINAIESLSDLKPTFLKSAQALCITSANTEFDEPLIVISCLI

SEQ ID NO: 11736 - protein, 203 aa, Klebsiella pneumoniae
KVIIFGVFTMPKDPKRKSTQYKPLTVMQEAYAQEYVKCPENQTQAAINAGFSPKSAHVKASTMMRDERIQKRIAELMEERNKRLRVSADYVLLRLVEIDQMDVLDILNDDGSLKPIREWPKIWRTTLSGFDLSSTIMNMDETSIETILKKIKWPDKVKNLELIGKHVDVNAFKERMEVNVNVTIADRIAAARRRLKERQGGDQ

SEQ ID NO: 11737 - protein, 110 aa, Klebsiella pneumoniae
GFVMSITLSDSAAARVNAFLANRGKGFGLRLGVRTSGCSGMAYVLEFVDEPAAEDTVFEDKGVKVVIDGKSLQFLDGTQLDFVKEGLNEGFKFTNPNVKDECGCGESFNV

SEQ ID NO: 11738 - protein, 99 aa, Klebsiella pneumoniae
YMYIYTVFMGVFLMPERYQYPVDEGFSDRIHTPEGVRSLVVKSQLMELLREMERDGHDVSGAAAELVALVNYVTSSQLSMRELQTHLDFCAMQLRQQLR

SEQ ID NO: 11739 - protein, 659 aa, Klebsiella pneumoniae
GDDISANSIQGHKMHHLNDFPKRDRNHRIERLAISAFENFLRDSNDFFIQSQDINDYGVDYQLEITTNGQATNIRLFVQLKGTEQELNNDGSVSISVNRANLNYLLMHPYSFYVCFHAPSNSLKITFAESVIRSYEQSEKQWIEQETLTVRFIENISDSRLHEIAELARFNAMNDRNARIELITNHISNVSNVINKAIPKIHIPEDKKLAYELLNSLYENNHDDVISANFYEFLAIFGPDHPAMIIPYMSEINKAMDRVNGNEARVLNGIQYLRDRLEEGNITKGSLYYSIGNGFTALDRDKEAIQEYKTALEHIIEADKLAAQCYKNMGSSYSRLGNENEAYECYKKALELEPNLSEANLALGVIHNRRGNYELSLEYLDRVLFPGNYQHKIIYVDKWRINTLFNIGDYRSAYREINNLLTRNDNKEDLWKWCLMLVASFCRTSTASAKLSLPFWARFLEFYPNHPDASREILLAKNYLRVNDNLTKYSYHDFKKEFELRINNVSNEDSAFLWDRIGHWAQDEDEWEDAEMHFRKAYEIAGGEYGYCLGVALNHLGRFQESLPILVEQAEKIQPDDFSWFQVAVAYEFQGYIQEAIDSYEKCLSINNKNELALFNLGGLYWNSRNYDEASRVWKLAVAYYPEHELSHKLRKDIPFILN

SEQ ID NO: 11740 - protein, 105 aa, Klebsiella pneumoniae
GDDMRKVEIVPVTEEQIAAMLPHVRQADRDEFMAAAGMTPAEVITRAMKSASVAAAGMINGQVVTIFGISPASIITGRGIPWLVSTDHIEHQPLTFLRHCRPVSS

SEQ ID NO: 11741 - protein, 184 aa, Klebsiella pneumoniae
RPCIMRPAFSAGVAAVSDLELNDEYWMRHALTLAKRAWEEGEVPVGAVLVHNNQVIGEGWNRPIGRHDPTAHAEIMALRQGGLVLQNYRLIDATLYVTLEPCVMCAGAMVHSRIARLVFGARDAKTGAAGSLMDVLHHPGMNHRVAISEGVLAESCSAMLSDFFRWRREEKKALKKARAQTGES

SEQ ID NO: 11742 - protein, 129 aa, Klebsiella pneumoniae
LGRIQQAEGGACRMTTDITELAQRMKAAAVRAKTATEEYASGHMSISVCYAECEEFNRLTDGPDNIIALVEALEKAQQRIAELESRTVKLPDLRQIVSGDRYVWSDGVYNYSQDVKVALAAAGIKVEAE

SEQ ID NO: 11743 - protein, 376 aa, Klebsiella pneumoniae
EESMVAELTALRDQIDEVDKALLSLLAKRLELVAEVGEVKSQYGLPIYVPERESAMLASRREEAAALGVPPDLIEDVLRRVMRESYSSENDKGFKTLQPNLRPVVIVGGGGQMGRLFEKMLTLSGYQVRILEKNDWARAADIVADAGMVIVSVPIHTTVETIGRLPPLPADCILVDLASVKAEPLQAMLAAHQGPVLGLHPMFGPDSGSLAKQVVVYCDGRQPEAYQWFLEQIQVWGARLHRISAVEHDQNMAFIQALRHFATFAYGLHLAEENVRLEQLLALSSPIYRLELAMVGRLFAHDPQLYADIIMSSENNLALIKRYYQRFGEAIGLLEQGDKQAFIDSFRKVEHWFGDYAQRFQSESRTLLRQANDNRQ

SEQ ID NO: 11744 - protein, 132 aa, Klebsiella pneumoniae
GEFIMAYSEKVIDHYENPRNVGSFDNSDENVGSGMVGAPACGDVMKLQIKVNNEGIIEDARFKTYGCGSAIASSSLVTEWVKGKSLDEAQAIKNTDIADELELPPVKIHCSILAEDAIKAAIADYKSKREAK

SEQ ID NO: 11745 - protein, 338 aa, Klebsiella pneumoniae
GVIMALIGQTLPSLLDVYSRTDKNGRIAKIVEQLAKSNDVITDAIYVPCNDGSKHKTTIRAGIPEPVWRRYNQGVQPTKTQTVPVTDTTGMLYDLGFVDKDLADRSGNADSFRVSENMGKLQGFNNKVSRYTFYGNTDAEPEAFMGLAPRFNTLSTSKAASAENVFSAGGAGSTNTSIWFMSWGENTAHMIYPEGMVAGFQHQDLGNDLVSDANGGQFLAYRDEFKWHLGLSVRDWRSISRICNIDVTTLTKDAATGADLISMMVDAYYARDVAMLGDGKEVIYCNKTIHAWLHKQAMNAKNVNLTIDEYAGKKIVSFLGIPIRRADAILNTESAVTA

SEQ ID NO: 11746 - protein, 74 aa, Klebsiella pneumoniae
GAIMKTRADSNDAFPESGNVRMRQVVQFLAMSESSVYRLIKNTDFPRPVHLSSRLVVFDAAEIRQWQQRRTAIR

SEQ ID NO: 11747 - protein, 133 aa, Klebsiella pneumoniae
GGIMLLDQQALFSAAQAITATAASTNVIDTGSNKDVGKYGDIPLLIQVVEGFNNLTSLTVTVQTDDNSAFSSAADVLSMTIPLASLVLGYKSPVITLPMKMERYIRLNYTVTGTAPTTGKVTAGITGGVQTNA

SEQ ID NO: 11748 - protein, 138 aa, Klebsiella pneumoniae
TVVIMSASLTADTINQGLSYGALAAVIAGVPPEVALGSLAGAVIFVTSAVEYPVKRRVLLALLSFLCGLLFYKPTASILIGVASMIPTITQDSFERGIVYSAGAFVAAIVAVRVGIWLYHRSDNPSDLIPGGKDDDRP

SEQ ID NO: 11749 - protein, 330 aa, Klebsiella pneumoniae
GENMSTNALKAAATGNQVAQHSDKPTTLAGLLADPKIKAQMALALPKHMTADRLARIATTEIRKIPKLAACDQASFLGAIMQCAQLGLEPGGALGHAYLIPFDKRQKVNGRWETVSTEAQLIIGYRGMIDLARRSGQILSISARTVHANDKFSYSYGLEETLEHSPCETGDRGELTHVYAVARLKDGGVQFEVMSRADVEKVRAMSKAGSSGPWVDHFDEMAKKTVIRRLCKYLPVSIELQKAVVMDERAEAGLSQDNAAVITGEYSVVDDEQQSMTAVSESVREEAREYASAILNSLDPSVDDAKALFKRAEDEINALAEKVRGTREKF

SEQ ID NO: 11750 - protein, 164 aa, Klebsiella pneumoniae
LQDIMTKKKAHKPGSATIALNKRARHEYFIEDEYEAGLALQGWEVKSLRAGKANIGDSYVILKDGEAFLFGANFTPMAVASTHYVCDPTRTRKLLLNQRELDTLYGRINREGYTVVALSLYWKNAWCKVKIGVAKGKKQHDKRTDLKDREWALDKARIMKHAGR

SEQ ID NO: 11751 - protein, 298 aa, Klebsiella pneumoniae
RKDIQIMKNHFKCIGIVGHPRHPTALTTHEMLWRWLCSKGYEVLVEQQIAHELQLSNVKTGTLAEIGQQADLAVVVGGDGNMLGAARTLARYDINVIGINRGNLGFLTDLDPDNALQQLADVLEGHYIAEKRFLLEAQVCQQDCQKRISTAINEVVLHPGKVAHMIEFEVYIDEVFAFSQRSDGLIISTPTGSTAYSLSAGGPILTPSLDAITLVPMFPHTLSARPLVINGDSTIRLRFSHRCSDLEISCDSQIALPIQDGEDVLIRRCDYHLNLIHPKDYSYFNTLSTKLGWSKKLF

SEQ ID NO: 11752 - protein, 352 aa, Klebsiella pneumoniae
TVRIRCRSANRRCAFFRSWSQSAAIARGSSPASANRWSICISRPLTPRLSVWGSAVSWLPMVCAALPERREQVISPVKSWSLRWRTRKKTRSKRPITAATTWNKGGRSCSGGETTLMPPDGRRCSVQKNRCGSWKENNVTSPIRQNLFERECDMPLLEARHLALLLLGLDASQPANALPEEHQENYRILHDAISRTIKATGMVSAPANKRMFYADEMFALAWRFIDDELTPPEIKARSLKAVMKLSCNSRGRKWLKTLGDDALPDLTASAQPSQRGMHKRDKARENTARLCWLLVQLLVEETDGRYGTSDKPASDRILRKLKTLLQERELPSDGLGRGTFYEVLKMGREKGT

SEQ ID NO: 11753 - protein, 417 aa, Klebsiella pneumoniae
RLRIYREAGADIQHFTFHALNDRVVIDIVQHVTHPASQLFDFRFFKAAASHCRRTDTDTGGYERALRIVRHAVFVDGDVGAAQSGVSFFTGQVFIHQIQQEQVVLSTARHHFVAAVQEHFHHRFSVFRNLLLVNFKLWLHRFFQRHRFRRDNVHQRAALRAWEYRRVQFFVQLFATAFRQNQAAARTRQGFVGGGGHNVSMRNRVRVHASGNQACHVRHIDEQVSADAVSDFTHFRPVNDTGVSGETTDDHLRFVFLSLLRHVVIVNFTGLIDTVRDDIVQFAGEVNRGAVSQVAALRQVHTEHGVARLQQRGVDGKVSLGAGVRLDVSIVSAEQFFRAVDCQLFNHVDVFTAAVVTLARIPFSIFVGQLRALRLHNARTGVVFGGDQFDVLFLTYFFLLHSLPQFGIIIGNVHFTL

SEQ ID NO: 11754 - protein, 148 aa, Klebsiella pneumoniae
GVGMANMFALILVIATLVTGVLWCLDKFIFAPKRRERQAAAQAATGEQLDKKTLKKVGPKPGWLETGASVFPVLAIVMVVRSFIYEPFQIPSGSMMPTLLIGDFILVEKFAYGIKDPIYQKTLIETGHPKRGDIVVFKYPGRPGSGKH

SEQ ID NO: 11755 - protein, 873 aa, Klebsiella pneumoniae
PHLISSSKFDLFMGGVMRLDRLTNKFQLALADAQSLALGHDNQFIEPLHLMSALLNQEGGSVRPLLTSAGVNAGKLRTDIEQALSRLPQVEGTGGDVQPSQDLVRILNLCDKLAQKKKDNFISSELFVLAALESRGTLTDLLKSAGATTANVTQAIEQMRGGESVNDQGAEDQRQALKKFTVDLTERAEQGKLDPVIGRDEEIRRTIQVLQRRTKNNPVLIGEPGVGKTAIVEGLAQRIVNGEVPEGLKGRRVLALDMGALVAGAKYRGEFEERLKGVLTDLSKQEGNVILFIDELHTMVGAGKADGAMDAGNMLKPALARGELHCVGATTLDEYRQYIEKDAALERRFQKVFVAEPSVEDTIAILRGLKERYELHHHVQITDPAIVAAATLSHRYIADRQLPDKAIDLIDEAASSIRMQIDSKPEELDRLDRRIIQLKLEQQALKKESDEASLKRLDMLNEELADKERQYSVLEEEWKAEKASLSGTQTIKAELEQAKIAIEQARRVGDLARMSELQYGKIPELEKQLAAATQSEGKTMRLLRNKVTDAEIAEVLARWTGIPVSRMMESERDKLLRMEQELHHRVIGQDEAVEAVSNAIRRSRAGLSDPNRPIGSFLFLGPTGVGKTELCKTLANFMFDSDDAMVRIDMSEFMEKHSVSRLVGAPPGYVGYEEGGYLTEAVRRRPYSVILLDEVEKAHPDVFNILLQVLDDGRLTDGQGRTVDFRNTVVIMTSNLGSDLIQERFGELDYGHMKDLVLGVVSQNFRPEFINRIDEVVVFHPLGEKHIASIAQIQLQRLYKRLEERGYEVQMSDEALKLLSANGYDPVYGARPLKRAIQQQIENPLAQQILSGELVPGKTIELVVKDDRIVAVQ

SEQ ID NO: 11756 - protein, 147 aa, Klebsiella pneumoniae
LEVIMAIERTFSIIKPNAVAKNVIGSIFSRFEAAGFKIVGTKMLHLTVEQARGFYAEHEGRPFFDGLVEFMTSGPIVVSVLEGENAVQRHRDLLGATNPANALAGTLRADYADSFTENGTHGSDSVESAAREIAFFFAEGEVCPRTR

SEQ ID NO: 11757 - protein, 542 aa, Klebsiella pneumoniae
TKTMNITPDFSCDVLIIGSGAAGLSLALRLAEHSSVTVLSKGPISEGSTFYAQGGIAAVFDETDSIESHVEDTLIAGAGLCDRHAVTFVASNARSCVQWLIDQGVLFDTQVQANGEESYHLTREGGHSHRRILHAADATGKAVETTLVDKALAHPNIRILERSNAVDLIVSDKIGLPGTRRVVGAWIWNRNKERVETCSAKAVVLATGGAAKVYQYTTNPDVSSGDGIAMAWRAGCRVANLEFNQFHPTALYHPQARNFLLTEALRGEGAHLKRPDGTRFMPDFDERGELAPRDIVARAIDHEMKRLGVDCMFLDISHKPEAFVRQHFPMIYEKLLGLGIDLTKDPVPVVPAAHYTCGGVMVDDNGRTDVDGLYAIGEVSYTGLHGANRMASNSLLECLVYGWSAAEDITRRLPLAQKVATLPAWDESQVEIPDELVDIQHNWHELRLLMWDYVGIVRTTRRLERALRRITMLQQELDEYYARFRVSNNLLELRNLVQVAELIVRCAMLRKESRGLHYTLDYPQPLPDSGPSILSPLAHIKR

SEQ ID NO: 11758 - protein, 80 aa, Klebsiella pneumoniae
SVKINIKSVASSGSVNISNYDTFIRLSRNTGLIFNIKVSTHKRVCARCSFCRITMYKYTITATAYGSFYPTLLSITSIVI

SEQ ID NO: 11759 - protein, 255 aa, Klebsiella pneumoniae
HARIIFSRRTIMLQNIRIVLVETSHTGNMGSVARAMKTMGLTNLWLVNPLVKPDSQAIALAAGASDVIGNAQIVDTLDEALAGCSLVVGTSARSRTLRWRMLDPRECGLKSVAEGQHAPVALVFGRERVVLTNDELQKCHYHVAIAANPEYSSLNLAMAVQVIAYEVRMAWLAAQEQAQPAVEHEEAPYPLVDDLERFYDHLEQTLLATGFIRPNHPGQVMNKLRRLFTRARPESQELNILRGMLASIEQQNKGK

SEQ ID NO: 11760 - protein, 60 aa, Klebsiella pneumoniae; identical to SEQ ID NO: 8602

SEQ ID NO: 11761 - protein, 70 aa, Klebsiella pneumoniae
RQSMRLLTLTPSSPLKVLYNPKAFFTHAAWLHQACAHCAIFPTAASRRSLDRVSVPVWLVILSDQLGIVA

SEQ ID NO: 11762 - protein, 270 aa, Klebsiella pneumoniae
ERPMHPMLNIAVRAARKAGNLIAKHYETPDTVETSQKGSNDFVTNVDKAAEAIIIETIRKSYPQHTIITEESGEHAGEEQDVQWVIDPLDGTTNFVKRLPHFSVSIAVRIKGRTEVAVVYDPMRNELFTATRGQGAQLNGYRLRGSNARDLDGTIIATGFPFKAKQHATTYMNILGNMFTECADFRRTGSAALDLAYVAAGRVDGYFEIALKPWDFAAGELIAREAGAIVCDFTGGHNYMLTGNIVAGNPRVVKAMLANMREQLSDALKR

SEQ ID NO: 11763 - protein, 446 aa, Klebsiella pneumoniae
SMTIRKPARLLLVDDDPGLLKLLGMRLVSEGYSVVTAESGPEALRVLGREKVDLVISDLRMDEMDGLQLFSEIQKGHPGMPVIILTAHGSIPDAVAATQQGVFSFLTKPVDKDALYKAIDEALEQRSPATDEAWRQAIVTRSPLMLRLLEQAGMVAQSDVSVLINGQSGTGKEIVAQAIHNASPRHDKPFVAINCGALPEQLLESELFGHARGAFTGAVSNREGLFQAAEGGTLFLDEIGDMPVALQVKLLRVLQERKVRPLGSNRDIEINVRIISATHRDLPKAMARGEFREDLFYRLNVVNLKIPPLSERTEDIPLLANHLLRQSADRHKPFVRAFSSDAMKRLMAAKWPGNVRQLVNVIEQCVALTSSPVIGDALVEQALEGENTALPTFVEARNQFELNYLRKLLQITKGNVTHAARMAGRNRTEFYKLLSRHELDANDFKE

SEQ ID NO: 11764 - protein, 240 aa, Klebsiella pneumoniae
AIAMTLLQESKMTTPLTWHDVLADEKQQPYFLNTLKTVAEERQSGITIYPPQKDVFNAFRFTELGDVKVVILGQDPYHGPGQAHGLAFSVRPGVAIPPSLLNMYKELEATIPGFTRPTHGYLESWARQGVLLLNTVLTVRAGQAHSHASLGWETFTDKVIALINEHCEGVVFLLWGSHAQKKGAIIDRQRHCVLKAPHPSPLSAHRGFFGCNHFVQTNQWLVDRGETPIDWMPVLPAESE

SEQ ID NO: 11765 - protein, 117 aa, Klebsiella pneumoniae
VLKMGLAKKGIILVCLIGWIVAVIGKRLKISRVNAGLTQTELGVRAGLEEDSASARISSYEKEVHAPDFKLVCKFAAVLDVPEAYFYTVDEDLSELILQYHRYKKSNPNSTIIISFQ

SEQ ID NO: 11766 - protein, 118 aa, Klebsiella pneumoniae
FAEMSMSKIVALNADEEQGKKPSIRQRRLLTRAGLRKARRMTHLDALAEKLGYQIVRGTYVAFRHTVTVESIRKLPHAEVNLVPRVKKMTFTEACNISRELSDSREERLMSASFDGPE

SEQ ID NO: 11767 - protein, 248 aa, Klebsiella pneumoniae
LTRIVMAELLLGVNIDHIATLRNARGTAYPDPVQAAFIAEQAGADGITVHLREDRRHITDRDVRILRQTLHTRMNLEMAVTEEMLTIACETKPHFCCLVPEKRQEVTTEGGLDVAGQRDKMRDACQRLADAGILVSLFIDADEAQIKAAADVGAPYIEIHTGCYADAKTDAEQARELERIAKAATYAASLGLKVNAGHGLTYHNVKAIAALPEMHELNIGHAIIGRAVMSGLKEAVAEMKRLMLEARG

SEQ ID NO: 11768 - protein, 383 aa, Klebsiella pneumoniae
ILYFVWYRYVMPSEATLIANELHRIAIMQKDALNNVHITDEHVLMTPEQLKAEFPLSVEQEAQIAHARQTISDIIAGRDPRLLVVCGPCSIHDPEAAIEYARRFKALAAEVSDSLYLVMRVYFEKPRTTVGWKGLINDPHMDGSFDVEGGLKIARRLLVELVNMGLPLATEALDPNSPQYLGDLFSWSAIGARTTESQTHREMASGLSMPVGFKNGTDGSLATAINAMRAAAMPHRFVGINQAGQVCLLQTQGNPNGHVILRGGKAPNYGPEDVAKCEKEMAQAGLKPSLMVDCSHGNSNKDFRRQPAVAESVVAQIKDGNRSIIGLMIESNIHEGNQSSEQPREAMKYGVSVTDACISWETTEALLRELDKDLRGHLAARLV

SEQ ID NO: 11769 - protein, 90 aa, Klebsiella pneumoniae
VCTVETQQQAFLQPHHPQSEIKSAYDNAKRALSGGLVKIKEQTNKEARKASGGGRSPQGRARGLQGKGRTMATPLAANRLSCAAERHTDG

SEQ ID NO: 11770 - protein, 442 aa, Klebsiella pneumoniae
NMTVTTFSELELDENLLEALQDKGFTRPTAIQAAAIPPALDGRDILGSAPTGTGKTAAYLLPALQHLLDFPRKKSGPPRILILTPTRELAMQVADHARELAKHTHLDIATITGGVAYMNHAEVFSENQDIVVATTGRLLQYIKEENFDCRAVETLILDEADRMLDMGFAQDIETIAGETRWRKQTMLFSATLEGDAIKDFAERLLEEPVEVSANPSTRERKKIHQWYYRADDIEHKTKLLVNLLQQPEATRAIVFERKRERVHELANWLREAGINTCWLEGEMVQAKRNEAIKRLTDGRVNVLIATDVAARGIDIPDVSHVFNFDMPRTADTYLHRIGRTGRAGKKGTAISVVEAHDHLLLGKIGRYIEEPLKARVIDELRPTTRAPSEKLTGKPSKKVLAKRAQKKKDEKEKPRVKKRHRDTKNIGKRRKPSAAGTPSSDE

SEQ ID NO: 11771 - protein, 80 aa, Klebsiella pneumoniae
CGNVRFCVIAIAGRRPTINDLANCVVTLPLVRKQVFTQRTNTMLRGHEFRKTPITTRLAIPRIGTGFDIPWIIIPQPSGG

SEQ ID NO: 11772 - protein, 156 aa, Klebsiella pneumoniae; identical to SEQ ID NO: 8616

SEQ ID NO: 11773 - protein, 202 aa, Klebsiella pneumoniae
QEGVSMSGKYTLIYADPPWAYRDKAADGDRGAGFKYPVMNVLDICRLPVWELAAEDCLLAMWWVPTQPVEALKVMEAWGFRLMTMKGFTWHKTNKHKGNSAIGMGHMTRANSEDCLFAVRGKLPARIDASICQHVTAPRLENSRKPDVIREKLVQLLGDVPRIELFARQSSHGFDVWGNQCTAPAVELLPGCAVPVVKTEAA

SEQ ID NO: 11774 - protein, 373 aa, Klebsiella pneumoniae
SARFAQRRWRKLMSDELKNKSGKVKVMYVRSDDDSDKRTHNPRTGKGGGRPGKSRVDGRSRPARDERNSRGDDRKRDDRKRDERKRDDFHRDDASPWRTVSRAPGDETPVKEDHGGISGKSFIDPEVLRRQRAEETRVYGENACQALFQSRPEAIVRAWFIQSVTPRFKEALRWMAANRKAYHVVDETDLAKAFGTEHHGGVCFLIKKRHGTSVAQWVAKAGEEDCVLALEDVGNPHNLGAIMRSCAHFGVKGVVVQDAGVLESGAAIRTAEGGAEHVEPITGDSFIDTLDQFRKAGYAIVSTSSHNGTPLFKAELPKKMVLALGQERDGLSDAAISSADLSVAIEGTGNVESLNVSVATGVLLAEWWRQNKA

SEQ ID NO: 11775 - protein, 346 aa, Klebsiella pneumoniae
AASVWPGPDSAGRSPGTGLSNFRNTIAVMKQLWCAMSLMAGSLLFSVNASADTSSGALLQQMNLASQSLNYELSFVSISKQGVESLRYRHARLNNQPLAQLLQLDGPRREVVLRGTEISYFEPGLDPFTLNGDYIVDSLPSLVYSDFKRLSAAYDFISVGRTRIADRLCDVIRVVARDGTRYSFIAWLDAETKLPLRVDLLDRDGETLEQFRVVSFNVGDNVSASMETLAKANLPPQLSVPEGGDKANFNWAPTWLPQGVTEVSSSQRRLPTFDGPVESRLYSDGLFSFSININRATAASSDQLLRTGRRTVSTTVRDNAEITVVGELPPQTAKRISDSIKFKAVQ

SEQ ID NO: 11776 - protein, 96 aa, Klebsiella pneumoniae
WTQVQDISTYKCICKQHFALFSKTRGGLMHDLICTSVTGIASSYFVVGETYSADEEWRLTTPNPDGSLALWTVEGNMIYGIVGDHDSEVLAKFEGL

SEQ ID NO: 11777 - protein, 373 aa, Klebsiella pneumoniae
GERVGSGFAVSGVNYSGSTLALKYLTMRQRPELSALKTKGLNMVTTVVAAFNEFMKDTVNLRKADTDDARASRDWLIGKINDFEKDNAFPVSYPAIHIAFGSFARRTKIRPLDDIDLMFGLSAQGATYNILSDRITLTSSGEGSRLHGYRHSGADTICSVRILNAFKSHLQDIAQYAQADIRRNQEAVTLKLISKDWNFDIVPCFMTSEDVFGRTNYLIPDGNGHWKFTDPRKDRDRVTTINVQNDGNVLNVIRAVKYWQRRPTMPSMSSYLLETLILDYYASRTSCSSFVDIELEALFRHLGLFVQFSVNDPKGIQGDINSLSAEARQAISDRCYLDAQKASEARWFEKGKEYEKSINKWRDLFGPFFPIYG

SEQ ID NO: 11778 - protein, 510 aa, Klebsiella pneumoniae
MQSVTLCIMPRQYLSTLVEILPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGESREVVFAKMHEKRVEKALVVDESFHLRGMITVKDFQKAERKPNACKDEQGRLRVGAAVGAGAGNEERVDALVAAGVDVLLIDSSHGHSEGVLQRIRETRAKYPDLQIIGGNVATGAGARALAEAGCSAVKVGIGPGSICTTRIVTGVGVPQITAVSDAVEALEGTGIPVIADGGIRFSGDIAKAIAAGAAAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDLLRTKAEFVRISGAGIQESHVHDVTITKESPNYRLGS

SEQ ID NO: 11779 - protein, 188 aa, Klebsiella pneumoniae
SVTVVMMSKQHTAQAPVDPIVLGKMGSSYGIRGWLRVFSSTEDAESIFDYQPWLIQKAGQWQVVELESWRHHNQDIIIKLKGVDDRDAANLLTNCEIIVDSSQLPELEEGDYYWKDLMGCQVVTTEGYSLGKVIDMMETGSNDVLVIKANLKDAFGIKERLVPFLDGQVIKKVDLTTRTIEVDWDPGF

SEQ ID NO: 11780 - protein, 92 aa, Klebsiella pneumoniae
HKKVNEPLVNIMHELCQLSKHFINILIYMTLTARTVELPLFIFHPRCRYLATPNRLPITHHLNQWLKCRLLTTLQYRSCRQFPTPWRADHHR

SEQ ID NO: 11781 - protein, 66 aa, Klebsiella pneumoniae
GKEVIQPQVPLRLPCYDFTPVMNHKVVSALPKVKLPTSFATHSHGVTGGVYKARERIHRSILIYDY

SEQ ID NO: 11782 - protein, 158 aa, Klebsiella pneumoniae
MILFALCLNVEPAMPQISRTALVPFSAEQMYQLVNDVKSYPDFLPGCTGSRVLELGPTQMTAAVDVSKAGISKTFTTRNTLTSNQSILMSLVDGPFKKLIGGWKFIPLSPEACKIEFHLDFEFTNKLIEMAFGRIFKELAANMVQAFTSRAKEVYSAG

SEQ ID NO: 11783 - protein, 774 aa, Klebsiella pneumoniae
MRVLPRVKRRWRWLAAFIFLLWLAVLAADRLWPLPLHDVTPARVVVAEDGTPLWRFADAQGVWRYPVTLADVSPRYLQALIQYEDRWFWRHPGVNPFAVLRAAWQDLTSGRVISGGSTLTMQVARLLDPHPRTFGGKLRQLWRALQLEWHLSKSDILTLYLNRAPFGGTLQGIGAASWAYLGKPPASLSYGEAALLAVLPQAPSRLRPDRWPQRAQAARDKVLTRMVSQGVWPEQAVKEAMEEPVWLFPRQMPQLAPLFSRRALATSRDEKVVTTLDAGLQRQLEDLALNWKSRLPPRSSLAMIVVDHTDMKVRGWVGSADITDDSRFGHIDMVSAVRSPGSVLKPFIYAMAMDEGLIHPASLLQDVPRRFSDYRPGNFDSGFHGPVSASEALVRSLNLPAVQVLEAYGPKRFAANLRNAGLPLTLPAGAEPNLSLILGGAGARLEDIVAAYSAFARHGKAARLRLKPSDPLTERALMSPGAAWIVRRILAGEAQPVPDASLPQAVPLAWKTGTSYGYRDAWAVGLNARYLIGIWTGRPDGTPVVGQFGFASAVPLLNQVNNLLLARPAMSRGGLPSDPRPATVSQGTICWPGGQDLPAGDRNCRRRLASWLLDASQPPTLLLPGQESVRGIRFPVWRNEHGERVAADCPGARESQVEVWPLPLDPWLPASERRRARLGPASESCPPLQTQDTAPLVLSGIRDGAVIKRLPGEARVMLPLQTSGGEGRCWWFINGEPLEAAGARTTLTLDKPGEWQLVVMDEAGQTAAASFTLQ

SEQ ID NO: 11784 - protein, 165 aa, Klebsiella pneumoniae
CKSFTIRPLYGGAVVSNSFQQTTPKRRAAWLALLAILLIVVAPLISVSLQKDPMSAMPGMHHAMMRDSSSANMAQMPGHKMAMMHSIDGATHTGHEMPLDHAEACGYCVLLAHVPGLLFALALFVAMLLRRIRLPVSRPVLKHWHYFPWLYPETRAPPRLSAFSL

SEQ ID NO: 11785 - protein, 436 aa, Klebsiella pneumoniae
AKSFKESYVEHISTTTLIITLIVMVIISAYFSGSETGMMTLNRYRLRHMAKQGNRPAKRVEKLLRKPDRLISLVLIGNNLVNILASALGTIVGMRLYGDAGVAIATGVLTFVVLVFAEVLPKTIAALYPEKVAYPSSFLLAPLQVLMMPLVWLLNTITRILMRMMGIRTDTVISSALSKDELRTIVNESRSQISRRNQDMLLSVLDLEKVSVNDIMVPRNEIVGIDINDDWKSIVRQLTHSPHGRIVLYRDSLDDAISMLRVREAYRLMTEKKEFTKEIMLRAADEIYFVPEGTPLSTQLVKFQRNKKKVGLVVDEYGDIQGLVTVEDILEEIVGDFTTSMSPTLAEEVTPLNDGTVIIDGSANVREINKAFNWHLPEDEARTVNGIILEALEEIPVPGTRVRIEQYDIDILDVQDNMIKQVKVMPVKSLRESVAE

SEQ ID NO: 11786 - protein, 416 aa, Klebsiella pneumoniae
FLALSDVRSLRAMKLPIYLDYSATTPVDPRVAEKMMQFLTMDGTFGNPASRSHRFGWQAEEAVDIARNQIAELVGADPREIVFTSGATESDNLAIKGAANFYQKKGKHIITSKTEHKAVLDTCRQLEREGFEVTYLAPQSNGIIDLKELEAAMRDDTILVSIMHVNNEIGVVQDIATIGEMCRARGIIYHVDATQSVGKLPIDLSQLKVDLMSFSGHKIYGPKGIGALYVRRKPRIRIEAQIHGGGHERGMRSGTLPVHQIVGMGEAYRIAKEEMESEMARLRTLRNRLWNGVKDMEEVYLNGDLEQGAPNILNVSFNYVEGESLIMALKDLAVSSGSACTSASLEPSYVLRALGMTDELAHSSIRFSLGRFTTEEEIDYAIDLIRKSIGRLRELSPLWEMFKQGVDLNSIEWSHH

SEQ ID NO: 11787 - protein, 123 aa, Klebsiella pneumoniae
SSISPGDSSVPASMEPTITAAAPAAIALAISPEKRIPPSAITGIPVPSSASTASETAVICGTPTPVTIRVVQMEPGPMPTFTALQPASASARAPAPVATLPPMICRSGYFARVSRIRCRTPSE

SEQ ID NO: 11788 - protein, 70 aa, Klebsiella pneumoniae; identical to SEQ ID NO: 9056

SEQ ID NO: 11789 - protein, 275 aa, Klebsiella pneumoniae
RTYSMVGWAGVRKDAGIRLGRYANSVQFTTSNWRCGGDNSTKRGITMNTKPSIFNFESDSTIRAIMIDGNPWFFASDVCRAIGIANHRDAVRKLDDDEKGVGSTDTLGGEQESVIISESGLYTLILRCRDAVTPGTIPYRFRKWVTSEVLPQIRKTGRYVREELSQTDKARMLAQEMTSSMLPAIMDALQVEQKHYTFPLNRRYQDHIHSPDGLRELAKSSMVMKLLRELDADGHDVSGAAAEVTAMLSYIVGIGAVLRDIETHAQYVMAKAKGY

SEQ ID NO: 11790 - protein, 192 aa, Klebsiella pneumoniae
QWYSSPGIGSGFSRAMATLTEALMTVLHRLLLTVFFLIAVSPVFAAGPSEHVRAIVSGIVTYTRWPSLTGAPKLCIFASSRFTHSLAHEDPDALPYQPVIVRNREEALKTTCDGFYFGSESPTEQSELTRRYGPRPLLLIAEQNTDCSIGSAFCLIINDDRVRFSVNLDVLTHSGVRVNPDVLMLARKKPHE

SEQ ID NO: 11791 - protein, 117 aa, Klebsiella pneumoniae; identical to SEQ ID NO: 8757

SEQ ID NO: 11792 - protein, 60 aa, Klebsiella pneumoniae; identical to SEQ ID NO: 8602

SEQ ID NO: 11793 - protein, 66 aa, Klebsiella pneumoniae
GKEVIQPQVPLRLPCYDFTPVMNHKVVSALPKVKLPISFATHSHGGTGGVYKARERIHSSILIYEY

SEQ ID NO: 11794 - protein, 70 aa, Klebsiella pneumoniae; identical to SEQ ID NO: 9056

SEQ ID NO: 11795 - protein, 370 aa, Klebsiella pneumoniae
YHRFIRVLEGQSMSKEKFERTKPHVNVGTIGHVDHGKTTLTAAITTVLAKTYGGSARAFDQIDNAPEEKARGITINTSHVEYDTPTRHYAHVDCPGHADYVKNMITGAAQMDGAILVVAATDGPMPQTREHILLGRQVGVPYIIVFLNKCDMVDDEELLELVEMEVRELLSQYDFPGDDTPIVRGSALKALEGDAEWEAKIIELAGHLDTYIPEPERAIDKPFLLPIEDVFSISGRGTVVTGRVERGIIKVGEEVEIVGIKETAKTTCTGVEMFPKMVDEGRAGENLGVLLRGIKREEIERGQVLAKPGTINPHTKFESEVDILAKDESGRHTPVLQRLPSGVLLSDLLEWTGPIELAEGRKNGIAGATP

SEQ ID NO: 11796 - protein, 363 aa, Klebsiella pneumoniae
SDKPSPARYDKLTPILHQEATMNHSLKPWNTFGIERFAKTIVRAETEQQLLSAWQTAAAAGEPTLILGEGSNVLFLNDYAGTVILNRIMGIEVSETPEAWRLHVGAGENWHQLVQFTLQHAMPGLENLALIPGCAGSSPIQNIGAYGVELQRVCEYVDCIELETGRKQRLSAAECRFGYRDSIFKHEYQDRYAIVAIGLSLAKTWQPVLSYGDLTRLDPQTVTPQQVFDAVCHMRMTKLPDPKINGNAGSFFKNPIISAQVAEALLAQFPHAPHYPQANGSVKLAAGWLIDQCELKGQRIGGAAVHRQQALVLINEDRATSEDVVKLAHYVRQRVGAKFDVWLQPEVRFIGTHGEVNAEESIA

SEQ ID NO: 11797 - protein, 112 aa, Klebsiella pneumoniae
AISARLERAAGIEPASSAWKAEVIAIIRCPHPETRLPSSFCNTKETALFSIELISLPNQLRLRKASPESGGGGRIRTFEVDDGRFTVCSLWPLGNPTQIVMVPTTGIELVTY

SEQ ID NO: 11798 - protein, 117 aa, Klebsiella pneumoniae
PIIQKVRSHTRRCSHCLYVHGFRFFFTPLAGVLFAFPSRYWFTIGQSGVFSLGGWSPHIQTGYHVSRPTLRVHNLCILVYGTITLYRRTFQTVPLTHKLIQTLGCSPFARRYWGNLG

SEQ ID NO: 11799 - protein, 116 aa, Klebsiella pneumoniae
VFCCVVSNVKKSNVVRYWLSRAPSTRTPSSNLKWTSWPKTKAGVILPFFKGYRPEFYFPTYWSGLDPSNLRKGVKMVLPGRHHKKGGSPYPPQRKGQRFAFLNPGRGPNPCPGRGC

SEQ ID NO: 11800 - protein, 328 aa, Klebsiella pneumoniae
SQRRGEHCVKDHTIPLTLISILADGEFHSGEQLGEQLGMSRAAINKHIQTLRDWGVDVFTVPGKGYSLPEPIHLLDEKKISQEIDHGRVTVLPVIDSTNQYLLDRLDELTSGDACVAEYQQAGRGRRGRKWFSPFGANLYLSMYWRLEQGPAAAIGLSLVIGIVIAEVLQQLGAEQVRVKWPNDIYLQDRKLSGILVELTGKTGDAAQIVSGAGINLVMRRVESDVVNQGWISLQEAGVVIDRNLLAARLIKELRLGLELFEQEGLAPYLPRWEKLDNFIHRPVKLIIGDKEIYGISRGIDAQGALLLEQDGVIKAWVGGEISLRSAE

SEQ ID NO: 11801 - protein, 60 aa, Klebsiella pneumoniae; identical to SEQ ID NO: 8602

SEQ ID NO: 11802 - protein, 91 aa, Klebsiella pneumoniae
PRSISSRLIPRSRTPRFSPARPSSTIFGNISTPVQVVFAVSLIPTISTSSPTLMIPRSTRPVTTVPRPEMENTSSIGSRNGLSIARSGSGI

SEQ ID NO: 11803 - protein, 156 aa, Klebsiella pneumoniae; identical to SEQ ID NO: 8616

SEQ ID NO: 11804 - protein, 335 aa, Klebsiella pneumoniae
LTRVKHHRFKVFGDSKNMLMSQKEQTLMTPYLQFNRHQWAALRDSVPMTLTEEEITRLKGINEDLSLEEVAEIYLPLSRLLNFYISSNLRRQAVLEQFLGTNGQRIPYIISIAGSVAVGKSTTARVLQALLSRWPEHRHVELITTDGFLHPNSVLKERGLMKKKGFPQSYDMHRLVKFVSDLKSGVPQATAPVYSHLIYDVIPNGDKTVAQPDILILEGLNVLQSGMDYPHDPHHVFVSDFVDFSIYVDAPEELLKSWYINRFLKFREGAFTDPDSYFHNYAKLSKEEAVDIATSLWNEINLMNLKENILPTRERASLIMTKSANHSVNQVRLRK

SEQ ID NO: 11805 - protein, 66 aa, Klebsiella pneumoniae
GKEVIQPQVPLRLPCYDFTPVMNHKVVSALPKVKLHTSFATHSHGVTGGVYKARERIHRSILIYDY

SEQ ID NO: 11806 - protein, 78 aa, Klebsiella pneumoniae
YGLSRNALLCVDFTMRANEAHLGLKPYIEFRTHPLANIMSKFHHILAGRSIFINQYQRLLPMDGSAADALSFELTLID

SEQ ID NO: 11807 - protein, 70 aa, Klebsiella pneumoniae; identical to SEQ ID NO: 9056

SEQ ID NO: 11808 - protein, 1011 aa, Klebsiella pneumoniae
AFLLKIPHRIIYEGNYMARRQILSLSERESLLALPDEELTLTRMAYFSEHDLALISAHRKPASRFGFAVLLCYLKNVGFTPDKKIPPSDALLKHIASRLKLTGDLWPAYLSGRETTRREHLTELYRYLGLKAFTGKIQQDCITHLLPMATRTDKGILLAEELLVWLRQNNVIIPSIDVVERSCAEAMAGGDKIVFQTLNAPLTPAHRDALDCLLESSDNQSSRLTWLLQPPGKINGKNVLQHLDRLSSIESLALPEGIDRTIHQNRLLKLAREGRKMSSRDLTRFSAARRHAILVCVLEEARATLTDEVIELHERMLNSLFSKAKRTQAERLQQTGKLIQSKLRQYINVGQALSDARDSGGDPWLAIENILPWPEFVASLEETRHLARKNNFDPLHIITEKYSTLRKYAPRMLSALQLIATPAAQPLADALVVIKDMYRKQSRKVPATAPLEFVPESWRKVVITPAGIDRQYYEFCALSELKGALRSGDIWVKGSRRYKNFDDYLIPEKDFDKLTPALPLPVSADYHEYITSRMTLLQSRLEEVNAMAALGELPDVEISYRGVKVSPLDNSVPVQVSPLAELVYSMLPRPKITEILDEVNSWTTFTRHFSHIKTDITRPDIRLLLTTILADGINLGLTKMAEACPGSTKSSLEDIQAWYIRDETYSAALAELVNAQGKRPLAAFWGDGTTSSSDGQNFRTGRSGRYAGQVNPKYGQEPGRQFYTHISDQYSPFYTCIISRVRDSTHVLDGLLYHESDLEIREHYTDTAGFTDHVFALMHLLGFAFCPRIRDLHDKKLFIKGKAGQYPALQSLISTTSLNLKEIEIHWREVLRLATSIKQGTVTASLMLKKLASYPKQNGLAKALREIGRIERTLFMLDWFRDPALRRRVQAGLNKGEARNALARAVFMHRLGEIRDRKPENQSYRASGLTLLTAAISLWNTVYMERAVDALKRKGVKINEQLLSHLSPLGWEHINLTGDYIWKSNRIPSAGKFRRLRPAKLGRSKNNLNVQ

SEQ ID NO: 11809 - protein, 79 aa, Klebsiella pneumoniae
PARPVWPFWGGWLSPCLSRAGEKPSCVRTSTQTQIITCCSRLTCSGLPGARAGWLSGLCWRGCWRSCCLTVILRLLTRR

SEQ ID NO: 11810 - protein, 129 aa, Klebsiella pneumoniae
RGETMAWVTVRQATELTGKARSSLYRDMAKGRVSYRTEADGGRVVDTSELIRVYGELRQDETHERDELRLSGETEKMASDALIAEIKALREEVAGLRQEMQSMRLLEHKPETAETPAGTPRRWWPWGKR

SEQ ID NO: 11811 - protein, 623 aa, Klebsiella pneumoniae
RCTAPAPSVNPRKIIIRFRPAAVGRGPELRQGIGFRQHRETLQRDFPALNPQRTAERHPGHTQPGHDREPVRQVLQGVHVKQRPRLLLDEAVPADMLHVPRLPAGTAALHVHPDFPGLPRRPLRGLQAGRPVKPADRRVIQYRGFHKFSGQILPALPEIAQRLVREQQIAVPAAQRPQCVQYILRQQIFNFIEHHADVWPLPELVPRNDDLRAAGKQHFLHTDHRLVVHRADNVQAAAAVDNPRHIDATVRLQDAQVSDVFQPSDQPLHVLFQGLRQRVRRRQHLLNVCPLRKLLRNQLRRFLLADAVVVRHVAGLAQVKPGNQQVFQRVLVEIAEQIQLRRFPRPQIQQGEVRTVRPEDVRRPCVPFGVEVHHRVPEIAYAANERVGGHHALAAPGQAEDLNVGLAPGITRNQHRLALLILTQKHRLLLPGLLRGKIGQRINRYRLPEMQVAHVGHLSCPLAAAPALLIQFRVHRLVSSRKMTVKQQERQQPRQHNPDSQPARAPGNPEQVSRLQQVIICVCVEVRTQDGFSPALDKHGDNQPPQKGQTGRAGQPVRVVPDMSTCPDHPPGRIQRGQHRKWRWPFIIALIAIGILPSLLMTQPHKTHPSGPKFSQTEKQADN

SEQ ID NO: 11812 - protein, 178 aa, Klebsiella pneumoniae
GIMALYMVFIEDAEDRNGERCIMPTSEHLEDMVVLAWQTGAYVFCFVDRAQHLAMMKSIGMYDERLNSDEKATYFFTGKNPQWERNKPTGMKLCDYLYRKVERFAIENGVQVVDAGKCSPEQINAMIDVVSERHGESAVNEKLKAELMREYNSRYFNVPVPELPEDKPARRWWPFGKK

SEQ ID NO: 11813 - protein, 127 aa, Klebsiella pneumoniae
ARWYPPPGRHQLPYGMIRGLSPYPDTGNFGLYPSVPSPVSPSPTPLSHPAIFETVYLTGAHHARKERIMTKQEKTALNMAKFIKEQSLLLLDKLNELDMDTPADMCERLHEDAETLWQVMRDKLGEE

SEQ ID NO: 11814 - protein, 379 aa, Klebsiella pneumoniae
LSHHIEDNLHMKSRAAVAFAPGKPLEIVEIDVAPPKKGEVLIKNTHTGVCHTDAFTLSGNDPEGVFPVVLGHEGAGVVVEVGEGVTSVKPGDHVIPLYTAECGECEFCQSGKTNLCVSVRETQGKGLMPDGTTRFSYNGQPLYHYMGCSTFSEYTVVAEVSLAKINPEANHEHVCLLGCGVTTGIGAVHNTAKVQPGDSVAIFGLGAIGLAAVQGARQAKAGRIIAIDTNPAKFELARQFGATDCINPNDHDKPIKDVLLEINKWGIDHTFECIGNVNVMRAALESAHRGWGQSIVIGVAGAGQEISTRPFQLVTGRVWKGSAFGGVKGRTQLPAMVEDAMKGEIELEPFVTHTMTLDEINEAFDLMHEGKSIRTVIRY

SEQ ID NO: 11815 - protein, 113 aa, Klebsiella pneumoniae
VDFQPQKMCLIFRPEQGLNPADLRCAVTGGFSSFSYAQFLDLSVIQNFLMSFLIGLFAPVFSQRMCPFNSLLLPMAAAQPVLMRHRGHQVDKHIIDGGYHGAGDWVSLRRIFI

SEQ ID NO: 11816 - protein, 116 aa, Klebsiella pneumoniae
PRNNSASACMAVIRNCAMPYDVEWKQGAIEDVTTLFDYIAENSSLWDAQNVTDRVLAAADKLADFPRLYEVDSRYGEDVRRISLMGQHVLYDVDDQTRKVRVLAVVGQRQNPHIVL

SEQ ID NO: 11817 - protein, 215 aa, Klebsiella pneumoniae
RGGKMFIRAYLRASTEDQFADRAKEMLEQFVQERGHKIASYYRENISGTKLDRPELGRLLMDSHRNDILLVEQIDRLTRLSNSDWMTLKKQIEQHELRIVSLDVPTSWQALSDKDPSQADPITRAVITAINNMLIDLMASMSHKDWLSRRHRQKQGIERAHTLGKYRGKQADQERHKKVLYYRQVKKLSIRETAEATGYSTSQVCRIQALFRPEN

SEQ ID NO: 11818 - protein, 658 aa, Klebsiella pneumoniae
RRENMFNTDSLAWKWHIPELARQIYPWVSWLYQEYYGLAGAFLVIGLFFGLAELWAGRMRFVGLSHKERREYADRYKRDNKRPAPFSVLASLDSPGRMVRARRHVWNYAYWLTGAAGLALLGGLVVAVFIESWGETVLRPDLYANADYYLLQPANLFGIAWCAGGLAVGIVLARLLAFLLLDGHFAAADEAVNAKLNQESRRSSQRTGEMTDVRHLHFGEPVPVNALADFSSEQARQEQAVFLGKDEQGKPVLVPRDTWRKTNIQILGLPGSGKSVMATNALIRCVRDFGDAVVYFDPKGDAWAPHVFRAHCPDFTLLDLRPGKPAQLNLFRDLDQYALKNLLIAGLNLGETGDVADHYRISEQKAAKLIAEQFPQGANIQQVLAAAYALPEALKKDVKGLITRLENVADLSVLQTDSGIDVAGIINGGGCLYVIGSMDDEAVIRVQKMLFARCAQIIIARDEFREWPHVSVMLDEIKYLLSKYVLNALGTLRSRDCNLLLAHQSLGDFGQCGQDLPAEFVKTTVLDNTPIRWFYRAACLESAQWAAGQTGEIRVDVERRRASREAGNVEHISGDSFIQKEARPLFDVNTLQHLPDGFAVMTGLGVARMAFSSPLRVERREIPLQRFPVLAKTDPLAEFRPPADGGGPKADDDFAGIY

SEQ ID NO: 11819 - protein, 91 aa, Klebsiella pneumoniae
DCWNTNRRQQRPRPEHRAGGGRGENADALCLSNRRRPRNELRPRHRLLENNMGILALADHGQNPDFSGLVINIIEDMLSHQTDPANVLAIA

SEQ ID NO: 11820 - protein, 61 aa, Klebsiella pneumoniae
PLYLFHIPSLYLKTPVFIPEHRKSVFQIILDNFCLPVTIPVNKGYKVIKFTNIDYIFKVWL

SEQ ID NO: 11821 - protein, 249 aa, Klebsiella pneumoniae
FCGDLLMALELYNVSHAKRQARNAEKTRLTLRWLREELCSTAELVARRLGIAAVQPVYRFLDSLVAKGLLVRTKYPVDGRQVSVWGLTPHGVAFSFDEDEPLADVIPFQPSRVSAAHLPHRLAVQSLRLDMEARGATGWRILHRLSLKGMKVPDALAELDGKTVAFEVERTVKSRRRYQEVVSGYLFNRKANGIDEIWYICPDRATQVRVQRAILSVDEIVNPQTGEARKTAELDRERLFACFKFMTTE

SEQ ID NO: 11822 - protein, 88 aa, Klebsiella pneumoniae
PRMRRTRVRTFFFSSGVLGIIYLTIFDFIYYSGVYNYRQCILHYSITKNKHNYLYLRYKSYIYIIFGCDTVGRKVTTKMISTDTGFGA

SEQ ID NO: 11823 - protein, 92 aa, Klebsiella pneumoniae
IMPSTPEEKKKVLTRVRRIRGQIDALERALENGAECRSILQQIAAVRGAANGLMAEVLESHIRETFDQNDSYSHEISKSVDDTIELVRAYLK

SEQ ID NO: 11824 - protein, 309 aa, Klebsiella pneumoniae
QNHGLYVHLTSGYKETSPDSLSGEITMRQRLMELIEQHASAGGWQNVYRHNSQTLNCGMNFGVYLPPKAATEKLPVLYWLSGLTCTEQNFITKSGMQHYAARNNIIVVVPDTSPRGEHVADADSYDLGQGAGFYLNATEHPWNTHYRMYDYILHELPDVVMEHLPVTSRKSISGHSMGGLGALVLSLRNPDEYVSVSAFSPIVSPSQVPWGQQAFTAYLGENKKTWEHYDPVSLILQGAKLPEIFIDQGLSDAFYEDQLRTKSLERVCNEMNINTSFRYHTGYDHSYYFISSFIGEHIAYHANRLRLSA

SEQ ID NO: 11825 - protein, 88 aa, Klebsiella pneumoniae
EVNMGLKLHIHWFDKKTEEFKGGEYSKDFGDDGSVIESLGMPLKDNINNGWFDVEKSWVSILQPHFKNVIDISKFDYFVSFVYRDGNW

SEQ ID NO: 11826 - protein, 572 aa, Klebsiella pneumoniae
FIVLKVKEEKYMSGGDGRGPGNSGLGHNGGQASGNVNGTSGKGGPSSGGGTDPNSGPGWGTTHTPNGDIHNYNPGEFGNGGSKPGGNGGNSGNHSGSSGGGQSSATAMAFGLPALATPGAEGLALSVSGDALSAAVADVLAALKGPFKFGLWGIAIYGVLPSEIAKDDPKMMSKIVTSLPADTVTETPVSSLPLDQATVSVTKRVADIVKDERQHIAVVTGRPMSVPVVDAKPTKRPGVFSVSIPGLPSLQVSVPKGVPAAKAPPKGIIAEKGDSRPAGFTAGGNSREAVIRFPKESGQKPVYVSVTDVLTPAQVKQRLEEEKRRQQAWDAAHPEEGLKREYDKAKAELDAEDKNIATLNSRIASTEKAIPGARAAVQEADKKVKEAEANKDDFVTYNPPHEYGSGWQDQVRYLDKDIQNQNEKLKAAQTSLNEMNESLSRDKAALSGAMESRKQKEKKAKDAENKLNEEKKKPRKGTKDYGHDYFPDPKTEDIKGLGELKEGKPKTPKQGGGGKRARWYGDKKRKIYEWDSQHGELEGYRASDGEHLGAFDPKTGKQVKGPDPKRNIKKYL

SEQ ID NO: 11827 - protein, 149 aa, Klebsiella pneumoniae
EKRIKGKETLMRRSGSKLCLIAMITATATLTACAPKGSVEQHTRHYVYASDDGFDPNFSTQKADTTRMMVPFFRQFWDMGAKDKATGKSRSDVQQRIQQFHSQEFLNSLQGTTQFAGTDYRSKDLTPKKSRLLADTISAVYLDGYEGRQ

SEQ ID NO: 11828 - protein, 136 aa, Klebsiella pneumoniae
RKWIMATPVISGNDVFSHVFIGASDVEKSADFYDAVLGTLGINNLGPFGNGWVLYGREKPAFIIAHPGNGEAPSANGVTVGFAAASPEEVDAFHAAGLAAGGKDEGQPGPRSHLPGAYAAYLRDPAGNKITAYTFI

SEQ ID NO: 11829 - protein, 63 aa, Klebsiella pneumoniae
SIYVMPGMLFHAALWSTGSESCCRCYHGDKTQFAAGTSHERLLTFNSFFSLSYISAGYLIISF

SEQ ID NO: 11830 - protein, 166 aa, Klebsiella pneumoniae
SHSFIPVGLFRSHCGFLPVKKYVAFSSLLSRSSYIPMDFIIARCWARSTKQKTYAPVCQASTTISSRCSLVGMMQRSPFRSSASSINTMYSAIIPHSVVINLKHANNRSRSSSAVLRASPVCGFTISSTDRIARCTLTCVARSGQMYQISSMPLALRLNRYPDTTS

SEQ ID NO: 11831 - protein, 180 aa, Klebsiella pneumoniae
PGWVWPGWRSAVRCGLSAGKSRCSVSRCWRKPIPWRSSGPRPTAAGRKRMMILRGFTDGAGAVQRQPRETTGAERGENPADPALVAGRAVFHGGAGCAAAGDCGGAAGLPLPRQPGGERAAGPDQISGGRPSGQRVGADAAWRGVLVRRGRTAGGCYSVSAVKGVGSTSAAPAGRAIPAP

SEQ ID NO: 11832 - protein, 79 aa, Klebsiella pneumoniae
VIAFNLSHIGYVIHRVPSRFEYGVRVYPYAISISVKNTASDNLRGKLYGKEADSFSVGKRIITGITGRRVNADPDGVFQ

SEQ ID NO: 11833 - protein, 69 aa, Klebsiella pneumoniae
PHDWSQLENQKRKACQKRKNINEDTDASGSELVLPIPLQDQAEAGLIVAGTASPAFVKIHHCRDKSKEI

SEQ ID NO: 11834 - protein, 97 aa, Klebsiella pneumoniae
DGSYDRPQSKEDDVKYVDIPAPVPVGELRHEGSPDHEEEYIGYECPGCKPGIHLEVALYGWKCGANDSYVEGPHEYSNKEQKQYPVPFFCLNLMINP

SEQ ID NO: 11835 - protein, 463 aa, Klebsiella pneumoniae
RINHKIETEKRNRILLLLFVGVFMGALDIGIIGPALPAIEGYFKVDPRLASWTFISYILFFMVGTPLMAKLSDRYGRRDIYILDIILFALGSVITAISPSYPLLILGRSIQGFGAGGIFPVASAFIGDTFPPESRGKALGIIGSVLGFSSIAGPILAGFILPYGWQWLFLINIPIAATIVVGGFLMLPVTGKTDDGEFDARGTLLLAIIVASLAVGINQIDTTDLTGSLMRPIVVVPLILAAALTPIFWRVERAAPDPVVQVDLLASREVRIATAISAGNGLSQAAIVFIPRYAFFALSLSESMASFSFLPFVTTMAFSAPIVGVLLDRVGSRVVMISGSLILMVGCTIMALLSSTTPLFILAEVLMALGLITVIGAPLRYIMLSETPPEHRASGQALINILSSAGQLVGGALIGGIVASMGSGVMGYRFSFLFLVAVAFTLFLLSTGLKGRKEQLETMKGNI

SEQ ID NO: 11836 - protein, 69 aa, Klebsiella pneumoniae
SFSSAGKTSINLSTAGAAPRVCNVAITRCPVSAAVNARRMVSLSRSSPSRITSGSWRSATRSAAANEGQ

SEQ ID NO: 11837 - protein, 91 aa, Klebsiella pneumoniae
LGLSLGLAPTGPAQALFKTASRFVRQLELFRVYTKRDYRDGLPDKAEWGQGIIATFESGFTQGPVGFGVDCIAQYAVRLNGGRGPSGLRLD

SEQ ID NO: 11838 - protein, 492 aa, Klebsiella pneumoniae
RRRSGRAGDVSGGDYRVCPRCRTAVPRHLCPSAANRTGSPQTDITLTKIRSGGVMTQQEFLSRRQTLLAQMQPGSAALIFAAPEAVRSADSEYPYRQNSDFWYFTGFNEPEALLVLIKSDETHNHSVLFNRVRDLTAEIWFGRRLGQEAAPAKLGVDRALAFSEINQQLYQLLNGLDAIYFAQGEYAYADEIVFNALEKLRKGSRQNLQAPNSVIDWRPIVHEMRLFKSAEELAVMRRAGEITALAHTRAMEKCRPGMFEYQLEGEILHEFNRHGARFPSYNTIVGGGENGCILHYTENESELRDGDLVLIDAGCEYRGYAGDITRTFPVNGKFTQPQREIYDIVLESLETALKLYRPGTSICQVNQEVVRIMITGLVRLGILKGEIDELIANNAHRPYFMHGLSHWLGLDVHDVGNYDTNRSRVLEPGMVLTVEPGLYIATDADVPAQYRGIGIRIEDDIVITEDGNENLTAGVVKKADEIEALMAAARQS

SEQ ID NO: 11839 - protein, 132 aa, Klebsiella pneumoniae
EILSAMPNRSIAARVSPPPAMEKPSLSAIALATISVPLRKLGNSNTPTGPFHRMVLAFFRISASFCAETSPRSRICSSSLMSLTDFRVAVAVSENSVATRTSVGTGISQVPSRRLASSTRSASYRDLPTLWP

SEQ ID NO: 11840 - protein, 460 aa, Klebsiella pneumoniae
IAKSISPLISTSVTSLTPKPNRTSLCEPWSITMKNVLISATLSATLGLSAFSSLAQDVDLRMSWWGGNGRHQVTLKALEEFHKQHPDINVKAEYTGWDGHLSRLTTQIAGGTEPDVMQTNWNWLPIFSKNGDGFYDLNTLKDEIDLSQFDAKELQSTTVNGKLNGIPISVTARVFYFNDEAWKKAGIPFPKTWDELMAAGKTFESKLGKQYYPVVLEHQDVLALLNSYMVQKYNQPAIDEKGRKFSYSKAQWADFFGMYKKLIDSHVMPDTRYYASFGKSNMYEMKPWIQGEWGGTYMWNSTINKYSDNLKPPAKLVLGEYPMLPGATDAGLFFKPAQMLSIGKSTKNPQAAAKVINFLLNSKEGVDILGLERGVPLSKAAVTYLTEDGVIKADDPAVSGLKLAQSLPTALPVSPYFDDPQIVAQFGTTLQYIDYGKKSVEEAAEDFQRQTDRILRRAMR

SEQ ID NO: 11841 - protein, 366 aa, Klebsiella pneumoniae
KIWSTRRKQPMSESVHTNSSLYSKGMVAVICAQFLSAFGDNALLFATLALMKQLYYPEWSQPVLQMLFVGAYILFAPFVGQFADSFAKGRVMMVANGLKLLGAGCICFGVNPFIGYTLVGIGAAAYSPAKYGILGELTTGDKLVKANGLMESSTIAAILLGSMAGGILADWHVLAALIVCALVYGGAVVANLWIPRLPAARPGQSWRFKPMTHSFFSACRTLWRNGETRFSLMGTSLFWGAGVTLRFLLVIWVPVALGITSNAMPTYLNAMVAVGIVLGAGAAANLVTLETVSRCMPAGILIGIAVIAFAVQQSLLPAFGLLLLLGVFGGFFIVPLNALLQNVGNIRSGQVTPLRYRTSVRTWRCC

SEQ ID NO: 11842 - protein, 610 aa, Klebsiella pneumoniae
RLLPVHLEHLRQQRRGGPHRRLRRLRPRCHRHPPRLPGIDGRAAHRPLRAKPAAGVLPLRHHRGQRQRDLHQYRLRLAGAGDRRSADAQRQRRPGEQHGLAGHRRHFAGQPRPDGHLCPDHRPGYRRQRAVDHRHHLCLSMMTDYILSPCSLAARGLSQLMLNAARRPVELPVEGVSLRELAAVKRIVVYLPDDPLWMLTTLRQAARLLDEALPPLPMLILSRSPAIWLWQTLLYQVSHPDRLRNVHTAPADLSCAELAHRLENAPRLERLAGEAALIHGKRVVGLTHAELKVILALLQGQTIGEQAQRLGLSQKTLYTQRLAGVKKLVECHPHLAPRFPRTLLPRSPANALTAFEQEWVQAIHDRQVFPVFQPIVDSRSQLQGVEILIRWRHRGQVLHPQTFLPHFRADYTWLLLTAFVLQEAVQNINEYPGTFYFSVNIPSSLADSDSMLRMVEAARQQLRQPEGVARLVLEYAETFDFRHQSRSAAHVAQLQRAGVRVKLDDCFSQGSVIFPARRLHFNAYKLDMSIVNDAQHDPKALALIKSLAYYCQLSDSRCVAEGVDSLAKFTQLKSLGIDRFQGYLFSPPMRREHLPDLIRRFSHQRDPADR

SEQ ID NO: 11843 - protein, 270 aa, Klebsiella pneumoniae
RQLLICSPVLPARWREAGICATNGISSMRIPRIHHPERLIVGSQIALSDDAANHVGRVLRMTAGQHLQLFDGSNQVFDAVITEAGKKNVTVEVLSGEPDDRESPLHIHLGQVMSRGEKMEFTIQKSIELGVSLITPLFSERCGVKLDAERLQKKIQQWQKIAIAACEQSGRNVVPEIRPAMQLEAWCAEQDSGLKLNLHPRASASINTLPLPVERVRLLIGPEGGLSAEEIAMTAQYQFTDILLGPRVLRTETTALTAITALQVRFGDLG

SEQ ID NO: 11844 - protein, 474 aa, Klebsiella pneumoniae
FCHPYTLLRGQMMTLFSSHPGDEGLPGPARARVMAAIMTTTLMGVFDGTMINIALPSMAQEMQVPASIAVWFANGYLLAAAMTLAIFAALAARLGYRPVFLAGLTTFTLTSLGCALANKPEVLIGMRVLQGIGGAATLSIAPAILRSVFPGRLLGRILGFHALLIASSSAIGPVLGGTILHTLSWQWLFAINVLPGTLALLLAVRALPRDAIRMQAPFDTVGAILSALLLGSTIMAANSLQNATSQFGSLCWMALAALSGMAFIWQIRRTGSPLLPPSMFKNERFTLAAFTSMVAFVSQGITFIALPFLFQSEYGYSPVVSALLFTPWPLGIVLIAPHAGRWADTISAPAISTLGLVIFVVGLILLATLPARPSMWDICLRSLVCGIGFGCFQSPNNREMLSNVIREHASYASGVLSIMRTFGQCLGAAAVAVLLAADERSIHVALWSAAAASAVSVVVSASRLRKIAHPAETG

SEQ ID NO: 11845 - protein, 213 aa, Klebsiella pneumoniae
ILMFTYYFQGLALGAAMILPLGPQNAFVMNQGIRRQYHLMIALLCAVSDLLLICAGIFGGSALLMQSPWLLALVTWGGVAFLLWYGFGALKTAFSQSLELANAEVMQQGRWKIIITMLAVTWLNPHVYLDTFVVLGSLGGQLAVEPKRWFALGTISASFLWFFGLALLAAWLAPRLRTARAQRIINIVVGAVMWFIAFQLAREGVSHIQALLN

SEQ ID NO: 11846 - protein, 246 aa, Klebsiella pneumoniae
VVVLSAGCLMMKRFYMTLMLAASLVLAGCSSTSDSGGTYTVKRGDTLYGISRTTGTSVRDLARLNNISPPYTIEVGQKLKLNGSSSTKTTKKKSSSTRTAAVTPSSAVPQSSWPPVGQRCWRWPTSGKVVLPYSTADGGNKGIDIAGTRGQPVYAAGAGKVVYVGNQLRGYGNLIMIKHSEDYITAYAHNDKLMVNNGQSVKAGQQIATMGSTDADSVRLHFQIRYRATAIDPLRYLPPQGSKPKC

SEQ ID NO: 11847 - protein, 145 aa, Klebsiella pneumoniae
TRSPRRPGNPGVDLKLMLANCLRKIRLSGKSGCSPPKSTGPPAKTDTSNWAQSRPGPAKISPRAWPASLKRLQTDYLDLYQVHWPQRPNQLLGQVGLYLGRLRARCDAAGHPRSADRVPARREDPLHRRVERNRLRRDALSAPGG

SEQ ID NO: 11848 - protein, 383 aa, Klebsiella pneumoniae
LRCPTIAARVVDLPLPVAPVTNSKPLSSASSSLSAGGAPSISRRGHCSGRRRSTSDIPRVWAKALARSRAPQARFSAKSIWPCSCQCSNCAASSQSLSKFAISGAGKGAGSSLPCRRQRGAAELHRCRSETLCFTLRATISSSFITHPRNMNDIAHNLAQVRDKISGAAARCGRAPEEVTLLAVSKTKPASAIEEAIAAGQRAFGENYVQEGVEKINHFQQAGVSGLQWHFIGPLQSNKSRLVAEHFDWCHTVDRLKIATRLNEQRPAHLPPLKVLIQINISDEQSKSGIPLEALDGLAAEIAELPHLELRGLMAIPAPESEYVRQFAVARQMAVAFARLKTRYPTVDTLSLGMSDDMEAAIAAGSTMVRIGTAIFGARDYSK

SEQ ID NO: 11849 - protein, 451 aa, Klebsiella pneumoniae
KGLPMNKIWVGCFLTSLYLPSVMAQAPLSLEERLAQMEQRLKATEARAASAEAEIKTLKGQQQAATVARAAPASPRLQLNDNGELKFYGDVEFNLDGASRTGSLTSVKTSANKSWAPGDKERWDINGRILLGFDGRRNGADGQYAGFSVQPLADMDGKMNLDDAAFFFGQQDDWKIKIGRFEAWDMFPLNQDTFIEYSGNTANDLYSDGYGYIYMMKEGRGRSSSGGNLLFSKTVDNWYFEVNTLVEDGSSLFVDQNYHGNALENRKNVVYVRPVAAWQSGAWSAAAAIESNLVNNAYGYQSQSGRWVDQSNRTGYGLTMSWNTLKSDPQDGAVVNLSTALLDAADETDFSAGINALWHRVELGYIYAHNKIDQFNMAGVSGECDDDCAILAPGRYDIHTLHTSWQLPNIMAMPNFNIYLGAYASWLDSTAAKSGNPDERYGARVRFKYFF

SEQ ID NO: 11850 - protein, 236 aa, Klebsiella pneumoniae
SSSPCTVLALQNISRHGVWFRCDGHSYPFSGATIVNRRRFLTAKEVQAMMQAARQGPTGERDYCLILLAFRHGMRISELLDLHYHDLDLHEGRVNVRRLKNGFSTIHPLRFDEREAIERWSLVRAGWKAADKTDALFISRRGTALSRQQAYRIIRSAGENAGTVTHTHPHMLRHACGYELAERGTDTRLIQDYLGHRNIRHTVRYTASNAARFAGIWERNNLLEEKVQKTKNEITD

SEQ ID NO: 11851 - protein, 73 aa, Klebsiella pneumoniae
SRAPKMAVPMRTIVLPAAIAASISSDIPRDNVSTVGYRVFNRANATAICRATANCLTYSDSGAGMAIRPRSSR

SEQ ID NO: 11852 - protein, 494 aa, Klebsiella pneumoniae
LSAFASAGLASSSSVTTWKTFAPSPTVSWCCVSGATKGSSRPMLLIRIWSPRSPARRKTPSHAGLNVNHSQRLPERCNFMNSKTASHTALDRSDERVRHDEGLFGALRAQITRIKTGDLGTAPVIAGLIVISLVFTFLNPVYIAPNNLVNLLFDCATVGFISLGIVCVLMLGEIDLSVGSMSGLASAIVGVLWVNAGWPLAGAIAVALACGVAVGLVYALLYTRVGMPSFVATLAGLLALLGMQLYILGPSGSINLPYTSPLVRFGQLLVMPGWFSHLMALLPGLAILIFGLKKRSRRLAANLSAEGVSSLVARAIALTIIFEAAVLYLNQGRGIPWIFGLFVACVMILNYALKRTKWGRSMFAVGGNREAARRSGINVRAIYVSAFVLCTTLATFGGILAASRLASASQQAGTGDVNLNAIAAAVIGGTSLFGGRGSAWSALLGIIVIQSISNGLTLLNLPSSLRYIITGAVLAIAVIIDSLARRSRVSHGRA

SEQ ID NO: 11853 - protein, 633 aa, Klebsiella pneumoniae
LFQPAYISRHRQLRYAVLASVAQQSFTSQFIIGGKQHQRLAFAGVLFNRRGVHFVRRRAEGHLLHHLEGDHLAGDFGEALRAALNADIALLVEGNDIPGVIPARFHLAVLVFRRRRFQHAGVFHPQVAFHDVRPFQLQPPPLLNAWHRQQAGVHPRQDAAHGADLRRHRHVNRDHRRALGHAIAFENAQAEFILPQLFGALLQLLRPGDHVAQAVEIVRIGETGIVGEEGRSAEQHRTVAIVDQLRHHAIVQRAGIEKHFRPGKQRRQQADGEAKRVEQRQRRHKAVIGGKVGDSFDLLDVGQQTLMAVHHPFRIALGTGGEEDHRRVFRLLLNLRQTRRQQMSKNPQFVSEGDIAFKIFQEYPAHLGQLLRQVPEFAFIEEGARGENGVELRGGYRAAEPFHPGGMVHHRRNTAAGDSAENHRRADAGVRQHQADLLARLAVFFQNAGDKQGFGQQLAIGIRLEVDILHAGFARAEAVLRRQQRLIQGFPRAHRHPGFHHDLMQHLPGDLPPVAGARRLGHRQMGGRQEMQLNTREQATFHQPLQPAEGRQFGAFNTQRHNGRLRFGGDKGGAVINFHQRAADRNSPFREDNHRPPLLNQAHQMFDRHRLGRVQRHKIDNRRQRAHKPALAD

SEQ ID NO: 11854 - protein, 350 aa, Klebsiella pneumoniae
QGQPCRRSMTIRIAINGFGRIGRNVVRALYESGRRAEITVVAINELADAAGIAHLLKYDTSHGRFAWDVRQEREQLFVGDDAIRLLHEPTIAALPWRELAVDVVLDCTGVYGSREHGEAHLQAGAKKVLFSHPGGNDLDATVVYGVNQDELRAGHRIVSNASCTTNCIIPIIKLLDDAYGIESGTVTTIHSAMHDQQVIDAYHPDLRRTRAASQSIIPVDTKLAAGITRIFPQFNDRFEAIAVRVPTINVTAIDLSVTVKKPVKACEVNQLLQKAAQGAFHGIVDYTELPLVSTDFNHDPHSAIVDGTQTRVSGAHLIKTLVWCDNEWGFANRMLDTTLAMAAIGFRFDA

SEQ ID NO: 11855 - protein, 128 aa, Klebsiella pneumoniae
TAWPSSRPRRMGLNVREGEIMAKNRSRRLRKKMHIDEFQELGFSVAWRFPEGTSEEQIDQTVNDLIEEVIEPNKLAFDGSGYLSWEGLICMQEIGKCTEEHQAIVRKWLEARKLEDVRTSELFDVWWD

SEQ ID NO: 11856 - protein, 236 aa, Klebsiella pneumoniae
NVITTLFQNKKAVKFNNDLTQARKTKNMPAIKGKTMTNNADIKKRNFLTQNEIESLLKAADTGPYAARNYCLTLLCFIHGLRASEICRLRISDIDLAARCVYIHRLKKGFSTTHPLLDKEIYALKRWLAIRSSWPQAASEWLFLSRKGNPLSRQQFYQIIASSGGLAGLSLEIHPHMLRHSCGFALANMGIDTRLIQDYLGHRNIRHTVWYTASNAGRFYGIWDNPRDKQRSSLIQ

SEQ ID NO: 11857 - protein, 96 aa, Klebsiella pneumoniae
SAATARAMLSLKDKNDRGNVMDKELLEAGYRAYTGEKIDVYFNTAICQHSGNCVRGSAKLFNLKRKPWIIPDEVDVATVVNVIDTCPSGALQYRHK

SEQ ID NO: 11858 - protein, 306 aa, Klebsiella pneumoniae
ADYTYGLATVRRVLMSSVTLSGRGTLGDRQVYRLGYGAMQLAGPGVFGPPKDPEEAVRVLQAAVEAGINHIDTSDFYGPHVTNQLIRKALHPYPDDLCIVTKVSARRDEKGNWLPAMSPAELTQAVEDNLRHLGLEVLEVVNLRSMLSPHGPVEGSLEAPLATLLELKERGLIRHIGLSNVTAKQVADAQKMTPIVCVQNLYNVAHRADDALVDALAAQHIAWVPFFPLGGFTPLQAQELNEVAASLEATPMQVALAWLLQRAPNILLIPGTSSRTHLAENIAAAELVLPAEALRTLDNIATAARR

SEQ ID NO: 11859 - protein, 219 aa, Klebsiella pneumoniae
TANTFSPPCPPLKENNMRAITALLLLCVSAFSFAAPAEGPQSNGNDQLAQLLFNDPNSPRTGAKEPKLTIVSFTDYNCPYCKQFDPLLEKIVHDNPDIQLIVKLLPFKGQSSVNAAKIALSTWRQQPDKFWALHQRLMAKKGYHDDASIAAAQKKTATDSVNIDDKTMDSLKMNLILSQVLNIQGTPATIIGDQMVAGAIPADELEGLVKEQLAKARGQ

SEQ ID NO: 11860 - protein, 104 aa, Klebsiella pneumoniae
YKDTPMPAVIDKALDFIGGMNTSEPVPQSMDESTAKGILKYLKELGVPATPADVAARGQQQGWSAGFTDKVAEWAERVAAGERLVIKHPEFFSTYMREELRALV

SEQ ID NO: 11861 - protein, 493 aa, Klebsiella pneumoniae
PPCTLLDLTLMTTGRIPERGLRATQRHVEKLSVSALRTRKTVSASPLCMQPLKKSLKRPQSVRNVRQTLSVASAVKALHSVCKFNGLTALWVRTHGVAPTLARLATSISSKLNTRRHPMPEVKRIDSNNSKIKHTDELRAHLLDKEGNKIPHSVFGTDTTRTEIISQVDGTGETMNVGFTDRSGRPQAFGNDVTDYVQALESALDETLNDGDFIDGLNTEVFPCEQRPFATLPTPINRETLTDRTVRFLSNGVYNPAKNAPTTKVKGGQTLMVNPVIADKDAKETGILCSAITHVSDFAMMGGWTGAGLMATATDMVDQYLRNMTSKVVDVLLDAPDLQSAKVGALSGKASAQADDILDAVAVNLPFYLGSSLTDYTLLVPEKYEAILNRAAQKAGMTEISELVGTAVAPYSGDDRGVIILPKKYAMLSFRSTRSGDLVNVLVTRDANRAGYDVELVGALDVMATGTVKVKAGAFDTEAAASYPLVHVLKFED

SEQ ID NO: 11862 - protein, 410 aa, Klebsiella pneumoniae
TRSTANCLSRRWCSSCLKGKTCTSKATRRRKNSKGPAAFKKTNTTRTPGMMKKYLALALIAPLLVSCSSSNKKGAEYNEAWVKDTNGFDILMGQFAHNIENIWGYNEVLLAGPKEYVKYTDQYQTRSHINFDEGTITVETIAGTDPRGRLRQAIVKTLLMGDDPNSIDLYSDVDDIQISKEPFLYGQVVDNTGASIRWEWRAARFADYLLQTRLKSRNNGLRVVYSITINLVPNHLDKRAHKYLGMVRQASRKYGVDESLILAIMQTESSFNPYAVSHADAMGLMQVVQHSAGRDVFRSQGKSGLPSRSYLFDPANNIDTGTAYLAMLNNVYLAGIDNPTSRRYAVITAYNGGAGSVLRVFSSDKVQAANIINSMAPGDVYQTLTTRHPSAESRRYLYKVNTAQKSYRRK

SEQ ID NO: 11863 - protein, 681 aa, Klebsiella pneumoniae
QFRLIHHLRSKLMYMVFRRLLVCLLWLWLPVSQAADSGWLRAADNQHASVRLRAQTESNGDTRLLLDVALEKGWKTYWRSPGEGGIAPAIAWHTPLEVNWRWPTPQRFDVAGISTQGYHGDVSFPMTLRGKIPPTLSGVLTLSTCSNVCILTDYPFSLDMTTPAGERFNYDFTRAMGTLPQRDGLTSQLTASYISGKLTVTARRNAGWQQPALFIDSMEDVDFGKPSFTSRGDTLTATIPVTDSWGEAAPDLRGKTLSLVLADSGQAQESQIAVAAGSAAPGLALGWVLLMALAGGLILNVMPCVLPVLAMKLGSLVQTEGRERGAVRRQFLASVFGIVVSFLALALMMTALRLGNQALGWGIQFQNPWFIGAMALVMVLFSASLLGLFEIRLSSSASTFLATRGGNGLMGHFWQGAFATLLATPCTAPFLGTAVSVALVAPLPLLWGIFFAMGIGMSLPWLLIVAWPGLAQRLPRPGRWMNHLRVVLGLMMLGSALWLVSLLTIHIGRTPVLTLLVILAIALLVATAWRYRWRTALRAGALAIVVAGAVAFVAQQDGQGPRRDRVNWQPLSEQAIASALAEHKRVFIDVTADWCVTCKANKYNVLLRDDVQQALLAPDVVALRGDWSRPSADISQFLTARGSAAVPFNQIYGPELPQGKILPALLDREHLLATLSAAKGK

SEQ ID NO: 11864 - protein, 307 aa, Klebsiella pneumoniae
ERLTNKEADVKQDLALIEQFLDALWLERNLAENTLSAYRRDLTMLVEWLHHRGLSLASVGSDDLQALLAERQSGGYKATSTARLLSAVRRFFQHLYREKIRPDDPSALLASPKLPQRLPKDLSEAQVERLLQAPLVEQPLELRDKAMLEVLYATGLRVSELVGLTMSDISLRQGVLRVVGKGNKERLVPLGEEAVLWVENYLEYGRPWLLNGVASDVLFPSQRAQQMTRQTFWHRIKHYAVLAGIDSEKLSPHVLRHAFATHLLNHGADLRVVQMLLGHSDLSTTQIYTHVATERLRQLHQQHHPRA

SEQ ID NO: 11865 - protein, 663 aa, Klebsiella pneumoniae
KLRFAMSDDMSMVSPSSAGEHGVLRSMQEVAMSSQEASKMLRTYNIAWWGNNYYDVNELGHISVCPDPDVPEARVDLAELVKAREAQGQRLPALFCFPQILQHRLRSINAAFKRARESYGYNGDYFLVYPIKVNQHRRVIESLIHSGEPLGLEAGSKAELMAVLAHAGMTRSVIVCNGYKDREYIRLALVGEKMGHKVYLVIEKMSEIAIVLEEAERLNVVPRLGVRARLASQGSGKWQSSGGEKSKFGLAATQVLQLVEILREAGHLESLQLLHFHLGSQMANIRDIATGVRESARFYVELHKLGVNIQCFDVGGGLGVDYEGTRSQSDCSVNYGLNEYANNIIWAIGDACEENGLPHPTVITESGRAVTAHHTVLVSNIIGVERNEYTEATPPAEDAARPLQSMWETWLEMHETGNRRSLREWLHDSQMDLHDIHIGYSSGTFNLQERAWAEQLYLNMCHEVQKQLDPSNRAHRPIIDELQERMADKIYVNFSLFQSMPDAWGIDQLFPVMPLEGLNKSPERRAVLLDITCDSDGAIDHYVDGDGIATTMPMPEYDPENPPMLGFFMVGAYQEILGNMHNLFGDTEAVDVFVFPDGSVEVELSDEGDTVADMLQYVQLDPNTLLTQFRDQVKNTGLDDALQQQFLEEFEAGLYGYTYLEDE

SEQ ID NO: 11866 - protein, 83 aa, Klebsiella pneumoniae
GSVTMKTLPEALPDLPPTYSVDVKIDPRTPEGRKAMRLLDVPTAILVAALGLPPKHTRPDMYYSKGALCLMATAEGLTPMDFK

SEQ ID NO: 11867 - protein, 972 aa, Klebsiella pneumoniae
VETTTIHRTFQEPSLMTQTLSQLENRDAFIERHIGPDAQQQQEMLKTVGADSLNALIGQIVPQDIQLATPPQVGDATTEFAALAELKAIASRNKRFKSYIGMGYTAVQLPPVIQRNMLENPGWYTAYTPYQPEVSQGRLESLLNFQQVTLDLTGLDIASASLLDEATAAAEAMAMAKRVSKLKNANRFFVAADVHPQTLDVVRTRAETFGFDVIVDDADKVLDHQDVFGVLLQQVGTTGEIHDYSKLIAELKARKVIVSVAADFMALVLLTAPGKQGADIVFGSAQRFGVPMGYGGPHAAFFAAKDEFKRSMPGRIIGVSKDAAGNTALRMAMQTREQHIRREKANSNICTSQVLLANIASLYAVFHGPAGLKRIAGRIHRLTDILADGLQKKGLKLRHAHYFDTLCVEVADKAAVLARAEALQINLRSDIHGAVGITLDEATTREDVLNLFRAIVGDDHGLDIDTLDKDVALDSRSIPAAMLRDDAILTHPVFNRYHSETEMMRYMHALERKDLALNQAMIPLGSCTMKLNAAAEMIPITWPEFAELHPFCPVEQAEGYHQMIAQLSDWLVKLTGYDAVCMQPNSGAQGEYAGLLAIRHYHESRNEGHRDICLIPSSAHGTNPASAQMAGMQVVVVACDKNGNIDLADLREKAEQAGANLSCIMVTYPSTHGVYEETIREVCEIVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKQASQNAILNANYIATRLKDAYPVLYTGRDGRVAHECILDIRPLKEETGISELDIAKRLIDFGFHAPTMSFPVAGTLMVEPTESESKVELDRFIDAMLAIRAEIDRVKAGEWPLEDNPLVNAPHTQGELVGEWNHPYSRELAVFPAGLHNKYWPTVKRLDDVYGDRNLFCSCVPMSEYQ

SEQ ID NO: 11868 - protein, 199 aa, Klebsiella pneumoniae
PGGFVPGHFLFSGVVMAGEHVILLDEQDQPAGMLEKYAAHTFDTPLHLAFSCWLFNQQGQLLVTRRSLGKKAWPGVWTNSVCGHPQQGETFEQAVTRRCRFELGVEISDIAPVHPAFRYRAVAPNGIVENEVCPVYAARVVSEVQPNDDEVMDYQWVDLATMLSALAATPWAFSPWMVLEAENRDARQALTDFVARLRG

SEQ ID NO: 11869 - protein, 260 aa, Klebsiella pneumoniae
HGETTVKLKVLALAATLGLTTMAAQASELPDGPHIVTSGTASVAAVPDIATLAIEVNVSAKDAASAKKQADDRVAQYLSFLEKSGIAKKDINSANLRTQPDYDYQNGKSILKGYRAVRTVEVTLRQLDKLNGLLDGALKAGLNEIRSVSLGVAQPDAYKDKARKAAIDDAVHQAQELAAGFHSKLGPVYSVRYHVSNYQPSPMVRMMKAADAAPVSAQETYEQATIQFDDQVDVVFELQPAQAAAPATPAKPAETPKPAQ

SEQ ID NO: 11870 - protein, 448 aa, Klebsiella pneumoniae
FQRTRSRYGTSRIVKRGFCSAGAGIGQKTSRPRRAGLRIASGVAEGFLRGAGPAVLQHPADRDNQHGQHGGADQQCDGAAGEEVRQQRQLIGLHMTADQARRQVTQRAGAEPQPHHLAAHSLRRQQSHGRQPNRAEAQFTERQHQDAAHQPQRRHTGPAVAQDVLRRQHHQAKARRCAQDTNDEFGHTARTNVFTRQRRPRPAEYRREENDKQGVNRLEPDRGDLKIADHPVGVVVSKQVEGGRFLFKRGPEKGRRDQQNKAYQQARPLFTVESGEDEQPDEIERHGGGNHIDQHAGHRHRVNHDRAQADKRDQHRHSQSQRQQPRSNAILFRHRAVPGGIEANLRVIALHRRYGKDTENDQRHQHPDPPDAEAPVPAMRFDKPARDQWRDKRADVDPHVEQRKTTVAARVALFIQGADHHRDTGFKQPGTQDDKHQTDKEQIVAQPC

SEQ ID NO: 11871 - protein, 320 aa, Klebsiella pneumoniae
RRRTMIKLGIVMDPIATINIKKDTSFAMLLEAQRRGYELHYMEMNDLYLINGEARARTRTLSVEQNYDKWYDFTGEQDLPLADLDVILMRKDPPFDTEFIYATYILERAEEKGTLIVNKPQSLRDCNEKLFTAWFSELTPETLVTRNKAQLKAFWEKHGDIIMKPLDGMGGASIFRVKAGDPNLGVIAETLTELGSRYCMAQNYLPAIKDGDKRVLVVDGEPVPYCLARIPQGGETRGNLAAGGRGEARPLTESDWEIARRVGPTLKAKGLIFVGLDIIGDRLTEINVTSPTCVREIEAAFPDISITGMLMDAIERRIDK

SEQ ID NO: 11872 - protein, 343 aa, Klebsiella pneumoniae
SLMTTSRTSLLRKKWPLLALVLAAILALILVIWQLQTSPETNDAYVYADTIDVVPEVSGRIVEMPIRDNQRVRKGDLLFRIDTRPYQAMLDDAKARLTTLDAQIMLTQRTIKAQEYNAQSVAAAVERARALVKQTTSTRIRLEPLVPQGFASQEDLDQARTAEKAARAELEATLLQAKQASAAVTGVDAMVAQRAGVLAQIALAELHLEFTEVRAPFNGVVVALKTTVGQYASALKPVFTLLDDERWYVIANFRETDLDNVRPGVAARITVMINHNRTFNGVVDSVGSGVLPEGGSVIEGLPLIQKSINWVHVSQRFPVKIAVSDPDPELFRMGASASAVLQP

SEQ ID NO: 11873 - protein, 98 aa, Klebsiella pneumoniae; identical to SEQ ID NO: 9193

SEQ ID NO: 11874 - protein, 739 aa, Klebsiella pneumoniae
IRQTRTHRWARSPLSEVFTLPIRAFALMKSMHIAASCELVTRLSTHRRVVALDSTDFTDVAAVVISVADSRSGILTLLRRSGFNLPVYLLSETAVDKPEGVQAVIAGKDQEWLELEAAACDYEARLLPPFFNTLTQYVEMDNSTFACPGHQHGAFFKKHPAGRQFYDFFGENVFRADMCNADVKLGDLLIHEGSAKHAQKFAAKVFNADKTYFVLNGTSAANKVVTNALLTRGDLVLFDRNNHKSNHHGALIQAGATPVYLEAARNPFGFIGGIDERCFDEHYLRDLIREAAPEKANASRPFRLAVIQLGTYDGTVYNARQVVDKIGHLCDYILFDSAWVGYEQFIPMMADCSPLLLELTPDDPGIFVTQSVHKQQAGFSQTSQIHKKDNHLRGQARFCPHKRLNNAFMLHASTSPFYPLFAALDVNAKIHEGESGRRLWAECVALGIEARKAIIANCKMIQPFIPPTVAGRPWQDHPTEAIARERRFFSFEPGARWHGFEGYADDQYFVDPCKLLLTTPGIDAESGEYSEFGIPATILAHYLRENGIVPEKCDLNSILFLLTPAESAEKMAQLVAMLGQFEQHIEADTPLADVLPTIYNKYPVRYRDYTLRELCQEMHDLYVSFDVKSLQKEMFRKRSFPRVVMNPQDANHEFIRGNVELVRLSEAEGRVAAEGALPYPPGVLCVVPGEVWGGAVLRYFLALEEGINMLPGFSPELQGVYSETDPDGIKRLYGYVLKG

SEQ ID NO: 11875 - protein, 140 aa, Klebsiella pneumoniae
GGKTIKLNFAGCTLDAIVGHPEHEILFVANQVNKAAGLANQNIAHYIAKGVASGIRLRDLGDNLSCSGELREPSGRLMRDTTWLIDEPNTYKVLLRGHSTQSEPFRKWVTEEVLPTIRKTGKYYIAKSNLIIDNMSGTWN

SEQ ID NO: 11876 - protein, 106 aa, Klebsiella pneumoniae
CTAAGAVDGAMSAVETCADGLVLRLYIQPKASRDSIVGVHGDELKVAITAPPVDGQANAHLVKFLAKQFRVAKSQVLIEKGELGRHKQVKIIAPQQIPTAVAALTE

SEQ ID NO: 11877 - protein, 403 aa, Klebsiella pneumoniae
  UNSURE (344): Identity of amino acid at the above locations are unknown.
SRYFDAILSFTSLMLLLTAAENRKILQSMAENKRGLSAGLRPESGGGLFTAVAFLRRINFVQIAARFRRRMAGGQRLVDVPWRHAVDNIGRLHFIAGEDPQYAAGAAVIGSDHRVATRGGVIDAGEVNIVQHRQVGGTGVDIIRRVKQIAAAWQAGFTLGAEDVSAGAVLDHLHQPHGVGMADRIGVKGGFGLHNREDQRLINPILTRGLTHHAEVFMRTFVEVVRHQVNGDAIDHAQAVVAALQTGLQQIVGKARGAPLPANRRPGVIHHLAIEERLFGDLDVIDIGIEVNGVGVIAHQQSFDDRLAQTSARVGAGNGLDGDRPFIEVDVAAGLILVGVLDVXLWPGEQDFVVPPNVLDVVGELAHQNIESVRVLDPGLVVFGAFFIGAGTRNEQRRNQRER

SEQ ID NO: 11878 - protein, 545 aa, Klebsiella pneumoniae
SALAAPKADVGPPSCLFIDTSFDSVHQHTGDRNIREGGFDFAYAGGAGDVNFRQTVADDIQADEDKAFGLQRRADAAGDFPVAFGQRAGFAAAAGGQIAAGLATLRNSRQAVRHGLSIHYQHALVAIFNGRQIVLRHAVAAAQFGQRLGNHPKVWIAGFNTENRGAAHAVERFHDDIAVLFPEGFQLGFIAGDQRFRSQFREPGGEQLLVTVAQTLRLVDDKRAFLFRPLQDVGGINKFGIKRRILTHQDDVKVRQRQILLAGKVIPFIVVLFDAQRARPGAGFAVDQIEVVHLHIMEFIAATLRLQQHSEAGVFLDVDGCDGIHHDAELDHGSSPLTPQPKSPKRTCRAVMAVSAVVSVRRTRGPNRISVNWYCAVIAISSADSPPSGPISRRTRSTGSGSVLMLALARGCRLSFSPLSCSAHHASSCIAGRISGTTLRPLCSQAAIAIFCHCWIFFCKRSASSLTPQRSENSGVMRLTPSSIDFWMVNSIFSPRDITWPKWICSGDSRSSGSPLSTSTVTFFLPASVMTASNTWLLPSKSCRC

SEQ ID NO: 11879 - protein, 106 aa, Klebsiella pneumoniae
TVVAGLPDFFNCLCRSEMRIRIEARSLASRLESGSSNRKTSGFLTIARPTATRCAWPPESWRGRRSSSSSSSRIFAASSTCLSICAFGSLLSLRPKARFSRTVICG

SEQ ID NO: 11880 - protein, 649 aa, Klebsiella pneumoniae
PGDAMFPLAHFLRQELRDAPGRASYTLRLTLSCAVLITLFMTLQIPFLAVALIVVFYVSQPNVLMIKLVSVVFFVTVTVALGGVLLIIKWTYDYPLIRLAASVALFFCALYLMRVLGKLGLAFFVVALAVIYAQTFPSMTSQSEILVRLLLWLWVAINTAILVTLLVNACFQQAFPGNQFKARLAGMLHEVARRLAAPDAEAPPTFGETAAQFNQLQSLFAQASRATPEIAADPQAWRSRLAATLRCYQLAALLQADEADSDDRQQLSQAVLQLKNALSERPFDGAIPPLTLSGRGVNRAVLQEMATTLQRLAQGEPVALPQGEVEKAPLLAPDAWRNPAYLHFALKTLLATLICYVFYTAADWQGLHTIMLSCVIVAQPGLGATMQKTWLRIGGALLASLLALLLIVFVQPWTDSLTGLLAMSLPVLALAAWIAAGSERIAYAGIQIGFTFALAFLSWFAPLTNLTELRDRVLGILLGVLVSSIVHLYLWPDSEAPQLKTRLAALYRRLADCLAAPKEAVPLAPLLVAFTDSEALIHRVRAEPLGTYAHPWPQAKDWPMRATLAQAEEIARLSEGYRLNAAPGDPTLARCAEQLRRYAERIEQEATAPGEQLTADLTNPFGPALAAALAALPDWGPTPIATEQQAKTS

SEQ ID NO: 11881 - protein, 403 aa, Klebsiella pneumoniae
DRGADGGGAPVMSVLIVGGGMTGATLALAISRLTGGALPVHLIEAQDPHSSRHPGFDDRAIALAAGTCQQLARIGIWQRLAERATPIQRVHVSDRGHAGFVNLAAADYGLSALGQVVELHDVGQRLFGLLREAPGVTLHCPAKVEAVSRSQESVSLTLEGGKIINGKLLVAADGSRSALGARCGISWQQQPYEQIAIIANVSTALPHEGRAFERFTEHGPLAMLPMSQGRCSLVWCHPQSRRDEVQSWSDERFCQELQQAFGWRLGRITHAGKRSVYPLALTTASRAVSHRLALVGNAAQTLHPIAGQGFNLGLRDVMSLAELLADAHLSGEDVGHYPLLCRYQARRAGDKAATIGVTDGLVHLFANRWAPLVAGRNVGLMAMELFTPARDALAQRTLGWVPR

SEQ ID NO: 11882 - protein, 143 aa, Klebsiella pneumoniae
ITRAGRRYYSRLRRIIFVGAGTSGALAKYGARFFSNVGKFSNHIDDPYFPVTNDMARNALAIVLSVSGETEEILRFASQFSLHHCKVMSITSHEHSRLAKLADFNLSWHVPQTRIGGVYDITTQIPVIYILESLGRKLARKIS

SEQ ID NO: 11883 - protein, 254 aa, Klebsiella pneumoniae
LHPAPSFATLRARFDTELTMSRMHVLAVAVLSAAVSGPLAAAGINSFSQAKAAGVKVNADVPGDFYCGCKIDWQGKKGVIDLESCGYKVRKNENRASRVEWEHVVPAWQFGHQRQCWQEGGRKNCAKDPEYRKMESDMHNLQPAVGEVNGDRGNFMYSQWNGGEGQYGQCTMKVDFKDKIAEPPARARGAIARTYFYMRDRYQLNLSRQQTQLFTAWNKQYPVTAWECERDERIAKVQGNHNPYVQQACQAQKS

SEQ ID NO: 11884 - protein, 573 aa, Klebsiella pneumoniae
CLAALRLHRPTVLRHCVARIRRLRRHPGSPACAALSQATPALGPHIRHKKTRQAGFFAFREGRLFLRTHRREQNNVADGVAVGEQHDHTVDTDTQTSGRRQAVFQRGDIVFVIEHCFVVACGFRINLILEALRLVFGVVQLAKAVTDLTAANEEFKAVGDFRVDVVTARQRRNFRRVFGDEGRLDQVRFRHFFEDLGHDTAQTPALLHFDADRFSDRFRGIKVIQIRHLGFRTVFLDRFAHGQFFKRLAEVEHLVAVRHFGIAEDVLRQGAEQRFGQLDQIFVIRISHVEFHHGELWVMTNGDPFVTEVTVDLEDAFEAANHQTLEVQFRRDTQVHVQIQRVMMGDERTRGSAARDHLHHRGFYFHKAAANHELTDARQDLRTHFEGLTRFIVGNQVQVTLTVTRFLILQAVEFVRQRAQSFSQQTQLGAVDRELTGFGLEQLTAGGDDVAEVPLFELVVINAFRQVITRHVQLDAAAYVLQGHEGRFTHDTTGHHAASNGHFNVQRFQLFVFFAIEVSVQLVRGMVTTEIVRECDALLTQRSQLLATGFQFIIKVNCRVSALCLLFRHVGSS

SEQ ID NO: 11885 - protein, 124 aa, Klebsiella pneumoniae
IFEAIMIKRQRKAILFVLLACLVVLTCTAQRMAGMHALVMNLTADSPSLQQNQDQAEAPVTPCELSAKSLMAVPPMLFEGALLAITLLLAVLAAIPPRIERQWPPRVISPPRLRVHLRLCIFRE

SEQ ID NO: 11886 - protein, 217 aa, Klebsiella pneumoniae
VINLNGNSSSSRQVTFITHPSIQSKAFASYLSETLMAPVVLQNINKPLAQRLAKDSVILFDIAVSNKKLNGVWRDIIRLQADNPRLLIINSAQKYELYEMAQWPALYGVFRHDDDESRLIEGVKAVLNGEQTAELSVMHPAMYAADHASTPVENSPLTERECEILNELRCGATNLDIARALFISENTVRTHLYNVFRKLSVKNRTQAVSWANEHLRH

SEQ ID NO: 11887 - protein, 76 aa, Klebsiella pneumoniae
FHTYWSLSFPLSYASLVNSCREAFDFSYSNSNILIGLIRCFYERLMLLTIFAARLICINLEFDIVFPVIKSFEFWS

SEQ ID NO: 11888 - protein, 294 aa, Klebsiella pneumoniae
TCNYSIFSNHISAEPAIRRQRHRYSFRTSSHHTRLYYHKNQIWQNLKPQNTRLTQNTDHLSQRVKMAPIVSSVGRKLCRAGSWTTRLKSEMPGRHNGCQSGSLFRHRSKENSMKIKTLAMIVVSALSLSSTAALADTTTVNGGTVHFKGEVVNAACAVDAGSIDQTVQLGQVRSAKLATAGSTSSAVGFNIQLDDCDTTVATKASVAFAGTAIDSSNTTVLALQNSAAGSATNVGVQILDNTGTPLALDGATFSAATTLNDGPNIIPFQARYYATGAATAGIANADATFKVQYE

SEQ ID NO: 11889 - protein, 467 aa, Klebsiella pneumoniae
LQVLTVAGDDLFVPVKALLARAGHVAGAIVVFVDVDEAVAFAVLPGGEGDAVDAAPWGIAQQIDAVISDRFDHLFDVGAQVVDAVVIVDAAVGFYFVVGAKAVFHDKQRLLITLIQFTQRIAQADRVNLPAPVGGFDVRVRHAAFETGNGVASAALGFHRVGHVVAEAEIGAGTFAQDLRVAVFHPDVEAAAFPFIQHIARVVTAQLDVGKDVALAHRLLGEHDIFRFAGVRVEGDHRQHAADLHVRVDAPRRFHRQRAGHELVVQHLVHGLFRIVMLGIDHPGAAVAEQRRAPVALVIDLVKGHPVFHFVHIALEDHFGEAYKEIDHFAVGPAAVLLHQVQGHLEVGEGDHRLDVVFQQLVEHVVVELQSLFIRLGFVTLREDAGPGDRGAEAFEAHLGEQFDVFFVATVEVDGFVVRVVFSRFDLMGDFARHAVRPAGQHIADAGAFAALIPAAFNLMRGDRATP

SEQ ID NO: 11890 - protein, 314 aa, Klebsiella pneumoniae
RHLYLRLSQESIMMKKIIPLFTTLLLLGWSMNAWSFACKTATGATIPIGGGSANVYVNLTPAVNVGQNLVVDLSTQIFCHNDYPETITDYVTLQRGSAYGGVLSSFSGTVKYNGTSYPFPTTTETARVIYDSRTDKPWPAVLYLTPVSTAGGVAITAGSLIAVLILHQTNNYNSDSFQFIWNIYANNDVVVPTGGCDVSARDVTVTLPDYPGSMAVPLTVHCAQSQQLGYYLSGTTADSANAIFTNTASASPAQGIGVQLTRNGSAVPANSTVSLGTVGTSPVNLGLTATYARTTGQVTAGNVQSIIGITFVYQ

SEQ ID NO: 11891 - protein, 84 aa, Klebsiella pneumoniae
RTAYGATKKDQYTCAKTYILIHVCDEHPGFCAPPSLLISTEKCRVFFYPSSKYVRLEIPLDCQGFQDEYDLCGCFNVYKTARRG

SEQ ID NO: 11892 - protein, 155 aa, Klebsiella pneumoniae
TDWYRHCDDARRRGACVMSGTFLGFDFGTKSIGVAVGQRITATARPLPALKAQDGKPDWNVIEKLLKEWQPEAVIVGLPLNMDGTEQPLTARARNFANKIHGRFGVAILLHDERLSTVEARAGLFEHGGYRALNKGSVDSASAVVILESYFEQSF

SEQ ID NO: 11893 - protein, 447 aa, Klebsiella pneumoniae
KIYLNIYDFSNVIGGGTMLLAGTIFILTLVLVIWQPRGLGIGWSAAFGAALALATGGVQVADIPVVWHIVWNATATFIAVIIISLLLDESGFFEWAALHVSRWGRGRGRLLFTWIILLGAAVAALFANDGAALILTPIVIAMLRALGFSKGTMLAFVMAAGFIADTASLPLVVSNLVNIVSADFFAIGFREYASVMVPVDLAAILTTLAMLHLFFRKDIPPAWDMALLKAPATAIKDPATFRTGWGVLLLLLAGFFVLEPLGIPVSAIAALGAGILFAVAKRGRVINTGKVLRGAPWQIVIFSLGMYLVVYGLRNAGLTDYLTTVLNMLAERGLWAATLGTGVLSAFLSSIMNNMPSVLVGALSIDGSAATGTIKEAMIYANVIGCDLGPKITPIGSLATLLWLHVLAQKHITIGWGYYFRCGITMTLPVLLVTLAALALRLSFNQP

SEQ ID NO: 11894 - protein, 340 aa, Klebsiella pneumoniae
AIYLSNPSSSGLTTRRGFFILIFYVPRLSKEVISMSTLGHQYDNSLVSNAFGFLRLPMNFMPYESDADWVITGVPFDMATSGRAGGRHGPAAIRQVSTNLAWEHNRFPWNFDMRERLNVVDCGDLVYAFGDAREMSEKLQAHAEKLLAAGKRMLSFGGDHFVTLPLLRAHAKHFGKMALVHFDAHTDTYANGCEFDHGTMFYTAPNEGLIDPNHSVQIGIRTEFDKDNGFTVLDAGQVNDRSVDDVIAQVKQIVGDMPVYLTFDIDCLDPAFAPGTGTPVIGGLTSDRAIKLVRGLKDLNIVGMDVVEVAPAYDQSEITALAAATLALEMLYIQAAKKGE

SEQ ID NO: 11895 - protein, 285 aa, Klebsiella pneumoniae
MEDLNVVDSINHAGTWLARNQELLLSYAVNIVAAIAILIVGMIVARVVSNTVNRLMLARKIDATVADFLSALVRYAVIAFTLIAALGRVGVQTASVIAVLGAAGLAVGLALQGSLSNLAAGVLLVMFRPFRAGEYVDLGGVAGTVLNVQIFSTTLRTADGKVVVVPNGKIIAGNIINFSREPARRNEFIIGVAYDADIDKVKQLLTSIIESDDRILRDREMTVRLNELGASSVNFVVRVWSKSSDLQNVYWDILERIKREFDANGISFPYPQMDVHVVRLPEKAE

SEQ ID NO: 11896 - protein, 141 aa, Klebsiella pneumoniae
GLYLRTRVAIVSPLRRPGPGCEGSAVNQQEGGMSAQPVDLQIFGRSLRVNCPPEQRDALNQAAEDLNQRLQDLKERTRVTNTEQLVFIAALNISYELTQEKAKTRDYASSMEQRIRMLQQTIEQALLEQGRISEKPGSKFE

SEQ ID NO: 11897 - protein, 252 aa, Klebsiella pneumoniae
RHIHLEPRVQGLQPAAASRRFPSLLRIIPHTCFRLKPPCITLAPIVSPARNETCMTIQPDTLLSRQHIRQQIRDRRRALSPEQQRLFAQQAAERMMAWPPVVLAHNVALFLSFDGELDTQPLIDQLWRAGKRVYLPVLHPFSPGNLLFLHYHPQSQLIVNRLKIREPKLDVRDVLPLAELDVLVTPLVAFDVSGQRLGMGGGFYDRTLQNWQQYRLQPVGYAHDCQQVDSLPSEEWDIPLPAVITPGKTWCW

SEQ ID NO: 11898 - protein, 248 aa, Klebsiella pneumoniae
CGYQGFLTGVSVVTGPFINASAVLVGGVLGALLSQRLPERIRTAMTSIFGLASLGIGILLVIKCANLPVMVLSTLVGTLLGEICNMEKGINTLVSKLQQLMSAKGKKKASAHESYIQSYVAIIVLFCASGTGVFGAMREGMTGDASILIAKAFLDFFTATIFACTLGIAVAAISVPMLLIQLTLAACAAIIMPLTTPMMLADFSAVGGMLLVATGLRICGIKMFAVVNMLPALVLAMPISAAWTLFFA

SEQ ID NO: 11899 - protein, 68 aa, Klebsiella pneumoniae
QGNHQMILTTDPLIHHKGILWAKRQYHSRSQGKPLKVISKHKDLSAEFESGADYSANELLAEIERINH

SEQ ID NO: 11900 - protein, 158 aa, Klebsiella pneumoniae
SRRQSARSDGCPSLSRCAPATPARRTRPPGSVLAQSPVSPGAPDGPRSAPGRGSTGHNSGRCRWPLHLRGKESTDRRRRRWPADPGQSRRPGAPSRRTPAPGDHSQRQSRYAYGSRPAAADSDASLPAPPAGGCTRCHACYSHRRYWFSGCGRGQSPG

SEQ ID NO: 11901 - protein, 326 aa, Klebsiella pneumoniae
RRGQRCSPSTEPGRHPLSGRSLSAALPHRRDGAKHAASQRPSSGVDALTIRPADRKGANMKNVIAAAALSLVLSDFTYAHEQRDEAMMKITPSTLADADIQAVSPALARFGREAISNDLWQRDTLSARDRSIVTVAMLIARNQPGELKHYIAVALDSGVTPAEVSEIITHLAFYAGWPNAMSAVSVAKAIFEARGVTAEALPAASPTLLPLNEQVEKQRADTVEKNVGPISPGLVKFTADPLFLDLWQRPALTPRDRSLVTVSALIAAGQSAQIGYHLNRAMDNGLSAEEAGEVVAQAAFYAGWPNAFTAAPVVGEVLRSRESKTE

SEQ ID NO: 11902 - protein, 514 aa, Klebsiella pneumoniae
CPSQNPSCQQYSPYLWLILPDPFIHQSRTFVLCLTLCGRKKMTSISNDSTLSPRTQRDTRRMNWFVSIAAAVAGLLFGLDIGVISGALPFITDHFTLSSQLQEWVVSSMMLGAAIGALFNGWLSFRLGRKYSLMAGAVLFVAGSIGSAFAASVEVLLVARVVLGVAVGIASYTAPLYLSEMASENVRGKMISMYQLMVTLGIVLAFLSDTAFSYSGNWRAMLGVLALPAVILIILVVFLPNSPRWLAEKGRHIEAEEVLRMLRDTSEKARDELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDAIGAAGTFWLYTALNVAFIGITFWLIPETKNVTLEHIERNLMAGEKLRNIGNR

SEQ ID NO: 11903 - protein, 79 aa, Klebsiella pneumoniae
GDGLNTTSLAQLVLLVLLSTHGSLSVQPSATLCLRPAVPTRSLLWAWLLADTLMYLIVKSLGSNQRQTTGNIVCISFGP

SEQ ID NO: 11904 - protein, 155 aa, Klebsiella pneumoniae
LAMQQTPHQRKTLTERVIHAITFEGLATLILAPTAAWLMQRSVVEMGGLSILLATLAMVWNIIYNAAFDRLWPVSRFPRQLKVRALHALGFETGFVIIGVTMVAIVLGVSLLQAFMLEIGFMLFFLPYTMAFNWVWDTLRERVIRHRRPRQTARG

SEQ ID NO: 11905 - protein, 66 aa, Klebsiella pneumoniae
NSAQNGAGCSSRHAVLNLLYGRLSRYVAPGLLTIFSLSAISPLSSLFPLLFLPLYTASAPVVYVSR

SEQ ID NO: 11906 - protein, 304 aa, Klebsiella pneumoniae
LWGHARIMKRPDYRTLQALDAVIRERGFERAAQKLCITQSAVSQRIKQLENMFGQPLLVRTVPPRPTEQGQKLLALLRQVELLEEEWLGDEQTGSTPLLLSLAVNADSLATWLLPALANVLSDSPIRLNLQVEDETRTQERLRRGEVVGAVSIQPQALPSCLVDQLGALDYLFVASKEFAQRYFPNGVTRSALLKAPVVAFDHLDDMHQAFLQQNFDLPPGSVPCHIVNSSEAFVQLARQGTTCCMIPHLQIEKELNSGELIDLTPGLFQRRMLYWHRFAPESRMMRRVTDALIDYGHKVLRQD

SEQ ID NO: 11907 - protein, 219 aa, Klebsiella pneumoniae
RTINTGGGMKGLPKNTIAWLLFCGSLAAPSAWGFETNYDRGRVDFAGRVTDISCSVALNGGQHAGSGNVWLAPVSLAEVHDRGAGAFMKPQPFTLALSNCQLRHDGGAASQDEVRRVSVRWVDGFLLTAVGNENAGYLANTLPDGAQNIYLALSTNDNNTLDKSNKIVPADPQQNQVRLQESAVSGGLFTYYVGYVSPTPKSATSGPITSWAMWELVYN

SEQ ID NO: 11908 - protein, 334 aa, Klebsiella pneumoniae
QTNKKYRFIATLCKNDMVPAEPHGDRMPAVNLRHIEIFHAVMTTGNLTEAARMLHTSQPTVSRELARFEKVLGLQLFERTRGRLQPTVQGLRLFEEVQRSWYGLDRIVSAAESLREFRQGELSIACLPVFSQSFLPLLLPPFLSRYPEVSLQIVPQESPLLEEWLSAQRHDLGLTETLHTPAGTERTPLLTLNEVCVLPAGHPLAAQATLTPADFHGENYISLSRTDSYRQLLDALFLEHQVKRRMVVETHSAASICAMVRAGAGISVVNPLTALDYADSGVVVRRFSVEVPFTVSLIRPLHRPRSALVDAFVAHLQQSLPQILTPLASVLQRA

SEQ ID NO: 11909 - protein, 891 aa, Klebsiella pneumoniae
RVILQRPFAGFDAVDFRADRQHRVDKAVQLDLAFRFRRLNHQRPRYRERHGRGMEAKVDQALGDIQLANAGLFFQRTNIENTFVRYATIATGVEHRVGVFQSGSDVVGVKDRVLARLLQPFRAHHADIHPADRQNGRAAERRGGNRALAGQHTFNLYHAVARHERRQVRFYADWAHARAAAAVRNAERFMQVEVRNVGADKARRGDPDLGVHVGAVEINLAAKLVHDLAHFANGLFIHAVGRRIGDHDAGEIGPRLLCFFTQIGEIDVAVFITGNDHYLHTRHLRGSRVGAVRGARDQADIAMAFVAALVIMANRQQASILALRAGVRLHTDGVIAGQFHQPVGKLGDHLMITFRLLDRAERMQLSEFRPGDRDHLRRGVQFHGAGAQRDHRLVQRQIFTLQGVHVAHHLGFAMVAVKHRMGEDRIVAQHRRRDRTAIQRHVFIQGIDIQTVIVADDGAEQVQHIFAGGRFIERNAHRAVNIAAQVNLQGFGTRQHRGFIRHFDAQGVEVVGMAQLQPFLLQAVGQNVGQTMNAASDTFQARRAVEYRVQAGDVGQQNLRSTNVGVRFLTADVLLASLHRHAQRGIPRRIFRYADNPARHGAFEFIFRREEGRVRAAVAHRHAEALGGTENDIRALLARRRQQHQRHKVGGDADNHFARFQLGDKFTVIVDFAGGAHLLQQHAKDILVIEHFVGVIDDDVEAESFRAGANHVQGLRMDIGGNEEAVGVLQFTDAFGHRHRFGGGGGFIKQRSGSDIQPGQIQSDLLEVEQRLQTALGYFRLVRGIGGIPARVFQHVALNDRRQLHGGIAHADVRLEALVATGNRLQLRQRGEFGSRVAHLRWGRQLDILRHNLADQGVKRIRADGLQHLLLLLSVRANVTFNKGVAVFKLT

SEQ ID NO: 11910 - protein, 403 aa, Klebsiella pneumoniae
VQAKENVCVGVRQRCRRRISWRKIADNFVAGSVLFDEEKMAQQTPLYEQHTLCGARMVDFHGWMMPLHYGSQIDEHHAVRGDAGMFDVSHMTIVDFHGSRIREFLRYLLANDVAKLTTPGKALYTGMLTASAGVIDDLIVYFLSEDYFRLVVNSATREKDLAWISEQAEPYGLEITVRDDLSLIAVQGPQAKAKAATLFTDAQRQAVEGMKPFFGVQAGDLFIATTGYTGEAGYELAMPNEQAADFWRGLLDAGVKPCGLGARDTLRLEAGMNLYGQEMDEGVSPLAANMGWTIAWEPADRNFIGREALEMQREKGTEQLVGLVMTEKGVLRGGLPVRFTDSDGNQKEGIITSGTFSPTLGYSIALARVPAGIGDTAVVQIRNREMPVKVTKPGFVRNGKAIV

SEQ ID NO: 11911 - protein, 487 aa, Klebsiella pneumoniae
TINKPPTLSEEPMTTVRMTIPDDFILGAAASAWQTEGWSGKKPGQDSWPDLWYKNDRHVWHNGYGPAVATDFINRFQEDVQLMKLAGLTHYRTSINWSRFLTDYENVTVDEEYAAYYDQLFDALLANGITPMICLEHYELPGYLLEKYGGWGSKTVVELFVRYAEKVFARYHPKVTRWFTFNEPIVVQTRVYLDALRWPYEQNTSTWMQWNYHKVLATASVVKRFRELGYPGTVGCILNPEVTYPRSRAPHDLRAAEIYDLFYNRMFLDPLVHGVWPPELLALLEQHQVTWETSEEDLAVIREHTVDELGINLYYPHRVKAPSRAWHPHTPFHPAWYYEPFELPGRRMNASRGWEIYPQIIFDMAMRIKNDYRNIPWFVAESGMGVENEGQFRNREGVIDDSYRIRFISEHLWHTLRAREAGANCQGYMLWAFTDNVSPMNAFKNRYGLIEIDLQNHRARRAKASAHWFRQLGERRELVLDIDDEYR

SEQ ID NO: 11912 - protein, 249 aa, Klebsiella pneumoniae
SADKQDNTVSRQGDNVRKTATMAHGLLAGCVLFAASIFSASAQAGVALGATRVIYPAGQKQVQLAVTNNDDNSTWLIQSWVENADGQRDGRFVITPPLFAMQGKKENTLRIIDATNNQLPQDRESLFWMNVKAIPSMDKSKLSDNTLQLAIISRIKLYYRPGKLALPPDQAAEKLTFSRSGSSLTLTNPTPYYLTVTELNAGTRILENALVPPMGKTSVKLPADAGNTITYRTINDYGALTPKMNGVLR

SEQ ID NO: 11913 - protein, 61 aa, Klebsiella pneumoniae
PFLKYSNLLNPKGYGFKPSDSFTHCNQHCNPVATKLRPYVDKVSGPRVSVHAQFLHLPLPA

SEQ ID NO: 11914 - protein, 119 aa, Klebsiella pneumoniae
LVSKPHAEGAARLPQNSSHAIVFFGNPFIPPPVLIVRQVKDHMRLHLAGAGRRAILIKTRVQRYGDVAGLLIIQAADGVFLIKLQRGAILQHLGNDSNLLIVFYVQIMPDDFVMQLHRF

SEQ ID NO: 11915 - protein, 141 aa, Klebsiella pneumoniae
GESNYMAISYRKLDINLSSDKETVLVFGQEMSTKYFTEIVVTSMLNGLPALSAGAHAILTSLHAAGLNANDYGAYSRAWSESNAEARREAERQRIENEKDRQRIAAMYATPEEIAKEAAERKERKADLERRFSRKGAAFGL

SEQ ID NO: 11916 - protein, 400 aa, Klebsiella pneumoniae
TSTKLYESTRGFTMSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVEVAAGELVVLENVRFNKGEKKDDEELSKKYAALCDVFVMDAFGTAHRAQASTHGIGKFADVACAGPLLAAELDALGKALKEPARPMVAIVGGSKVSTKLTVLDSLSKIADQLIVGGGIANTFVAAQGHNVGKSLYEADLVDEAKRLLGTCDIPVPTDVRVATEFSETATATRKSVNDIKDDEQILDLGDVSAQKLAEILKNAKTILWNGPVGVFEFPNFRKGTEIVANAIADSEGFSIAGGGDTLAAIDLFGIADKISYISTGGGAFLEFVEGKVLPAVAMLEERAKQ

SEQ ID NO: 11917 - protein, 385 aa, Klebsiella pneumoniae
NMAKHLFTSESVSEGHPDKIADQISDAVLDAILEQDPKARVACETYVKTGMVLVGGEITTSAWVDIEEITRNTVREIGYVHSDMGFDANSCAVLSAIGKQSPDINQGVDRADPLEQGAGDQGLMFGYATNETDVLMPAPVTYAHRLVQRQAEVRKNGTLPWLRPDAKSQVTFQYDDGKIVGIDAVVLSTQHAEDIDQKSLQEAVMEEIIKPILPTEWLNASTKFFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPSEQLTLLVREFFDLRPYGLIQMLDLLHPIYKETAAYGHFGREHFPWEKTDKAALLREAAGLK

SEQ ID NO: 11918 - protein, 356 aa, Klebsiella pneumoniae
AYKKEGNTMNYRNIFITLAALSGTVTASAWSAESATVAFLMPDQASTRYEQHDFPGFKAEMSKLCADCKVIYQNANANASLQQQQFNSVIAQGAKVIVLDPVDSSAAAALVENAQAQGVKVIAYDRPVPDKPADFYVSFDNEGIGYAIAKSLTDHLKASGVPQDAGVLQINGSPTDAAAGLIRDGIHRGLKESGYKTLAEFDTPEWAPPKAQEWTAGQVTRFGDKIKGVVAANDGTGGGAIAAFKAAGVQPLPPVTGNDATIAALQLIIAGDQYNTISKPSEIVAAAAAKVAVDFIQGKKPQASTTLYNTPSQLFTPEVVTAKNIKAEIFDKKIQTWDQVCSGEYAAACQKLGISK

SEQ ID NO: 11919 - protein, 200 aa, Klebsiella pneumoniae
PCLKAYPGGKMQPYFHWINEPAEWRRDSDGLTVVTNKHTDFWRHTWYGFERFSGHLYAAEVAGDFTLQAKICADFTTLYDQAGLMMMADEQTWLKAGIEFNDDAPAIGSVLTLTHSDWATGLFPGDPRTFWLRLTRKGDALRLQYSTDGERWPLLRLGYFPPGPVKAGVMCCSPERGGLAVAFQDIQLSPPLDKALHDLS

SEQ ID NO: 11920 - protein, 298 aa, Klebsiella pneumoniae
VCMNENKLLGLAWISPYIIGLIVFTAFPFVSSFFLSFTEYDLMSPPVFNGIENYRYMLTEDSLFWKSMGVTFAYVFLTIPLKLAFALGIAFVLNFKLRGIGFFRTAYYIPSILGSSVAIAVLWRALFAIDGLLNSFLAVFGIDAINWLGEPSLALMSVTLLRVWQFGSAMVIFLAALQNVPQSQYEAAMIDGASKWQMFMKVTVPLITPVIFFNFIMQTTQAFQEFTGPYVITGGGPTYYTYLFSLYIYDTAFKYFDMGYGAALGVGAVLVVAVFASIAFKSSKYWVFYSADKGGKNG

SEQ ID NO: 11921 - protein, 401 aa, Klebsiella pneumoniae
RCSKSALSSNSVQAGKPACFSARLRAREPSSTVEDTDTGLSNMSKIFDFVKPGVITGDDVQKVFQVAKENNFALPAVNCVGTDSINAVLEAAAKVRSPVIVQFSNGGAAFIAGKGVKTDVPQGAAILGAISGAHHVHQMAEHYGVPVILHTDHCAKKLLPWIDGLLDAGEKHFAATGKPLFSSHMIDLSEESLHENIEICSKYLARMAKMGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSSAQEIKDSVSYGVVKMNIDTDTQWATWDGILQYYKANEAYLQGQLGNPKGEDQPNKKYYDPRVWLRAAQTSMVTRLEQAFKELNAIDVL

SEQ ID NO: 11922 - protein, 218 aa, Klebsiella pneumoniae
PAQNREDTAGPDLRSQAQKENLTTLDSILLYTNDNLIGHSIYHYLIDSHENATRLSYADVIHEKHLPLAQTIIFNLINKDISAIRIVDLLNALRLSLLRCQQPVLMVKSDIVGLCRELINFDNAMIISEKSPLTLFSSIVQRAKGVSELPPRGLRKQLSPRECQILELLIANNNNKRIAALLGIAHKTVHSHRIHIMQKLGIDNSRTMNQRIAALHQC

SEQ ID NO: 11923 - protein, 126 aa, Klebsiella pneumoniae
LARKNAAFSFIHHRNMSGWRSHWIARAFRMSTIYVVVLTYIKPLEEVDRAIPAHIEWLKKGYADGLFLASGRRIPRTGGVILAKCDSRETLQARLSQDPFQQLGLARTEIIPFEASMASPALQSLL

SEQ ID NO: 11924 - protein, 109 aa, Klebsiella pneumoniae
PGRNYIMQANDITFFQRFQDDILAGRKTITIRDAAESHFKPGDVLRVGRYEDDGYFCTIAVTATSTVTLDTLTEQHAQQENMTLGQLRQVISDIYPGESQFYVIEFKTL

SEQ ID NO: 11925 - protein, 170 aa, Klebsiella pneumoniae
AEAEMKWTHVGWLLAGLLTASASLRAADVTLTVNGKVVARPCTVSTVNATVELGDLYTFSLIGAGSASAWHSVALDLSNCPVGTSRVKATFSGTADSTGYYKNQGTAGNIQLELQNEDGTTLNNGSSQSVQVDEASQSARFPLQVRALSVNGGATQGTIQAVINVTYTYA

SEQ ID NO: 11926 - protein, 174 aa, Klebsiella pneumoniae; identical to SEQ ID NO: 9228

SEQ ID NO: 11927 - protein, 232 aa, Klebsiella pneumoniae
VGNESVLVFTESSMVRKPLITQGYSLAEEVANSISHGIGLVFGIVGLVLLLVQAADTNASATAIASYSLYGGSMIMLFLASTLYHAIPHQRAKQWLKKFDHCAIYLLIAGTYTPFLLVGLNSPLAKGLMIVIWSLALLGILFKLTIAHRFKILSLVTYLTMGWLSLIVVYQLAVKLAVGGVTLLAVGGVVYSLGVIFYVCKRIPYNHAIWHGFVLGGSVCHFLAIYLYIGQS

SEQ ID NO: 11928 - protein, 262 aa, Klebsiella pneumoniae
RTGDFVEKAIVPPEKKPYQEIGDDLRAQIAQGRYPVGSRLPPERHIAETYGVSRTIVREALLMLELQGTVDIRQGSGVYVMRIPHENDSEEEQLLSSDVGPFEILQARQLLESNIAAFAAKMATRADIDNLKRIIEQEQRAIALNDTAQDNARLFHLVLAGATQNQMLLATVERIWLQMDSSPLWQQFNVHIASRAWRLKWLGDRQTLLAALRRRDVMGAWQAMWQHLENVKNSLLELSDEDAPDFDGYLFDSVPIFQGKLV

SEQ ID NO: 11929 - protein, 194 aa, Klebsiella pneumoniae
TRNEPLTMNLQHHFLIAMPALQDPIFRRSVVYICEYNDEGAMGIIINKPLENLQVEGILEKLKIVPEPRNPEIRLDKPVMLGGPLAEDRGFILHTPPSDFSSSIRISDNTVITTSRDVLETLGTDRQPGNVLVALGYSSWEKGQLEQEILDNAWLTAPADQNILFRTPIADRWREAAKLIGIDIVTMPGVAGHA

SEQ ID NO: 11930 - protein, 67 aa, Klebsiella pneumoniae
MNRERDWVAIFADSMKSITADLPQIDRHLPIAGFDAAGARHYQALKTHAAPRQRDVPMITGQRQRRQ

SEQ ID NO: 11931 - protein, 495 aa, Klebsiella pneumoniae
TGGDEDQLRLAGAIFQHITAAGHVRQLLCGTLLLRQVLTGEDQRGRAVLTLHAIFPRNRGFHLVTRTPGGHVRGHAQGSHLLYRLVSRAVFAQTDGVVGVDHHLTLFHQRGHTYRVTRVFHEHQEGGGVRQEAAVQRDTVGDSGHTELAHAVVDVVPGSVFVDRLRARPQGQVGRREICGAAEEFRQQRAESFDGVLRGFTAGDFRRVGLQLRDELVSFRVEVRRHLAFHTAGEFGCFLREGFGVSRKLLVPCGFFRLAGFFGIPLGIDVRRDVKRRVFPAQRFAGQGDFGVAQRRAVGVVGTGFVRRTETDDGFAHQQGRFVGDRPCFFYRAFDGVSVVTVHAAHHVPAVGFKAFGGVVGEPAFNVAVDGDAVVIIERHQFTQFQGTGQGAHFVRNAFHHAAVAHEGVGVVVDDIVSRTVELRRQGFLGDSHPDRVSDTLAQRTGGGFHACGVADFRVTRGFGVQLAEVFQLFNRQIVASEVQQAVNQHRTMAI

SEQ ID NO: 11932 - protein, 344 aa, Klebsiella pneumoniae
LYSLYSAAMAEEKMASLKDVAKLANVSLMTVSRALNTPERLKPETLARVQAAIAETNYVPDLSAKKIRGARATPSTIGVLALDTVTTPFSVEITLSIEETARAHGWNSFVVNMFSDDRPEAVVDLLLSHRPDGIIFTTMGLRQVPLPEKLLTLPCVLANCESLSQPVACYIPDDEQGQYDAVKALLAAGYRRPLCLHLPASQPATIRRRRGLERACREAGIEPDHLSHSYMGQGDEHYHDIPAVVLAHIREGKPGFDSVICGNDRIAFMVYQTLLGQGLRIPQDVAVVGYDNMVGIGDLFLPPLSTVQLPHYDIGRLSALHIIHGDNHRETRKVASPWLPRASH

SEQ ID NO: 11933 - protein, 476 aa, Klebsiella pneumoniae
PSTESITQLEGVMPDNKKQGRSNKTMTFFVCFLAALAGLLFGLDIGVIAGALPFIANEFQISAHTQEWVVSSMMFGAAVGAVGSGWLSFKLGRKKSLMIGAILFVAGSLFSAAAPNVEILLVSRVLLGLAVGVASYTAPLYLSEIAPEKIRGSMISMYQLMITIGILGAYLSDTAFSYSGAWRWMLGVIIIPAVLLLIGVIFLPDSPRWFAAKRRFVDAERVLLRLRDTSAEAKRELDEIRESLKVKQSGWSLFKDNSNFRRAVFLGILLQVMQQFTGMNVIMYYAPKIFELAGYANTTEQMWGTVIVGLTNVLATFIAIGLVDRWGRKPTLILGFIVMAAGMGVLGTMMHIGIHSSTAQYIAVLMLLMFIVGFAMSAGPLIWVLCSEIQPLKGRDFGITCSTATNWIANMIVGATFLTMLNSLGSANTFWVYGGLNVLFILLTLWLIPETKNVSLEHIERNLMQGRPLREIGARD

SEQ ID NO: 11934 - protein, 83 aa, Klebsiella pneumoniae
IKKDTNSREFINHQGNLQTETLFHENHPIPTNSINRMTQSCQKIIKLFSWKCVFTVDISNLNVLFEFIIKSYLYYQIILINNK

SEQ ID NO: 11935 - protein, 333 aa, Klebsiella pneumoniae
AIQDMTMAFTPFPPRQPSSSARLPLTLMTLDDWALATISGPDSEKYLQGQITADVSHLTDAQHLLAAHCDAKGKMWSNLRVFRREGGFAWIERRSLRDAQLTELKKYAVFSKVTIAANDDLVLLGVAGFQARAALAPLFAALPDAATPVVSEGATSLLWFEHPGERFLLVTDVDTANRVTDALRGEAQFNNSQQWLALNIEAGLPVIDSANSGQFIPQATNLQALGGISFKKGCYTGQEMVARAKFRGANKRALWTLSGTASRVPEAGEDLELKMGDNWRRTGTVLAAVQLDDGSLMVQVVMNNDMEPDSVFRVRDDAGSLSIKPLPYSLEEN

SEQ ID NO: 11936 - protein, 259 aa, Klebsiella pneumoniae
TTKEHNMILDAFSLQGKVAVVSGCDTGLGQGMALGLAEAGCDIVGINIVEPVETIERVTALGRRFLSLTADLRQIDGIPQLLERAVAEFGHIDILVNNAGLIRREDALAFSEKDWDDVMNLNIKSVFFMSQAAAKHFIAQGSGGKIINIASMLSFQGGIRVPSYTASKSAVMGVTRLLANEWAKHNINVNAIAPGYMATNNTQQLRADEQRSSEILDRIPAGRWGLPADLMGPVVFLASSASDYINGYTVAVDGGWLAR

SEQ ID NO: 11937 - protein, 393 aa, Klebsiella pneumoniae
RMKDVVIVGALRTPIGCFQGALSRHSAVELGSVVVKALVEKTGIDPHSVDEVILGQVLTAGTGQNPARQSAIRGGLPNTVSAITINDVCGSGLKALHLATQAIQCGEADVVIAGGQENMSRAPHVLTDSRTGAQLGNSQLIDSLVHDGLWDAFNDYHMGVTAENLAREFGISRELQDAWALSSQHKARKAIDSGRFRDEIVPVVTEHNGAARTVDTDEQPRVDASAEGLASLQPTFDRLGSVTAGNASSINDGAAAVMMMSEAKALELGLPILARIRAFASVGVDPALMGIAPVHATRRCLERAGWRLDDVDLIEANEAFAAQAISVGRVLEWDERRVNVNGGAIALGHPIGASGCRILVSLVHEMIKRDARKGLATLCIGGGQGVALAVERA

SEQ ID NO: 11938 - protein, 95 aa, Klebsiella pneumoniae
ISEEKMEILEGHNKFYVNDAQGNQVAEIVFVPTGEHLSIIEHTDVDPSLKGQGVGKQLVAKVVEKMRQEQRKIIPLCPFAKHEFDNTREYDDIRA

SEQ ID NO: 11939 - protein, 96 aa, Klebsiella pneumoniae
SLRDVPLNHIATIARPARLLLVLPLSGCSLSPEIPVLGAAFPGWFFCLLGGAFLLIPCHILITRKGWQPRFSPLVFSYVALMFLFATLLWFLFFVH

SEQ ID NO: 11940 - protein, 338 aa, Klebsiella pneumoniae
RWLLPGGRRTIFTLLLHQTPYLNVLGGRVMSDPDFNLLVALDVLLSEASVAGAARRLNLSTSAMSRTLSRLRDVTGDPILVRAGRNMVLTPWAEATRDRARRAVHDARAVLQPSTETFSAQNLARLFTIRANDGFVVAFGPALIAAVADAAPDVCIRFAPKPEKTSRYLREGLVDLEIGVQSNMGPEIRLQRLFEDRFVGVVRKGHPLAKQAEIGVSDYVAWGHVVASPEGALHGSVDDALAELGTKRKIASVVPGFPTALSVALESDLIAMIPALYLLNQQVTDQVHLFELPFKSRRITVSQMWHPRMERDPGHRWLREQILAICGVARSVMTKEPV

SEQ ID NO: 11941 - protein, 70 aa, Klebsiella pneumoniae
HHLLNMRKRYFEVSIQCRTTSQVENPKVIPNPVIADRYQNQSLCNAFMLPSAPFTWGLVGWRRCEHRGVT

SEQ ID NO: 11942 - protein, 77 aa, Klebsiella pneumoniae; identical to SEQ ID NO: 9235

SEQ ID NO: 11943 - protein, 97 aa, Klebsiella pneumoniae
PIFCCWKVNMDINNKARIHWACRRGMRELDISIMPFFEYEYDTLSDADKQLFIRLLENDDPDLFNWLMNHGKPADAELQRMVTLIQTRNRERGPVAI

SEQ ID NO: 11944 - protein, 174 aa, Klebsiella pneumoniae
KSSWRKPVASKIRRWLRELAVWLLIGAAVSLAVDYFRQPALPQNVSATSLQTLDGRTLDLNAMSQQKPLLLYVWATWCGVCRYTTPSVASLAADGGNVLTVALRSGDNAALEKWLSRKKMALPTVNDPSGQLARQWDIQVTPTLVVISQGEVKSVTTGWTSSWGMRLRLWLASW

SEQ ID NO: 11945 - protein, 316 aa, Klebsiella pneumoniae
LTPCTVRHRGLPGLFALLRRLDVQHLQRQGRRRQSGNFGLIVGRGDFHHVHPDDVQVLQAAHQLDRAVGGQPTDNRGTGAWRKRRIQTVDIKGQVHRHVADDLLHLGNHVINAAVVNLAGVEHRKAIVFVELGADPDLYGVVRIDKPFVRRGIEHGAVVELAAVGVGIGVSIEVHQRHFTKVLGMGAQQRQGNEVVAAKGEHTFAGRQQLLGVSLQLLAHFARVAEGVHQIPTVHHVQALAHIEVPRETVVLPGKVSGNLTDRRRAMTAARAPGGRHIERHAGDDPVRIAFIRHKVHWQTQKAKGIGYQGVIVLMT

SEQ ID NO: 11946 - protein, 418 aa, Klebsiella pneumoniae
INTCLLKHITQRHASGPAASQERKEHYMAKGMRVKLNYHVSHDPDTGAEVTRLTPPEVTCHRNYFYQKCFFNDGSHLLFAGEFDGHWNYYLLNIASAEAVQLTEGAGDNTFGGFLSPDDKSLYYVKNDRILLEVNLTTLAEREVYRVSDDWVGYGTWVANSDCSKLVGIEIAKSDWTPLNDWQIFHDFFHKGPHCRLLRVDLRSGESQVIHEEKIWLGHPIYRPFDDHTVAFCHEGPHDLVDARMWLVNEDGSHVRKVKAHAPGESCTHEFWVPDGSALIYVSYLKGQQGRTIYRFDPESGVNEALMTMPACSHLMSNFDGTLLVGDGSGTPVDVKDTGGYSIDNDPWLYVFNVAEKRYFRVARHDTSWATVANSRQVTHPHPSFTPDDSAILFSSDKDGKPAIYIAKLPAHPSMLSA

SEQ ID NO: 11947 - protein, 518 aa, Klebsiella pneumoniae
SWACWCSAPPLFPSSCCAPANPPPIRWCRNLPLSESKRVKMMTYTISRAEQVLQTQRQALNLRWYPHYHLAARAGWINDPNGLVWFDGWYHAFYQHHPYSTQWGPMHWGHARSKDLVHWEHLPVALAPEGPEDKDGCFSGSAVVDGDTLALIYTGHKFHGDPGDEANLYQVQCLATSRDGIHFERQGMVVDTPPGMHHFRDPKVWREGDSWYMIVGAREGDTGQVRLYRSADLRQWQDAGVLDEAESTMGYMWECPDFFTLNGKRVLMFSPQGMQAAGFSNRNLFQSGYLIGEWQPGQRFIRHGEFREMDNGHDFYAPQSFATPDGRRIVIGWLDMWESPLPEQQDGWAGMLSLPRELSLSADDRLQMRPAKEVESLRGAWFPWPVSTLNNQQTTMVDNCEAMEVNLRWDCARSSAEQYGLRFGDGLRIYVDAQQQRLVLERHYPQYGLCGTRSVPLTAGADLNLRIFFDSSSVEVFVNDGEACLSSRIYPQAPHRELALFAWSGSAALTEAGAWQLE

SEQ ID NO: 11948 - protein, 387 aa, Klebsiella pneumoniae
NCYWKHYVMANLPPLSLYIHIPWCVQKCPYCDFNSHALKGEVPHDDYVQHLLNDLQADAHYAQGREIGTIFIGGGTPSLLSGPAMQTLLDGVRACLPLAAGAEITMEANPGTVEADRFVDYQRAGVNRISIGVQSFSEPKLQRLGRIHGPEEAKRAARLASGLGLRSFNLDLMHGLPDQSLEEALDDLRQAIALNPPHLSWYQLTIEPNTLFGSRPPVLPDDDALWDIFEQGHQLLSAAGYQQYETSAYAKPGFQCQHNLNYWRFGDYLGIGCGAHGKITFPDGRILRTAKTRHPRGYMEGRYLERQHDVEEADKPFEFFMNRFRLLEAAPRAEFSLYTGLDEQVIRQQIDAAIAEGYLLEDAQNWQITEHGKLFLNSLLELFLSEE

SEQ ID NO: 11949 - protein, 259 aa, Klebsiella pneumoniae
VRICKAVCRRPANGGSICAIKNAVPHGRYVVSGNVGRYGSRNRGGKHDGAHRYCHFWCARLQQIIRNLRNAMKTLTFLLSTVIELYTMVVLLRVWMQWARCDFYNPFSQFVVKATQPIVGPLRRIIPAMGPIDSASLLVAFILCVIKAIVLFMVITFQPIIWISALLILLKTIGSLIFWVLLLMAIMSWVSQGRSPVEYVLMQLADPLLRPIRNLLPSMGGIDFSPMVLVLLLYVINMGIAEVLQATGNVLLPGLWMAL

SEQ ID NO: 11950 - protein, 242 aa, Klebsiella pneumoniae
TKGLSMKKGLLMFTLLAASLSGAAHADSAAIKQSLAKLGVQSTDIQPSPVSGMSTVLTDSGVLYVTDDGKHIIQGPMYDVSGAQPVNVTNQLLLGKLNALSNEMIVYKAPKEQHVITVFTDITCGYCHKLHEQMSDYNALGITVRYLAFPRQGLQSQAEQDMKAIWCAKDRNKALDDAMNGKGVQPASCSVDIAKHYTLGVQMGVNGTPAMVLSNGMVLPGYQGPKELKAFLDEHKKQTSGN

SEQ ID NO: 11951 - protein, 119 aa, Klebsiella pneumoniae
PEARIAQLSRPDVQVTIFAPAPRTGFRQAGYEPDLSPPPERHRSISPPPAPRRGYVMSPLPGARSPPRLTPGEWFRCRVAPRAGSHPDPGAAPRGAPRRTKGSDGQLPAAGSDSARCDE

SEQ ID NO: 11952 - protein, 113 aa, Klebsiella pneumoniae
QQDRPMFIFHKDTTLEDLGNGVTRRILAHDGKMMAVEVNFAAGAVGPMHNHPHEQLTYVLSGEFEFTIGEETRVVSAGDTLYKRPGIMHGCVCLQPGTLLDTFTPIREDFLEG

SEQ ID NO: 11953 - protein, 144 aa, Klebsiella pneumoniae
RRYRPAAARRQPVRPSPSGDARPPAAAAAGENDRQTAVPGTSAPTARRRAASAPLPCSSPPPPAGHRKPPRPATAQDPAIRSPARRSAVETLQNAPPPAISPPPSRGRRTSGLARDKAYQGAPAHRAYATPEWNGRSLSACRRR

SEQ ID NO: 11954 - protein, 728 aa, Klebsiella pneumoniae
LINRSHGVVMLLGFFRLLFKGLYRVRLTGDTQALYQQKVLITPNHVSFLDGILLALFLPVRPVFAVYTSISQRWFMRALTPIIDFVPLDPTKPMSIKHLVRLIEQGRPVVIFPEGRISVSGSLMKIYDGAAFVAAKSQATIVPLRIEGAELTPFSRLKGLVKRRLFPRIQLHLLPPTHLPMPEAPRARDRRKIAGEMLHQIMMEARMAVRPRETLYESLLAAQDRFGARKPCVEDINFQPDTYRKLLTKTLFVARILEKYSQPGEKIGLMLPNAGISAAVIFGAIARGRIPAMMNHTAGVKGLSSAIAAAELNTIFTSRTFLDKGKLWHLPEQLTQVRWVFLEDLKGDITLADKLWIFAHLLAPRLAQVKQQPEDAAMILFTSGSEGNPKGVVHSHKSLLSNVEQIKTIADFTANDRFMSALPLFHSFGLTVGLLTPLLTGAEVFLYPSPLHYRVVPELVYDRNCTVLFGTSTFLANYARFANPYDFYRLRYVVAGAEKLQESTKQLWQDKFGLRILEGYGVTECAPVVSINVPMAAKVGTVGRILPGMDARLLAMPGIEQGGRLQLKGPNIMKGYLRVENPGVLEAPAAENQHGEMEAGWYDTGDIVTFDEQGYVRIQGRAKRFAKIAGEMISLEMVEQVALGASPDKMHATAIKQDASKGEALVLFTTDNELTREALLRYARQHGVPELAVPRDIRWLKQLPVLGSGKPDYVTLKNMVDEAETTHE

SEQ ID NO: 11955 - protein, 502 aa, Klebsiella pneumoniae
SFIRGGIQQRGNLRFVAGFDLEDPAVGIRVAVDQFRRVVQLFVDGNDFTANRRVDIGGRLHGFGNRAIGARFNGGAHFRQVNENHIAKQLLRVLGDPYGIGAVRFFTQPLVFFAVFQFCWYVAHQFISKKGKSHNGFAIAYKTRFSHFYRHFTVTDLHHRGVANPGRHASQRDAVAQRRREGAAGDNAFFLITVAIGKTDRQTTAQDAFLGHHQANQLLGAFFALHLQRFAADEVTIGGLPGDSPAHVRRQRGNAFVHLLAVQVHPGLQAQGVARAKTARLNASVQQTAPEISRLLVRHRKFITRFAGIAGGGDKQVAGLHAEERLHAFHGLTLSVGKQRRRLRFRLGALDRDQRQIVANGNFKAVRFSLFGDPGEVFFAGGGVNNEAEIIFRKEIDNQVVDDAGGGGQHAGVERFARGGELRHIVGQQIAQELADPAAVEIDDGHMRHIEHPCIAAHRMVLINLGPVMQRHHPAMEIHHARAAQRVLFIQRSLLSHLFLIE

SEQ ID NO: 11956 - protein, 304 aa, Klebsiella pneumoniae
RRVRRRLPEVRHQQVTFAPAPAAAGAISPLLRSFCMPQQQHNSAAGRPILQLRNVSKHFGAVSALTDIELEVHAGEVVALVGDNGAGKSTLVKILAGVHQPTSGTIEFDGNPVTLDSPGKALEYGIATVFQDLALCENLDVVANLFLGHEISPFQLDEVAMEVKAWTLLQELAARIPSVREPVASLSGGQRQTVAIARSLLLNPKIIMLDEPTAALGVAQTAEVLNLIERVRERGLGVIIISHNMEDVRAVADRIVVLRLGRNKGIFTPDASNQDLVAAITGATENAVSRRVERKSQPTTSGAM

SEQ ID NO: 11957 - protein, 92 aa, Klebsiella pneumoniae
SGQRDVDSTYQYLWDSQNINRIREQTSEHSQQRIAKCKQRFVFSCAGFNYRSRQCKQVTDKPALNHICAIPSPPRLESAALSRNIAVCKRLP

SEQ ID NO: 11958 - protein, 528 aa, Klebsiella pneumoniae
LALRRTLPGEFMHSSVNKNESRTFFGHPYPLGSLFFTEMWERFSFYGIRPLLILFMAATVYDGGMGLARENASAIVGIFAGSMYLAALPGGWLADNWLGQQRAVWYGSILIALGHLSIALSAWLGNDLFFIGLMFIVLGSGLFKTCISVMVGTLYKKGDARRDGGFSLFYMGINIGSFIAPLISGWLIKSHGWHWGFGIGGIGMLVALIIFRVFAVPSMKRYDAEVGLDSTWNSPVAKKNGVGAWLLALALGVAVLVTLISLGTIVINPVAVASVLVYVIAASVALYFIWLFVFAGLNRKERARLLVCFILLVSAAFFWSAFEQKPTSFNLFANDYTNRMIGDFEIPAVWFQSINALFIILLAPVFSWAWPALARKNVRPGSMTKFVIGILCAAAGFGLMMLAAQNVLSNGGAGVSPLWLVGSILMLTLGELCLSPIGLATMTLLAPERMRGQMMGLWFCASALGNLAAGLIGGHVKADQLSLLPDLFARCSIALLICAAVLAVLIVPVRRMLENSRSSAAQKSLSNA

SEQ ID NO: 11959 - protein, 516 aa, Klebsiella pneumoniae
HITRRFCTPSSSAEARQAPTPGECTSMPRKFCSGLAFAIATSEAPIPKPISKVTGASRPNRAAKSSGASLNSTPITGQMLSSACCCPFVRRPWRRTKLRIRRSGRPFSSNSGEMTSFFIKVWSACECVRKTGIIQSYPADARVYSHSPLCCNLPPCNRDPGAVALTFLATQFSAQVLDWYDKYGRKTLPWQIAKTPYKVWLSEVMLQQTQVTTVIPYFERFMARFPTVVDLANAPLDEVLHLWTGLGYYARARNLHKAAQQVATLHGGEFPRTFDEVAALPGVGRSTAGAILSLSLGQHYPILDGNVKRVLARCYAVSGWPGKKEVEKRLWDISEEVTPAEGVERFNQAMMDLGAMVCTRSKPKCELCPLSNGCVAYANHSWAEYPGKKPKQTLPERTGYFLLMQHGDEVFLSQRPPVGLWGGLFCFPQFADEAELREWLAQRQIKADNLTQLTAFRHTFSHFHLDIVPMWLTVHSSGAYMDEGNALWYNLAQPPSVGLAAPVERLLQQLKAGAPV

SEQ ID NO: 11960 - protein, 67 aa, Klebsiella pneumoniae
NAARGSLKKRTGHGPVVPLPAGLSSLYLQNLAAAYRLLPGMYSFGLSPTLSQGGVEVIPDNEPMFFV

SEQ ID NO: 11961 - protein, 71 aa, Klebsiella pneumoniae
TRALLPGKSFLVVSPDCHTLFGYVFYDDMNKKPVAQSQNQQIVLGFRTVHGLLSHLWTAIVVNCLTLIIKN

SEQ ID NO: 11962 - protein, 107 aa, Klebsiella pneumoniae
KPERRYKFFGYQRGLIMSRTIFCTFLQREADGQDFQLYPGELGKRIYNEISKEAWAQWQHKQTMLINEKKLSMMNPEHRKLLEQEMVQFLFEGKDVHIEGYTPPEKQ

SEQ ID NO: 11963 - protein, 327 aa, Klebsiella pneumoniae
VMKLEEIVALSVKHNVSDLHLCNSAAPRWRRQGRLEPAPFPAPDIANLLNDWLDAAQLLHWQEHGQIDFALNLACGARLRASAFAHTRGISLVLRLLPEQCPRLDMLGAPPALSELLAEESGLLLVTGATGSGKSTTLAAMVGHLNQHLDGHILTLEDPVEFIHHSERCLIQQREVGRHCPSFAAALRVALRQDPDVILLGELRDSETIRLALTAAETGHLVMATLHTRGAAPAVERLIDVFPAEEKDQVRSQLAGSLCAVLAQKLLPARQGGRVALYELLVNTPAVANLIREGKVHQLPGVMQTGMQAGMLTFTQSFQQRVAAGAL

SEQ ID NO: 11964 - protein, 301 aa, Klebsiella pneumoniae
TKDRTHRYCRYIMRYSPEALTAFVEAVDSGSFSAAARRLRKSQSTISTAIANLEADLGVTLFDRATRQPTLTPQGEQVLSYVKAILAASERLDELAVSLSGETEPRLTFVLSDTLHPDVLEDLLVQFDRRFPHTEFECLIGEDEDVIDLLQKSRAQVGLIEARERYPTDIGSTRLPLQTAMGIYVAPGHPLAAQGKVAWDELRSWRELRLSTFLASATEPAAGQVWSAPNYLLLLSMAAQGFGWCILPSALVAEFAPQGGLVALDIPGWPRAISVDLLWNKKAPPGAAGSWLRQHLQRRER

SEQ ID NO: 11965 - protein, 91 aa, Klebsiella pneumoniae
SCIRPTTTIATPSSSSGTFTPTTTWWSPPAAATSPPAMSPSPSPTTRDRWPCRSPSTARKASSWGITSPAPPRTAPTRSSPIPPPPRRRRG

SEQ ID NO: 11966 - protein, 504 aa, Klebsiella pneumoniae
RADRLWYANVDFIGYLGYHCARCERCHRTIFAWRLCFGMPKVSGCSPGRNKPFTLRYSFMALQDKLIDALGRFATTFNSYRYIMAIKSAFITLMPVIIVGAFSVLISNMVLDPKNGLASFSSLSFLAALKPITSALNYATLNFLNIGAVFLIGIELGRINGIKSLFPGLLAVICFICVTPTTVEMMVDGQMHVVKDVLLRQFSDTRSLFLGMFIAILSVEIYCWLEGRKGLKIKMPDTVPPNVSASFSALIPAIITTTAIATFGFLFHQLTGMYLYDAVYQVVQQPLERVVQSLPGILLLMFVAQLFWVIGIHGNQMIKPIREPLLLGAITVNMSAFEQGKEVPNIITMPFWDVYMSIGGSGLTIGLLIAVMIATRRKEMKEIAKLSIGPGLFNINEPVIFGMPIMLNPILAIPFIITPLVTGSIGYFATLTGFAGKAVVMVPWTTPPLINAWLSTAGSMGAVVTQLICIVVAVLIYLPFVKIASRRADAAQRQVDNQQTANPV

SEQ ID NO: 11967 - protein, 228 aa, Klebsiella pneumoniae
SGCRRIISIYIRFTGRSGPTNCLGKLGYTWADSAPAVTLLDTLEALTEFQRAGKIRYIGVSNETAFGVMRYLHLADKHDLPRIVTIQNPYSLLNRSFEVGLAEVSQFEGVELLAYSCLAFGTLTGKYLTGAKPAGARNTLFSRFTRYSSEQSQKAVAAYVDIAKRHGLDPAQMALAFVRRQPFVASTLLGATTMTQLQANVESLQLELSEEVLAEIEAVHQVYTYPAP

SEQ ID NO: 11968 - protein, 261 aa, Klebsiella pneumoniae
TTIRLWKIKMKIRSTVLALGIAATLTGCQNMDSNGLLSSGAEAFQAYSLSDAQVKTLSDQACKEMDAKAKIAPANSEYSQRLNKIAAALGDNINGQPVNYKVYETKDVNAFAMANGCIRVYSGLMDLMNDNEVEAVIGHEMGHVALGHVKKGMQVALGTNAVRAAAASAGGIVGSLSQSQLGDLGEKLVNSQFSQRQESEADDYSYDLLRKRGINPSGLATSFEKLAKLEAGRQSSMFDDHPASEARAQHIRDRMKADGIK

SEQ ID NO: 11969 - protein, 401 aa, Klebsiella pneumoniae
NVQSVDVAIVGGGMVGLAVACGLQGSGLRVAVLEKAEPRPLAADAPPALRVSAINAASEKLLTKLDVWREIVAQRASCYHGMEVWDKDSFGHISFDDQSMGFSHLGYIIENAVVHHALWQKAQRCADVTLLAPAELQQVAWGENEAFLSLQDGSMLTARLVIGADGANSWLRNKADIPLTFWDYHHHALVATIRTAEPHQAVARQAFHGDGILAFLPLSDPHLCSIVWSLSPGEAQRMQQADETTFNQALNIAFDNRLGLCQLASEREVFPLTGRYARQFAAHRLALVGDAAHTIHPLAGQGVNLGFMDAAELIDELKRLHVQGKDIGQHLYLRRYERSRKHSAALMLAGMQGFREMFSGSHPAKKLLRDVGLKLADTLPGVKPQLIRQAMGLNDLPAWLR

SEQ ID NO: 11970 - protein, 115 aa, Klebsiella pneumoniae
SAQSRAGSDTSSLSVNQYRRINFWTAILGQILSPFPAFFDGGRIYGKTRLAKFPDNRANRHIFILLFTPLLGIKRRARLIKKAHGAWPCGATSSRVKQSVFTESRSGVSPVARYV

SEQ ID NO: 11971 - protein, 484 aa, Klebsiella pneumoniae
LLERLARMKKLTLPKDFLWGGAVAAHQVEGGWDQGGKGPSICDVLTGGAHGVPREITHQVEAGKYYPNHEAVDFYGRYKEDIKLFAEMGFKCFRTSIAWTRIFPQGDETQPNEEGLKFYDDMFDELLKYNIEPVITLSHFEMPLHLVQQYGGWTNRKVVDFFVRFAEVVFERYMHKVKYWMTFNEINNQRNWRAPLFGYCCSGVVYTEHDNPEETMYQVLHHQFVASALAVKAARRINPDMQVGCMLAMVALYPYSCKPEDVMFAQESMRERYVFTDVQLRGYYPSYVLNEWERRGFNIRMEDGDAQILREGTCAYLGFSYYMTNAVKAEGGTGDAISGFEGSVPNPHVKASDWGWQIDPVGLRYSLCELYERYQKPLFIVENGFGAYDKVEADGSINDDYRIDYLRAHIEEMIKAVTYDGVDLLGYTPWGCIDCVSFTTGQYSKRYGFIYVNKHDDGTGDMSRSRKKSFNWYKEVIASNGENL

SEQ ID NO: 11972 - protein, 138 aa, Klebsiella pneumoniae
IFPGGFHVLYIPDPLDDTRMMMKAWASGHGKAAINAVMIDCLFTGQCHPSKPASLADNLREWHEKFLRQNTTLSRLDSIHCKTTTVIKPYCKKPGDNSIVCNRAHYAVFQRVSLIWYMRLNEMKTRHGQRIQEDINGR

SEQ ID NO: 11973 - protein, 461 aa, Klebsiella pneumoniae
GSAGTISFLHRVAIKRYFLFVCHCGVIRKNSDQHTHCTGVLMPHSLYATDTDLTADNLLRLPAEFGCPVWVYDAQIIRRQIAQLSQFDVVRFAQKACSNIHILRLMREQGVKVDSVSLGEIERALAAGYDPQQNPEDIVFTADLIDDATLDRVKALQIPVNAGSIDMLSQLGEVSPGHRVWLRVNPGFGHGHSQKTNTGGENSKHGIWYSHLPAALEVMRRYQLQLVGIHMHIGSGVDYGHLEQVCGAMVRQVVDFGQDLQAISAGGGLSIPYREGEEAIDTAHYYGLWNRAREQIAAHLGHPVKLEIEPGRFLVAESGVLVSQVRSVKEMGSRHFVLIDAGFNDLMRPAMYGSYHHITALAGDGRDLSAAPQVETVVAGPLCESGDVFTQQEGGKVETRLLPAVAPGDYLVLHDTGAYGASMSSNYNSRPLLPEVLFDGGKARLIRRRQTIQELLALELI

SEQ ID NO: 11974 - protein, 120 aa, Klebsiella pneumoniae
TSAGLHERDAGCGVLTRDRTTRRIKRKTLVHYLVSPPHRPATGSATSQSYTYRATGDTPLRDSVNTDCLTRLEVAPQGHAPCAFLMSRARRFIPRSGVKSKIKMCLFARLSGNFARRVFP

SEQ ID NO: 11975 - protein, 342 aa, Klebsiella pneumoniae
KRHGMATIKDVARLAGVSVATVSRVINNSPKASEASRQSVGAAMETLNYHPNANARALAQQSTETVGLVVGDVSDPFFGAMVKAVEQVAYRTGNFLLIGNGYHNVQKERQAIEQLIRHRCAALVVHAKMIPDEELAGLMKQIPGMVLINRILPGYETRCVALDDRYGAWLATRHLIQQGHTRIGYLCSNHDISDAEDRLQGYYAALEESGLPCNDRLVTFAEPDESGGEQAMTELLGRGRHFSAVACYNDSMAAGAMGVLNDNGIDVPREISLIGFDDVLISRYVRPRLTTVRYPIVTMATQAAELALALAEQRPAPEITHLFSPTLVRRHSVVAPQEGDKS

SEQ ID NO: 11976 - protein, 351 aa, Klebsiella pneumoniae
YSGGITQREKITMQYTRLGKSDLLVSRICLGCMGFGDPSTGQHRWTLDETASRDIIRHALEQGINFYDTAIAYQNGSSERYVGRALREMAKREEVVLATKFLPRTAAQIAEGISGKQAIARSLDQSLRNLGMDYIDLYIYHIWDYNTPVIDVLEALHTAVTAGKVRAIGISNCYAWQLAKANALAEREGLTSFVSVQSHYNLIMREDERELFGLCAEEGIAMTPYSALASGRLSRLEGHTRREVEDDYARGKYDGTAEQDRLIIARVAELAERHQVSMTEISLAWLLTKVTAPVIGATQKHHVDGAVNAVALQLSPEDIRYLEEAYQPHFLTGVMAQNTPQAKDRPQVWTR

SEQ ID NO: 11977 - protein, 138 aa, Klebsiella pneumoniae
CDGGGGDCAGCRGGGKSGDPGDGVALYAGRDFDRYRGDSLCGATVAAAGVRSAAAARGVRRVLYRTAERAAAERGKHSVGAGNAIAVQNLGENVAMLLMLGLYSLAVSVGVPPVAVGIGFGAVFAVAIAALWVWGRRK

SEQ ID NO: 11978 - protein, 94 aa, Klebsiella pneumoniae
RSGGIYSSQRALSDPAAGSWPSLPFVRRGAPRGAAPGSGCDPARGATRQRNHSPGVNRGGDRAPGNGDITYPRRGAGGGEIDRCLSGGGERSGS

SEQ ID NO: 11979 - protein, 143 aa, Klebsiella pneumoniae
FRHGIGNVVLWQSDLRISWRAQWFSLLLHGVVAALVLLVPWPLSYTPIWLLLLSLVVFDCVRSQRRIHARRGEIKLLTDSRLRWQNAEWEILGTPWVINSGMLLRLRHVDTRRGQHLWLAADSMDAGEWRDLRRLVLQKPAQE

SEQ ID NO: 11980 - protein, 545 aa, Klebsiella pneumoniae
ADLGSQYMLNSYTYLYQRNGVYYFRLRVRQSNNDRMTSVSLRTKDRRTAMAHSRHIKAALKAIHADNPTASYEDMRKHLRDIAEWELSAGRSDLFEPDMRDIYRDQYSELGENLTDALASEPLSIDQHRYINEALKVLKACMKRIEAGDSQSLIDYVDRFDGIDRQDDQASVSLSVSAPEVKPAALAALAVTPSVTVASLFEQYEAENAQNWKPATLRENQSSHAALIEIFDYLGLGADANTVTRADVLRVRDVLQQLPKNRKQRFKDAPLVDLLGREEKTDCLDVVTINNKYLIKMAAVFKWAVRNDLIKKNMTEGLELKVPQRKASEARNAFSTEQVRQLLVAAKAYSQKTSGKPYHYYVTVLAAITGARLNEVAQLQVKDVRTTEAGTVYIHINEDDSSLPGKSIKNAHSDRCVPLVDGAYGFVLADFMDLLEARRNAGSEDAMVFDGLRLMKNGYGEQVSKWFNRTLLPKVLADRDGLAFHSFRHTVATQLKQHGVELAYAQAIMGHSSGSITYDRYAKEVEVDRLVNVLADVYKEVRLSN

SEQ ID NO: 11981 - protein, 207 aa, Klebsiella pneumoniae
PDAGSSTARDRCPRLTFLSFLPSREEASSCSPPSAALSSGAMKTPRIPIAIQQAVMRSLREHLANANRKLERRYAEPTLVYQQRGTSAGTAWLEKNEIRLNPVLLLENQREFIDEVVPHELAHLLVWQHFGRVAPHGKEWKWMMESVLGVPARRTHRFELASVRQNTFPYRCRCQQHQLTVRRHNRVVRGEATYRCVRCGDLLVAEK

SEQ ID NO: 11982 - protein, 152 aa, Klebsiella pneumoniae
AAAGSLAPTRPGLRQVRWRWPEKCSNAARASCAAHPRRPYPAPPADGQGLHKCPSPSAAAGGCCRYRWGSAPSPQSAPPGRGIFAGDRSHPRLRQSNTQTRYEESGGQTAPADLPARPGAEYRRARRSAAAPSRRTATQPVRPAARWRQESL

SEQ ID NO: 11983 - protein, 262 aa, Klebsiella pneumoniae
TFKGAAAPLFFWREGMGIALISGASRGIGRATALLLAQEGYTVAVNYHHNINAATEVVNTIVASGGKATALRADISDEAQVMAMFEAVDRMGEPLTALVNNAGILFTQCTVESLSAERINRVLATNVTGYFLCCREAVKRMSHRHGGKGGAIVNVSSAASRLGAPGEYVDYAASKGAVDTLTTGLALEVAAQGIRVNGVRPGLIYTEMHASGGEPGRVDRVKGSLPMQRGGQPEEVAQAIAWLLSDKASYVTGSFLELAGGK

SEQ ID NO: 11984 - protein, 708 aa, Klebsiella pneumoniae
RAKGCSMYMTCRLGYIVHTFFRRSPKRALVKSLRAWPSTVRTGVKMSSRKELANAIRALSMDAVQKAKSGHPGAPMGMADIAEVLWRDFLNHNPNNPAWADRDRFVLSNGHGSMLIYSLLHLTGYDLPIEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLVAFYDDNGISIDGHVEGWFTDDTAKRFEAYGWHVVRGVDGHDADAIKRAVEEARAVTDKPSLLMCKTIIGFGSPNKAGTHDSHGAPLGDAEIALTREALGWKHAPFDIPSDIYAQWDAKEAGQAKEAAWNEKFAAYAKAFPQEAAEFTRRMKGEMPSDFDAKANEFIAKLQANPAKIASRKASQNAIEAFGPLLPEFLGGSADLAPSNLTLWSGSKPINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAIAWKYGVERQDGPTALILSRQNLAQQERTAEQLANVARGGYVLKDCAGQPELIFIATGSEVELAVAAWDKLTAEGVKARVVSMPSTDAFDKQDAAYRESVLPKDVTARVAVEAGIADYWFKYVGLNGAIVGMTTFGESAPAEQLFEEFGFTVDNVVAKAKALL

SEQ ID NO: 11985 - protein, 176 aa, Klebsiella pneumoniae
ATAGGASASSPIFASQQSNSQGFIEDSHLELFLRNAYTRHTSSCMCVGNNSAYPWASPLRGQRKRCSKRLAVLSGNSNYLGYIPNVIIAMGCRIKPNGARGLSPPSNPALPRDRSASVWTVSPSMRCALTAVAGPAACALINPLYRTAQGVTGVIRPSSPPGCTASPAPGSPPPER

SEQ ID NO: 11986 - protein, 137 aa, Klebsiella pneumoniae
FPFFGDELMSNVPAELKYSKEHEWLRKEADGTYTVGITEHAQELLGDMVFVDLPEVGATVEAGADCAVAESVKAASDIYAPISGEIVAVNEELNDSPELVNSDPYTDGWIFKIKASDEAQVAALLDAAAYEALLEDE

SEQ ID NO: 11987 - protein, 242 aa, Klebsiella pneumoniae
GSFMMRKTLLAVALSVTALSAHADYQCSVTPRDDVILSPQQVQVKGENGDLVIKPDGNLTFNGKAYALSAAQREQAQDYQASLRSSLPWIDEGARSRVEKSRKALDKIITEQVGANSSMHGRLTKLDAQLKEQMNRIIERRSDGLTFHYKAIDQVRADGQQLVNQAMGGILQDSINEMGAKAVLKGGGNPLQGILGSLGGLQTAIQEEWKNQEADFQQFGKDVCSRVVSLEDSRKALVGSLK

SEQ ID NO: 11988 - protein, 234 aa, Klebsiella pneumoniae
GYLMLKRSLVLAALCGMSFAATAVTIDLRHEFIDGGKSDKSNADRVSVSHRFANGLGFTVEAKWRSGGDNGSQPYSDVVGNGHEDTISWRWKATSNLFLTPGFTIESNDSRSIYKPHLHAQYSFDNGFYVAARYRYEYTRYPNNAGKDDDKVNRGDAWAGFVLGDWRTELNYVYARSSEGVSRNDNKPYSQEYNVKVAYKLDNNWSPYGEIGNVGVNDRSDRQTRFRVGVAYSF

SEQ ID NO: 11989 - protein, 143 aa, Klebsiella pneumoniae
ERTMSITIYHNPDCGTSRNTLALIRNSGAEPTIIYYLETPPSGDELRQLLAAMGIPVRALLRKNVEPYDALGLAEDRFTDDQIIDFMLQHPILINRPIVTTPQGTRLCRPSEVVLEILTAPQQGAFVKEDGEPVIDAAGQRVK

SEQ ID NO: 11990 - protein, 311 aa, Klebsiella pneumoniae
GDAMNNALYNQIRIFQSIAREGNISAAARKLEITPPSVSNALRLLEEHIGHPLFVRTTRRIELTETGQQLLEQTAAAVETLEKSLEIIRDQNQEPSGAVRITLSRFAYLLILKPAMAAFCQQYPGIQLEISVYDGTVNIIEERFDLGIRFGDILEGGVVARPLMKPFREGLYASSAYLAEYGVPAMPADLHHHRLIGYRFITNNRILPLILNDHGEQLTVEMPGQLISNDIDVMADGIRHGMGIGRLFEPILQLQPDREQFIPVMEDYWKTYPPVYLYYPKNAGRTKRVKALIDFLIMHAADDAEKVGSSR

SEQ ID NO: 11991 - protein, 379 aa, Klebsiella pneumoniae
EGNIMAEVIFNKLEKVYSNGFKAVHGIDLKIADGEFMVIVGPSGCAKSTTLRMLAGLETISGGEVRIGDKIVNNLAPKSRGIAMVFQNYALYPHMTVRENLAFGLKLSKLPKAQIDRQVEEAAKILELEELLDRLPRQLSGGQAQRVAVGRAIVKKPDVFLFDEPLSNLDAKLRASMRIRISDLHKQLKKSGKPATTVYVTHDQTEAMTMGDRICVMKLGHIMQVDTPDNLYHQPKNMFVAGFIGAPEMNIRPSQLVEHGGRLHLTLGDQRLPLNDRLQSKVETHKNQQVFFGVRPEFVSLSDEPFAEGSCAGEMVRVENMGHEFFVYLRVADYELTARVPSDDAKPMIARGLNRKVYFTFDLNKCHIFDAKTEQNLSL

SEQ ID NO: 11992 - protein, 201 aa, Klebsiella pneumoniae
TGFIMQKVVLATGNAGKVRELASLLEDFGLDIVAQTELGVDSAEETGLTFIENAILKARHAAQITGLPAIADDSGLAVDALGGAPGIYSARYSGVDASDQQNLEKLLDALKDVPDDQRQAQFHCVLVYLRHAEDPTPLVCHGSWPGVITRQAAGHGGFGYDPIFFVPSEGKTAAELSREEKSAISHRGQALKLLLEALRNG

SEQ ID NO: 11993 - protein, 112 aa, Klebsiella pneumoniae
GEIMSLLPLQLFKNLADETRLGIVLLLKARGELCVCDLCTALAQSQPKISRHLAMLRESGLLLDRKQGKWVHYRLSPQMPAWAAQVIEQAWLSQQEDVRLMISRLAGGPGCR

SEQ ID NO: 11994 - protein, 64 aa, Klebsiella pneumoniae
VGVITQVLKDGSPLQFNKKYTVGRLNNQETRYITIPLHARFYQYGPTTSTGEVESHMIFNLTYD

SEQ ID NO: 11995 - protein, 426 aa, Klebsiella pneumoniae
QAHIREDNYMNLKLQLKILSFLQFCLWGSWLTTLGSYMFVTLKFDGAAIGAVYSSLGIAAVLMPTLLGIVADKWISAKWVYAICHLVGALTLYLAAQVTTPGEMFLVILLNSLAYMPTLGLINTISYYRLQSAGLDIVTDFPPIRIWGTIGFILAMWGVSFSGFELSHMQLYIGATLSVLLTLFTLTLPHIPVANAQRNQSWAEMLGLNAFALFKNKRMAIFFIFSMMLGAELQITNMFGNTFLHSFDKDPLFAGSFIVEHASVLMSISQISETLFILTIPFFLSRYGIKNVMLISIVAWMLRFGLFAFGDPTPFGTVLLVLSMIVYGCAFDFFNISGSVFVEKEVRPEIRASAQGMFLMMTNGFGCILGGMVSGKVVEHFTVEGITDWQSVWLIFAGYSLVLAFAFVALFKYKHVRQPTAAQQSV

SEQ ID NO: 11996 - protein, 508 aa, Klebsiella pneumoniae
GTNMSEQQAQGADAAIDLNNELKTRREKLAALREQGVAFPNDFRRDHTSDQLHADFDGKENEELEALNVEVAVAGRMMTRRIMGKASFVTLQDVGGRIQLYVARDDLAEGVYNDQFKKWDLGDIIAARGKLFKTKTGELSIHCTELRLLTKALRPLPDKFHGLQDQEARYRQRYLDLISNDESRKTFKVRSQILAGIRQFMVGRGFMEVETPMMQVIPGGASARPFITHHNALDLDMYLRIAPELYLKRLVVGGFERVFEINRNFRNEGISVRHNPEFTMMELYMAYADYKDLIELTESLFRTLAQDILGNTEVPYGDQVFDFGKPFEKLTMREAIKKYRPETEMADLDNFDSAKAIAESIGIKVEKSWGLGRIVTEIFEEVAEAHLIQPTFITEYPAEVSPLARRNDVNPEITDRFEFFIGGREIGNGFSELNDAEDQAQRFQDQVDAKAAGDDEAMFYDEDYVTALEHGLPPTAGLGIGIDRMVMLFTNSHTIRDVILFPAMRPQK

SEQ ID NO: 11997 - protein, 195 aa, Klebsiella pneumoniae
RMRMSIQNEMPGYNDVDQLLNQQGVGLTPAEMHGLISGLLCGGNTDSSWQPLVHDLTNEGLAFGHELAQALRNMHSAISDSLDDDGFLFQLYLPEGDAVSVFDRADALAGWVNHFLLGLGVSQPKLDKVKDETGEAIDDLRNIAQLGYDEDEDQEELEMSLEEIIEYVRVAALLCHDTFARQQPTAPEVRKPTLH

SEQ ID NO: 11998 - protein, 91 aa, Klebsiella pneumoniae
VGSITKKSQIKINKLFLGEHFLSVIMLRFRQEYSLTAIYCTLQQDHFHEKRLTYPGYCCHRFPYRPPGAATSARRHVTKSGEPAGFGVSWM

SEQ ID NO: 11999 - protein, 412 aa, Klebsiella pneumoniae
SRIMSKIWSKEETLWSFALYGTAVGAGTLFLPIQLGSAGAIVLFITALVAWPLTYWPHKALSQFILSANIAPGTGITGAVNHYYGKKIGNLITGLYFLAFFVVVLIYAVAITNSLAEQVAHRTPMTPGLRALLSLGVVLVLNLIFLMGRQVTIKVMGFLVFPLIACFLFLSLYLIRDWHPEHLTSQMQFSPQTLHQVWISIPVMVFAFSHTPIISTFAIDQQEKHGDLAMGKCKKIMKVAYTIICASVLFFVFSCLLAIPATYIETARDQGVTILSALSMVPGAPGWLAVTGIIVAVVAMSKSFLGTYFGVIEGASEIVKSSLGLLGVRKSRAFNRAMSILLVSAFTFAVCFINPNAISMIYAISGPLIAMILFIMPTLSTWLIPALKPYRSVGNAITLVVGLLCVSVMFFG

SEQ ID NO: 12000 - protein, 256 aa, Klebsiella pneumoniae
LWIMPVFRTHSQADQTFMKNDVISPEFDENGRPLRRIRSFVRRQGRLTKGQQHALDNIWPVMGVEFNDAPLDFAALFGRDAPVTLEIGFGMGASLVAMAKAKPEQNFLGIEVHSPGVGACLASAEEEGVQNLRVMCHDAVEVLHTMIPDNSLNMVQLFFPDPWHKARHNKRRIVQPPFAELVKSKLKLGGVFHMATDWEAYAVHMLEVMSSLEGYRNQSASNDYVPRPESRPVTKFEQRGHRLGHGVWDLMFERVK

SEQ ID NO: 12001 - protein, 241 aa, Klebsiella pneumoniae
RGIMNTKIFEDNILSRNDIAVRYVFQKMFSPQGTLVAVECLSRFDNLSISPEDFFRHATAAVRERIFLEQLALIEKHKAWFLRNHISATINVDDHILNLLRQKDIKAKIAALTCVHFEVTENAENLLHNSLAAWQSPQDTSLWLDDFGSGYAGINAIRGYHFDYVKIDKDFFWHLMRKESGRQLMDALVTFLSRNHHNVIIEGVESEAHKEWLQGMEWFAIQGHYWREVSIEQLVADDIAM

SEQ ID NO: 12002 - protein, 336 aa, Klebsiella pneumoniae
MATMLDVSIRAGVSKATVSRVLNGTGQVKESTRQQVFKAMEELGYRPNFLARSLANQTSNSIGLVVSTFDGFYFGRLLQQASRQTEAWGKQLIVTDGHDTPEREEEAVQMLADRQCDAIILYTRHMSEKAIMSLINSIAMPLVVINRDVAQARERCVFFEQQEAAFQAVEYLITQGHRDIACITVPMHTPTGQARLQGYRNALIKHDIEWDPSRVKYGDSTMTRGYELCRELLDEKARFSALFSCNDDMALGASKALHQAGLRIPQDVSLFGFDDAPSAKWLEPGLSTVYLPIDNMITTAIDQAIKLANQQPIETIPPFTGTLVLRESVTTGPFFK

SEQ ID NO: 12003 - protein, 881 aa, Klebsiella pneumoniae
PEAMTAGQRRTGGIMSHRKYGLDHLGCRTARRLVSPALALWLCSQPFAARADLYFNPRFLADDPAAVADLSGFEKGQEVPPGTYRVDIYLNNGFMTTRDVTFQADAQGHGLSPCLTRGQLASMGVDTGRVPGMATLDSTACVPLTTLISEATTRFDVGQQRLYLTVPQAFMGNHARGYIPPELWDNGITAGLINYNFTGNNAHNTTGGSSRYAYLNLQSGLNIGAWRLRDNSTWSYSSGGSTSSNENRWQHVNSWLERDITPLRSRLTLGDSYTNGDVFDGINFRGAQLASDYNMLPDSQKGFAPVIHGIARGTAQVSIRQNGYEIYQSTVPPGPFTIDDLYAAGNGGDLQVTIKEADGSRQVFSVPWSTVPVLQREGHTRFALTAGEYRSGNSQQETPDFFQGTVMHGLPAGWTLYGGTQLADRYRAFNLGVGKNMGYFGALSLDITQANATLADDSEHQGQSVRFLYNKSLDETGTNLQLVGYRYSTRGYYNFADTTYRRMSGYSVETQDGVIQVKPKFTDYYNLAYSKRGKVQLSVTQQLGRTATLYLSGSHQTYWGTDDADEQLQAGLNAAVDDINWSLSYSLTKNAWQQGRDQMLAININIPFSHWLRSDSRSVWRHASASYSLSHDLNGRMTNLAGLYGTLLEDNNLSYSVQTGYAGGDNGSTGYTALNYRGGYGNANVGYSRSDGFKQLYYGVSGGVLAHANGITLSQPLNDTVVLVKAPGAGGVKVENQTGVRTDWRGYAVLPYATEYRENRIALDTNTLADNVDLDDAVVSVVPTHGAIVRANFNAQVGMKILMTLTHRGKPVPFGALATGDSNQSGSIVADNGQVYLSGMPLAGKVRVKWGDGPDAQCVADYRLPPESQQQALSQLSVACR

SEQ ID NO: 12004 - protein, 69 aa, Klebsiella pneumoniae
ISTFSGGKCAGRCSFRRVAIFSRSTVWHQSKCSATNRLLLDCRGPIKCHCSPLTPACWKWLIFSTPSWT

SEQ ID NO: 12005 - protein, 484 aa, Klebsiella pneumoniae
NVMMILPFSARLRGTLFTLTLTLLSGCALIQDEPAQVAIVNPQQAQLAQVIHLANSDWPAARWWEAYDDPQLNMLINRALQNSPTMQAARLRISQSQSTVELARSAMGLQATAVAAQNRLRITDKSFSWPYSYSLPVDKNGPWYTLNTVGVGAQLNIDLWGADRARVAAAIGEKNARLAETAGIELDIASSVAQLYFAMQATFQKIALLQELEGIARFSVEAHEHRTRRGLEDSVDVANAQAEQLAARQQIISAEGMLTQYRETLRALIGADAQSMPAIHPVALPALQEKLPPSLSFELLARRPDLQALRGYVTASLSQVDAAKAAFYPHFDIKAFWGYNALSVGDLFKSSFQQINLLPGLYLPIFDGGRLNANLQSVRTASNILIKQYNQAVLDAVRDVAISSSQLNDLNQQRALQQLKVTAAQTTTDSARAHYQRGLLSRYAAEEARRAVLAQQLLLLDIEAQRLSTDITLIKALGGGYRGQ

SEQ ID NO: 12006 - protein, 139 aa, Klebsiella pneumoniae
NKTMYICKYFKIIKLHFYFNSQLFLIILKRFEFNDIKLALARIDVADDLPQLPESHILLLRMLFGQRIERHRRGRGHSNGAKIAVIFIAPNAQHIAGLKVRLRCIANGDGFAPGEDVVLKTLKKGNVIGLHDIIPSWSL

SEQ ID NO: 12007 - protein, 212 aa, Klebsiella pneumoniae
NGAMARTLSAWPITVCRRRASSRRSVSFRSRAAKEIMMRTLQYLLGALFTLGAPAALAADSTIAISGYVRDNACAVAGESKDFTVDLQDNAAKQFYAVGATTPPVPFRIVLSPCGTSVTAVKVGFTGVADSINTSLLKLDAGASAAAGMGVEILDQQQSRLPVNAPSSTMTWTTLTPGQTNILNFYARLMATQVPVTAGHVNATATFTLEFQ

SEQ ID NO: 12008 - protein, 214 aa, Klebsiella pneumoniae
RTRMPRSKCSTSKTRVRQGSYSGQEGPLSIFNRSETMQGMKSGLLLLLPPLALAGNHWNVTLPGGSMRFQGLIMASSCRVEAGDRQMTVNLGQISSNRFHAVGEDSNPIPFAIHLQDCSTAVSQHVGVTFHGVADGKNPDVLSVGEGPGIASGIGIALFDSQGQQLPLNRPADRWISLYRGPTTLNFVAKYRATGRQVTGGAANAQAWFSLTYQ

SEQ ID NO: 12009 - protein, 174 aa, Klebsiella pneumoniae
RLSVRLSADFSGEAGMTILPLYAAPQFAPQVTDWLWQAFGGETLPRQFFASIVQHSQTAEALPLTFIAVEGEQLLGTIGLWRCDLISRQDLFPWLAALYVAPAARGQGLAGKLQRHVIDYARRAGFRELYLYSACRDFYERFGWRYIGEGLDYPATAVHLYRYDLSPSCGATTE

SEQ ID NO: 12010 - protein, 154 aa, Klebsiella pneumoniae
VRPVSMFSHAAVASLNNLEMMVYHYVIKNRDKVMYMTIRELAEAAGVSTTTVLRFCRKLQCEGYSEFRVRFKLYLEQNEPQQANIGASEIMSFFKSVNNDEFDELLEQAVDIILASDVLFLSAPAPPARWRNMAHASSPTSVNSATILTTPIFR

SEQ ID NO: 12011 - protein, 417 aa, Klebsiella pneumoniae
HENVMMKAPHSHSYPLLSALLFFFFVTWSSSGSLLSIWLHQEVGLKAGDTGIIYAVLSVSALFAQVCYGFIQDKLGLRKHLLWYITALLILSGPAYLLFGHLLKINVLLGSIFGGIYIGLTFNGGIGVLESYTERVARQSQFEFGRARMWGSLGWAVATFFAGLLFNINPQLNFLVASCSGLVFFILLARLRVSSAPHAMQEAVSGGKVTLEDALRLLTLPRFWALVFFVIGTCIYGVYDQQFPVYFSSQFATLQEGNEMYGYLNSFQVFLEAAGMFCAPWLVNRIGAKNGLIFAGMVMAMRMVASGLVEGPLLISITKLLHAVELPILLVAIFKYNSLNFDKRLSSTLYLVGFACTSSIIASVLSPLAGYSYEKYGFAQSYLIMGLLVFCTTFISIFLLRSGKSSADPLVSQPTAI

SEQ ID NO: 12012 - protein, 235 aa, Klebsiella pneumoniae
GVHVNMNIINLDQLISMTSKEIAELTGKRHDNVIRDVRKMLDEIYPDGGLLSFEDTYVNTQNGETYSMYRLDRKHTFILVAGYSVQLRAKCYDHIQMLEQKVLRLEDQQKRAAVQSANRRGVTWGDYCKTHGLPAQKLMNILKRERKLFQVHPVSGEWSVNPKYAEYFRVIKPTDQRFNPSGINIRFNAKGLEFFGQPEHVLKMRGKVIEIHGTDAEKQKHLQDVASISSQNEGL

SEQ ID NO: 12013 - protein, 580 aa, Klebsiella pneumoniae
LIRVKQQIQLRRREAVDGVELPADLPPLLQRLYASRGVRSAQELERSVKGMLPWTQLTGVEKAVEMLHDAFQKGLHIVVVGDFDADGATSTALSVLALRALGYGNVSYLVPNRFEDGYGLSPEVVDQAHARGAQMIMTVDNGISSHAGVDHAHALGIPVLVTDHHLPGETLPAAEAIVNPNLRDCDFPSKSLAGVGVAFYLMLALRTFLRDKGWFDARGIPAPNLAELLDLVALGTVADVVPLDANNRILTWQGLSRIRAGKCRPGIKALLEIANRDPQKLAASDLGFALGPRLNAAGRLDDMSVGVALLLCDNIGEARVLANELDALNQTRKEIEQGMQAEALTLCQQLERSADTLPGGLAMYHPQWHQGVVGILASRIKERFHRPVIAFAPTGDGTLKGSGRSIQGLHMRDALERLDTLYPGLILKFGGHAMAAGLSLEEARFEEFQQRFGELVTEWLDPALLQGEVVSDGPLAAAEMSMEVAQMLRDAGPWGQMFPEPLFDGRFRLLQQRLVGERHLKVMVEPVDGGPLLDGIAFNVDTSIWPDNGVREVQLAYKLDINEFRGNRSLQLIIDHLWPN

SEQ ID NO: 12014 - protein, 234 aa, Klebsiella pneumoniae
ALSVFSARLRSSQRASRNCSISARSCFTSASLFVKRSHYALRGRLSGTLPAIHGKNRDVYAMNIGLFYGSSTCYTEMAAEKIRDIIGPELVTLHNLKDDSPALMSQYDVLILGIPTWDFGEIQEDWEAVWDQLDTLNLEGKIVALYGMGDQLGYGEWFLDALGMLHDKLATKGVKFVGYWPTEGYEFTSPKPVIADGQLFVGLALDETNQYDLSDERIQSWCEQILGEMAEHFS

SEQ ID NO: 12015 - protein, 94 aa, Klebsiella pneumoniae; identical to SEQ ID NO: 9277

SEQ ID NO: 12016 - protein, 192 aa, Klebsiella pneumoniae
TSGVTLGMAHILVVSGHPDLNHSIANATILDELATALPDAQIRRLDWLYPDGKFNIAAEQESLLQADVIVWQFPFSWYGLPGLMKQWLDEVFVHGFAHGSTAKLGGKKLILSFTTGAPQALYTADGFFGHAIEEYLLPFETTARLCNLALLAPVYTCGISYADRDADKIAQQKTLAREHAARLIARLNTLVE

SEQ ID NO: 12017 - protein, 364 aa, Klebsiella pneumoniae
PAAVRPITPTCSHSISTIPPLSTSTWAMAPRWAWVLSSSWRSLRRSPLSHRNTGSSTPPIREAKMADIQQMAPVMSDADREVARTLRREKVSRVVRYVVLIFVGLLMLYPLAWMFSASFKPNHEIFTTLGLWPAHATWDGFINGWKTGTEYHFGHYMLNTFKYVIPKVVLTIISSTIVAYGFARFEIPWKKFWFATLITTMLLPSTVLLIPQYLMFREMGMLNSYLPLYLPLAFATQGFFVFMLIQFLRGVPRDMEEAAQIDGCNSIQVLWYVVVPILKPAIISVALFQFMWSMNDFIGPLIYVYSVDKYPIALALKMSIDVTEGAPWNEILAMASISILPSIIVFFLAQRYFVQGVTSSGIKG

SEQ ID NO: 12018 - protein, 64 aa, Klebsiella pneumoniae
AVQVSTTRQARRTKRMALRCRLIMIASNIHEAYLNGRTGFGNGKAVKKCLADKQLALPRPGEGG

SEQ ID NO: 12019 - protein, 260 aa, Klebsiella pneumoniae
HKFLFDTDEIGLFSCVICIAGTFPLSMFYNAPQAFTSRTRIMTQDELKKAVGWAALQYVQPGTIVGVGTGSTAAHFIDALGTMKGQIEGAVSSSDASTEKLKSLGITVFDLNSVDRLGIYVDGADEINGHMQMIKGGGAALTREKIIASVADKFICIADASKQVDILGKFPLPVEVIPMARSAVARQLVKLGGRPEYRQGVVTDNGNVILDVHGLEILDAIALENAINGIPGVVTVGLFANRGADVALIGTADGVKTIVK

SEQ ID NO: 12020 - protein, 277 aa, Klebsiella pneumoniae
SETLFHLTYPTLHEKEIRGQRSGKLITSLLHWQKRHKEQKMKTIGLLGGMSWESTIPYYRLINEGVKARLGGLHSASLVLHSVDFHDIEACQSAGDWDRAGEILAEAAVGLQQAGAEGIVLCTNTMHKVADVIAARCQVPFLHIADATGRAIAAKGQRRVALLGTRYTMEQTFYRGRLQEQFAIETLIPEADDRAQINQIIFDELCLGTFSEASRDYYLQTIAALAEQGAEGVIFGCTEIGLLVPAELSPLPVFDTAAIHAEDAVNFMLSAGPTPAA

SEQ ID NO: 12021 - protein, 358 aa, Klebsiella pneumoniae
KTAFRTSRSAPTFLGGIFDYDAKKERLEEVNAELEQPDVWNEPERAQALGKERSSLEAIVDTLDQMSQGLEDVAGLLDLAVEADDEETFNEAVAELDTLEEKLAQLEFRRMFSGEYDSADCYLDIQAGSGGTEAQDWASMLMRMYLRWAEARGFKTEIIEESEGEVAGIKSVTIKIIGDYAYGWLRTETGVHRLVRKSPFDSGGRRHTSFSSAFVYPEVEDDIDIEINPADLRIDVYRASGAGGQHVNRTESAVRITHIPTGLVTQCQNDRSQHKNKDQAMKQMKAKLYELEMQKKNAEKQAMEDNKSDIGWGSQIRSYVLDDSRIKDLRTGVETRNTQAVLDGSLDQFIEASLKAGL

SEQ ID NO: 12022 - protein, 427 aa, Klebsiella pneumoniae
DELSFSTTSVKTKQDGEMAKVSLEKDKIKFLLVEGVHQKAIDSLRAAGYTNIEFHKGALDSEQLKASIRDAHFIGLRSRTHLTEEIFAAAEKLVAVGCFCIGTNQVDLNAAAKRGIPVFNAPFSNTRSVAELVIGELLLMLRGVPEANAKAHRGVWNKQAIGSFEARGKKLGIIGYGHIGTQLGILAESLGMHVFFYDIENKLPLGNATQVQHLSDLLNMSDVVSLHVPENASTKNMMGAEELALMKPGALLINASRGTVVDIPALCDALASKHLAGAAIDVFPTEPATNSDPFTSPLCEFDNVILTPHIGGSTQEAQENIGLEVAGKLAKYSDNGSTLSAVNFPEVSLPLHGGRRLLHIHENRPGVLTAINQIFAAQSINIAAQYLQTSPQMGYVVIDIEAEEDVAQQALQAMKAIPGTIRARLLF

SEQ ID NO: 12023 - protein, 75 aa, Klebsiella pneumoniae
CTPSTSRNLILSFSSDTLAISPSCFVLTDVVLNESSSQQHIKKNYRGNMNVCVAVLKKCHPEGNRRTKHQKEKKW

SEQ ID NO: 12024 - protein, 575 aa, Klebsiella pneumoniae
EIPFHPLPRGITLNMYIKYNFKGVTMFCVQCEQTIRTPAGNGCSYAQGMCGKTAETSDLQDLLIASLQGLSAWALKAREYGIIDHQVDSFAPRAFFSTLTNVNFDSPRIVGYARQAIALREALKAQCLAIDASAAVDSPVADLQLVSDDLGDLQRQAADYTPNKDKAAIGENILGLRLLCLYGLKGAAAYMEHAHVLGQYDNAIYAQYHKIMAWLGTWPADMNALLECSMEIGQMNFKVMSILDAGETTKYGHPTPTQVNVKATEGKCILISGHDLKDLYNLLEQTEGTGVNVYTHGEMLPAHGYPELRKFKHLIGNYGSGWQNQQVEFARFPGPIVMTSNCIIDPTVGAYDDRIWTRSIVGWPGVNHLEGEDFSPVIAQAQQMAGFPYSEIPHLITVGFGRQTLLGAADTLIDLVSREKLRHIFLVGGCDGARGERNYFTDFATSVPDDCLILTLACGKYRFNKLDFGDIEGLPRLVDAGQCNDAYSAIILAVTLAEKLGCGVNDLPLSLVLSWFEQKAIVILLTLLSLGVKNIVTGPTAPGFFTPDLLAVLNEKFGLRSVTTVEQDMQQLLSA

SEQ ID NO: 12025 - protein, 307 aa, Klebsiella pneumoniae
LPPFRMPGIRTRRRLAVTFFTNEEGVRFQPDMMGSVVFAGEYPLAQALAAKDLDGITLDEALRNIGYKGERQPGDMAVDSYVELHIEQGPILDKEQIDIGVVTGVQGISWQEFTLRGVSNHAGTTPMSMRRDAGLAAAKIAVFARELALSLGGNQVATVGHFSVKPNLINVIPNHVVMSVDLRNTDNAILCLAEQQLAEFVAKTSQEEGVEITSRSLVRFNPVIFADEIVNAVEAEAERQALSYRRLPSGAGHDAQFMASVCPAGMIFVPCVDGISHNVKEHSAAKDLIAGANVLLQVVLQRAQRMD

SEQ ID NO: 12026 - protein, 223 aa, Klebsiella pneumoniae
RERSPLPGNISVVASDSELILASRKAEKVYNDSLTVDLIIMDKFDANRRRLLALGGAALGAAAILPAPAFATLSTPRPRILTLNNLHTGESLRAEFFDGRGYIQDELARLNHFFRDYRANKIKSIDPNLFDHLYRLQGLLGTNKPVQLISGYRSLDTNDELRARSRGVAKHSYHTKGQAMDFHIEGISLSNIRKAALSMRAGGVGYYPRSNFVHIDTGPVRHW

SEQ ID NO: 12027 - protein, 497 aa, Klebsiella pneumoniae
ARWSPTGRLFYNAKESGVSQSVLVLGASGYIGQHLVRELSARGYPVLAAARHIDRLQKLALPGVTCRSVDLNQPQDLPALLTGIDTLYYLVHGMGEGGDFIAHERRVATYVRDALRQSSVRQVIFLSSLQAPAQEQSDHLRARQITGDLLRESGVPVTELRAGIIVGAGSAAFEVMRDMVYNLPVLTPPRWVRSRTTPVVLENLLVDLVELLNHPSDAHRVFEAAGPEVLSYQQQFIRFMAVSGKHRPLIPIPLPTRWISVWFLNVITSVPPTIAKALIQGLKHDLIADDRALRALIPQTLIPFDQAVRRTLKEEEQLVNSSDWGYDAQAFARWRPEYGYYPKQAGCTVATQASRQALWQVVNQIGGEEEYFFGNLLWKTRGAMDLLVGHRLAKGRPQRAYLQTGDTVDSWKVIIVEEEKQLTLLFGMKAPGLGRLSFTINDKGDRRELDVRAWWHPHGMPGLIYWLLMIPAHLFIFRGMAQRIARLAEQISGRVEG

SEQ ID NO: 12028 - protein, 195 aa, Klebsiella pneumoniae
SDLFSLHVLAILRPELKIRLTENMVDKRESYTKEDLLASGRGELFGAKGPQLPAPNMLMMDRVIKMTETGGNYDKGYVEAELDINPDLWFFGCHFIGDPVMPGCLGLDAMWQLVGFYLGWLGGEGKGRALGVGEVKFTGQVLPTAKKVTYRIHFKRIVNRRLIMGLADGEVLVDDRLIYTANDLKVGLFQDTSAF

SEQ ID NO: 12029 - protein, 174 aa, Klebsiella pneumoniae
PITPDFLLVLFLSGCAYSGSTQDAKKDAHQMVKGLLNTVNRRLSHDDAGKLLLRLAVGGLMLFHGIHKLIDGVDGISGMLAAQGLPGFIAYGVLVGEVVAPCLLILGVLTRPAALVLAFTMVVAWLMVGLDKTFALDTVGAWAIENLVYFFVGALAIALLGAGRYSLAGQSAWR

SEQ ID NO: 12030 - protein, 424 aa, Klebsiella pneumoniae
RYTPPPFSALVSMERSSERMLLRTMTQFTSPVLHSLLDTDAYKLHMQQAVFHRYGDVHVAAEFRCRGDDLLGIYADAIREQVESMRDLRLRDDEYRWLSTLPFFRQDYLNWLRDFRYDPSQVTVSNDNGKLNIRLTGPWREAIMWEVPLLAVISELVHRYRSPEMGVDQALNTLEHKLGDFATMTADLDMSAFRLMDFGTRRRFSREVQEGIVRRLQQEPWFVGTSNYDLARRLNLTPMGTQAHEWFQAHQQISPSLASSQRAALAAWLEEYPDQLGIALTDCITMDAFLRDFGPEFATRYQGLRHDSGDPVEWGEKAIAHYQKLGIDPLSKVLVFSDNLDLAKAVDLYRHFASRVKLSFGIGTRLTCDLPQVKPLNIVIKLVECNGKPVAKLSRQPGKTICHDKAFVRALREAFDLPPIKKAS

SEQ ID NO: 12031 - protein, 487 aa, Klebsiella pneumoniae
HRYPPAVGGRDFFIGLHREIIMSVVPVADVLQGRVAVDSEVTVRGWVRTRRDSKAGFSFLAVYDGSCFDPVQAVINNSLPNYNQEVLRLTTGCSVIVTGKVVASQGQGQSFEIQATSVEVTGWVEDPDTYPMAAKRHSIEYLREVAHLRPRTNLIGAVARVRHTLAQALHRFFNEQGFFWVSTPLITASDTEGAGEMFRVSTLDLENLPRNDQGKVDFDKDFFGKESFLTVSGQLNGETYACALSKIYTFGPTFRAENSNTSRHLAEFWMLEPEVAFANLNDVAGLAEAMLKYVFKAVLEERADDMQFFAERVDKDAIDRLQRFITADFAQVDYTDAVTILENCGKQFENPVYWGVDLSSEHERYLAEEHFKAPVVVKNYPKDIKAFYMRLNEDGKTVAAMDVLAPGIGEIIGGSQREERLDVLDARMAEMGLNKEDYWWYRDLRRYGTVPHSGFGLGFERLIAYVTGVQNVRDVIPFPRTPRNATF

SEQ ID NO: 12032 - protein, 567 aa, Klebsiella pneumoniae
HLIPVYCGIVSQIQAMRKYNNMENKSGEAKVQKVKNWSPVWIFPIVTALIGAWILFYHYSHQGPEVTLITTNAEGIEGGKTRIKSRSVDVGVVESATLTDDLTHVEIKARLNSGMQKLLHNDSVFWVVKPQVGREGISGLGTLLSGAYIELQPGTKGSVPAQYPLLDSPPLASPDAKGIRILLESSKAGQLSPGDPVLFRGYRVGSVETSTFDTQKRRITYQLFINAPNDRLVTTNVRFWKDSGIAVDLTSAGMRVEMGSLSTLFGGGVSFDIPEGLDLGEPVANKTEYHLFDDQKSIQDSVFTEHIDYVMFFKDSVRGLQPGAPVEFRGIRLGTVGKVPFFIPGLKQRLNDDYRIPVEVRVEPQRLINQLGGDPNIRAHIDDLINRGLRGSLKTGNLVTGALYIDLDFYPKAPPRGKIQEFNGYPIIPTISGGLAQIQQRLMDALDKINNLPINPLLEQATSTLAQSEKTMQHVQTTLDNLNKITSSQSMQQLPADMQTTLRELNRSMQGFQPGSAAYNKMVADMQRLDQVLRELQPVLKTLNDKSNALVFEAKDKKDPQPKGAKQ

SEQ ID NO: 12033 - protein, 397 aa, Klebsiella pneumoniae
YPGPHLAAHRHTRSEIMSLNMFWFLPTHGDGRYLGTEEGARPVDYGYLQQIAQTADRLGFTGVLIPTGRSCEDAWLVAASMIPVTQRLKFLVALRPSVVSPTVAARQAATLDRLSNGRALFNLVTGSDPAELAGDGVFLDHTERYEASAEFTHIWRKLMEGETVTFNGKHQRVRDAKLLFPPLQQPRPPLYFGGSSEVAQELAAEQVDLYLTWGEPPAQVAEKIAQVREKAARHGRQVRFGIRLHVIVRETNEEAWQAADSLISHLDDETIARAQAAFARTDSVGQQRMAALHNGRRDKLEISPNLWAGVGLARGGAGTALVGDAATVAERINEYAALGIDSFIFSGYPHLEEAYRVGELLFPLLDVAVPSIPQPQNLRVQGEAVANEFIPRKVAQS

SEQ ID NO: 12034 - protein, 188 aa, Klebsiella pneumoniae
SPPPTGKPVQTGCARFAPRLFSVPATAFSPSLPALSPGRFPATRRRSPGSDPADGTAPSRAPAPAAPGYTEWRGSAAHRAPADSRRAGFSAHPLPARRPQRGLRSLPDDRRLPPPLHSALPDGSAARRDPLRSARFFPADAAQSAPGSGDRWRPGNRLPDRPPRRYAPAVRAPCRRAYTAQPPAANAR

SEQ ID NO: 12035 - protein, 430 aa, Klebsiella pneumoniae
PMNTENIIINKGYSDPAKWHSEDTVWVLGLFGTAIGAGVLFLPINAGIGGFWPLLIVFVLAFPITYLAHRGLARFIYSSNTPESSITDVIGEHFGALAGKVFTVIYFFAVYTILIMYAVAITNTAQSFITHQLAMAEPPRSLVAIVLILGLMFIVRFGQRLIMRVMSTLVYPFIISLIFMALFLIPHWNGAILQTVSFSATGDGQGIMLSLWMTFPVLVMSFNHYPIISPMVVRQKQRYGLALAEGKCAQIQRYGILLMTVVVLFFVLSCVLSLSPQQLAEAKAQNLSILSYLANQYDTPIIAWLSPIIAFVAITKSFLGHYIGAYESLRDLILEAAAARGKKPGIRLVDAVILVFMVLTCWFAAYKNPSILGIIECISGPTGAAILLLLPMYAIHKLPVLAPWRGKASNVFVTLIGLITVSAIFYGMFQ

SEQ ID NO: 12036 - protein, 620 aa, Klebsiella pneumoniae
QRFTLGMQGFNAVFTCRAAKQRQRREARITPLAIGNLHHHRFFQLVDAEYAVVKGLRIAFDQIEIFRAIFQSLKLLGYPRQIRYHDRMARRTVQRGEVRRIVQANIIVDLGQQNAAEPFRQGVEARIFRTARLAETLDFFVDGALAGADLVTFNDSLSFTLQQLLQVFGDLLAGLKLLAALLAQLVKAVLRRQPDRRPAHQRLGTRLQLLQLLTQRHALLLSIGDAVGQRRDARFQLLMQRFQIVDIVTFTLAFAELGQLTLSVLLLAQALFKLVEAAAQPLRLLGLVALVHAVAQQFARHVPGFIARQRAVNRRHQLVSLFKLAVRGLRHAYFLFQRQHFLRRFLLFRLEGFQPLVGALRGQIRQMAQRLRALQRLQRLVILNGAGLLHIERLLIVGELAFQLIHFQLGGLSAGFVLFLTIDGFRHHFILLFQTDLQLVEIRFVALDFFLLTQRSLHQVQVIAGGLVIGFQIALRAVMLLQFARHVDVLILLSRQLRTRGEEIAAILQRLIQVNAPLVGVTHIVRRHVVGGFADQVFKQIAVGLGNANGFQRHAVFPQRRFHILERFTHAAVFRQQVVAQRAGNGAGDPAVQRGLNQAVVLATIGGGTQATRHHAQIEH

SEQ ID NO: 12037 - protein, 197 aa, Klebsiella pneumoniae
KRSTAEGSETMKKWLLAAAVCVLTACSSGGESKTYYQLPVVQGGAQSAASQGARLLWVEQVSIPDYLAGNGVVYQTTDVQYVIANNNLWASPLDQQLRTTLVANLSQQLPGWVVSSQPLGSEQDTLNVAVNGFHGRYDGRVIVSGEWLLKHQGQLIKRPFNIVLRQEQDGYDAMVKTLAQAWSQEAAAIASELNRLP

SEQ ID NO: 12038 - protein, 258 aa, Klebsiella pneumoniae
RMNTARLNPGIPLLLNGVTKRYGDNTILNELDLHIPSGQFVAVVGRSGGGKSTLLRLLAGLEKPNAGELLAGATPLAAIQDDTRMMFQDARLLPWKTVIDNVGLGLKGAWRDAALQALASVGLESRAQEWPAALSGGQKQRVALARALIHRPRLLLLDEPLGALDALTRLEMQELIVSLWQEHGFTVLLVTHDVSEAVAMADRVLLIEEKKIGLDLSVDIPRPRRTGSAKLAELEAEVLDRVMKRGDSERAPRLFSHG

SEQ ID NO: 12039 - protein, 404 aa, Klebsiella pneumoniae
IVDTIKYQLNARRQPYGQGADLSLLNESVGNEVLAFHQKFPDYRVTPLRKLEFLSQRLGLGSIHIKDEAQRFGLNAFKGLGGSYAMGKYLAALLERDINTLSFAELNSPVIKARIKDIVFVTATDGNHGRGVAWAAEQLGLRAVVYMPKGSSPVRAQNIRRHGAECTITELNYDDTVRLAAKTAREQGWVLLQDTAWQGYEQIPTWIMQGYMTLAVEIWQQLAESGAPMPTHLFLQAGVGSFAGSIMGYFIEKMQQQAPTIIIVEPHKANCLYRSATINDGLPHSVGGDMSTLMAGLACGEPNITSWPMLRDHATCFISADDCLAANGMRLLAAPRPGTDEPFVSGESGAIGTGVLYALMTQPAYRELAESLRLNADAQVLLISTEGDTSPDVYEDIVWFGRNG

SEQ ID NO: 12040 - protein, 206 aa, Klebsiella pneumoniae
PMTTQYGFFIDSARCTGCKTCELACKDYKNLTPEVSFRRIYEYAGGDWQEDNGVWQQNVFAYYLSIACNHCEDPACTKVCPSGAMHKREDGFVVVNEEVCIGCRYCHMACPYGAPQYNADKGHMTKCDGCHERVAEGKKPICVESCPLRALDFGPIAELRAKHGQLAAVAPLPSAHFTRPSIVIKPNANARPCGDTTGYLANPKEV

SEQ ID NO: 12041 - protein, 358 aa, Klebsiella pneumoniae
GHRTGENQLAQVKQKQYVEPDQGKAVIDLRSDTVTRPGRAMLEAMMAAPVGDDVYGDDPTVNELQRYAADLAGKEAALFLPTGTQANLVGLLSHCQRGEEYIVGQGAHNYLYEAGGAAVLGSIQPQPIDAAADGSLPLDKVAAKIKPDDIHFAPTRLLSLENTHNGKVVPRDYLQEAWAFTRQRNLALHVDGARIFNAVVAYGCELRDIAQYCDSFTICLSKGLGAPVGSLLLGSEAYIRRAVRWRKMVGGGMRQAGILAAAGLYALKNNVQRLQEDHDNAAWMAEQLRAIGADVTRHDTNMLFVRVGEEQAPALGKFMQAQGVLINASPVVRLVTHLDVNRQQLSEVVAHWQAFLQR

SEQ ID NO: 12042 - protein, 98 aa, Klebsiella pneumoniae; identical to SEQ ID NO: 9193

SEQ ID NO: 12043 - protein, 106 aa, Klebsiella pneumoniae
LIFALKETGGIMTKSELIERLASQQSHIPAKAVEDAVKEMLEHMASTLAQGERIEIRGFGSFSLHYRAPRTGRNPKTGDKVELEGKYVPHFKPGKELRDRANIYEG

SEQ ID NO: 12044 - protein, 68 aa, Klebsiella pneumoniae
RIVAQNGGDHGGAMRRRVRVVGADHRLHLTEGAVYSLLIRGDQSAGADALVVQAKVFRVGAGDQQLFM

SEQ ID NO: 12045 - protein, 120 aa, Klebsiella pneumoniae
PAGAAGATGTTGHSRTLFVSGGDLRQLPHPAGRGRSESVKEKRGCRRWDYSRLQLCTENSATPGALNRLPQTVADRALRRLQSVIHDFYDIAQLHDAAGKGETRLSQQTERGVIARLHHQ

SEQ ID NO: 12046 - protein, 297 aa, Klebsiella pneumoniae
YLTANLYKERVSVKADNPFDLLLPAAMAKVAEEAGVYKATKHPMKTFYLAITAGVFISIAFVFYITATTGTAAMPYGIAKLIGGICFSLGLILCVICGADLFTSTVLIVVAKASGRITWGQLAKNWLNVYFGNLVGALLFVLLMWLSGEYMTANGGWGLNVLQTADHKMHHTFVEAVSLGILANLMVCLAVWMSYSGRSLMDKAMIMVLPVAMFVASGFEHSIANMFMIPMGIVIRNFASPEFWTAIGSTPESFSHLTVMNFITDNLIPVTIGNIIGGGLLVGLTYWVIYLRGNDHH

SEQ ID NO: 12047 - protein, 263 aa, Klebsiella pneumoniae
NNAALFLSSSLITINKDRHGPLVRVNNLIEVVMFRKLAAECFGTFWLVFGGCGSAVLAAAFPELGIGFAGVALAFGLTVLTMAFAVGHISGGHFNPAVTLGLWAGGRFPAKEVIGYIIAQVVGGIIAAAVLYVVASGKAGFDAAASGFASNGYGEHSPGGFSMLSAIVIEIVLTCGFLLVIHGATDKHAPAGFAPIAIGLALTLIHLISIPVTNTSVNPARSTAVAIFQGGWALQQLWLFWVMPIVGGILGGVLYRTLLEKRD

SEQ ID NO: 12048 - protein, 100 aa, Klebsiella pneumoniae
FLNASVCGCVKQEASPCSTIWPFSIYTTRLAVLRATSTSWVTITWVMPVSASSRMMLTIWAVISGSSAAVGSSNSRTCGSIISARAMATRCCWPPDKCSG

SEQ ID NO: 12049 - protein, 101 aa, Klebsiella pneumoniae
ADPATAVAWSAFAAVDYRHYASAAGGSGSPAAQGRQADAPAGQPVVAAVRAATQSDRTAAAAAQADGVSADAAQVDNPAAERPPVVDSAGPAAAAGLPAWA

SEQ ID NO: 12050 - protein, 181 aa, Klebsiella pneumoniae
RLRAGTGVGKEYRETIIMVDSKKRPGKDLDRIDRNILNELQKDGRISNVELSKRVGLSPTPCLERVRRLERQGFIQGYTALLNPHYLDASLLVFVEITLNRGAPDVFEQFNAAVQKLEEIQECHLVSGDFDYLLKTRVPDMSAYRKLLGETLLRLPGVNDTRTYVVMEEVKQSNRLVIKTR

SEQ ID NO: 12051 - protein, 364 aa, Klebsiella pneumoniae
GEMAQVYNFSSGPAMLPAEVLKLAQQELCDWHGLGTSVMEISHRGKEFIQVAEEAEQDFRALLNIPSNYKVLFCHGGGRGQFAGIPLNILGDKKVADYVDAGYWAASAVKEAKKYCTPNVIDAKITVDGKRAVKPMSEWQLTPGAAYLHYCPNETIDGIAIDETPNFGDDVIVTADFSSTILSREIDVNRFGVIYAGAQKNIGPAGLTLVIVREDLLGKASVACPSILDYTVLSENDSMFNTPPTFAWYLAGLVFKWLKQQGGVAAMDKINQQKAELLYGVIDNSGFYRNDVAQANRSRMNVPFQLADSALDKLFLEESFAAGLHALKGHRVVGGMRASIYNAMPLDGVKALTDFMLDFERRHG

SEQ ID NO: 12052 - protein, 258 aa, Klebsiella pneumoniae
SVIYKQCSLSGVLMRIMRGVYIPCALLKEKKMTANIPVITIDGPGGAGKGTLCKAMAEALGWHLLDSGAIYRVLALAALHHHVDVESEEALVPLAAHLDVRFISTDGNLEVVLEGEDVSSEIRTQEVANAASKVAAFPRVREALLRRQRAFRELPGLIADGRDMGTVVFPDAPVKIFLDASADERAHRRMRQLQEKGFDVNFERLLSEIKERDDRDRNRAVAPLVPAADALVLDSTELNIEQVIEKALQYAREKLAVA

SEQ ID NO: 12053 - protein, 113 aa, Klebsiella pneumoniae
IVIYFFRFARCQDQLAIARHDRDVARQRRAFALTALRIERNDMYMHFWRTKGTLPGIIANVKAASPQENRALQRCSALFYPVLGQQNPLNYFIYLINCSAFVRICALDRAVIS

SEQ ID NO: 12054 - protein, 96 aa, Klebsiella pneumoniae
ALIQALVWTHFFRSSRDTRLISALVCPFQAISFLSLHASFPSFFDLVEKKTVVANCAATGYEYREKKATSMRKIHASVIFVTYIRVHFLFARRSRR

SEQ ID NO: 12055 - protein, 582 aa, Klebsiella pneumoniae
RRYQKKEMEIMKQTVAAYIAKTLEQAGVKRIWGVTGDSLNGLSDSLNRMGTIDWMPTRHEEVAAFAAGAEAQLTGELAVCAGSCGPGNLHLINGLFDCHRNHVPVLAIAAHIPSSEIGSGYFQETHPQELFRECSHYCELVSTPEQIPQVLAVAMRKAVINRGVSVVVLPGDVALKAAPESASSHWYHAPLPTVTPAEEELRKLAQLIRYSSNIALMCGSGCAGAHQELVEFAAKIKAPIVHALRGKEHVEYDNPYDVGMTGLIGFSSGFHTMMNADTLILLGTQFPYRAFYPTDAKIIQIDINPGSIGAHSKVDMALVGDIKSTLKALLPLLEEKTDRHFLDKALEHYRDARKGLDDLAKPSDKAIHPQYLAQQISHFADEDAIFTCDVGTPTVWAARYLKMNGKRRLLGSFNHGSMANAMPQAIGAKATAPERQVVAMCGDGGFSMLMGDFLSLAQMKLPVKIVIFNNSVLGFVAMEMKAGGYLTDGTELHDTNFARIAEACGIKGIRVEKASEVDEALQTAFRTDGPVLVDVVVAKEELAIPPQIKLEQAKGFSLYMLRAIISGRGDEVIELAKTNWLR

SEQ ID NO: 12056 - protein, 577 aa, Klebsiella pneumoniae
AECHLASALAILLITEGEWWCSGGDMLLERVEIVGFRGINRLSLMLEQNNVLIGENAWGKSSLLDALTLLLSPEFDLYHFVRDDFWFPPGDIQGREHHLHIILTFRETEPGRHRVRRFRPLQRCWVPCDDGYHRVFYRLEGELAEDDSVMTLRSFIDGEGEALVLEEIDELARHLVRLMPVLRLRDARFMRRIHNGTVPHSPQIEITARQLDFLSRELVSHPQNLSDGQIRQGLSAMVQLLEHYFAEQSSAQTRHRLMRRRSHDEQRSWRYLDIINRMIDKPGGRSHRVILLGLFATLLQAKGTVRLDRDARPLLLIEDPETRLHPIMLSVAWHLLNLLPLQRVTTTNSGELLSLTPVEQVCRLVRESTRVSAWRLGPGGMNAEESRRIAFHIRFNRASSLFARCWLLVEGETETWVINELARQCGHHFDAEGVKVIEFAQSGLKPLIKFARRMGIQWHVLVDGDEAGKKYAATVRGLLNNDRELERDHLTSLPALDMEHFMYRQGFDDVYHRVAQIPDNVPMNMRRVITKAIHRSSKPDLAIEVAMEAGRRGVDAVPTLLKKMFSRVLWLARGRAD

SEQ ID NO: 12057 - protein, 415 aa, Klebsiella pneumoniae; identical to SEQ ID NO: 11334

SEQ ID NO: 12058 - protein, 135 aa, Klebsiella pneumoniae
TCHHPQLSSAGLRPGAGLRVAYGLARSAAGAGPGLLVRAADSRSQTGGLAARPGLCSDTGGRDDRPRRILWPAYDRWDGCRQLTTSIMPVPNHRHDENVLSIDEIFQLKLTSAFINKPAKTIVYYLLSHLFPSSG

SEQ ID NO: 12059 - protein, 263 aa, Klebsiella pneumoniae
AAHQHGPGWATSGENTAMSVIGRIHSFESCGTVDGPGIRFITFFQGCLMRCLYCHNRDTWDTHGGKEITVEELMKEVVTYRHFMNASGGGVTASGGEAILQAEFVRDWFRACKKEGIHTCLDTNGFVRRYDPVIDELLEVTDLVMLDLKQMNDEIHQNLVGVSNHRTLEFAQYLAKKNINVWIRYVVVPGWSDDDDSAHRLGEFTRDMGNVEKIELLPYHELGKHKWVAMGEEYKLDGVHPPKKETMERVKGILEQYGHKVMY

SEQ ID NO: 12060 - protein, 60 aa, Klebsiella pneumoniae
NSLQTLFKLEVPALFSEQLRVTTLLNYLAVVHDYYLIKTRQVPQAMGHHQHGFVAHDICQ

SEQ ID NO: 12061 - protein, 720 aa, Klebsiella pneumoniae
HRAHIGYNAHQFSLSKSDDMNSLFASTARGLEELLKTELEGLGATDCQVVQGGVHFQGDTRLLYQSLMWSRLASRIMLPLGECRVYSDLDLYLGVQAIPWTEMFNPGATFAVHFSGLNDEIRNSQYGALKVKDAIVDSFTRKNLPRPNVDRESPDLRINVWLNKETAHISLDLSGEGLHLRGYRDGTGMAPIKENLAAAIVMRSGWVPGTPLLDPMCGSGTLLIEAAMLATDRAPGLHRGHWGFGGWAQHDDAIWKEVKAEAQTRARQGLAAYESRFYGSDVDVRVIERARRNARRAGIGELVDFDVKDVAQLNNPLPKGPYGTVISNPPYGERLESEPALIALHSLLGRIMKSQFGGWNLSVFSASPELLSCLQLRADKQFKAKNGPLDCVQKNYHLAESEGGKPAMLAEDFANRLRKNLKKFEKWARQEGIECYRLYDADLPEYNVAIDRYADWVVVQEYAPPKTVDAHKARQRLFDIIAATIAVLDMAPNKLVLKTRERQKGKNQYQKMAEKGDFIEVQEYNARLWVNLTDYLDTGLFLDHRIARRMLGQMSKGKDFLNLFSYTGSASVHAGLGGARSTTTVDMSRTYLEWAERNLRLNGLTGRAHRLMQADVLGWLRESTEQFDLIFIDPPTFSNSKRMEDAFDVQRDHIRLMTDLKRLLRKGGTIMFSNNKRGFRMDHDGLAALGLKAQEISQKTLSQDFARNRQIHNCWLITAA

SEQ ID NO: 12062 - protein, 68 aa, Klebsiella pneumoniae
PWAQPMPFYMINHVTGNVCQRPIPSAPASQGDFQLTTEENSLVRSRWVTGSKNKHQHCEIRHLFAKKR

SEQ ID NO: 12063 - protein, 437 aa, Klebsiella pneumoniae
FDKHRISMLDPNLLRTEPDAVAEKLARRGFKLDVDKLRALEERRKVLQVQTENLQAERNSRSKSIGQAKARGEDIEPLRLEVNKLGEQLDAAKSELETLLAEIRDIALAIPNIPHDDVPVGRDENDNVEVSRWGTPRQFDFEVRDHVTLGEMHGGLDFAAAVKLTGSRFVVMKGQLARLHRALAQFMLDLHTEQHGYSENYVPYLVNQDTLYGTGQLPKFAGDLFHTRPLEEEADSSNYALIPTAEVPLTNLVRDEIIDEDDLPIKMTAHTPCFRSEAGSYGRDTRGLIRMHQFDKVEMVQIVRPEDSMAALEEMTGHAEKVLQLLGLPYRKVALCTGDMGFSACKTYDLEVWVPAQNTYREISSCSNVWDFQARRMQARCRSKSDKKTRLVHTLNGSGLAVGRTLVALMENYQQADGRIEIPEVLRPYMRGLEYIG

SEQ ID NO: 12064 - protein, 178 aa, Klebsiella pneumoniae
FAYKEIIMRYKLFAVLLPCALALSACTTVTPAYKDNGTRSGPCVEGGPDDVAQKFYDTQIQNRTQDPAALRPYLSDGLAQLLNDARQDPANSKLLQANPFSSSSTPADSAVVASASTIPNRDARNIPLRVDLKQGTQSWKDEVLMIQEGQCWAVDDVRYLGNNSHAPAGTLRQSLEKR

SEQ ID NO: 12065 - protein, 265 aa, Klebsiella pneumoniae
ILHNYSAKGSICGLNSYSYQTAQMSIKLNGINCFYGAHQALFDITLDCPQGETLVLLGPSGAGKSSLLRVLNLLEMPRSGSLSIAGNQFDFTRAPSDKAIRELRQNVGMVFQQYNLWPHLTVQQNLIEAPCRVLGLSKDQALARAEKLLERLRLKPYSDRYPLHLSGGQQQRVAIARALMMEPQVLLFDEPTAALDPEITAQIVSIIRELAETGITQVIVTHEVEVARKTASRVVYMENGHIVEQGDASCFTHPQTDAFKNYLSH

SEQ ID NO: 12066 - protein, 223 aa, Klebsiella pneumoniae
GTGNERSVMNYRIIPVTAFAQNCSLIWCGQTRLAALVDPGGDAERIKAVVAEAGVTLMQILLTHGHLDHVGAAAELAQHYGVPVIGPEKEDEFWLEGLPAQSRMFGLEDCQPLRPDRWLNEGDVVNVGNVALQVLHCPGHTPGHVVFFDDASRLLISGDVIFKGGVGRSDFPRGDHGQLIAAIKEKLLPLGDDVTFIPGHGPLSTLGEERRNNPFLQDEMPVW

SEQ ID NO: 12067 - protein, 440 aa, Klebsiella pneumoniae
TSKNNSVLSAVSPFSILWIKNFYRSRQNRVTPDFRWIDNVFSSGMMRSRSEHSSRFLPMTIYTRPVQMLLCGLLLLTLAIAVLNTLVPLWLAHENMPTWQVGMVGSSYFTGNLAGTLLAGWVIKRLGFNRSYYLASLIFAVGCVGLGITVGFWTWLSWRFIAGVGCAMIWVVVESALVCSGTSRSRGRLLAAYMMVYYVGTVLGQLMVSKLPTDLMSVLPWVTGLALAAILPLLFTRIMGQAEEPHETVRIWPMLKLRQARHGVNGCIISGIVLGSLYGLMPLWLNHQGVSDSGIGFWMAVMVSAGILGQWPVGRLADRYGRLLVLRVQVFVVILGCLAMLSQAAMAPALFVLGASGFTLYPVAMAWACEKVEHHQLVAMNQALLMSYTIGSLLGPTLTAMLMQNFSDNLLFIMIASVSFIYLLTLLRKAGHHPTPVAHA

SEQ ID NO: 12068 - protein, 476 aa, Klebsiella pneumoniae
CQKNLECRVARRPRERNNIADVLHAGHVSDEAFEAQTEAGMRHGAVATQVAIPPVVFFVKTHLCHTRVKHVETLFTLGTADNLADARRQNVHCRDGFTVFVKAHIERFNVFRVVFHHHRRFEVLFGQVTFVLRGEIHAPVHRVLELFAAVFQNGDGVGVIHLGKISGDKALQTVDSVFIHALGEELHVVRTLFQYRFEDVLEHRFRQAGNVVQVGEGHFRLQHPEFRQVAAGVGVLGAEGRAEGINLRQRTGVGFAVQLPGNGQERLFTEEVFVEIDFALIVTRQVFQIQRRHAEHFAGAFGIGGGDQRGGNPEEALFVEEAVQRLRQGVTHAGYRANQVGARTQVRYFTQILDAVALGRHRVGVRVFHPAGHFHAGRLDLKALTLTLRSHDFTGDNHRAAGGQTQHFLIVIGQRIINNGLYRIKAGTVIDGEERKASFRISAGTHPSADRDFAVNGNAALEYVGYRHNAHNNLSM

SEQ ID NO: 12069 - protein, 341 aa, Klebsiella pneumoniae
KRLNHNSAIPIPISNSKAGSGNSRPPTIFFSVKSMPDGSFFNHITKVMFGSYNRSLHSRRGYDKIAVLCWLVESLVQDRNFDDIAEKFSRNIYGTTKGQLRQAILWQDLEPLLAQLGPGPLRVLDAGGGEGQTAIKVAQLGHHVTLCDLSAEMVARARQAAADKGVIDNMHFVQCAAQDIAQHLESPVDLVLFHAVLEWVAEPQEILHTLWSTLRAGGGLSLMFYNANGLLMHNMVAGNFDYVQLGMPKKKKRTLSPDYPREPQQVYHWLEEIGWQIVSKTGVRVFHDYLREKRQQHDSYAALLALETRYCRQEPYLSLGRYIHVTALKSQAHSRRCKDKV

SEQ ID NO: 12070 - protein, 339 aa, Klebsiella pneumoniae
SDMKVLVTGATSGLGRNAVEYLRNKGISVRATGRNEAMGKLLSKMGAEFIPADLTELVSSQAKVMLAGIDTLWHCSSFTSPWGTQQAFDLANVRATRRLGEWSVAWGVRNFVHISSPSLYFDYHHHRDIQEDFRPHRFANEFARSKAASEEVINLLAQANPHTRFTILRPQSLFGPHDKVFIPRLAQMMQHYGSVLLPRGGSALVDMTYYENAVHAMWLASQPACDHLPSARAWNISNGEPRTLRSIVQKLIDELGIKCRIRSVPYPMLDIIARSMERFGDKTAKEPAFTHYGVSKLNFDFTLDITRAQDELGYQPVVTLDDGIVRTAAWLRDHGKLHR

SEQ ID NO: 12071 - protein, 94 aa, Klebsiella pneumoniae
IMMKRNILAVVIPALLVAGAANAAEIYNKNGNKLDFYGKMVGEHVWTTNGDTSSDDTTYARIGLKGETQINDQLIGYGQWEYNRFFAGSWGSGS

SEQ ID NO: 12072 - protein, 451 aa, Klebsiella pneumoniae
VEAKVSNLSLDFSDNAFQPLAARMRPENLAQYIGQQHLLAPGKPLPRAIEAGHLHSMILWGPPGTGKTTLAEVIARYASADVERISAVTSGVKEIREAIERARQNRNAGRRTILFVDEVHRFNKSQQDAFLPHIEDGTITFIGATTENPSFELNSALLSRARVYLLKSLTTDDIERVLDQAMNDKTRGYGGQDIILPDETRRAIAELVNGDARRALNTLEMMADMAESDDSGKRVLKAELLTEIAGERSARFDNKGDRFYDLISALHKSVRGSAPDAALYWYARIITAGGDPLYVARRCLAIASEDVGNADPRAMQVAISAWDCFTRVGPAEGERAIAQAIVYLACAPKSNAVYTAFKAALADARDRPDYDVPVHLRNAPTKLMKEMGYGQEYRYAHDEPNAYAAGEQYFPQEMAQTRYYHPTNRGLEGKIGEKLAWLAEQDQNSPIKRYR

SEQ ID NO: 12073 - protein, 402 aa, Klebsiella pneumoniae
SQWNLVMFENITAAPADPILGLADLFRADDRPEKINLGIGVYKDETGKTPVLTSVKKAEQYLLENETTKNYLGIDGIPEFGRCTQELLFGKGNAIIADKRARTAQTPGGTGALRVAADFLAKNTDVKRVWVSNPSWPNHKSVFTSAGLEVREYAYYDAANHALDFDGLLASLNEAQAGDVVLFHGCCHNPTGIDPTLDQWQQLAQLSVEKGWLPLFDFAYQGFARGLEEDAEGLRAFAALHKELLVASSYSKNFGLYNERVGACTLVAADQETVDRAFSQMKSVIRANYSNPPAHGASVVATILSNDALRAIWEQELTDMRQRIQRMRLLFVNTLQEKGASRDFSFISQQNGMFSFSGLTKEQVLRLREEFAIYAVASGRINVAGMTPDNMAPLCEAIVAVL

SEQ ID NO: 12074 - protein, 339 aa, Klebsiella pneumoniae
PPWNKICSSCLALKESLMTMPTSQCPWRMQVHHIHQETPDVWTLSLLCHDYYPYRAGQYALVSVRNSAETLRAYTLSSTPGVSEYITLTVRRIDEGTGSQWLTREVKRGDYLWLSDAMGEFTCDDKAEDKFLLLAAGCGVTPIMAMRRWLAKYRPQADVQVIYNVRSPEDVIFAEEWRNYPVTLVAEQNATHGFVAGRLTRELLQSVPDLASRTVMTCGPAPYMEKVEQDVAALGVTRFFKEKFFTPVAEAATSGLKFTKLQPAREFYAPVGTTLLDALESNKVPVTVACRAGVCGCCKTKVVSGKYSVTSTMTLTDAEIADGYVLACSCHPQSDLVLA

SEQ ID NO: 12075 - protein, 812 aa, Klebsiella pneumoniae
RKHLRVLFLCPPFTAILTKKACLAASEAIVWNAPRKPEFASRTPAPLCVTLPTHREVFMRLPWLAGCAIIAMLPLLWLPVLPGPCSLAGASALALALIRLHGRAVAGVAMTLLLVVWGVLSAHQALWPTRHLTGAIRQAEVILSETDGQTLHRGQMVRLRGRYLFPPVGVTLYGELAPAPACAGQHWLMTLRLRPVHGQLNDGGFDSQRYALAQHRPLSGGIVAASALDARCSLRARYLTSLTRRLQTYPRRAVMLGLGMGERLSLPTEIKVLMQNTGTSHLMAISGLHIALAASLIMLLLRGVQYILPGRWIGWRLPLVAGLAGAVGYAWLTGMQPPALRTCLGLAVCCALRLSGQRWTSWQVWLCCLGAILVADPLAVLSQSLWLSAFAVAGLIFWFQWLPLPAGRWRWPWKTVIALVHLQAGVTLLLLPLQLLLFHGVSLTSMAANLLAVPLVTLLAVPLILTAMLVHLSGPEIVESLLWLAADRVLAVLFWGLRRLPDGWLTLDARWLWISILPWLLVMGWRFQSWRHSPALCLSVLFLLTRPFSRQPPADEWRVTMLDVGQGLAMVIERHGKALLYDTGPAWPQGDSGQQVIIPWLRWHHLQLQGIMLSHEHLDHRGGLDSVLQAWPQAWVRSPLGWAHHLPCHRGERWQWQGLNFQALWPLPGSTAKGNNHSCVVRIDDGRSSILLTGDIERQAEQAMISRYWRHLTSTLIQVPHHGSNTSSSALLIRRVDGAAALASASRYNAWRMPSYKVVQRYRQRGYRWFATPQQGQITVVFSAEGWQIHSLRDQVLPRWYHQWFGAPADNG

SEQ ID NO: 12076 - protein, 430 aa, Klebsiella pneumoniae
AVVERAQQAAFTIHFEIACRPDGRGADITGENGIFIGKMTDLLRQILRVNGFIAGFSQIVEPFSRVAIVLQRLIEEVAIGFLFQQRQQRLQRRFNIAHQRHVDLTVCADAAGVDVDLDNFRVGWVEGAIGELGAQQDQGIGVHHGVEARREANQPGHAHIVRVVVLHVLFAAQGVDDGGFNFGCELHQFLVGAGATAAAHERDIAGVANKLRQLAQLFFRRGDRRQRRMIPVAAGAFRGGLQRHIAGQHHHRDAAVNHCLTHRHCQHLRDLLRRGDQFAVMAALAEQLLRMGFLKIAAADFAGWDVGGDGQHRDMVAMTVKQTVNQVQVARSAGAGADRQLAGQLRFRASGESGDLFVPGGHPVDGAHAVKAIAQSIEGISGDAPDTFHAGLFQRFGNVCRHGLFHDLHLLFLITPSSLDETDRNVTDYS

SEQ ID NO: 12077 - protein, 270 aa, Klebsiella pneumoniae
RKAEETVMAKSTHPLLLRLAPWLLPVGTVIVWQLASSVGWLSTRVLPSPEGVLKAFWTLSASGELWQHLAISSWRALVGFAIGGSIGLILGLISGLSRWGERLLDTSIQMLRNVPHLALIPLVILWFGIDETAKIFLVSLGTLFPIYINTWHGIRNIDRGLVEMARSYGLSGFALFRHVILPGALPSVMVGVRFALGLMWLTLIVAETISANAGIGYLAMNAREFLQTDVVVVAIILYAILGKLADVCAQLLERLWLRWNPAYHLQEANA

SEQ ID NO: 12078 - protein, 174 aa, Klebsiella pneumoniae; identical to SEQ ID NO: 9228

SEQ ID NO: 12079 - protein, 441 aa, Klebsiella pneumoniae
SMSEFSQTVPELVAWARKNDFSISLPVDRLSFLLAIATLNGERLEGEMSEGELVDAFRHVSDAFEQTSETISQRANNAINDLVRQRLLNRFTSEITEGNAIYRLTPLGIGITDYYIRQREFSTLRLSMQLSIVAGELKRAADAAEEGGDEFHWHRNVFAPLKYSVAEIFDSIDLTQRIMDEQQQLVKDDIAQLLNKDWRAAISSCELLLSETSGTLRELQDTLDAAGDKLQANLLRIQDSTMARDDLHFVDRLVFDLQSKLDRIVSWGQQAIDLWIGYDRHVHKFIRTAIDMDKNRVFAQRLRQSVQTYFDEPWALTYANADRLLDMRDEEMALRDEEVTGELPADLEFEEFNEIREQLAALIEAQLAVYKEKGIPLDLGLVAREFLAQYPRGRHFDVARIVVDQAVQLGVAQADFTGLPAKWQPINDYGAKVQAHVIDKY

SEQ ID NO: 12080 - protein, 582 aa, Klebsiella pneumoniae
MQNDKDLSTWQTFRRLWPIIAPFKAGLIVAAVALVLNAGSDTFMLSLLKPLLDDGFGKTDRSVLLWMPLVVIGLMVLRGITSYISSYCISWVSGKVVMTMRRRLFGHMMGMPVAFFDKQSTGTLLSRITYDSEQVASSSSSALITVVREGASIIGLFVMMFYYSWQLSLILIVLAPIVSVAIRVVSKRFRNISKNMQNTMGQVTTSAEQMLKGHKEVLMFGGQEVETKRFDKVSNKMRLQGMKMVSASSISDPIIQLIASLALAFVLYAASFPSVMDTLTAGTITVVFSSMIALMRPLKSLTNVNAQFQRGMAACQTLFAILDSEQEKDEGTRVIERAKGNLKFENVTFTYPGREVAALRNINLDIPEGKTVALVGRSGSGKSTIASLITRFYDVDEGQILLDGHDLREYKLSSLRDQVALVSQNVHLFNDTVANNIAYARTEEYSREQIEEAARMAYAMDFINKMDNGLDTIIGENGVMLSGGQRQRIAIARALLRNSPILILDEATSALDTESERAIQAALDELQKNRTSLVIAHRLSTIEQADEIVVVEDGRIVERGTHHDLLEHKGVYAQLHKMQFGE

SEQ ID NO: 12081 - protein, 385 aa, Klebsiella pneumoniae
NHRLERQGNSRNRNMKVKGKRRTVWWLLAIVVLGLAIWGWRILNAPLPSYQTLVVRKGDLQQSVLATGKLDALRKVDVGAQVSGQLKTLHVNIGDKVKKDQLLGVIDPEQAQNQIKEVEATLMELRAQLNQARAESKLAQVTLARQQQLAQRQLVSRQDLDTAATDLAVKQAQIGTIEAQIKRNQATLDTAKTNLDYTRILAPMAGEVTQITTLQGQTVIAAQQAPNILTLADLSTMLVKAQVSEADVIHLRPGQKAWFTVLGDPLTRYEGKLKDILPTPEKVNDAIFYYARFEVPNPQGILRLDMTAQVHIQLAEVKNVITIPLSALGDAVGDNRYHVRLLRTGEVKEREVIIGARNDTDVAVVQGLEEGDEVIVGESASGAAK

SEQ ID NO: 12082 - protein, 234 aa, Klebsiella pneumoniae
PACDALRTETRLMLDYLPELLKGLHTSLTLTVASIIVALILSLILTIILTLKTPGLVWIVRGYITLFTGTPLLVQIFLIYYGPGQFPSLQDYPWLWHLISEPWLCALIALSLNSAAYTTQLFYGAIRAIPDGQWQSCSALGMSKKDTLAILLPYAFKRALSSYSNEVVLVFKSTSLAYTITLMEVMGHGQLLYGRTYDVMVFGAAGIIYLIVNGLLTLLMRLVERKALAFERRS

SEQ ID NO: 12083 - protein, 81 aa, Klebsiella pneumoniae
SRRLPSCDMLLRNLSGPSGGNMDHRLLEIIACPVCNGKLYYSQDKQELICKLDSLAFPLRDGIPVLLETEARPLALEESHS

SEQ ID NO: 12084 - protein, 72 aa, Klebsiella pneumoniae
MAKEDNIEMQGTVLETLPNTMFRVELENGHVVTAHISGKMRKNYIRILTGDKVTVELTPYDLSKGRIVFRSR

SEQ ID NO: 12085 - protein, 299 aa, Klebsiella pneumoniae
STMEQLRTELSHLLGEKLSRVECVSEQAATALWFLYDAQGNPMPLLARSFTTPGVARQLAWKISTLARNGTVRMPVVYGVMTHEEHPGPDVLLLERLRGVPVEAPTRTPARWEQLQEQIVEGLLAWHRQDSGGCVGMVDNTQENLWPNWYRQRVEILWSTLNLYQDTGLTMQDKRLLFRSRECLPELFRDFNDNAVLVHGNFTLRSMLKDPRSDQLLAMVGPGMMLWAPREYELFRLAEGGQAEQLLWRYLQQAPVSEAFVWRRWLYLLWDEVDSLVNTGRFDRARFDLAAKSLLPWLA

SEQ ID NO: 12086 - protein, 429 aa, Klebsiella pneumoniae
SLMESLTLQPIARVEGTVNLPGSKSVSNRALLLAALARGTTVLTNLLDSDDVRHMLNALSALGVQYTLSADRTRCEVTGNGGPLRSAAALELFLGNAGTAMRPLAAALCLGCNDIVLTGEPRMKERPIGHLVDTLRQGGAQIDYLEQENYPPLRLRGGFQGGNVEVDGSVSSQFLTALLMTAPLAPQDTVIVIKGDLVSKPYIDITLHLMKTFGVEVDNQSYQRFVVRGKQQYQSPGDYLVEGDASSASYFLAAGAIKGGTVKVTGIGRNSVQGDIRFADVLEKMGATVTWGDDFIACTHGELKAVDMDMNHIPDAAMTIATAALFAQGTTTLRNIYNWRVKETDRLFAMATELRKVGAEVEEGEDYIRITPPAKLKYAEIGTYNDHRMAMCFSLVALSDTPVTILDPKCTAKTFPDYFEQLARISTLA

SEQ ID NO: 12087 - protein, 266 aa, Klebsiella pneumoniae
  UNSURE (113): Identity of amino acid at the above locations are unknown.
WQSDFPAQELADTRRPTARVRAPASLPLPRNNRAADVSLPPARPRALAPVGELARFAADTPLAPADTAAARADRHADRKPAADTALAQADRSAAQVDRHRDRKPAADTALAQXDRLAAQVDRHADRKSAADTALAPADRPAARADRHRDRKPAADTALAQADRPAAQVDRHTDRKPAADTALAQADTPAAQVDRHADRKPAVDTALAQADTPAVRFAPLAADKQPAGTERVQADTPAAADSWLPADKLAQRRDGPPVILPTPAARQ

SEQ ID NO: 12088 - protein, 394 aa, Klebsiella pneumoniae
CLQEQRMNQQQLKQQLIAWRHYLHAHPESAFEEQNTSRFIAEKLEAMGIEVHRDIGKTGVVGRLKCGDGKGVIAIRADIDAIQLSEQGDWSYRSMTAERMHGCGHDGHTCIALGAAQLLLQRQNFNGTVCFVFQPAEEPGYGARAMMDDGVIERFGIEEIYGLHNMPGMKAGTIATRVGGIMASEDNFIIRIKGQGAHAARPHMAKDPLVIAAEIILALQTIVSRNVDPNVPAVISCTELHTDGIRNAIPTHVEIKGDTRSFAPEVQMLLEERMRTISEAICAMHGATCQFSYTHEFAPTVNWQQCVDVAVTAAINVVGAEKVDGNVAQMMISEDFGAFLQKIPGCFIFLGNGDSSDAQGNTPLHNAWYDFNDEILLTGAEYFAEVVRTRLPQE

SEQ ID NO: 12089 - protein, 547 aa, Klebsiella pneumoniae
QRLLAFRCFERFSHSVVGEVRVFLLVHGSDSVFFFRFVFRTYRQAHYAVLTIHAGEFRFNFVANAQNQSCVFNAVTGCFRSTQVTFYAVSQFYGCAFSVNCSHFTNNDSAFLVQSNVVVERIFRELFNAQGDTLTLCVNLQNNCCDFVAFFVFTNCFFACNVPGDVRQVNQAVDAAVQADEDTEVSDRLDFTFNTVALVVGFRELLPWVRFALLQTQGDTTTLFVDIQNHYFHNVANVNNFGRVDVFVGPIHFGNVNQAFNALFDFNEAAVVGQVGHATSQFGTFRITFSDSYPRIFAQLFQAQGYTGTLAVELQHFNSDFVANVYDFARMLNAFPGHIGDVQQAVNAAQINECTVVSEVLNDTFDFHAFLQVFQQLIALCAVFGFDNGTTRNNNVVTLLVQLDDFELKLFAFQVQRVAHRTNVYQGTRQERTNTVQLNSEATFNFAVDNTGNSFSVFVSFLQRDPSFVTFSFLTGQQSFTEAVFYCIQSNVNFVTNLDFQLALGVFELLSRDGGLRFQTGVNQYYVFVDSNNNTTNDGTRAGFDFF

SEQ ID NO: 12090 - protein, 636 aa, Klebsiella pneumoniae
IMSLISMHGAWLSFSDAPLLDNAELHIEDNERVCLVGRNGAGKSTLMKILNREQGLDDGRIIYEQDLIVARLQQDPPRNVAGTVYDFVAEGIAEQAAYLKAYHDVSHQVMTDPSDKNLNELARLQEQLDNLGLWQLDSRINEVIEQLGLDANAQLASLSGGWLRKAALGRALVSGPRVLLLDEPTNHLDIETIDWLEGFLKTFKGTIIFISHDRSFIRNMATRIVDLDRGKLVTYPGNYDQYLLDKEEALRVEELQNAEFDRKLAQEEVWIRQGIKARRTRNEGRVRALKAMRRERGERREVMGSAKMQVEEASRSGKIVFEMENVNYQVDGKVLVKDFSAQIQRGDKIALIGPNGCGKTTLLKLMLGQLQADSGRIHVGTKLEVAYFDQHRAELDPDKTVMDNLAEGKQEVMVNGKPRHVLGYLQDFLFHPKRAMTPVRALSGGERNRLLLARLFLKPSNLLILDEPTNDLDVETLELLEELIDGYQGTVMLVSHDRQFVDNTVTECWIFEGGGRIGQYVGGYHDARGQQAQSLAQKQTVVKKTTEVAQPKAETVKRGGNKLSYNLQRELEQLPQKLEALEAELQTLQDQVADPDFFGQPHDRTQQVLAQLAEAEQALEAAFERWEYLEGLKNGA

SEQ ID NO: 12091 - protein, 573 aa, Klebsiella pneumoniae
MRALLPYLALYKRHKWMLLLGVVLAIVTLLASIGLLTLSGWFLSASAVVGVAGIYSFNYMLPAAGVRGAAIIRTAGRYFERLVSHDATFRVLQHLRVFTFSKLLPLSPAGLARFRQGELLNRVVADVDTLDHLYLRVISPLVGALVVIVVVTCGLSLLDVTLALTLGGIMLATLLVMPPLFYRAGKPAGESMTQLRGQYRQQLTAWLQGQAELMVFNASDRYRAQMEKTELSWQDAQRRQAELTALSQAVMLLIGGIAVVAMLWLASDGVGGNSQPGALIALFVFCALAAFEALAPVTGAFQHLGQVIASARRISQITDQQPEVTFVEDEASSPAQVALTLREVTFRYPQQPSPALENISLQIAAGEHIAILGRTGCGKSTLLQLLTRAWDPSQGEILLNNQPLSGLSEATLRQAMSVVPQRVHLFSATLRDNLLLAAPEADDAHLSATLEKVGLEKLLQDGGLNGWLGEGGRQLSGGELRRLAIARALLHDAPLMLLDEPTEGLDAATESQILHLLADVMRDKTVLMVTHRLRDLAGFNQIIVMDNGQIIEQGSHAELLAKQGRYFQFKQRL

SEQ ID NO: 12092 - protein, 77 aa, Klebsiella pneumoniae; identical to SEQ ID NO: 9235

SEQ ID NO: 12093 - protein, 162 aa, Klebsiella pneumoniae
SQACRTRYMMKLDAWDKKILTLLQRNNRLSQREIADRISLSPSAVNRRIAALEDAGVIKGSVSLVDASKVGRPITIMVQVTIENERLDLLEEDKQRFVTCPQVQQVYYVTGDFDFLLVINVRDMAEYEALTRELFFASGNIKSFRTIVSMQNAKQEMTVIIE

SEQ ID NO: 12094 - protein, 402 aa, Klebsiella pneumoniae
GLRCKHERWRKLGLFCPKRRFRPLQFFIGFQQRLMGREGLQIAIDRLETIERRFPAQRRAGGFDRVGAVHTDEGVQVLQRLTLFFLAQQQQGLQTAIVVRALRAEDRSIKFHGPLGPDQRLFQIAAGQGQHRFQLADAQSIPAVVFSGGEPQQFANAGEIIQTFIVHLLDQRQVIFFIPLAARQGQNGVPQMSAHAVVRQPQVFRRVYVRHPRDDDTAGVNAQVLVVGDVHFFIFGLEDGHQGGELFFGSTREAPVNEWIVGVLLEHIPGDQAAGVDKVGFEVRVLGDLFVIEGWRREDVEVFQAAALQQFGDGSLQRHAKVRVGAEGGEAGAVSRVKQHDADNRIFAAQRAIIGKDRETFSFQFGDRLHDARIARHDFRRDLRQADAFSDDAVFNVTFKDL

SEQ ID NO: 12095 - protein, 337 aa, Klebsiella pneumoniae
RRTCMSVLQLSLNEVRHLHLAAQGLLKKPRRRARPKDILSTIQQMSLLQIDTINVVARSPYLVLFSRLGSYPQHWLDESLRNGELMEYWAHEACFLPRSDFALVRHRMLNPDNMGWKYHRAWMEEHAGSIAELVAHIGQNGPVRSADFTHPRKGASGWWEWKPHKRHLEGLFTAGEVMVVERRNFHRVYDLTRRVMPDWDDERDALSREDAEAIMLRNSARSLGIFRAQWLADYYRLRQPALPGLLAAWQEKGLVVPVNVEALGEMWLHHEALAQLETAPGGKLTASHSAVLSPFDPVVWDRKRAEQLFNFSYRLECYTPAPKRQYGYFVLPLLHQG

SEQ ID NO: 12096 - protein, 349 aa, Klebsiella pneumoniae
QNRCALFLRQQIPYNPSPMYANYYGDLMGTAKHSKLLILGSGPAGYTAAVYAARANLQPVLITGMEKGGQLTTTTEVENWPGDPNDLTGPLLMERMHEHAAKFETEIIFDHISRVDLQNRPFRLTGDSGEYTCDALIIATGASARYLGLPSEEAFKGRGVSACATCDGFFYRNQKVAVIGGGNTAVEEALYLSNIASEVHLIHRRDSFRAEKILIKRLMDKVASGNIVLHTDRTLEEVTGDQMGVSGLRLRDTKNSDNVESLEVAGLFVAIGHSPNTAIFEGQLELENGYIKVQSGIHGNATQTSIPGVFAAGDVMDHIYRQAITSAGTGCMAALDAERYLDGLADACK

SEQ ID NO: 12097 - protein, 1253 aa, Klebsiella pneumoniae
APRCNPCCTAAAAPSPLLCIWAAGLTLFTGWSWVSIAEKLGGGILSVLTFASNRTRRDDTWVDEGEYEDDEEEYDDEEAARPQESRRARILRSALARRKRLAEKFTNPMGRKTDAALFSGKRMDDGEEVVQYSASGAPVAADDVLFSGASAARPAEDDVLFSGASAVRPGDFDPYDPLLNGHSIAEPVSAAAAATAAPQAWAESPVGHHGAAPAYQPEASYPPQQAYQPEPAPFQQAAYQPPAGQTAPQAYQPEPAPYQQPVYDPRVGQPAPQAYQPEPAPYQQPAYDPYAGQPAPQAYQPEPAPYQQPAYDPYAGQPAPQAYQPEPAPYQQPTYDPHAGQPAPQAYQPEPAPYQQPAYDPYAGQPAPQTYQPEPAPYQQPAYDPHAGQPAPQPYQPEPAAYQPQSAPVPPPEPEPEVVQEEVKRPPLYYFEEVEEKRARERELLASWYQPIPEPESPIATKPLTPPTTASKPPVETTVISAVAAGVHQATAASGGAAAATSSTAATPLFSPASSGPRVQVKEGIGPKLPRPNRVRVPTRRELASYGIKLPSQREAEQRARHAERDPHYDDELLSDEEADAMEQDELARQFAATQQQRYGHRWEDDHATDDHEADAAAEAELARQFAATQQQRYATEQPPGANPFSPADYEFSPMKTLVNDGPSEPLFTPTPEVQPQQPAQRYQQPAAAPQQGYQPAQHQPIHHQPVPPQPQSYPTASQPVQPQQPVAPQGHQPAAPAPQESLIHPLLMRNGDSRPLQKPTTPLPSLDLLTPPPSEVEPVDTFALEQMARLVEARLADFRIKADVVNYSPGPVITRFELNLAPGVKAARISNLSRDLARSLSTVAVRVVEVIPGKPYVGLELPNKKRQTVYLREVLDNAKFRDNPSPLTVVLGKDIAGDPVVADLAKMPHLLVAGTTGSGKSVGVNAMILSMLYKAQPEDVRFIMIDPKMLELSVYEGIPHLLTEVVTDMKDAANALRWSVNEMERRYKLMSALGVRNLAGYNEKIAEAARMGRPIPDPYWKPGDSMDAVHPVLEKLPYIVVLVDEFADLMMTVGKKVEELIARLAQKARAAGIHLVLATQRPSVDVITGLIKANIPTRIAFTVSSKIDSRTILDQGGAESLLGMGDMLYSGPNSTTPVRVHGAFVRDQEVHAVVQDWKARGRPQYVDGITSDSESEGGGGGFDGGEELDPLFDQAVNFVTEKRKASISGVQRQFRIGYNRAARIIEQMEAQGIVSEQGHNGNREVLAPPPFE

SEQ ID NO: 12098 - protein, 765 aa, Klebsiella pneumoniae
EGRCYMSELNEKLATAWEGFAKGDWQNEVNVRDFIQKNYTPYEGDESFLAGATEATTKLWDTVMEGVKQENRTHAPVDFDTALASTITSHDAGYIEKGLEKIVGLQTEAPLKRAIIPFGGIKMVEGSCKAYNRELDPMLKKIFTEYRKTHNQGVFDVYTPDILRCRKSGVLTGLPDAYGRGRIIGDYRRVALYGIDFLMKDKFAQFNSLQAKLESGEDLEATIRLREEIAEQHRALGQIKEMAAKYGYDISGPATTAQEAIQWTYFGYLAAVKSQNGAAMSFGRTSSFLDIYIERDLQAGKITEQDAQEMVDHLVMKLRMVRFLRTPEYDELFSGDPIWATESIGGMGVDGRTLVTKNSFRFLNTLYTMGPSPEPNITILWSEKLPLSFKKFAAKVSIDTSSLQYENDDLMRPDFNNDDYAIACCVSPMVVGKQMQFFGARANLAKTMLYAINGGVDEKLKMQVGPKSEPIKGDVLNFDEVMDRMDHFMDWLAKQYVTALNIIHYMHDKYSYEASLMALHDRDVIRTMACGIAGLSVAADSLSAIKYAKVKPIRDEDGLAVDFEIEGEYPQFGNNDPRVDDMAVDLVERFMKKIQKLHTYRNAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMENPEKYPQLTIRVSGYAVRFNSLTKEQQQDVITRTFTQTM

SEQ ID NO: 12099 - protein, 331 aa, Klebsiella pneumoniae
DAIRRMIARIWSGESPLWRLLLPLSWLYGLVSGVIRLSYQLGWQKAWRAPVPVVVVGNLTAGGNGKTPVVIWLVEQLQQRGIRVGVVSRGYGGKAERYPLVLDDRTSTAQAGDEPVLIHQRTGAPVAVAPLRSDAVKALLSAHDLQMIVTDDGLQHYKLARDREIVVIDGVRRFGNGWWLPAGPMRERASRLQSVDAVIVNGGVARPGEIPMRLRPGMAVNLLTGERRDVSTFTNVVAMAGIGHPPRFFATLESCGAQPVKTVALADHQALSQADVAALVTADQTLLMTEKDAVKCRDFAAANWWYLPVDAIMADERAQRLLADLATLAQR

SEQ ID NO: 12100 - protein, 724 aa, Klebsiella pneumoniae
ATPRPREALEACSVDLVALSQELEAFIELTTPVLPATEEERDTQPTLSFQRVLQRAVFHVQSSGRSEVTGANVLVAIFSEQESQAAYLLRKHEVSRLDVVNFISHGTRKDEPSQSSDNSGSQPGNEEQAGGEERMENFTTNLNQLARVGGIDPLIGREKELERAIQVLCRRRKNNPLLVGESGVGKTAIAEGLAWRIVQGDVPEVMADCTIYSLDIGSLLAGTKYRGDFEKRFKALLKQLEQDTNSILFIDEIHTIIGAGAASGGQVDAANLIKPLLSSGKIRVIGSTTYQEFSNIFEKDRALARRFQKIDITEPSVEETVQIINGLKPKYEAHHDVRYTAKAVRAAVELAVKYINDRHLPDKAIDVIDEAGARARLMPVSKRKKTVNVADIESVVARIARIPEKSVSRSDRDTLKNLGDRLKMLVFGQDKAIEALTEAIKMARAGLGHEHKPVGSFLFAGPTGVGKTEVTVQLAKALGIELLRFDMSEYMERHTVSRLIGAPPGYVGFDQGGLLTDAVIKHPHAVLLLDEIEKAHPDVFNLLLQVMDNGTLTDNNGRKADFRNVVLVMTTNAGVRETERKSIGLIQQDNSPDAMDEIKKIFTPEFRNRLDNIIWFDHLSTTVIHQVVDKFIVELQVQLDQKGVSLEVSQEARDWLATKGYDRAMGARPMGRVIQDNLKKPLANELLFGSLVDGGQVTVSLDSDKNTLTYDFQSAPKHKPEAAH

SEQ ID NO: 12101 - protein, 672 aa, Klebsiella pneumoniae
YRRRSGARSGRGRRSDRRRERERGGKMTALLELRDIRRSYPSGDGSVEVLKGITLSIHAGEMVAIVGASGSGKSTLMNTLGCLDKPTSGTYRVAGTDIAQLDGDALARLRREHFGFIFQRYHLLSHLTAAQNVEVPAVYAGNERRARLARAHELLVRLGLGERADYQPSQLSGGQQQRVSIARALMNGGEVILADEPTGALDSHSGEEVMAILHQLKAQGHTVIIVTHDPQVAAQAERIVEIRDGEIVRNPPASRQGGGLRARPQAEPSAWRQFTSGFREALVMAWRAMAANKMRTLLTMLGIIIGIASVVSIVVVGDAAKQMVLADIRAIGTNTIDVYPGKDFGDDDPRYQQALKYDDLLAIQKQPWVRSATPAVSKSLRLRANNIDVAASAEGVGPQYFNVYGMTFSEGSTFNELQLNSRAQVVVLDSNTRRQLFPNKAKVVGEVILVGNMPATVIGVADEKQSMFGSSKILRVWLPYTTMAGRVMGQSWLNSITVRVHEGYDSETAEKQLLRLLELRHGKKDVFTWNMDSVLKTAERTTHTLQLFLTLVAVIALVVGGIGVMNIMLVSVTERTREIGIRMAVGARASDVLQQFLIEAVLVCLVGGALGVALSLMIAFILQLFLPGWEIGFSPLALLTAFLCSTLTGVLFGWLPARNAARLDPVDALARE

SEQ ID NO: 12102 - protein, 527 aa, Klebsiella pneumoniae
TCIRHGHWEVGIVIRDSLSAKQLLHILFHGGHGTQTKLLIEDRQQIRCEETWRRRTGDDVFHTQRQQRQQDDDRFLFEPGEHQRQWQIVDATAQFLRQRDRQNNRRVSVITLPGVDQARQPFDIAKVQFVEAVFTTGQGQDQAVIRHAGGEIGEVVTLPAGAVAAADEEDMAQFFTTDQIDQRIRRAKQGLTAKADGDQMRDFAVREARHLLRLGNDRGEVFAFQMVHTRPADDAASPDAIVVGADGRVDDAVRGHHDGAREAGELHLLVLPAAAVVANQMFEFTQLRIAVSRQHFAMSIDVDAGAFRLLQQVIQILQIVAGDQDALPFGGFNVDLSRRRMAVFGRFTGVEDAHHFEVHLADFHRTFEQRIHIRRPGAQPCHDFMVLGIDSVVVLAEHVGVLHIGRRTLQTVQAQQAQTENIFADGGFIFIRGIVRRLTLQVAQIVADQLQVGDRAVDRGAGIDRQALRFQRLTQGNCLAGVADDARGIEVNVSQGGEEGAGGKAVDLMIDNAIFARFKRPGGQALQ

SEQ ID NO: 12103 - protein, 325 aa, Klebsiella pneumoniae
RRCRRRTLPGRVSLSNLTPMPGRVAIPPVTWRTRRRCEMGNGWHEWPLMVFTVFGQCVVGGFIVLALALMTGKLSREQEQRVVGSMFGLWVLMGIGFIASTMHLGSPLRAFNSLNRMGASSLSNEIASGAIFFAVGGIGWLLAVCKKLPAGLRSLWLVVTMVLGVIFVWMMVRVYNTIDTVPTWYTVWTPLSFFLTLFIGGPLLGYLLLRVAGVDGWALRLLPVVSLLALLVSIMVVVMQGSELATIRSSVQQASALVPDYGLLMAWRVVLLALALACWCVPQIRGRKPAVSLLGLAFVLILAGEMIGRGVFYGLHMTVGMAVAS

SEQ ID NO: 12104 - protein, 168 aa, Klebsiella pneumoniae
LNKRGARSLSPRFITRSSTSASSSASFAEPVRRGRGISTLKSRPIFFSSINSTRSAMATASLTSCVTSRTVKPCSCHRETISSCISRRVRASSAPSGSSSSSRRGRWIRARASATRCFCPPDSAAGHSCARLSSPTLANACRAASRQAPFSPSPTLSITVFHGSRRAS

SEQ ID NO: 12105 - protein, 819 aa, Klebsiella pneumoniae
LTLRCFLQMWPIRGRVGAQLSGCVESVLTGTQSIDNWQSRLGRGMLVKKAPLMWGLYCTPFQSDRELHGLSEGTGNNILLLFFGQGVKTYGVARYADGQLRIFFRVFHRVEQHFAVHDVHVQVLTTFDGRFVMEVTIHQTRQVGLTNFVVFTQRVRHDREGIRDTIFRVSKRQFSDGGQRGYCAFLVTAVHRVSTWTERRASATTVWGVTGFLTVHHVRGDGQNRLSRDSVAVGVQFLNFLHETFNQVNGHVIDARVVVTKLRVFAFDFEVNSQTVFVTNRFNFRIFDSRQGVSSNGQTSDTTRHGADNVTVVQRHQRGFVAVLVVHVVDDVQRGDVLFSQPVHEVIHAIHYFVEVQDVAFDRFRFRTNLHFQFFIHAAVDSVQHGFREVSASAEELHLLTNNHRAYAACDSVVVVVEVRTHQVIVLILQRRGIDGHFSGEFLEAQRQFFRPQDSNVRLRRRPHGVQGVQEAEAVFGHQSTAVNAHTADGFRCPNRVAGEQFIIFRGTQEANHTQFHDQVVNHFLRVLLGDFTRLQVTLDVDIQEAGGTTEGHCRAVLRFHGSQVTEVGPLNRFLSGGRRTGDVIAIFSGHLFDLAQCAVLFSDFFTQTDGRFQVFAAFQFRLQRVELGEFVFHQEVDTVQRNATVVTDDTTTTVSIRQTRQHAGFTAAQDVRGIDVENALVVSFTVLCEDFFQHRVQLAIIRFAGTFNHFDTTERDDRTFQRRFGLQTNDFFQTFLDIARVVRGDGGSQGSVKINRRVSAVFLFYTFHYGVPQLGGRFSRASQEGFVAFIWGVVFLNKVTDVDFILPVTFRKTFPGCG

SEQ ID NO: 12106 - protein, 91 aa, Klebsiella pneumoniae
LSQRRRTSVRKKALPINWCVRCSIITNMCTSWGCAGLPRRCRKRCRERPTPRDDAAHYWRVSAEKGNVKLPFLLSSLLCQGGIIFKLLYIR

SEQ ID NO: 12107 - protein, 292 aa, Klebsiella pneumoniae
KSRRPSPESRDEPYNMDASNVEGSQTTKTRLAFAGLKAGEYGSFDYGRNYGAIYDVEAATDMLVEWGGDGWNYTDNYMTGRTNGVATYRNSDFFGLVDGLSFALQYQGKNDHDRAIRKQNGDGFSTAATYAFDNGIALSAGYSSSNRSVDQKADGNGDKAEAWATSAKYDANNIYAAVMYSQTYNMTPEEDNHFAGKTQNFEAVVQYQFDFGLRPSIGYVQTKGKDLQSRAGFSGGDADLVKYIEVGTWYYFNKNMNVYAAYKFNQLDDNDYTKAAGVATDDQAAVGIVYQF

SEQ ID NO: 12108 - protein, 313 aa, Klebsiella pneumoniae
CHGRYSHHARAASFMFSGLFIILLPLVVGYLLPLRHSSALKLINRMLSWIVYVILFFMGISLAFLDNLASNLLAILHYAAVSVVIILLCNIAALLWLESKMPWRSQHRQEKLPSRLAMALESLQLCGVVVLGFLLGLTRLPFLQHATEASEYTLIFLLFLVGIQLRNNGMSLRQIVLNRRGMIVAVVVTASSLLGGILNAFILGLPLKTGLAMASGFGWYSLSGILLTESFGPVIGSAAFFNDLCRELLAIMLIPGLIRRSRSTALGLCGATSMDFTLPVLQRSGGVEIVPAAIVHGFLLSLLVPILIAFFTA

SEQ ID NO: 12109 - protein, 308 aa, Klebsiella pneumoniae
SPGRTVRCIRRKIKDVINGLINPETLPGKGEGMKRMMRIVLLALLLTGCAGEKGIIDRDGYQLDTRHPAQAAYPRIKVLVIHYTADNFDVSLATLTDKEVSSHYLIPEQPPRYQHKPRIWQLVPEEDLAWHAGVSYWRGSTRINDTSIGIELENRGWQKTAGVKSFTPFHPEQIAALIPLARDIIARYHIAPQNVVAHADIAPQRKDDPGPLFPWQQLAQQGIGAWPDEQRVAFYLNGRPASEPVDPEIVLDLLSRYGYQVTPEMTPAQKKRVIIAFQMHFRPQRWDGVADAQTEAIAEALLEKYGQG

SEQ ID NO: 12110 - protein, 307 aa, Klebsiella pneumoniae
SKRSWRSIKRKEYRWISAWWRGSSWRSIRAGVTSTWRGSSWIRRYSWASPRQISPDCRQNGSRLMITEPRYRRMSLTNIEQVMPVKLAQALANPLFPALDSALRAGRHIGLDELDNHAFLMDFQDYLEEFYARYNVELIRAPEGFFYLRPRSTTLISRSVLSELDMMVGKILCYLYLSPERLANEGIFTQQELYDELLTLADESRLLKLVNNRSTGSDLDRQKLQEKMRASLNRLRRLGMVWFMGHDSSKFRITESVFRFGADVRAGDDPREAQRRLIRDGEAMALENHLQLNDENEENQPDSGEEE

SEQ ID NO: 12111 - protein, 381 aa, Klebsiella pneumoniae
SYRLIFGTRRQRMVTLSRLFIHPVKSMRGMGLTHAFADISGLAFDRLFMVTETDGTFITARQFPQMVKFIPAPLHDGLHLTAPDGSSAVVRFSDFATQAEPTEVWGNHFTALIAPAAVNQWLSGFFKRDVQLRWLGPQLTRRVKRHDAVPLSFADGYPYLLANEASLRDLQQRCPASVSIEQFRPNLVVTGAAAWDEDSWKVIRIGEVVFDVAKPCSRCIFTTVSPERGQKHPAGEPLETLKRFRTALDNGDVDFGQNLIARNSGVIRVGDEVEILTRGPAKAYGAGESDDTPAPEAQQQATVAIEWQGQQFTGNNQQVLLEQLEQQGIRVPYSCRAGICGSCRIRLEEGEVSPLKKNAVAGDGTILACSCVPKTALRLAP

SEQ ID NO: 12112 - protein, 436 aa, Klebsiella pneumoniae
RAERTSARGMTKFYSGEGTDPRQLLKVVRERFGRTFGIKDGHRRIRQRYQREAHRHPVVVIGADFCVLQLCRRGDADIIFPLFHLGAHFTQLGRHGEQTVRLLDPPVVDIAQGSGPLREQRGGGDGHRGVRDMVHIHIDRLEFAVGAGDEIVAPGDGGAHFLQYVGETNVALYAVAADTGDFYRAALNGASGEEIRGRGSIAFHQVISRRLILLLAAHHKSLIRLIVHLNAEGFHQVQRNVDIGFRHQIALNDDDGILRRQRRGHQQRGQELAGDAAVNLDVAALKTAAQAQRWIIFLLQIVDLSAALTQGIHQMADRTLFHPRFAGQHDIVAAKAQSRRQRTHRGTGVAKEQLQRRGRAQRAAVAGHFAAGAVGRQGILNPQRTQGIQHMAHIVAVQQVGQHRRAAGQGSQQQRAVGDAFRTWQVHGALYACDGL

SEQ ID NO: 12113 - protein, 1487 aa, Klebsiella pneumoniae
RGGRVMIERGKFRSLTLVNWNGFFARTFDLDELVTTLSGGNGAGKSTTMAAFVTALIPDLTLLHFRNTTEAGATSGSRDKGLHGKLRAGVCYSVLDVINSRHQRVVVGVRLQQVAGRDRKVDIKPFAIQGLPTSILPTQLLTETLNDRQARVVSLNELKDKLEAMEGVQFKQFNSITEYHSLMFDLGVVARRLRSASDRSKYYRLIEASLYGGISSTITRSLRDYLLPENSGVRKAFQDMEAALRENRMTLEAIRVTQSDRDLFKHLISEATNYVAADYMRHANERRIHLDKALEYRRDLFTSRSQLAAEQYKHVDMARELQEHNGAEGDLEADYQAASDHLNLVQTALRQQEKIERYEADLDELQIRLEEQNEVVAEAVDRQEENEARAEAAELEVDELKSQLADYQQALDVQQTRAIQYNQALQALERAKALCHLPDLTPESADEWLETFQAKEQEATEKMLSLEQKISVAQTAHSQFEQAYQLVAAINGPLARNEAWDVARELLRDGVNQRHQAEQAQGLRSRLNELEQRLREQQDAERQLAEFCKRQGKRYDIDDLETLHQELEARIASLADSVSNAQEQRMALRQELEQLQSRTQTLMRRAPVWLAAQNSLNQLCEQSGEQFESGQEVTEYLQQLLEREREAIVERDEVGARKRAIDEEIERLSQPGGSEDPRLNALAERFGGVLLSEIYDDVSLDDAPYFSALYGPSRHAIVVPDLSRVAEQLEGLEDCPEDLYLIEGDPQSFDDSVFSVDELEKAVVVKIADRQWRYSRFPSLPLFGRAARENRIETLHAERESLSERFATLSFDVQKTQRLHQAFSRFIGSHLAVAFEDDPEEEIRKLNSRRGELERALSAHESDNQQNRVQYEQAKEGVSALNRLLPRLNLLADDTLADRVDEIQERLDEAQEAARFIQQHGNQLAKLEPIVSVLQSDPEQFEQLKEDYAYAQQTQRDARQQAFALAEVVQRRAHFSYSDSAEMLSGNSDLNEKLRQRLEQAESERSRARDAMRAHAAQLSQYNQVLASLKSSYDTKKELLNDLYKELQDIGVRADAGAEERARARRDELHMQLSSNRSRRNQLEKALTFCEAEMDNLTRKLRKLERDYCEMREQVVTAKAGWCAVMRLVKDNGVERRLHRRELAYLSADELRSMSDKALGALRLAVADNEHLRDVLRISEDPKRPERKIQFFVAVYQHLRERIRQDIIRTDDPVEAIEQMEIELSRLTEELTNREQKLAISSRSVANIIRKTIQREQNRIRMLNQGLQSVSFGQVNSVRLNVNVRETHSMLLDVLSEQHEQHQDLFNSNRLTFSEALAKLYQRLNPQIDMGQRTPQTIGEELLDYRNYLEMEVEVNRGSDGWLRAESGALSTGEAIGTGMSILVMVVQSWEDESRRLRGKDISPCRLLFLDEAARLDARSIATLFELCERLEMQLIIAAPENISPEKGTTYKLVRKVFNNHEHVHVVGLRGFAAPLPEALPGTADAS

SEQ ID NO: 12114 - protein, 71 aa, Klebsiella pneumoniae
TDGSSTMKKLVLAALLTSFAFGAAAAEKISFGVSATYPPFESMDANNQIVGFDIDLAHALCKQMQAECTFT

SEQ ID NO: 12115 - protein, 236 aa, Klebsiella pneumoniae
YTGRWKMKAFDWQRMALDKVPVEFLAEVALRSLYTFVLVFIFLKITGRRGVRQMSLFEVLIILTLGSAAGDVAFYDDVPLLPVLVVFVTLALLYRGIMWLMGHSEKLEDLLEGKPIVVVEEGQLAWEKLHAENMTEFEFFMELRVNSVEQLGQVRLAILETNGQISVFYYPDEEVRAGLSILPAHCTTRYTTIPQEGIYACVRCSIVMAMQAGEKRICPRCANAEWSKASRAKRLT

SEQ ID NO: 12116 - protein, 611 aa, Klebsiella pneumoniae
PDDGDSTCQIKAVSLRAFRTTKVIAMTQTFIPGKDAALEDSIARFQQKLLDLGFDIEEASWLNPVPHVWSVHIRDKACALCFTNGKGATKKAALASALGEYFERLSTNYFFADFWLGDTIANGPFVHYPNEKWFPLTEDDEVPEGLLDARLRAFYDPDDQLTASMLVDLQSGNDERGVCGLPFTRQSDGETVYIPMNIVGNLYVSNGMSAGNTRNEARVQGLSEVFERHIKNRIIAESISLPEIPAEVMARYPGVVESIAKLEAEGFPIFAYDGSLGGKYPVICVVLFNPANGTCFASFGAHPDFGVALERTVTELLQGRSLKDLDVFTPPTFDDEEVAEHANLETHFIDSSGLISWDMFKQDADYPFVDWSFSGTTEEEFATLMAIFKAEDKEVYIADYEHLGVYACRIIVPGMSDIYPAEDLWLANNSMGAHLRDTILSLPGSEWDKEDYLALIEQMDDEGLDDFTRVRELLGLATGKDNGWYTLRVGELKAMLALAGGDLEQALIWTEWTMEFNASVFSAERANYYRCLQTLLLLSQEEERQPLQYLNAFIRMYGADAVEAASAALSGEAPFYGLQAVDSDLQAFPAHQSLLKAYEKLQRAKAAFWAK

SEQ ID NO: 12117 - protein, 404 aa, Klebsiella pneumoniae
PSSGPPINSVRKKLSGVQTVYQVGTVSMVLYTRTIIHTKITPSTMVTTSHRLRRPAGSFLHTASSQPIPPTAKKIAPLAISLLSDEAPMRFSELKARSGEPRCIVEAINPIPINTHSPNMLPTTRCSCSRESLPVISASARTIKPPTTHWPKTVKTISGHSCHPFPISHLLRVRQVTGGIATRPGIGVRFDNDTRPGKVRRRQRRYRGQLAVLSAQFGNRPEIQRPQRAGLDADRLFPLGDALVTAIALGHMAFVGVVLWGAVRAGHMAVAAANAYLFVDHHKTVFALMHRAARTDLGAGRIFTVVTGDGEVIGKHVLLPDAVVLLPVAAGIFIDAAEADLRGQVLVVLTGQFAGFATGATGGINKKSILSCHRLLLTASQPEQGWYATGFPSPAATDAGWSAR

SEQ ID NO: 12118 - protein, 349 aa, Klebsiella pneumoniae
YAPGLHTGNPGEFMYYPFVRKALFQLDPERAHEVTFQQLRRVTGTPLEMLVRQKVPARPVTCMGLTFKNPLGLAAGLDKNGECIDALGAMGFGSIEIGTVTPRPQPGNDKPRIFRLVDAEGLINRMGFNNHGVDNLVENVKKAHFDGVLGINIGKNKDTPVEHGKDDYLICMEKVYPYAGYIAINISSPNTPGLRTLQYGEALDDLLSGIKNKQLELQQKHQTYVPVAVKIAPDLLPEELIQVADSLVSHNIDGVIATNTTLDRSLVQGMKHCDETGGLSGRPLQLKSTEIIRMLSAELNGRLPIIGVGGIDSVIAAREKIAAGASLVQIYSGFIFKGPPLIKEIVTHI

SEQ ID NO: 12119 - protein, 440 aa, Klebsiella pneumoniae
SPSGPQRCRRRKDSCDVYLAAQAAPSFCRPARALADDHFVALFQTLHHCDVGIIAGANDNLTLFDLTGAQQSNMVAVIAYRVAQGAQRDSNHVLHLSQLNVHLRGHVEAQDPLRVRYLEAGIIEDGVIHFFRRRQNVFQFTFITGKRVAQHGKPRFLPRSEVDDIRFRDLRFNQHGAEIRQRQNVRRLLGGDHCLSLQGGNLRHFAGHRRQDPRVIEVGLRRIERRLVTLYLRFNSADLRLFHRQIGGRGIKVLPRDQLALRQLLLTGQSHLRQFALRARLIELGAQLHERRFHLFNLVLRLLRIDNPQQLILFNLIANIDVQRFQLSADLGADVNFSQGIQFAGGQHALLEIPFANYQRLVARQRRIEDPPSPDSQPQHNDRQQPPDGPAFSLHFHIPIPAVSLPLQAVILSKPVGNRTPIFRVNEVLFSCRRALCRRK

SEQ ID NO: 12120 - protein, 186 aa, Klebsiella pneumoniae
KGTGGKMRIKPDDNWRWYYDEEHDRMMLDLANGMLFRSRFARRMLTPDAFAPSGFCVDDAALYFSFEEKCRDLELSKEQRAELVLNALTAIRFLKPQMPKSWHFIAHTHHWQPSGGDAACVWLSDTGEQVNLLVVEPGDNAALCLLAQPGLTLAGRVMQLGDVIKIMNDRLQPAQSAVSYSLGQAV

SEQ ID NO: 12121 - protein, 221 aa, Klebsiella pneumoniae
QQAGNSLIPGEPFLSQEYTEDKEVKLTKLSSGRRLLEAMLILCSLFAIWLMAALLSFNPSDPSWSQTAWHEPIHNLGGAPGAWLADTLFFIFGVMAYTIPVIIIGGCWFAWRHQENDEYIDYFAVSLRLIGALALILTSCGLAAINADDIWYFASGGVIGSLLSTTLQPLLHSSGGTIAPVVYLGGRADAVHRLVVGQHCGKAGRRHPVRSHLCQQPYPSG

SEQ ID NO: 12122 - protein, 73 aa, Klebsiella pneumoniae
LLKGNFMSALRIELKKGFTNEGVVHELSWIPGVQTGGVLCAICCGKGIDLRQKIPHQRKRLPTPRAIMRFSAI

SEQ ID NO: 12123 - protein, 395 aa, Klebsiella pneumoniae
KGMGCAHGHAGHQGVKMLTNKRERARQQRAALWATRDNVQRHALSMSMPWLAFVNIAFALMIFFRNFIFTYFDKRLLTHRAVIPYIEAALIAVIIISAILVIIALTPRLAQGRYTLNIITGLLLALSLCWSLSNYCFIFFWTLPFAWPLLVILMTTGLTALYHHWPGITAFMLPLWVTALLAGIQLHYHTEIRFLILWAIFTAILLYGRRILQRWYDEAWDTHQENMQLIQRLESIANQDALTGTANRRALNAYLAAIWQQKTPLALMMIDVDYFKRYNDRYGHQAGDECLSSVAQVLKMAVRAEGDLVARYGGEEFVVVLPGVSLAHATAIAERIQQKIREAGLPHAASAVASEVTVSIGIVASDGTVPIETLIARADSALYQAKNKGRNQWSY

SEQ ID NO: 12124 - protein, 874 aa, Klebsiella pneumoniae
RFFMTQQPQAKYRHDYRAPEYLISDIDLTFDLDAAKTVVTAESKVSRHAAASDVPLRLDGEDLTLIALQVNGQPWSDYKEENNQLVIGGLPEHFTLTIVNEISPAANTALEGLYQSGEALCTQCEAEGFRHITWYLDRPDVLARFTTKIIADKAKYPFLLSNGNRMAEGELENGRHWVQWQDPFPKPCYLFALVAGDFDVLRDSFRTRSGREVALELYVDRGNLDRAPWAMTSLKNSMKWDEERFGLEYDLDIYMIVAVDFFNMGAMENKGLNVFNSKYVLARTDTATDKDYLDIERVIGHEYFHNWTGNRVTCRDWFQLSLKEGLTVFRDQEFSSDLGSRAVNRINNVRTMRGLQFAEDASPMAHPIRPDMVIEMNNFYTLTVYEKGAEVIRMLHTLLGEENFQKGMQLYFERHDGSAATCDDFVQAMEDASNVDLSHFRLWYSQSGTPIVTVHDDYNPETEQYTLTISQRTPPTAEQAEKQPLHIPFAIELYDNEGKVIPLQKGGHPVHPVLNVTQAEQTFVFDNVYFQPVPALLCEFSAPVKLEYKWSDQQLTFLMRHARNDFSRWDAAQSLLATYIKLNVNRHQQGQPLSLPVHVADAFRAILLDEKIDPALAAEILTLPSANEIAEMFAIIDPIAIAAVREALTRTLANELADEFLAVYNANKLDSYRVEHADIGKRALRNTCLRYLAFAEPTLGDKLVATQYHQADNMTDALAALSAAVAAELPCRDALMQEYDDKWHQDGLVMDKWFILQSTSPAANVVETVRGLLNHRSFSMSNPNRVRSLIGAFASSNPAAFHAEDGSGYQFLVEMLTELNQRNPQVASRLIEPLIRLKRYDEKRQALMRAALEQLKGLENLSGDLFEKISKALA

SEQ ID NO: 12125 - protein, 192 aa, Klebsiella pneumoniae
PAFFHRQLRQLLPLIERRIDTGRVVAAAVEQYHVARLGFVQAGQQTIKVQRVVSRVVVCVFAHFQPGRGEYAFMVRPARITYPHTFHVGVFGEEVCGDTQRTGTAGCLRGAGAFISDNRIAFTEQQLLGAATKFRNTIDAQIVFSRFIFQQILLCFFDAGQNGRFTGFILVNTNSEVNFFRAVIGTKQIGQT

SEQ ID NO: 12126 - protein, 129 aa, Klebsiella pneumoniae
PPAIAPCSRPSTRWSGIGNALSSCSTSAIAWSVIPRRRSVSMATSYCLCCTRDNWSGGWTVKYMAKAGELDIFALWLEEGVKITRGLEQGLRRAINDFARWQSAERILCRRLPEGLFVGQEQGWEIDAD

SEQ ID NO: 12127 - protein, 560 aa, Klebsiella pneumoniae
RLNMTESFAQLFEESLKEIETRPGSIVRGVVVAIDKDVVLVDAGLKSESAIPAEQFKNAQGELEIQVGDEVDVALDAVEDGFGETLLSREKAKRHEAWITLEKAYEDAETVTGVINGKVKGGFTVELNGIRAFLPGSLVDVRPVRDTLHLEGKELEFKVIKLDQKRNNVVVSRRAVIESENSAERDQLLENLQESMEVKGIVKNLTDYGAFVDLGGVDGLLHITDMAWKRVKHPSEIVNVGDEITVKVLKFDRERTRVSLGLKQLGEDPWVAIAKRYPEGTKLTGRVTNLTDYGCFVEIEEGVEGLVHVSEMDWTNKNIHPSKVVNVGDVVEVMVLDIDEERRRISLGLKQCKSNPWQQFAETHNKGDRVEGKIKSITDFGIFIGLDGGIDGLVHLSDISWNVAGEEAVREYKKGDEIAAVVLQVDAERERISLGVKQLAEDPFNNYVALNKKGAIVVGKVTAVDAKGATVELADGVEGYLRASEASRDRVEDATLVLSVGDEVEAKFTGVDRKNRVVSLSVRAKDEAEEKDAIATVNKQEDANFSNNAMAEAFKAAKGE

SEQ ID NO: 12128 - protein, 275 aa, Klebsiella pneumoniae
DPNITLVIWLKKEPSGMLFTLKKIVGGLLLPLPALLLLIGIGIALLWFSRFQRTGKLCVSLGWLLLTLLSLQPVADSLLKPIEDTYPTWRGEQPVNYVVVLGGGYTWNPEWAPSSNLINNSLPRLTEGIRLWQANPGSKMIFTGAAAKTNPVSTAEAGARVAESLGVPRSDIIVLDRPKDTEEEALAVKRAIGDAPFLLVTSASHLPRAMIFFRHAGLDPLPAPANQLAVTSPLNPWERAIPSPVWLMHSDRVGYETLGRVWQWLKGSSGEPGQE

SEQ ID NO: 12129 - protein, 206 aa, Klebsiella pneumoniae
GRTMKKLAITCALLSGMVVSQVWADAASDLKSRLDKVSSFHASFTQKVTDGSGNAVQDGQGDLWVKRPNLFNWHMTQPDESVLVSDGKTLWFYNPFVEQATATWLKDATSNTPFMLIARNQSSDWQQYNIKQNGDDFVLTPKSGSGNLKQFTINVGRDGTIHQFSAVEQDDQRSSYQLKSQQNGAVDAAKFTFTPPKGVTVDDQRK

SEQ ID NO: 12130 - protein, 130 aa, Klebsiella pneumoniae
LLQILTHFSPFPLLNRLTRFRISLNCSGESWRAIEQLVTPPPVHSILLIKIYEGCRSMEMGTVKWFNNAKGFGFICPEGGGEDIFAHYSTIQMDGYRTLKAGQAVRFDVHQGPKGNHASVIVPVEAETAA

SEQ ID NO: 12131 - protein, 238 aa, Klebsiella pneumoniae
MNEIFPLASAAGMTVGLAVCALVIGLVLAMLFAVLESVKWRPVAWLATGIVTILRGLPEILVVLFIYFGSSQLLLTLSDGFTIPLGFTQIPVQMQIENFDVSPFLCGAIALSLLYAAYASQTLRGALKAVPQGQWESGQALGLSKAAIFFRLVMPQMWRHALPGLGNQWLVLLKDTALVSLISVNDLMLQTKSIATRTQEPFNWYIIAAAIYLVITLLSQYILKRIDQRATRFERRPG

SEQ ID NO: 12132 - protein, 440 aa, Klebsiella pneumoniae
TLGISRRIKERRLSRGVVMCDHHHAARHILCPQCDLLVALPQLEHRQKAACPRCGTTLTTTWDAPRQRPTAYALVALFMLLLANLFPFIYMKVGGISSEIELLEIPNVLFTEDYASLGTFFLLFVQLVPAFCLVTILLLVNRVRMPAGLKTFLARILFQLKTWGMAEIFLAGVLVSFVKLMAYGDIGIGLSFVPWCMFCLLQLRTFQCVDRRWLWDDIAPMPAITQPLKVGVTGIRQGLRSCACCTAVLPVDQTVCPRCNSKGTARRKNSLQWTLALLVTSFILYLPANIMPIMITDLLGDKMPSTIMAGVILLWSEGSYPVALVIFIASIMVPTLKMIAIAWLCWNANGNGARDSERMHLIYEVVEFVGRWSMIDVFVIAVLSALVRMGGLMNIYPAIGAVMFALVVVMTMFSAMTFDPRLLWDREPDSSHEEIQQHGK

SEQ ID NO: 12133 - protein, 242 aa, Klebsiella pneumoniae
FLLMRIEVKMRLVQLSRHSIAFPSPEGALREPNGLLALGGDLSPARLLMAYQRGIFPWFSPGDPILWWSPDPRAVLWPEQFHLSRSMKRFHQRSPYRVTLNHAFGEVIEGCASDRDEGTWITSSIVRAYHQLHELGHAHSIEVWQENTLVGGMYGVAQGALFCGESMFSRAENASKTALLVFCQDFAHSGGKLIDCQVLNNHTASLGAVDIPRRDYLDYLSVLRGYRLPERFWVPRVLFPGG

SEQ ID NO: 12134 - protein, 108 aa, Klebsiella pneumoniae
TLTMSKRDWLDFEHLVDDEVRDAIKPPSMYKVILVNDDYTPMEFVIDVLQKFFSYDVERATQLMLTVHYEGKAICGVFTAEVAETKVAMVNQYARENEHPLLCTLEKA

SEQ ID NO: 12135 - protein, 290 aa, Klebsiella pneumoniae
SLIVFAPKASDAEGRDNSRSFHFCRQQKKTGPWPVFYIEDIASLVGRFRFVLRSALEVVSQRIFVAVQRDSDLTTVDQRAKQQLVRQRFFQVVLNDASHWTCPHRPIVAFRRQPVARFLTHFQGDAFLVQLDLQLDDKLVDNLMDHRGRQMIEPDDVVEAVTELRRKDLFDLIHRIRTVVLLNKANGFTLGFPHPGVGGHHQHHVAEVRFTAVIIGQRPVIHHLQQQVEHIRMRFFDLIKQQYRVRMFNHRIGQQPALIEADVAWRRPDQTADGMTFHIFGHVKAQQLNP

SEQ ID NO: 12136 - protein, 327 aa, Klebsiella pneumoniae
HLCVGWSMLNPLRALTLGGLLLFSSLGHAAPAAPDALRIGYQKGSVSMVLAKSHQLLEQRYPQTHISWIEFPAGPQMLEALNVGSIDIGSTGDIPPIFAQAAGADLVYIGAEPPKPKAEVILVAQGSPIHNVTELKGKKVAFQKGSSSHNLLLRALQLAGLKFSDIQPVYLAPADARAAFQQGNVDAWAIWDPYYSAALLQGGARVLTDGTDLKQTGSFYLASRPYAERNGAFIEGVLDTFTQADALTHSQRAQSITLLAKTMGLPEAVIASYLDHRPPTAVTPVSAETAARQQQTADLFYENKLVPKKVDIRARIWQPTATQGAKS

SEQ ID NO: 12137 - protein, 598 aa, Klebsiella pneumoniae
YWGVLLLIKKQRLLALTKMTRPDLAPILKPSQALFAQAEFSHPAPSLSGDLQPRWFYGLEQLLYTPAVSSFMLVKAPEEPEYLQWLAAETRTLHEPAAPLYGVRYEVTDAQVTLAPAQGAEDNFASTAPVVMADWVEAEQLFGCVRQFNGAITLQPGLVHQANGGVLVLSLRTLLAQPLLWVRLKNMVTRQRFDWLSMDESRPLPVSIPSMPLSLKIVLVGERESLADFQEMEPELAAQAIYSEYEDTLQFADADTLKAWCQWVWQNAQQLELPGPAADAWPLLIDEGTRYTGDQETLPLSPLWITRQLREAAAFCEGEEITGEAMQTMLARRVWREGYLAERMQDEILQEQILIETEGECVGQINALSVIEFPGHPRAFGEPSRISCVVHIGDGEFIDVERKAELGGNIHAKGMMIMQAFLMSELELEQQLPFTASLTFEQSYSEVDGDSASMAELCALISALANVPINQSIAITGSVDQFGRVQPVGGLNEKIEGFFTICQQRGLTGKQGVIIPAANVRHLSLSHELRQAVADNQFAIWAIDDITEALPMLTQLMWDGEGQTLRQTIQERIAQATQQETRHRFPWPLRWLGGTSSN

SEQ ID NO: 12138 - protein, 126 aa, Klebsiella pneumoniae
VTSLPRSRSTMRVAILRIKERSCEIKIIVPLKVFRKPSSQSMVSISRWLVGSSSSSTRGPLTRARPSAALRSQPPDSDASCALASRPSCSITSLMRLSSCHSPRLSSCSCRRASSFKFLSLGSVIT

SEQ ID NO: 12139 - protein, 71 aa, Klebsiella pneumoniae
ICSFSGRYSIVLSGQCRLRRNFNKTAFDKVHTQYTKIGAIFSTGQTASNDAREELIKKTNEQGGRHCPLLR

SEQ ID NO: 12140 - protein, 607 aa, Klebsiella pneumoniae
SLSFFTLGKAKAFSSLYTVLKPTNLWAAMCDNRGQGMLLKKRYGRPLSALSLSLAMAFAPLFNVQAAEPEVVPGDSSATPGELSVALSQSDGQSPAVAKLAGEQPLSMEAAANSRAQIEALLPAGYKPVFMNPLVSLYAARDMKPMWENREAVQAFQQQLAEIAIAGFQPQFTTWVSLLTDPAVSGMARDVVLSDAMMGYLHFISGIPTQGTRWLYSSTPYKMATPPLSVINQWQLALDNGSLPAFIAGLAPRHPQYETMHQSLLALVADSRPWPQMTGSGSLRPGEWSNDIGALREILQRTGMLENSANIVLPGDVVSPSAKKKSKPAARGVYDRQLVEGVKRFQAMQGLGADGVIGQSTRDWLNVSSAQRAGVLALNIQRLRLLPGKLSTGIMVNIPAFSLVYYQDGSQVLASRVIVGRPDRKTPMMSSALNNVVVNPPWNVPPTLARKDILQKERNNPGYLEQHGYTVMRGWNSKETIDPYRVDWSTITENNLPFRFQQAPGARNSLGRYKFNMPSSDAIYLHDTPNHNLFQKDVRALSSGCVRVNKASELANMLLQDAGWNDTRISDALKQGDTRYVNIRQNIPVNLYYLTAFVDADGRTQYR

SEQ ID NO: 12141 - protein, 825 aa, Klebsiella pneumoniae
RLSVYCEQPKRVSMKIKAPDALLAAEVSRRGLMKTTAIGGLALASNALTLPFTRLSHAADTPAPASEKVVWSACTVNCGSRCPLRMHVVDGAIKYVETDNTGDDNYDGLHQVRACLRGRSMRRRVYNPDRLKYPMKRVGKRGEGKFEQISWEEALDTIASNMQRLIKEYGNESIYLNYGTGTLGGTLTRSWPPGKTLIARLMNCCGGYLNHYGDYSSAQIAAGLNYTYGGWADGNSPSDIENSQLVVLFGNNPGETRMSGGGVTYYLEQARQKSNARMIIIDPRYTDTGAGREDEWIPIRPGTDAALVSGLAWVMITENLVDQPFLDKYCVGYDEKTLPAGAPANGHYKAYILGQGTDGIAKTPEWASTITGIPRERIVKLAREIATAKPAYISQGWGPQRHANGEIATRAISMLAILTGNVGINGGNSGAREGSYSLPFERMPTLDNPVETSISMFMWTDAIERGPEMTALRDGVRGKDKLDVPIKMIWNYAGNCLINQHSEINRTHEILQDDKKCEMIVVIDCHMTSSAKYADILLPDCTASEQMDFALDASCGNMSYVIFADQAIKPRFECKTIYEMTSELAKRLGVEEQFTEGRTQEGWMRYLYEQSRKAIPDLPDFDTFRQQGIYKQRDPQGHHVAYKAFREDPQANPLTTPSGKIEIYSQDLAKIAATWELPEGDVIDPLPIYTPGFENYNDPLTAKYPLQLTGFHYKSRVHSTYGNVDVLKAACRQEMWINPIDARKRGIANGDRIRIFNDRGEVHIEAKVTPRMMPGVVALGEGAWYNPDASRVDQAGSINVLTTQRPSPLAKGNPSHTNLVQVEKL

SEQ ID NO: 12142 - protein, 94 aa, Klebsiella pneumoniae; identical to SEQ ID NO: 9277

SEQ ID NO: 12143 - protein, 626 aa, Klebsiella pneumoniae
SLQVSNKGKEGDEKSPLFLLRCNIAVPNTPITTPAKRAMNKTRQQELTRWLKQQSIISRRWLMISRLLGVASGLLIVAQAWFLARILHRMVMENIPATALLLPLTLLVLIFVLRAWVVWLRERVGFQAGQHIRYEIRRQVLDRLQQAGPAWIQGKPAGSWATLILEQIDDMHDYYARYLPQMTMAACVPLLIVITIFPINWAAALILLGTAPLIPLFMALVGMGAADANRRNFQALARLSGHFLDRLRGMETLRIFHRGQAETDNIRDASQDFRQRTMEVLRLAFLSSGVLEFFTSLSIALVAVYFGFSYLGELNFGHYGAGVTLMAGFLTLILAPEFFQPLRDLGTFYHAKAQAVGAADSLKTFMETPLTQVERGEKTLNDNDLISVEARDLVIKSPEGKVLAGPLNFVLPAGARVVLVGQSGSGKSSLLNTLLGFLPYEGSLMVNGVELRELDAERWRRLLSWVGQNPQLPAATLRENVLLAWPEASEAQLRLALDKAWVSEFIALLPQGIHTAVGDQAGRLSVGQAQRIAVARALLVPCRLLLLDEPAASLDAHSEQRVMQALTHASSEQTTLLVTHQLEGLADWDDVWVMQDGQIIEQGDYATLARAGGVFSALLAHRQEEI

SEQ ID NO: 12144 - protein, 134 aa, Klebsiella pneumoniae
PPLLARCYMSHYLQINGQRLIDSLYALGEHGALPGGGVCRLAATAEDKAGRDFVVARMKALGLNVSIDAIGNVTGVYHGEETLPMVMMGSHIDTFATDGLYDGKYGVMAGLEVIATFQDAGDPHPTTVGGNFLY

SEQ ID NO: 12145 - protein, 256 aa, Klebsiella pneumoniae
KLSFTLMFFGEMTMKKVLIAALLAGMSLSASAAQTIRFATEASYPPFELVDANNQIVGFDVDLANALCKEIDATCTFTNQAFDSLIPGLKFRRFDAVMAGMDITPEREKQVLFSTPYYDNSALFVGQQGKFTSIDQLKGKKVGVQNGTTHQKFITDKHPEITTVPYDSYQNAKLDLQNGRIDAVFGDTAVVTEWLKSNPKLAAVGDKVTDKAYFGTGLGIAVRQGNTDLQQKFNAALEKVKKDGTYQTIYNKWFQK

SEQ ID NO: 12146 - protein, 201 aa, Klebsiella pneumoniae
MQTFSYKEREMRVITLAGSPRYPSRSSALLEYARETLTAADIEVCHWHLQNFAPEDLLYARFDNPALQTLNEQLAGADGLIIATPVYKASFSGALKTLLDLLPERALEGKIVLPLATGGTIAHMLAVDYALKPVLNALKAQEILHGVFADDSQVTDYQHKPQFTANLQRRLDDALETFWQALHRPSSRAPSLTSLRGVEHA

SEQ ID NO: 12147 - protein, 275 aa, Klebsiella pneumoniae
PGVSAARRYPGAAGDRGASAGARRESLMSFVVIIPARFASTRLPGKPLQDINGKPMIVHVLERARESGADRIIVATDHEDVARAVEAAGGEVCMTRADHQSGTERLAEVVEKCAFSDDTIIVNIQGDEPMIPPAIVRQVAENLAASSSGMATLAVPIHDAEEAFNPNAVKVVMDAKGYALYFSRATIPWDRDRFAQSRETIGDSLLRHIGIYGYRAGFIRRYVSWAPSPLEQIEMLEQLRVLWYGEKIHVAVAAEVPGTGVDTPEDLECVRAELR

SEQ ID NO: 12148 - protein, 163 aa, Klebsiella pneumoniae
TSLSFCRLQCPPVVSSVGLLQLYGSGPMAMVGTPWILIGCYFTVALPFMYRAITNNLQAINLHDLMDAAQLLGASTWQAAFLVVLPNLRKGLLVALLLSFSFLFGEFVFANILVGTRYETLQVFLNNMRNSSGHFTSALVISYFLFVLVLTWVATFLNKDKSQ

SEQ ID NO: 12149 - protein, 198 aa, Klebsiella pneumoniae
PDAFEHHEKGVALMALAIFDMDETLIHGDCATLWSEQMGRLGWVDPQAFLKRNNELMHAYSQGELKMEDYMAFSLEPLIGRTPEEVDHLVGPWVEDFIEPIIFSDATKTVAAHRKAGDRILIISASGVHLVKPIADRLGIDEVLGIELEVAHGAYTGNTVGTLTYREGKITRLLEWLDEQEVFTTGLQGSALSATFGA

SEQ ID NO: 12150 - protein, 362 aa, Klebsiella pneumoniae
QQRPFHQRAGDLVLPFCTGADLGCHLPEQGQKPMSFVSVEHLQKTYSGTPVFSDINFTISKGEFVTLLGPSGCGKSTLLRCIAGLTPVDDGKILLDGQDIVPLNPQKRGIGMVFQSYALFPNMTVDQNVAFGLRMQKVNANDSQKRVAEVLQLVELNDFAKRYPHQLSGGQCQRVALARSLVTRPRLLLLDEPLSALDARIRKHLREQIRQIQRELGLTPIFVTHDQEEALTMSDRIFLMNKGRIVQSGNAESLYVAPVDVFAASFIGNYNLLDADTASRLLQRPVTSRIAIRPETLGLSLHGDADTLIRNHSLLGNVIRYRVEVRGVELIVDVLNRSAADLYADGQRVALTIDSSALCEVA

SEQ ID NO: 12151 - protein, 233 aa, Klebsiella pneumoniae
RGATMSRAETGTASVYHRTVVYLLFIILLLPLLGTFVYSIASSWSATVLPSGFTFKWYLQLWSDPRFLTAFGHSLLICFGSLLLSVVLILPLLFVVHYHFPKLDALMNILILLPFAVPAGGVIGGPAATVRFGADGHGRYAVDPDRLLLHRGPALYVPGHHQQPASHQPARPDGRRSTARRQHLAGGVSGGVAELAQRLAGGVAAVVFVPVWRVCVCQHPGRHSLRNLAGVPQ

SEQ ID NO: 12152 - protein, 70 aa, Klebsiella pneumoniae
LWNTMPIPRFCGLSGTMSWPSRRILPSSTGVSPAMQRSSVDLPQPDGPSRVTNSPLLMVKLMSLKTGVPE

SEQ ID NO: 12153 - protein, 154 aa, Klebsiella pneumoniae
LCQALPAPTVGRSMPACGAGPLTGDAPTPVAAGRTVVSTGRPYPQAFARADPADPARAGPDPDFRHPRPGRSADHERPYLPDEQGPDRPERQCRKPLRRPGGRVCREFYWQLQPAGRRYRQPFIATPGHQPHRHTPGNPGLEPARRRRHTDPQP

SEQ ID NO: 12154 - protein, 83 aa, Klebsiella pneumoniae
RLSALPLWTIRPLFIRKIRSLMVSASSWSWVTKIGVRPSSRWICRICSRKCLRIRASSADNGSSSSNRRGRVTSERASATRWH

SEQ ID NO: 12155 - protein, 75 aa, Klebsiella pneumoniae
CTTNSSGRISTTDSSKDPKQINSEWPNAVKKRGSLHSCRYHLKVKPLGNTVADQLLAIEYTNVPSSGNSKIINSR

SEQ ID NO: 12156 - protein, 290 aa, Klebsiella pneumoniae
QTAVPDLIETRAMTRGKWLALLCLAPFAIVFIVFQIAPLVWVLVHSLQSEDTGWGLDNFSKIFASKFYLQAIQHSLEISFWSSLFGIVIAVLGSYSLHKVDSKLRNFVNAFANMTSNFSGVPLAFAFIILLGFNGSITIMLKQAGIIEDFNLYSKTGLIILYTYFQIPLGVLLLYPAFDALREDWRESASLLGANSWQFWRFIGLPVLTPALLGTFVILLANALGAYATVYALTTGNFNVLPIRIAAMVSGDISLDPNMASALAVILVGLMTLVTLVHQWLLKRSYHVAR

SEQ ID NO: 12157 - protein, 294 aa, Klebsiella pneumoniae
PTCSIKITRQFMATNLQDGNTPCLAATPSDPRPTVLVFDSGVGGLSVYNEIRQLLPNLHYIYAFDNVAFPYGEKSEEFIVERVVEIVTAVQQRYPLALAVIACNTASTVSLPALREKFAFPVVGVVPAIKPAARLTANGIVGLLATRGTVKRPYTRELIDRFANECRIEMLGSAELVELAEAKLHGEPVPLEELRRILRPWLRMQEPPDTVVLGCTHFPLLQKELQRVLPEGTRLIDSGAAIARRTAWLLEHEAPDAKSSDENKAFCMALTAETEQLLPVLRRYGFSTLEKLPL

SEQ ID NO: 12158 - protein, 335 aa, Klebsiella pneumoniae
ECGSEPARVMHGLPRVAADALPGLRTGSPDKPFTAQSGGTHIFRVRGSTPHRINRKDKTMQTIIDAWFVQGMIKATSDAWLKGWDERNGGNLTLRLDEADIEPYAADFHAQPRYIALSQPMPTLANQPFIVTGSGKFFRNVQLDPAANLGVVKVDSDGAGYHILWGLTEDAVPTSELPAHFLSHSERIKLTGGKDRVIMHCHATNLIALTYVLENHSDLFTRKLWEGSTECLVVFPDGVGILPWMVPGTDEIGQATAETMQKHSLVLWPFHGVFGSGPTLDETFGLIDTAEKSAEVLVKVLSMGGMKQTITRDELIALGKRFNVQPLQSALDLYP

SEQ ID NO: 12159 - protein, 236 aa, Klebsiella pneumoniae
LAFFISVARRAAMHYPVNVFVGKIRDYAGSRPSAIDKIQVDGELQLGDLGLDGDQQAEKKIHGGPDRALCHYPREHYADWIRDFPQQAERFCAPAFGENLSTTGLTEQNVYIGDIFRWGEALIQVTQPRSPCFKLNFHFAINDMAQLMQNSGKTGWLYRVIAGGQVSSDAPLELVSRLSDVSVHEAGAIAWQMPFDDDQYHRLLSAAGLSVSWSRTMQKRRLSGKIEDSSRRLWGK

SEQ ID NO: 12160 - protein, 319 aa, Klebsiella pneumoniae
WGLSPPFLLAKITMTDISRSQAWLESLRPKTLPLAFAAIIVGTVLAWEQGHFDPWVALLALITAGLLQILSNLANDYGDAVKGSDKPDRIGPLRGMQKGVITPQQMKRALIVTVVLICLFGLALLCAAWQSVGDFIGFLALGGLSIVAAITYTVGTRPYGYIGLGDISVLVFFGWLSVLGSWYLQAHNVEAAIFLPATACGLLATAVLNINNLRDIDSDRQNGKNTLAVRLGPVNARRYHACLLLGALLCLALFNLLALHSAWGWLFILATPLLVKQARYVLRESDPLAMRPMLEKTVKGALLTNLLFVIGIIASKLMA

SEQ ID NO: 12161 - protein, 241 aa, Klebsiella pneumoniae
PFIPIPGQNGLSFILGYSATRGYGRDSYIVMGVRAPAKRKNPPVRWWKRHFTQLSAERSFASLSLREVAREAGIAPTSFYRHFRDVDELGLTMVDESGLMLRQLMRQARQRIAKGGSVIRTSVSTFMEFIGNNPNAFRLLLRERSGTSAAFRAAVAREIQHFIAELADYLELENHMPRAFTEAQAEAMVTIVFSAGAEALDVGPEQRRQLEERLVLQLRMISKGAYYWYRREQEKMSHHSE

SEQ ID NO: 12162 - protein, 452 aa, Klebsiella pneumoniae
TAYPGYRFVARVRRQPRPGEARALPALAQNRILISPYAVQPLAARRRVVTLTVHLPDGLPRQRFLLFEQRQAGGVIAVVLQLAQLGGRFQQGAQQRFFHIAGANHPGRDAVDGGIEEVEADVHAVKQVMANDFAGDGLGFIIQQHHVVAVPAHRAADVQQQARDVEHGGGDLVGDHFRRMEVAGIEAQRRLTAGGVTHIELVGADGVAFGADAEQLALHGVDMVRRVELLADHLIKGVQQPLARGEAVNGYILHAVRHPDIHHRRRAQLFAKISGYAAAGFAVVDPELADLIVGVRQGKAVGAQRMREAGGVEIQPQFVGFRPCNPVFKVLRLNLIARYRRVGFQVNSVQIETLWPRDQAQRLLKVGAEFFCIARFARVVAGRLDTAGQASRRVFETGDVVTLPAVHGDGQTVQLAQGLLDIHADGGVALLSNFPGLFKLSGHAQSSLVCCG

SEQ ID NO: 12163 - protein, 394 aa, Klebsiella pneumoniae
LYFPRHSRLDIPGAFPTIPAYLFYSGYIMTPEHLPTEQYEAQLAEKVVRLQTMMAPFAAPVPEVFRSPVSHYRMRAEFRLWHDGDDLYHIIFDQQTRSRIRVDSFPAASALINQLMTAMLEGVRNNPVLRQKLFQIDYLTTLSNQAVVSLLYHKKLDDAWREQAEALRDALRAQGLNVHLIGRATKTKIELDQDYIDERLPVGGREMIYRQVENSFTQPNAAMNIQMLEWALDVTKGATGDLLELYCGNGNFSLALARNFDRVLATEIAKPSVAAAQYNIAANHIDNVQIIRMAAEEFTQAMNGVRQFNRLQGIDLHSYQCETIFVDPPRSGLDSETEKMVQAYPRILYISCNPETLCRNLETLSQTHNVTRLALFDQFPYTHHMECGVLLTRK

SEQ ID NO: 12164 - protein, 441 aa, Klebsiella pneumoniae
YRSPALRRHNHWHPQSAYLTLEAHLLTFDGFSYAQRYCIFIHNKCMNIDTITTQGVSTMKNNLPPFIEIYRALIATPSISATEEALDQSNESLINLLAGWFRDLGFNVEIQPVPDTRHKFNLLASTGHGAGGLLLAGHTDTVPFDDGRWTRDPFTLTEHDNKLYGLGTADMKGFFAFILDALRDVDVTTLKKPLYILATADEETSMAGARYFAETTRLRPDCAIIGEPTSLQPIRAHKGHMSNAIRIQGQSGHSSDPARGVNAIELMHDAIGRIMQLRDLLKERYHFEAFTVPYPTLNLGAIHGGDASNRICACCELHMDIRPLPGMTLNDLNGLLGEALAPVSERWPGRLTVSELHPPIPGYECPPDHKLVQVVEKLLGAQTDVVNYCTEAPFIQTLCPTLVLGPGSINQAHQPDEYLETRFIKPTRELISQVVHHFCWH

SEQ ID NO: 12165 - protein, 437 aa, Klebsiella pneumoniae
NCPFRGAVSATTDQGALRMTTQLEQAWEIAKQRYTAVGVDVEEALRQLDRLPVSMHCWQGDDVAGFENPAGSLTGGIQATGNYPGKARNAEELRADLEQALSLIPGPKRLNLHAIYLESDAPVARNEIKPEHFKNWVTWAKANKLGLDFNPSCFSHPLSADGFTLSHANDEIRQFWIDHCKASRRVSAYFGEQLGTPSVMNIWVPDGMKDITVDRFAPRQRLLNALDEVISEKLDPAHHIDAVESKLFGIGAESYTVGSNEFYMGYATSRQTALCLDAGHFHPTEVISDKISAAMLYIPRLLLHVSRPVRWDSDHVVLLDDETQAIASEIIRHNLFDRVHIGLDFFDASINRIAAWVIGTRNMKKALLRALLEPTAQLRQLENDGDYTARLALLEEQKSLPWQAIWEMYCQRHDTPAGSQWLDSVRAYENAVLSQRG

SEQ ID NO: 12166 - protein, 209 aa, Klebsiella pneumoniae
NSVTPSCASRWRIWRVSGGCEINNRCAARLMLFSSATTAKARSRRISRECNLEVVILKRYHEKGITQVRHTSLPFLLTHHHREEKTMSSERYIIGQEMLQRVDGKGGEAVVDSLRDIAPDFARYLIEFPFGDIYARPGLDLRSREIATIAALTALGNAEPQLKVHIAAGLNVGLTQEEITEAIMQMAVYAGFPAALNGLFAARAVFAAH

SEQ ID NO: 12167 - protein, 146 aa, Klebsiella pneumoniae
KSRTGSSSYDRLSSRRWFSALLPPELPAPRPGYAAAWYWYALASAADPGTAAGLTRSASAVAAEPASAAERAAAAVGRSAPESAPIVAAAPAAVAALNADAEASAGAAPAFVRSTALRSAGSAAGAYRPASGRAAGAARRSAVPVS

SEQ ID NO: 12168 - protein, 202 aa, Klebsiella pneumoniae
PVLTETTVLTNWNYQLTHFVTSAPDIRHLPADTGIEVAFAGRSNAGKSSALNTLTNQKNLARTSKTPGRTQLINLFEVAEGKRLVDLPGYGYAQVPEEMKIKWQRALGEYLEKRLCLKGLVVLMDIRHPLKDLDQQMIEWAVESDIHVLVLLTKADKLASGARKAQVNMVREAVLVFNGNVQVEPFSSLKKSGVDTAATEAG

SEQ ID NO: 12169 - protein, 820 aa, Klebsiella pneumoniae
HGPTVASLAPTFGRGAMTNHWVDIKNANLVVVMGGNAAEAHPVGFRWAMEAKIHNGAKLIVIDPRFTRTASVADFYTPIRSGTDITFLSGVILYLLNNEKFNREYTEAYTNASLIVREDYSFDDGLFSGYNAEKRQYDKTSWNYELDENGFAKRDTTLQHPRCVWNLLKQHVSRYTPDVVENICGTPKADFLKVCEYIAETSAPDKTASFLYALGWTQHSIGAQNIRTMAMIQLLLGNMGMAGGGVNALRGHSNIQGLTDLGLLSTSLPGYMSLPNEKQADLQTYLTANTPKPLLKDQVNYWGNYPKFFVSMMKAFFGDKATAENSWGYDWLPKWDKSYDVLQYFEMMNQGKVNGYICQGFNPVASFPNKNKVVASLSKLKFLVTIDPLNTETSTFWQNHGESNDVDPAKIQTEVFRLPSTCFAEENGSIVNSGRWLQWHWKGADAPGIAVTDGEILAGIFTRLRKMYAEEGGPAPEPVLNMTWNYSTPHEPASEEVAMESNGKALADITDPATGAVIVKKGQQLSSFAQLRDDGTTSSGCWIFAGSWTPEGNQMARRDNADPSGLGNTLGWAWAWPLNRRILYNRASADPQGKPWDPKRQLLKWDGAKWGGVDIPDYSAAAPGSDVGPFIMQPEGMGRLFAIDKMAEGPFPEHYEPFETPLGTNPLHPNVVSNPAARVFKGDLEQMGKAEKFPYVGTTYRLTEHFHYWTKHALLNAIAQPEQFVEIGEKLANKLGIGHGDTVKVSSNRGYIKAKAVVTKRIRTLKVDGKDIDTIGIPIHWGYEGVAKKGFIANTLTPFVGDANTQTPEFKAFLVNVEKV

SEQ ID NO: 12170 - protein, 233 aa, Klebsiella pneumoniae
RNATLFFGGKTRCSFVPVHYVPEGFDVVRAAVLEFQVVSVFPDVQADNREAGSAGNGFAHQRGILVGGGDNGQFVTFQDQPRPAGAETGSSGFFEFRFEVLHGTEIALDSRFQVALQGGTGFQAFPEQAVVRVAAGVVTQYGFFVSRQLIQLGNQLFSGQVSELRQAFQRGVGIVHVGLVVFSVMDLHRLLVEVRFQSIVSVRQGWQGIAHNHLHYCRAAQVLTPRKQFVHYS

SEQ ID NO: 12171 - protein, 327 aa, Klebsiella pneumoniae
DSETIVAQRDYVRRSQPASSRRKKSTTRSSRNKQSSLPAISPAMVAIAAAVLVAFIGGLYFITHHKKEEAEAMQNRQAAGNGLPPKPEERWRYIKELESRQPGVRAPTEPTAGGEVMKPEQLTDEQRQLLAQMQADMRQQPTQLTEVPWNEQTPAQRQQTLQRQRLAQQQQQAQQQQWAQTQAQTVQQQPPRVQQPKPVQQQQPKQTASNQQPYQDLLQTPAHTNTTQPRTQAAAPVTRVEEAPKTTAEKKDDRSWMIQCGSFKGAEQAETVRAQLAFEGFASHITTNNGWNRVVIGPLKGKESANEMITRLKMAGHANCIRLAARG

SEQ ID NO: 12172 - protein, 212 aa, Klebsiella pneumoniae
PYRTNFHYNEHIMIVFQGERIVRYKKQGAGMTQPISVIAKSLVRERARTGLSLAEVARRAGIAKSTLSQLESGNGNPSLETLWSLCVALDIPFARLLEPQVNKTQVIRRGEGTKVVAEQANYQAILLAACPPGARRDIYLLLTQPGADRISHPHPPGSVEHIIVTQGRARVGLTSAPEELGEGDYICYPADQEHVFQALEPDTQALLIAEQN

SEQ ID NO: 12173 - protein, 340 aa, Klebsiella pneumoniae
LSYAKTGIFMSLKAIAKQLGISVTTVSRALNGYDDVSQETRARVEAEAQRRGYRPNTFARRLKMGTIDAVGLVFPVRPAPLNNNVFLEMVGEISHELARHDIDLLLIADDEQADKHGYMRMVQGRRVDALIVAHTLDDDPRLAQLQASGFPFLALGRSRLAQPYAWFDFDNYAGTCRATRHLIQQGHQRIALLGENNNQAFILQRRNGYLDALREAGLSDAWLRSVPASRRGGYQATLELLRLPEPPTAIITDCNTHGDGAAMALAHLGRLTGDNRVALVVYDGLPQDSIIETDVAAVIQSTRQGVGRQIADMVRRLIAGEDLATLQVLWQPEFFPGETA

SEQ ID NO: 12174 - protein, 355 aa, Klebsiella pneumoniae
QHRAPLTETGRNITCKPYKTNSCGVKAMKTKTSLILTVAALALSGSALAEVKIALVAKSLGNGFFEAANVGAQQAAKELGDVKVIYTGPTTTTAEAQIDVLNGLIAQGVDAIAISANDPDAVVPVLKKAMQRGIKVVSWDSGVAPAGRQIHLNPSNNALIGETNVKLAADALQALNVEKGEVAVLSATPTSTNQNIWIEEMKKVLPQYPSVQLVTVAYGDDLSDKSYREAVGLLKSYPDLKVIVSPSSVGIVAAAQAVKDQGKIGKVYVTGLGLPSEMAGAIKSGASKSFAIWNPIDLGYAATYLADDLVKGTATKTEASMGKLGKVKLDAEGNGAMAKPFVYDASNIDKFSKIF

SEQ ID NO: 12175 - protein, 106 aa, Klebsiella pneumoniae
TMTANPSAFCLAMCGILFNTSRHSALSKQLNERVYIMKSIKTFVAVIAMAASFASFAAETVTATASTMDGAEAKIAAQAQAAGASSYKITEAFTGNRVHMTAELNK

SEQ ID NO: 12176 - protein, 461 aa, Klebsiella pneumoniae
VAAAGGAGAAHPRPGKRHSDWSATRVMVSGRAAALLEENIMNPTVCTHKNNPNFWIFGLFFFLYFFIMATCFPFLPIWLSDVIGLNKTETGLVFSSLSLFAICFQPILGVISDKLGLKKHLMWIVTVLLVLIAPFFLYVFAPLLKTNIWLGALSGGAYIGFVFSAGAGAMEAYIERVSRNSGFEYGKARTFGCLGWALCATTAGMLFSINPEWVFWMGSAAALLLVVLVAIAKPQASQSAQVMDSLGANRPAIDLKTAVRMFRQRKMWMFILYVIGVACVYDVFDQQFATFFKSFFATPEAGTRAFGFATTAGEICNAIIMFSSPWIINRIGAKNTLLIAGMVMAARMIGSSFATTAAEVVALKMLHALEVPFLLVGAFKYITGVFDVRLSATIYLVGFQFAKQVAAIFLSAFAGNMYDRIGFQDTYMILGGIALTVTLISAFTLAGKTKTEPLRDNAMTV

SEQ ID NO: 12177 - protein, 113 aa, Klebsiella pneumoniae
GSRALSGGLMIRKAFVMQVNPDAHEEYQRRHNPIWPELEAVLKAHGAHHYAIYLDKERHLLFATVEIESEARWEAVASTEVCQRWWKYMREVMPSNPDNSPLSAELKEVFYLA

SEQ ID NO: 12178 - protein, 208 aa, Klebsiella pneumoniae
FSTARKETKMLYIFDLGNVIVDIDFNRVLGAWSDLTRIPLATLKQHFTMGEAFHQHERGELSDEDFAAAMCHEMNMPLSYEQFAHGWQAVFVALRPEVITIMHKLRAQGHRVVVLSNTNRLHTTFWPDEYPEVRAAADRIYLSQEMGLRKPEAQIYLRVLEEEGFSAADTVFFDDNVDNIAGANRLGITSILVTGKETIPDYFAKQLC

SEQ ID NO: 12179 - protein, 451 aa, Klebsiella pneumoniae
DKTAQIFICHQNIQVFTHIFGINSDGLAVHLAGIIGDIFHQALQHGVQATRTDVLGGFVYLPCGLGDALDAVFGEFDVHPFGRHQRLVLHGDGGIRLGQDALEVVGGQRLQLNADRQTPLQFRDQIGWAGHLECAGGDKQDVVGLDHPMFGGDGAAFHQRQQVALYAFAGDVRAGGVAAALTDFVDFVDKDDTVLLYSVDGFLLQLFRIDQFGRFFFNQQLHRVFDFQLTRFLLLAAEVLEHRLQLAGHLFHARRGHDFNAHRRRSEIDFNLFIVQLAFTQFFTERLARCRRFLRRLSLAPVVLRRWDQHVEHALFRQLFRAVTVLIDGLHANHFDRRIGQIADDGVHFFTDIAHFGELRRFNFDKRRVSQFCQTTGDFGFTDAGWADHQNVFRRDFMTQLFVKLHPTPAVTQGDSNRTLGGVLTDNVFVQFADNFAWGHFRHGRSLRFRR

SEQ ID NO: 12180 - protein, 706 aa, Klebsiella pneumoniae
ASAARKRWRRSSSRTRTWLISLISWRPSKPTSSWSSPAKSWKSHRRPPDVLRALFRQYEFKRWTTDVEAGKWLQAKGGKPAAKPAVPAAAAEAEEEVEAATALSAEHYVTILDEATLLTWIDKLKQAPLFAFDTETDSLDNISANMVGLSFAVEPGVAAYVLGAHDYLDAPDQIPRERVLTLLKPLLEDEKVLKGGQNLKYDRGILANYDIELRGIAFDTMLESYILDSVAGRHDMDSLSDRWLKHKTITFEEIAGKGKNQLTFNQIALEEAGRYAAEDADVTLQLHLKMWPKLQQHEGPLNIFQHIEMPLVPVLSRVERNGVKIDPAVLHAHSQEIAQRLVELEQRAHEIAGEAFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQIELRIMAHLSRDKGLLTAFAEGKDIHRATAAEVFGLPLDSVSSEQRRSAKAINFGLIYGMSAFGLARQLNIPRKEAQKYMDLYFERYPGVLEYMERTRAQAKEQGYVETLDGRRLYLPDIKSSNGARRAGAERAAINAPMQGTAADIIKRAMIAVDEWLRSEKPRVRMIMQVHDELVFEVHKDELDAVSKKIHELMENSTTLAVPLLVEVGSGENWDQAH

SEQ ID NO: 12181 - protein, 148 aa, Klebsiella pneumoniae
KPHYADPRRQRRRAGACRRTVCAHRAAGAAFAVRFTVEEKIMGNMTLFIAGIAILSLGTYLMRLGGAKLGNRLAFSERSQALLSDAATVLLFSVALATTFYEGAHFAGMARVLGVAFAVFLAWRKVPLIGVIIAAAVVTALLRLAGIN

SEQ ID NO: 12182 - protein, 65 aa, Klebsiella pneumoniae
SSLYCFNIQCYSLDYGEKTGLLRSPVHYGKRLAKKSLPDKILFVSDSKSCRLLITSSLVIYLRYI

SEQ ID NO: 12183 - protein, 156 aa, Klebsiella pneumoniae
RYHLQCAGSVARLRRRRHGISTSATQGVVMTSGSALFDTNILIDLFSGRREAKQALEAWPPQNAISLITWMEVMVGAKKYHQEQRTRMALSTFNIINISQDIAERSVALRQEYKLKLPDAIILATAQLHRLELITRNTKDFAGIPGVVTPYEIHPE

SEQ ID NO: 12184 - protein, 298 aa, Klebsiella pneumoniae
PTLHYYQPVTDNFSHYEGGIMTILHSTDFFKAGISTVAIEPRLPQSAFPEHHHDFHEIVIVEQGAGIHVFNGQPYTIGGGSVCFIRDHDRHLYEHTDNLCLTNVLYRAPDAFRFLAGVSQLLPQEQEGNYPSHWRVNQTVLQQVRHIVAQIEAVGSDTDTHAVASREILFMQLLVLLRKSSLAEEATNNDARLNQLLAWLEDHFAQEICWEEVAAQFSLSLRTLHRQLKQQTGLTPQRYLNRVRLMKARHLLRHSDESVTDIAFRCGFGDSNHFSTLFRREFDWSPRDIRQGRDAILQ

SEQ ID NO: 12185 - protein, 124 aa, Klebsiella pneumoniae
FYPHLFLSETAASDGMSVKIGRFGRLQDVATGWRTLATMGLISCSTSQNDGYFFWLYPYEKYGIDKHFQYHLINYNGQTAYAALTLEPLDNNGDDYELYPAIPALRLRCSGTALRQADDGDPSH

SEQ ID NO: 12186 - protein, 69 aa, Klebsiella pneumoniae
WVHHHTLNKRLRLSEAETNIRALHRLRCGAFQQVILCRDDDEMIVLHGKTDITEWQAFDAFQSGHAFII

SEQ ID NO: 12187 - protein, 498 aa, Klebsiella pneumoniae
DISQILFSMVQRVEYIRGPRSAVYGSGAIGGVVNIITMTDAERSQINAGAGTNGYQSYDGAFNKRFGDTLVTAAGAYQTTKGFNVQPNSSYSGDSDRDGYRNKMLWGGVQHQFDDNFSGFFRGYGYSANADYDQGNWGYAGGNDEDQSYTQSWDTGLHYHSGIYSSQLIANYQRIKDYNYSSDGGRYAAGTTVDDMEQRYIQWGNNVVVGHGAVSGGVDWRPEKLKSSGTTSTDVYKRDTTGLILTGQQQIDSVTLEASGREDHDEQFGWHGTWQTAAGWEFIDGYRTTLSYGTGFLAPSLGQQYGAERFGIASNPNLKPEESKQWEAGLEGLTGPVDWRLSAYRYEIQNLIDYDNNAYYNVKSATIKGLEWTGNITTGPVEHHLTLQYVDPRDDETNKILYRRAKQQVKYELNGQVYDLGWDVTYHYIGKRYDYDYDNSRTVNMGGLSLWDVGLSYPVTSHLTVRGKIANLFDKDYETVYGYQSAGREYTLSGSYTF

SEQ ID NO: 12188 - protein, 711 aa, Klebsiella pneumoniae
WRCLMSDSLIHLQSAGADVVIKTRPFAEIVYWGPHLSHFSPQDADSLTRPVANGRLDVDSPVTLMAELGHGLFGAPGIEGHRQGLDASPLFTTSEVRHEGQTLTLVSEDPQAGLRLQSEIALDASGVLSVRHGVTNLRASPWQVDRLAVTLPVAERAREVMAFHGRWIREFQPHRLTLEHDSFVLENRRGRTSHEHFPALITGSRAFSEMQGEVWGVHLAWSGNHRLRAEVKTDGRRYLQAEALYLPGEMALAEGETLWTPYLYASYSANGLNGMSQQFHRYLRERIIRFPGNKPRPVHLNTWEGIYFDHDPDYIMRMADEAAALGVERFIIDDGWFKGRNDDWAALGDWYLDEKKYPYGLTPVIDHVKSLGMEFGIWVEPEMINPDSDLYRAHPDWVLALPGYTPLTGRHQFVLNLNIPEAFDYLLERMSWLLGEHAVDYVKWDMNRELVQPGHQGRAAADAQTRQFYRLLDTLVARFPHIEFESCSSGGGRIDYEVLKRSHRFWASDNNDALERNTIQRGMSYFFPPEVMGAHIGNRHCHATFRQHSIAFRGLTALFGHMGLELDPVSADEEERAGYRKYAALHKQWRDVIHHGVQWRIDMPDATTLAHGVVSPDKAQAIFLVSQLAMPDYTLMAPLRLAGLEASARYQVTLLDHPNIQITGEGGHTMRKLPAWMTTLQTVSGEWLQQAGLALPILDPESAILIGLQRV

SEQ ID NO: 12189 - protein, 143 aa, Klebsiella pneumoniae
RHGQVVTRGITLINTMTNTILGPDEVVTKYGVPPELIIDFLALMGDSSDNIPGVPGVGEKTAQALLQGLGGLDTLYAEPEKIAELSFRGAKTMAAKLEQNKDVAYLSYQLATIKTDVELELTCEELEVTPAAARRSAGAVQTV

SEQ ID NO: 12190 - protein, 177 aa, Klebsiella pneumoniae
IATQTFWEYVMRNVIAAVMASTLALSAYSQAAEVVTSVNWLPGDEGGQRGSQSHMFDGISLTEQQRQQLRDLMQRARHDRLPVNVSEMETMHRLVTAENFDENAVRAQAEKMAQEQVARQVEMAKVRNQMYHLLTPEQQAVLNAKHQQRMDQLREVARMQKGSAMMLSSSSNTLQPQ

SEQ ID NO: 12191 - protein, 171 aa, Klebsiella pneumoniae
KLSQQLNVKPMKYDTSELCDIYQEDVNVVEPLFSNFGGRSSFGGQIITVKCFEDNGLLYDLLEQNGRGHILLIDGGGSVRRALIDADLARLAVQNEWEGLVVYGAVRQVDDLEELDIGIQALAAIPVGAAGEGIGESDVRVNFGGVTFFSGDHLYADNTGMILSEDPLDIE

SEQ ID NO: 12192 - protein, 675 aa, Klebsiella pneumoniae
TVQQFRLQDVQRVGIDITQLDRLGDPRQVGHQMGVVGDGQHDVDIGSQQLAQLGTQRPQLRLHQALIVVLRQPQVGLRVNHLQHAEAGREERPVATHGFQFTLFSTFDHLLQRSASAQPGWQHQAVLGPGEDPRNGAQRLDAAGWTTFCRTRTQRQFAQLLLRGRRAEVRDEIFVFTHVAAIHLARHVGQLGHDVAPFCFRLRRRQQVGFQNGAGIQRQAADGDFRQAVLKADHLALLGNAQAAFQASRRLREQRGVGRRAAAADRAAATVEQRQFNTGFFAGFDQRVLRLVLRPGGGHHAGIFSGVRVADHDHLLALDKAAVPVDIQQLGHDVVGVVEVIQRFEQRGHRQSKANPGFFQQEMNRQHIGRRFRHRDHVGGDRSARRLGDHLAGVENFTRLFAWLPLARQQRTFGIQFADQESLFVGFRPAFVVADPEVTGHFTQRFGMAGAFLTNINTHQRYAERLHAAQGVEQLAVGDNAHAAGLQRFIAGVQRLPQLLVLSDQSRRFRQLLAFQARFQPGLGLHQLRAQFFHQITVRFLSALGASQGAQLVGTLHHRQLGDQHLHVFEEQVGRFPAAEQQHVAGDVGSHVRVAVAVAAHPRGETHRDEVHRQLIAKVGFQLFVQLAQIVRHPFPQAVFHHREAPFGFIDRGRAVLTNFIGMPRLGDQLAQTAH

SEQ ID NO: 12193 - protein, 107 aa, Klebsiella pneumoniae
NLRHPFSVSDAFTMIKKASLMTALSVTAFSGWAQDNNSDTLVVTANRFQQPVNTVLAPTDIVTRDDIDRWQSKDLNDVMRRLPGVDIARNGGMGQNASLYVRGTEAR

SEQ ID NO: 12194 - protein, 115 aa, Klebsiella pneumoniae
PIFNPQLNAADGYKLSPCPACKSPPASDCSARQLPLLRWWPPRPRTGSRRRTSRPSAPFHSWRGWRPARRHAATPRRLPPAGPTIYPGRHAGQRLQTRPPVRPSTGPTRPREYSR

SEQ ID NO: 12195 - protein, 262 aa, Klebsiella pneumoniae
IILNHDAYIYPVFGKFVIWRSFERKPYAYLNDSTELSIEENTMELYLDTANVAEVERLARIYPLAGVTTNPSIIAAGKVPVWDVLPRLQKAVGPEGTLFAQTMSRDAQGMVEEAKRLSNAVPGIVVKIPVTAEGLAAIKLLKKEGIPTLGTAVYSASQGLLAALAGAKYVAPYVNRVDAQGGDGIRMVQELQSLLEMHAPESKVLAASFKTPRQALDCLLAGCEAITLPLDVAQQMLGTPAVESAIEKFEQDWNNAFGTLNL

SEQ ID NO: 12196 - protein, 96 aa, Klebsiella pneumoniae
IAHNFITGDILEVYMSMMAERDMGRILLDLSDDVIQRLDDLKVQRNIPRAELLREAVEQYLEKQDRAKDTISSALGLWQDCEEDGMEYQRQLRKEW

SEQ ID NO: 12197 - protein, 233 aa, Klebsiella pneumoniae
TMNKILLVDDDRELTSLLKELLDMEGFNVLVAHDGEQALALLDDSVDLLLLDVMMPKKNGIDTLKELRQTHQTPVIMLTARGSELDRVLGLELGADDYLPKPFNDRELVARIRAILRRSHWSEQQQTTEAGSPTLEVDALSLNPGRQEANFDGQTLELTGTEFTLLYLLAQHLGQVVSREHLSQEVLGKRLTPFDRAIDMHISNLRRKLPERKDGHPWFKTLRGRGYLMVSAS

SEQ ID NO: 12198 - protein, 374 aa, Klebsiella pneumoniae
KFCNSLPRLSDKNDAAVSAQGKCQRHSARRNQVKPKKQVVAATMKDVALKANVSTATVSRALMNPDKVSQATRNRVEQAALEVGYLPQSLGRNMKRNESRTILVIVPDICDPFFSEVIRGIEVTAAEHGYLVLIGDCAHQNQKEKTFIDLIITKQIDGMVLLSSRLPFDASVEEQRNLPPMVMSNEFAPELELPTVHIDNLTAAFNAVNYLHELGHQRIGCIAGPEDMPLCHYRLQGYVQALRRSGITVDPHYIARGNFTFEAGANALEQLLAQPVPPTAVFCHSDVMALGALSLAKRRGLKVPDDLSIVGFDNIALSEFCDPPLTTVSQPRFDIGREGMLLLLEQMQGHNVNSGSRLLDCELIVRGSTQKIRR

SEQ ID NO: 12199 - protein, 499 aa, Klebsiella pneumoniae
TADNDFKKDRFMSIRHCVAVDLGASSGRVMLASYQPGPRALTLREIHRFTNSLQKVDGFDCWDVDSLEGEIRRGLEKVCEQGILVDSIGIDTWGVDYVLLDKQGQRVGLPISYRDDRTQGLLRHAEAQLGRAEIYRRSGIQFLPFNTLYQLRALVEQQPELVSQAAHALLIPDYFSFRLTGNLNWEYTNATTTQLVNINSDSWDETLLNWTGAPLAWFGKPTHPGNVIGHWICPQGNRIPVVAVASHDTASAVIASPLADRHAAYLSSGTWSLMGFESLTPYTCDAALQANITNEGGAEGRYRVLKNIMGLWLLQRVLKEQNVSDLQGLIARTAALPACRFIIDCNDDRFINPASMSAEIQAACRDAGQPVPESDAELARCIFDSLALLYARVLNELAALRGHPFSQLHIVGGGCQNTLLNQLCADACGIAVVAGPIEASTLGNIGIQLMTLDELANVDEFRQVVRGNAALTTFTPNPDSEIARFVAQFQPQQTKELCA

SEQ ID NO: 12200 - protein, 389 aa, Klebsiella pneumoniae
RPVKIVGIDLPVDTLFTINACKTFGCRNLGLPSAAEYHFPNFRLGYPALYCAACGSYPPLFNEREFRPWLAAYLTDHARRYGYFCPVCYQRDIIRYGRNPQGTQRLQCRHCKKVWTPKFPHIAPIEAPRRICSVPLIAPFQGNAAGQKLYFLLSFDAVRGNVIHLTSNFTPFAVGESLRYHWRGGQADREETDDIIQRISLTEMRFLQRSQFDEIQYGSAMQKRHARGNILRPVIAAHGHFKLLSQRFPEVKTHVIAHECFLRGAAIVAWAPLFRQRQGDLWYVEEEIRNPASPAPWQLQGKTHHGWWQNSWQRWTQEENQKMVCRLAGTVEENAFLPDLAASRRFTIWLKNRPAFAQSALYSAGRVTQIVASLVQEYNATLTAAAPGG

SEQ ID NO: 12201 - protein, 769 aa, Klebsiella pneumoniae
SASKAANHTEFDQHMQTDPRRLIVMCILSRQISSQEDDMSVAHVALPVPLPRTFDYLLPEGMAVKAGCRVRVPFGKQERIGIVAAVSERSELPLDELKPVAEALDDEPVFSTTVWRLLMWAAEYYHHPIGDVLFHALPVMLRQGKPASATPLWYWFATEQGQVVDLNGLKRSRKQQQALAALRQGKIWRHQVGELEFNEAALQALRGKGLAELACEAPALTDWRSAYSVAGERLRLNTEQATAVGAIHSAADRFSAWLLAGITGSGKTEVYLSVLENVLAQGRQALVMVPEIGLTPQTIARFRQRFNAPVEVLHSGLNDSERLSAWLKAKNGEAAIVIGTRSSLFTPFKDLGVIVIDEEHDSSYKQQEGWRYHARDLAVWRAHSEQIPIILGSATPALETLHNVRQGKYRQLTLSKRAGNARPAQQHVLDLKGQPLQAGLSPALISRMRQHLQADNQVILFLNRRGFAPALLCHDCGWIAECPRCDSYYTLHQAQHHLRCHHCDSQRPIPRQCPSCGSTHLVPVGIGTEQLEQALAPLFPEVPISRIDRDTTSRKGALEEHLAAVHRGGARILIGTQMLAKGHHFPDVTLVSLLDVDGALFSADFRSAERFAQLYTQVSGRAGRAGKQGEVILQTHHPEHPLLQTLLYKGYDAFAEQALAERQTMQLPPWTSHVLIRAEDHNNQQAPLFLQQLRNLLQASPLADEKLWVLGPVPALAPKRGGRWRWQILLQHPSRVRLQHIVSGTLALINTLPEARKVKWVLDVDPIEG

SEQ ID NO: 12202 - protein, 187 aa, Klebsiella pneumoniae
IGEKSGSRVIIVTIDVNTSGHLNFFAYRLSKVQIAVKIICISARRRRLISCQKARAYGKLRAIIARAEYSGPSLINRGLRYLMAEWSGEYISPYAEHGKKSEQVKKITVSIPLKVLKILTDERTRRQVNNLRHATNSELLCEAFLHAFTGQPLPNDEDLRKERSDEIPEAAKAIMRELGIDPDTWEY

SEQ ID NO: 12203 - protein, 203 aa, Klebsiella pneumoniae
QCRNKERTMQVSRRQFFKICAGGMAGTTAAALGFAPATALAETRQYKLLRTRETRNTCTYCSVGCGLLMYSLGDGAKNAKASIFHIEGDPDHPVNRGALCPKGAGLVDFIHSESRLKFPEYRAPGSDKWQQISWDEAFDRIAKLMKEDRDANFIAQNDAGTTVNRWLTTGMLCASASSNETGYLTQKFTRALGMLAVDNQARV

SEQ ID NO: 12204 - protein, 152 aa, Klebsiella pneumoniae
NRRNRTTMIALIQRVSRASVTVADEVTGEIGPGLLVLLGVEKDDDEQKANRLCERVLGYRIFSDAEGKMNLNVQQAGGSVLVVSQFTLAADTERGMRPSFSKGAAPDRAEALYEYFVARCRQQEMHTQTGRFAADMQVSLVNDGPVTFWLQV

SEQ ID NO: 12205 - protein, 159 aa, Klebsiella pneumoniae
RAGKPPAWRPRADRTDRRWRSHETGTADRRAAPAARPDAGRYAPAADPADRSAVERTNAGAAPADASASAFSAATAAGAAATMGADSGADRPTAAAARSAAEAGSAATAEADRVKPAAVPGSAADASAYQYHAAAYPGRGAGNSGGRSAENHRREERRS

SEQ ID NO: 12206 - protein, 280 aa, Klebsiella pneumoniae
SKVNKKPLEQIKNVTNVTGYRQVSLWKREDLQHPQPDELAEEVPVALVYNGISHVVMMASPKDLEQFAVGFSLSEGIIEHRREIFGMDVVAVCNGLEVQIELSSRRFMGLKARRRALAGRTGCGVCGVEQLNDIGKPVQPLPFTQSFDLANLDQALAHLNDFQPVGRLTGCTHAAAWVRLTGELAGGFEDVGRHVALDKLLGRRAEVGEGWQHGAALVSSRASYEMVQKAAMCGVEILFAVSAATTLAVEVAERCNLTLVGFCKPGRATVYTHPQRLIAG

SEQ ID NO: 12207 - protein, 485 aa, Klebsiella pneumoniae
SAANVIIVFILCIKQVSNTMSHSWDYDAIVIGSGPGGEGAAMGLVKQGARVAVIERYHNVGGGCTHWGTIPSKALRHAVSRIIEFNQNPLYSDHSRLLRSSFADILNHADSVINQQTHMRQGFYERNHCEILQGNAHFVDEHTLALECHDGTVETVTAEKFVIACGSRPYHPADVDFHHPRIYDSDSILSLQHEPRHVIIYGAGVIGCEYASIFRGMEVKVDLINTRDRLLAFLDQEMSDSLSYHFWNSGVVIRHNEEYEKIEGVDDGVIMHLKSGKKLKADCLLYANGRTGNTDTLALENIGLQTDSRGQLKVNSMYQTALPHIYAVGDVIGYPSLASAAYDQGRIAAQALVKGEASAHLIEDIPTGIYTIPEISSVGKTEQQLTAMKVPYEVGRAQFKHLARAQIVGMSVGTLKILFHRETKEILGIHCFGERAAEIIHIGQAIMEQKGGGNTIEYFVNTTFNYPTMAEAYRVAALNGLNRLF

SEQ ID NO: 12208 - protein, 363 aa, Klebsiella pneumoniae
SAQNATRCRSFVTLSARPITPIIRRKNAMAAWKWWARFPSGNGEDNYQLYLIRPASTSQSDFINLLFDRPLLLLIVTMLVSAPLLLWLAWSLAKPARKLKNAADEVAQGNLRQHPELEAGPQEFLAAGASFNQMVTALERMMTSQQRLLSDISHELRTPLTRLQLGTALLRRRSGESKELERIETEAHRLDSMINDLLVMSRNQAKNALVSETVKANQLWNEVLDNAAFEAEQMGKSFTVEYPPGPWPLYGNPNALESALENIVRNALRYSHTKISVSFSVDKDGITVNVDDDGPGVSPEDREQIFRPFYRTDEARDRESGGTGLGLAIVETAIQQHRGWVKADDSPLGGLRLTIWLPLYKRT

SEQ ID NO: 12209 - protein, 338 aa, Klebsiella pneumoniae
WSRDLLVAGMTQLPGRLRVTKESTTMYHLRVPQTAEELESYYQFRWEMLRKPLHQPKGSERDAWDAMAHHQMVVDEEGNLVAVGRLYINAENEASIRFMAVHPSVQDKGLGTLMAMTLESVARQEGVKRVTCSAREDAVEFFAKLGFVNQGEITTPTTTPIRHFLMIKPVASLDDILHRGDWCAQLQQAWYQHIPLSEKMGVRIQQYTGQKFITTMPEAGNQNPHHTLFAGSLFSLATLTGWGLIWLMLRERHLGGTIILADAHIRYSQPISGRPSAIADLGSLSGDLDRLARGRKARVQMQVELFGDDKQGAVFEGIYIVLPAKPFGSYEEGGNEEE

SEQ ID NO: 12210 - protein, 397 aa, Klebsiella pneumoniae
LFTDSAQELPNMTRKQATIAVRSGLNDDEQYGCVVPPIHLSSTYNFTGFNEPRAHDYSRRGNPTRDVVQRALAELEGGAGAVLTNTGMSAILLVTTVFLKPGDLLVAPHDCYGGSYRLFDSLAKRGCYRVQFVDQSDEQALRAALAEKPKLVLVESPSNPLLRVVDIAKICGLAREAGAISVVDNTFLSPALQNPLALGADLVLHSCTKYLNGHSDVVAGVVIAKDPATVTELAWWANNIGVTGSAFDSYLLLRGLRTLSPRMEVAQRNALAIVEYLKTQPLVKKLYHPSLPENQGHEIAARQQKGFGAMLSFELDGDEQTLRRFLSGLSLFTLAESLGGVESLISHAATMTHAGMAPEARAAAGISETLLRISTGIEDGEDLIADLENGFRAANEE

SEQ ID NO: 12211 - protein, 426 aa, Klebsiella pneumoniae
TEADQTAAWDHVVETYAAFTVRIHVFQVAFTLAQRLHDRTLMLLFDVQRHVLERLLFTAVDFAEDNFRTGNRHLETFTTHVFNQNGQVQFTTAGNAERISVFGFFNAQRHVVHQLFIQTVQDLARGNELTFFTAERRGVDVEEHGNGRLINGQGRQRFDILRVADGVGDVQLTQTGDRNDVASFSYVALNSLQTQVSQYLTDFTVTGFTFAIDDSDLLVRLHFTALDAADADNTNVVVVVQLGDLHLQRTVKINVRRRHAIDNRLVQRGHVVSHVFVIQTRDTVQRGRVNDREVQLFVGRIEVNEQVEHLIDNPVRTRARAVNFVDDHDRLQTVGKSFFGHEARLRHRAIKGIYHQQHRVNHGHNTLNFTSEVGVPWGINDVDTVIIPFDCGVFREDGNPTLFLQIVGVHHTFLCFSTCVERTGLL

SEQ ID NO: 12212 - protein, 292 aa, Klebsiella pneumoniae
LFRETAMLKTVHQKLLHHTRPLLAWLKLLWRRIDEDHMTTLAGNLAYVSLLSLVPLIAVVFALFAAFPMFSEVSVQIRHFIFANFIPATGDVIQGYIEQFVANSSRMTAVGAFGLIVTSLLLMYSIDSALNTIWRSTRSRPKVYSFAVYWMILTLGPLLAGASLAISSYLLSLRWASDLDGVIDNLLRLFPLILSWAAFWLLYSIVPTTQVRNRDAVIGALVAALLFEAGKKAFALYITTFPSYQLIYGVISVVPILFVWVYWTWCIVLLGAEITVTLGEYRKLKTEETEQP

SEQ ID NO: 12213 - protein, 687 aa, Klebsiella pneumoniae
RSRERRTARKSRSWGCFCGYRRSGSLYFPQEGPQRGPIPSHALQTNQNGAFRVEDGQRQPRLLQPLTAHRLQRRHPCRQLPHGVAALTGDLNVRMIEERHLIAGARLQARQAQRRHQGVVRHRQLANEENRLRFIRADDAMGKSGSIRHIYSPLHAVMDHVAPLFMQGRIFSVSGALFFIGAHRIQLKAHMTEQRRQAAEGDTMLAEGGMTVAIANMRAHYLGWKEVAHAALDGVALKGVIVVRSPEAMAAFEDFIIDPSAAGGAGFKFNVRETGHQRIQQAVKLARLRVRSGASLMPRLHQLAVHIPLHVVHRMLAQQPAHPLQQIIKRFGNVEVQDKLMAAGQRGIARQRQHPVRVRPVQIGIRVNHFRLHPDTEFHTQRLHVIDNRRQAVGVFFLIEIPVAKRRPVVVAPFKPAVIDNKALDAQGRRFVGHTHDVVRVVVEIDPLPGVEMHRARFVARETNNPFAQITMELLAHAVQPIRRVAGIQVRRPQGFPFRQRHFARQIERLGLQIATAIGFHLRPQAMVTAPGQMHAPDFTLHLAKGAAAGDQGREMFVRGAPAAVLQHKAVVLKRQAVRLKLADPAAMESHHLASAFGDRQRDRQAIHLPWAGAQIGHAMAHAQHAAGIQRDLALQAQAGLRIFADQGQRLALVPHFACGEQRRGIQPLTMAFNARRAKQTMAQLRH

SEQ ID NO: 12214 - protein, 222 aa, Klebsiella pneumoniae
RWLDTRTAFVSPPGVETLKIPPIYNCIRPRGQRGAPVPLLQPRGLLVTTIVSVRRNGHVVIAGDGQATLGNTVMKGNVKKVRRLYNDKVIAGFAGGTADAFTLFELFERKLEMHQGHLVKAAVELAKDWRTDRMLRKLEALLAVADENASLIITGNGDVVQPENDLIAIGSGGPYAQAAARALLENTDMGARDIAEKALDIAGDICIYTNHFHTIEELPSKA

SEQ ID NO: 12215 - protein, 396 aa, Klebsiella pneumoniae
GETDFPKSTLRRIIMSFMLALPKISLHGAGAIGDMVKLVAGKQWGKALIVTDGQLVKLGLLDSLFAALDEQQMAYQLFDEVFPNPTEALVQQGYAAYQAARCDYLIAFGGGSPIDTAKAIKILTANPGPSTAYSGVGKVKNAGVPLVAINTTAGTAAEMTSNAVIIDSERQVKEVIIDPNLIPDIAVDDASVMLDIPPAVTAATGMDALTHAIEAFVSVGAHPLTDANALEAIRLINLWLPKAVDDGHDLQAREQMAFGQYLAGMAFNSAGLGLVHALAHQPGATHNLPHGVCNAILLPIIENFNRPNAVARFARVAEAMGVDTRGMSDEAASMEAINAIRTLSKRVGIPQGFSQLGVSKADIEGWLDKALADPCAPCNPRPASRDEVRELYLEAL

SEQ ID NO: 12216 - protein, 222 aa, Klebsiella pneumoniae
QTQERVMTRKIPLLALGFGMALASAQAFAHGNHSHGPALTEVERQASEGIFADKDVQDRALSDWEGVWQSVNPYLLNGDLDPVLEQKAKKPGGKSVEEYRAYYKKGYATDVEQIGIEDDVIEFHVGQTVNSCKYRYSGYKILHYASGKKGVRYLFECQQGDAKAPKFVQFSDHIIGPRKSQHFHIFMGNESQEALLKEMDNWPTYYPYALHKEQIVDEMLHH

SEQ ID NO: 12217 - protein, 476 aa, Klebsiella pneumoniae
PIRESLSMSAEHVLTMLNEHEVKFVDLRFTDTKGKEQHVTIPSHQVNAEFFEEGKMFDGSSIGGWKGINESDMVLMPDASTAVIDPFYEEPTLIIRCDIVEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSSQDIRSTMCMIMEEMGLVVEAHHHEVATAGQNEVATRFNTMTKKADEIQIYKYVVHNVAHRFGKTATFMPKPMFGDNGSGMHCHMSLAKNGTNLFSGDKYAGLSEQALFYIGGVIKHAKAINALANPTTNSYKRLVPGYEAPVMLAYSARNRSASIRIPVVTSPKARRIEVRFPDPAANPYLCFAALLMAGLDGIKNKIHPGEAMDKNLYDLPPEEAKEIPQVAGSLEEALQALDADREFLTAGGVFTNDAIDAYIALRMEENDRVRMTPHPVEFELYYSV

SEQ ID NO: 12218 - protein, 288 aa, Klebsiella pneumoniae
RGFCDTRPTRDFRQRKPGPRPLPHQTFGDNADWLCHTRPLFFISNNSFALKNDHYVFIIMEIRSIWLSDMKQTLSSLSGDTIKAIVLVCLAVGVVGMSYGSLAVAYGFPLWVPLLLSVSVLAGASEFMFIGIVASGGSPLAAAAAGLLVNARHIPFGVTVRELVGRRALSFIGCHIMNDESVVFGLSQPTPAQRKAAYWLCGAGVALIWPLGTLTGAAVGKLLPAPETIGLDAVFPAILLALVIPAFKNRTTLIRAASGAALALAAVPFVPTGLPVLLSLFGLLSRKK

SEQ ID NO: 12219 - protein, 828 aa, Klebsiella pneumoniae
RFNCRPGKWLPGSKRGIKMSVIAQAGAKGRQLHKFGGSSLADAKCYLRVAGIMKEYSQAGDMMVVSAAGSTTNQLISWLKLSQSDRLAAHQVQQSLRRYHTELIGGLLEPAAADTLIAAFIHDLERLAGLLDGGVSEAVYAEVVGHGEVWSARLMAAVLNQLGMEAAWLDARAFLRAERAAQPQVDEGLSYPLLQQLMAQHPNKRLVVTGFISRNQAGETVLLGRNGSDYSATQIGALAGASRVTIWSDVAGVYSADPRKVKDACLLPLLRLDEASELARLAAPVLHARTLQPVSASDIDLQLRCSYTPEQGSTRIERVLASGTGARIVTSHDDVCLVEFQVPAGHDFKLAHKELDALLKRAQLRPLAVGVHADRKLLQFCYTSEVADSALKLLDEAGLPGELRLRQKLALVAMVGAGVTRNPLHCHRFWQQLKGQPVEFTWQSEEGISLVAVLRAGPTESLIQGLHQSLFRAEKRIGLMLFGKGNIGSRWLELFAREQTTLSARTGFEFILAGVVDSKRSLLNYDGLDASRALAFFNDEAVEQDEESLFLWMRAHPYDDLVVLDVTASEQLADQYLDFASHGFHVISANKLAGASSSDKYRQIHDAFEKTGRHWLYNATVGAGLPVNHTVRDLIDSGDTILGLSGIFSGTLSWLFLQFDGTVPFTDLVDQAWQQGLTEPDPRVDLSGKDVMRKLVILAREAGYDIEPDQVRVESLVPAHCEEGSVDHFFENGEELNEQMLQRLEAAREMGLVLRYVARFDANGKARVGVEAVREEHPLAALLPCDNVFAIESRWYRDNPLVIRGPGAGRDVTAGAIQSDINRLAQLL

SEQ ID NO: 12220 - protein, 304 aa, Klebsiella pneumoniae
RRRLMAYQSQDIIRRSATNGFTPAPQARDHQQEVAKLIDVTTCIGCKACQVACSEWNDIRDEVGHNVGVYDNPADLTAKSWTVMRFSEVEQNDKLEWLIRKDGCMHCADPGCLKACPSEGAIIQYANGIVDFQSEQCIGCGYCIAGCPFDVPRLNPEDNRVYKCTLCVDRVTVGQEPACVKTCPTGAIHFGSKEDMKTLAGERVAELKTRGYDNAGLYDPAGVGGTHVMYVLHHADKPNLYHGLPENPEISQTVKFWKGIWKPLAAVGFAATFAASIFHYVGVGPNRAEEEEDNLHEEKDEVRK

SEQ ID NO: 12221 - protein, 62 aa, Klebsiella pneumoniae
SGCWMSIRLKDKPSLASRIEKFNKHHVFHENSVTHCRDYLIKMMQQLAPKGNASAIQRGETR

SEQ ID NO: 12222 - protein, 152 aa, Klebsiella pneumoniae
NAAWPRVSDGFRFMIGSLTARIFAIFWLTLALVLMLVLMLPKLDSRQMTELLESEQRQGIMIEQHVEAELANDPPNDLMWWRRLFRAIDKWAPPGQRLLLVTSEGRVIGAERNEMQIIRNFIGQADNADHPQKKRYGRLEMVGPFSVRERGG

SEQ ID NO: 12223 - protein, 501 aa, Klebsiella pneumoniae
TSLRLVDSLGYLLRRDAAFRCAFLEARLQRQDRIHIVRNHRAEFLQIGQGQRFQRFPLRNGFHYRFTDNMVRLAERYAFRHQIIRQLSGVGIALLRRFRTARAFYLNAVQHQGRHMQAVEPGIQGVEKPLFIFLHVFVVGQRQSFQRHHHAGQRTLHAAAFATDKLQGVRVFLLRHQRGAGGHAVGKLDEVRLAGVKENQIFRKARQMHHTDSRIGKQLQHMIAIGHAVEAVAGGGGKAQPAGQLLAVDLIRRPRQRAAAQRADVEALQRVLQTAFVTRQHFNVGQTPVRERHRLGALQVGVPRHYRVLILLGGLHQRALQLAVRREQFDNGIFAPQFKIGGDLVVTAAPGVQFLAQLAHFIDQLAFHPAVNIFGIAGEDLLRIGAHLFQQHVQRFFQLLLFSGTQNADRYQRFRPGDRANDILLRQTIVEAQRVVELFEPLICCLCKTPAPKCHNMLPLFVSSAGGIVPLGLRSCKPGRRRAAGHEILSQNTCADRRAVK

SEQ ID NO: 12224 - protein, 309 aa, Klebsiella pneumoniae
MSIRIIPQDELGSSEKRTAEAIPPLLFPRLKNLYNRRAERLRELAANNPLGDYLRFAALIAHAQEVVLYDHPLQMDLTARIKAASEQGKPPLDIHVLPRDKHWHKLLHSLIAELKPEMSGPALAVIENLEKASEQELEQMASALFVSDFASVSSDKAPFIWAALSLYWAQMASLIPGKACAEYGEQRQFCPVCGSMPVSSIVQIGTTQGLRYLHCNLCETEWHVVRVKCSNCEQSRDLHYWSLDNEQAAVKAESCGDCGTYLKIMYQEKDPKVEAVADDLASLVLDARMEQEGFARSSINPFMFPGEGE

SEQ ID NO: 12225 - protein, 72 aa, Klebsiella pneumoniae
NRLLLWRKQVVHLVANLSHLDLAGNLFLRHLFCLSAHSVFIKIFCGDKAMHCLHFANINGEPVVACPLHKIP

SEQ ID NO: 12226 - protein, 303 aa, Klebsiella pneumoniae
NNVRYDEKGDALNGRMMDNDINQLIDALLKKQTSLGRVYFAGETRSPAEPVVQVDFPRLNILLDGQLPDQALGDNAPLLEAHDVLYIPGDSWNCPQWQAPCLLLSILFDKQQLECSLQHWNGKAITVVDKRQALRRGPRVGSFLLQALNELRMQPQEQQTARSIVVSLLSHCHDLLGSQAQTSSRSQALFEAIRQYMDIHYAEPLSRESVAQAFYLSSNYLSHLFQKCGPMGFNEYLNHIRLEQARMLLKGHDMKVKDIAHACGFADSNYFCRLFRKTTERSPSEYRRQYHSQLTEKASPVKN

SEQ ID NO: 12227 - protein, 217 aa, Klebsiella pneumoniae
HLSRSTIMEMIMSYTLPSLPYAYDALEPHFDKQTMEIHHTKHHQTYVNNANAALESLPEFANLSAEELITKLDQLPADKKTVLRNNAGGHANHSLFWKGLKTGTTLQGDLKAAIERDFGSVENFKAEFEKAAATRFGSGWAWLVLKGDKLAVVSTANQDSPLMGEAISGASGFPIIGLDVWEHAYYLKFQNRRPDYIKAFWDVVNWDEAAARFAAKK

SEQ ID NO: 12228 - protein, 495 aa, Klebsiella pneumoniae
KFPRQQNIPGISRHNTTYPGFTAKLDAVVQFELNRMRSHAYAVVLFHTQGDVGIDSVIGEHAASGQELAISIQGLQGFFQRTGNLRDLFRFFRRQVIQVFIHCFARMDFVLDTIKASHQQRRKAQVRVGSRVREAHFDTTRFRRGHHRNTDRGRAVTGRVSQHNRRFVTRDQTLVGVGGRVRQGVDGFSVFDYAADVEQRLLRQTGVFVAGEQVGPVFRQRHMAVHAGAVVAEHRFRHKGRGFTKAVSDVVNNVFVNLNFIRFFGHGIEAGCHFVLTCGCYFMVMGFNNQTHLFHDHTHGGTDVLRRVYWRNREVTPFHARTVTFVTAFVFGRGVPRTFNVIDRDMGAGDRGAKADVVEQEEFWFWPEQDGISDAGGAQVIFSAFRDGARVTVIALQGAWLDDIAADDQGRFFVERVNDRGGRVRHQDHVRFVDTFPATNRGAIKHFAFFEEFGIYLMRRNRDVLFFTFGIGEAQIDKLHFVLVQHRQNVFSGHT

SEQ ID NO: 12229 - protein, 218 aa, Klebsiella pneumoniae
RERRGAQMKRRDTIVRYTAPERINHWVTAFCFVLAAVSGLGFFFPSFNWLMHILGTPQLARILHPFVGVVMFASFIIMFFRYWHHNLINRDDIFWAKNIRKIVVNEEVGDTGRYNFGQKCVFWAAIIFLVLLLVSGVIIWRPYFAPAFSIPVIRFALMLHSFAAVALIVVIMVHIYAALWVKGTITAMVEGWVTKTWAKKHHPRWYREVRQKQEKSSE

SEQ ID NO: 12230 - protein, 124 aa, Klebsiella pneumoniae
REGRAMKHSVQDKGTLLLALIAGLSINGAFAALFSSIVPFSVFPILSLLLTVYCLHQRYQNRSMPVGLPGLAAAFFILGVLLYSTVVRAEYPDIGSNFFPAVLSVAMVFWIGYKMRNRKDTAAE

SEQ ID NO: 12231 - protein, 339 aa, Klebsiella pneumoniae
GDALPMLNTLIVGASGYAGAELVTYINRHPHMNITALTVSAQSNDAGKLISDLHPQLKGIVDMPLQPMSDISEFSAGVDVVFLATAHEVSHDLAPQFLAAGCVVFDLSGAFRVNDGVFYEKYYGFTHRHPDLLKQAVYGLAEWSADALKDAQLIAVPGCYPTAAQLSLKPLIEANLLDLNQWPVINATSGVSGAGRKAAIGNSFCEVSLQPYGIFNHRHQPEIASHLGAKVIFTPHLGNFKRGILETITCRLKPGVGHAQIAAVYQQAYADKPLVRLYDKGVPALKSVEGLPFCDIGFAVQDDHLIVVAAEDNLLKGAAAQAVQCANIRFGFAETQSLI

SEQ ID NO: 12232 - protein, 385 aa, Klebsiella pneumoniae
  UNSURE (330): Identity of amino acid at the above locations are unknown.
PDPRAACGRRHGHRGGIEMDRIIQSPGKYIQGAGAIKRLGDYLKPLAERWLVVGDKFVLGFAEEMLRKSLADAGLAAEIAPFGGECSHNEINRLRDIAGNAKCTAVLGIGGGKTLDTAKALAHFMNVPVAIAPTIASTDAPCSALSVIYTDEGEFDSYLMLPRNPNMVIVDTQIVAGAPARLLAAGIGDALATWFEARACSRSGATTMAGGKCTQAALALAELCYNTLLEEGEKAMLAAEQHVVTPALERVVEANTYLSGVGFESGGLAAAHAIHNGMTAIPDAHHYYHGEKVAFGTLTHLVLENAPVDEIETVAALCHSVGLPITLAQXDIKGDIPTKMRLVAEAACAEGETIHNMPGGVDSDQVYAALLVADQYGQRFLQEWE

SEQ ID NO: 12233 - protein, 345 aa, Klebsiella pneumoniae
RRQRHRPGGGMMGHAWLKHREALLALVIILMIGAIGSRAPSFVSPGNLVEMFNDTAILIILALGQMMVLLTKGIDLSMAANLALTGMIVALLNAHYPGIPVVALLALATLLGLLMGVINGLLVWRLGIPAIVVTLGTMSIYRGIIFLLTDGGWVNSHQMSADFLSLPRSPLLGLPLLSWCAIAALLLVGYFLRYSRTGRALYTAGGNATAAYYTGINAGKMQFVSFCLSGALAGFCGYLWISRFAVAYVDVANGFELQVVAACVIGGISTMGGSGRVLGCLCGALFLGVINNALPVIGISPFWQMAISGAVIVMAVLLNERGNRGHGRLILRNAALARQKQAVKS

SEQ ID NO: 12234 - protein, 491 aa, Klebsiella pneumoniae
IHQLAGSYRIFGIPAYSEVEVFMQRGIAWIVDDDSSIRWVLERALTGAGLSCTTFESGNEVLDALTTKTPDVLLSDIRMPGMDGLALLKQIKQRHPMLPVIIMTAHSDLDAAVSAYQQGAFDYLPKPFDIDEAVALVDRAISHYQEQQQPRNAPISSPTADIIGEAPAMQDVFRIIGRLSRSSISVLINGESGTGKELVAHALHRHSPRSKAPFIALNMAAIPKDLIESELFGHEKGAFTGANTVRQGRFEQADGGTLFLDEIGDMPLDVQTRLLRVLADGQFYRVGGYAPVKVDVRIIAATHQNLEQRVQEGKFREDLFHRLNVIRVHLPPLRERREDIPRLARHFLQIAARELGVEAKQLHPETETALTRLAWPGNVRQLENTCRWLTVMAAGQEVLTQDLPSELFETTIPDSPTQMQPDSWATLLGQWADRALRSGHQNLLSEAQPEMERTLLTTALRHTQGHKQEAARLLGWGRNTLTRKLKELGME

SEQ ID NO: 12235 - protein, 373 aa, Klebsiella pneumoniae
SRELFTDKKLYCTKLVHSFSGDCRMATGTLPDAGQILNSLINSILLVDDDLAVHFANPAAQQLLAQSSRKLFGTPLPELLSYFSLNIGLMQESLQAGQGFTDNEVTLVIDGRSHILSLTAQRLPEGFILLEMAPMDNQRRLSQEQLQHAQQVAARDLVRGLAHEIKNPLGGLRGAAQLLSKALPDPALTEYTKVIIEQADRLRNLVDRLLGPQHPGMHVTESIHKVAERVVKLVSMELPDNVKLIRDYDPSLPELPHDPDQIEQVLLNIVRNALQALGPEGGEIILRTRTAFQLTLHGVRYRLAARIDVEDNGPGIPPHLQDTLFYPMVSGREGGTGLGLSIARSLIDQHSGKIEFTSWPGHTEFSVYLPIRK

SEQ ID NO: 12236 - protein, 306 aa, Klebsiella pneumoniae
YLFSMTTSRLHSLDIRLLRAFAVVAEENNISRAAQRLFISQPPLTRHIRHLEAQLGVTLFQRHSKGLILTDAGKEVLEMIQPLLALQERTLAALSELAVHSPQALRLGVTTAFEQGIFAAVEAALSEHTRALHITRHASPALAQQVRKGKLDAALVALPLNTEGLHLHPLPYHEPLIAALPASWPEAARPGLTLSALNHRPLFWFKRERNPGFFDYTRRIFDRAGYAPTYVEEPAEHDVLLARIARGEGMILLPASFSAIQRQGVAFCPVAEGDAMPLSLGVIYPPHQAESVQQWLSLLDGILATG

SEQ ID NO: 12237 - protein, 351 aa, Klebsiella pneumoniae
KKMRIKSMNHAITMGIFWHLIGAASAACFYAPFKKVKHWSWETMWSVGGIVSWLILPWAISATLLPDFWAYYRSFSASTLLPVFLFGAMWGIGNINYGLTMRYLGMSMGIGIAIGITLIVGTLMTPIINGQFAVLMHTQGGQMTLLGVLVAVIGVGIVTRAGQLKERKMGIKAEEFNLKKGLLLAVMCGIFSAGMSFAMNAAKPMHDAAAALGVDPLYAALPSYVVIMGGGALVNLGFCFIRLAKVKNLSVKADFSLAKPLIISNLLLSALGGLMWYLQFFFYAWGHASIPAQYDYMSWMLHMSFYVLCGGVVGLVLKEWNNAGRRPVSVLSLGCVVIIIAANIVGLGMAS

SEQ ID NO: 12238 - protein, 509 aa, Klebsiella pneumoniae
  UNSURE (356): Identity of amino acid at the above locations are unknown.
FLWRTIMSASTPLLSLKGITKIFPGVRALENVQLDLWPGKVTALIGENGAGKSTLVKVMTGIYQPEEGEILYKAIPIHLPTPESAHKVGITAIHQETVLFDELSVSENIFVGQYLYKGVLKTLDWPAMHRRANEILTRLEVQIDPRATLKTLSIAQRHMVAIARALAFDAQVVILDEPTAALSQHEILEFYHIVERLKQDGKAILFISHKFDEIFELADYYTILRDGVYVSSGAISDITEERMVSMMVGRAISQTYPKVDCTPGETVLEVTDLCHPTEFAHISFRLRKGEILGFYGLVGAGRTELMQALSGVSRPSSGEIRLNGRTMRFHQPADAIRAGIVCVPEERQKQGAIIAXPIAQNISLPQLSKLNPNGVLNDAREWRLADEYASRLQVKAFSWRQPVETLSGGNQQKVVIGKWLATQPEVIILDEPTKGIDIGSKAAVHQFMSELVSQGLAVIMVSSELPEVMGMADRIIVMHEGLMVAEYQAGEATAETIVSAASGIGQEAA

SEQ ID NO: 12239 - protein, 721 aa, Klebsiella pneumoniae
TVSGADVRELLGLTHLLEIAFEDASGRVRDHVRVQRVGSERRFKRLVVFRERSFRHLVDSEQTAHPFRLHDKRTDVAARRGGAVVRNIHAAPFGAVPFQQLTLRIPRFTLRVRGGAVIQDAAVERPGPGPAQGIAETGWIGVIAARHLVTFRRPAPGEDPAAAGGGAIISQLRKGAQLLAFLDDHRAGCRVGDIRQRFTVAFHRHFFRCRLVWRGVVPRHVEHRLRRRATLFGIHLTQASEDTGENFTIGDGDPRGVRAFPVPLQPAAGVDDRPILFGEAGGGQTEHFGLDFRRIDIVRLTMVLPEGGRFGIERVDSHEELQLRQGSDDLVFIRERGDRVKALANIAIHFALIHHLEVLQNVVALIPLRQPVIAPAVFRGGFVAEEGFHHGDEELRIVAPVVDLVFQQRLRRVSRQVGLQVGLFFVRQRHVAWQAGGEQAEVGQTLDIGVAAQGVDAATRHPHVAEQQLDHRHGADILRTDGVLGPAESVQERCGLIRRAGFSNVFTDFEEVGLRRTADVFDHIRGITGNMLLQQVPDAARMLQRSIAFGEAVFVQLIVPAGFVVLAFFCVIAAEQPVVEAIVLTHDQAGVGVGFGVFAVEFFVIQQIQDHARQEGNVGTGTNRGIEISHRRRTRKARIDNDELGAVMNFGFHRPAEPHRMRFCGVTAHHYDQVGVFNINPVVGHRTATKCWSKTCYRWSVSDTRLVIHRQHPEGAGEFLR

SEQ ID NO: 12240 - protein, 387 aa, Klebsiella pneumoniae
RPAGDRHLALLANGDFRGGDRHGGAAQRARQSRSRAVNPAQRGVSPTETGGEIMSKMMVSEEMKNAPAAPSPLRRLLCWEGFLLAVTLAVFIGNAVASPYFLNIWNLSDATFTFTENAIVVLPMAMLIIAREIDLSVASTMALSSTVMGFCAAAGMDTPLLVVIGLGVGLLCGLFNGLLVTRFNLSSIVITIGTMSLYRGITYILLGDQALNHYPESFAWFGQGYVWGALSFEFALFILLAAAFTFLLHKTNFGRRTYAIGNNPTGAWFSGINVKRHNLVLFALLGLMAGLAAVLLTSRLGSTRPTLAMGWELAVVTMAVLGGVNILGGSGSMPGVIIAAFLMGLVTFGLSLLNVPGIVMSVIIGAMLIVVISLPIITRRMMQRRRC

SEQ ID NO: 12241 - protein, 282 aa, Klebsiella pneumoniae
AVAGLILRKEEFFPSATQAVAVADRYPQNVFAEHTHEFCELVLVWRGNGLHVLNDRPWRITRGDLFYIRAEDKHSYASVNDLVLQNIIYCPERLQLNFDWAGAIPGLFGTPWKPHWRMGSTGMAQARQVISQLEHECARRDAQGNAMAELLFAQLALTLQRHRYATDDPAATQREALLDKLLAALAASLSRPFVLERFCEQEGGSERALRQQFRQQTGMTINHYLRQLRICHAQYLLQHTERLIGDIAMQCGFEDSNYFSVVFSREIGMSPGQWRQRSRAAA

SEQ ID NO: 12242 - protein, 528 aa, Klebsiella pneumoniae
RFFITLKGTPMKLKTMSAALLLTLPFWACAKDVTIIYTNDLHAHVEPYKVPWIADGKRDIGGWANITTMVKQEKAKNNATWFFDAGDYFTGPYISSLTKGKAIIDIMNTMSYDAVTIGNHEFDHGWDNTLLQLSQATFPIVQGNIFYQNSDKSFWDKPYTIIEKDGVKIGVIGLHGVFAFNDTVSAATRVGIEARDEVKWLQHYIDELNGKVDLTVALIHEGVPARQSSQGGTDVRRALDKDIQTAGQVKGLDVLITGHAHVGTPEPIKVGNTLILSTDSGGIDVGKLVLDYQEKPHQFTVKHFELKTLYADEWKPDPQTKQVIDGWNKQLDQLVQQVITQSPVELTRAYGISSPLGNLAADALLLAAGRSTQMALTNSGGIRNEIPAGAVSMGAVISTFPFPNELVTMDLTGKQLRSLMEHGAGLSNGVLQVSRGLEMKYDSSKPVGQRVVLFRLNGKPIDDTTVYHIATNSFLADGGDGFVAFTEGQARNTSGGYYVSNAVVDYFKAGQKITDEQLSGQRVVDVKK

SEQ ID NO: 12243 - protein, 306 aa, Klebsiella pneumoniae
IMNIRDLEYLVALAEHRHFRRAADSCHVSQPTLSGQIRKLEDELGVMLLERTSRKVLFTQAGLLLVDQARTVLREVKVLKEMASQQGETMSGPLHIGLIPTIGPYLLPHIIPMLHQTFPKLEMYLHEAQTHQLLAQLDSGKLDCAILALVKESEAFIEVPLFDEPMMLAIYEDHPWANRDRVPMSDLAGEKLLMLEDGHCLRDQAMGFCFEAGADEDTHFRATSLETLRNMVAAGSGITLLPALAVPQERKRDGVVYLPCIKPEPRRTIGLVYRPGSPLRSRYEHLAEAIRGTMDGHFDKALKQAV

SEQ ID NO: 12244 - protein, 73 aa, Klebsiella pneumoniae
GSPMKKGIHPNYDEITATCSCGNVMKIRSTVGHDLNLDVCGKCHPFFTGKQRDVATGGRVDRFNKRFSIPGSK

SEQ ID NO: 12245 - protein, 447 aa, Klebsiella pneumoniae
GSPMSEMTPREIVSELDKHIIGQDAAKRSVAIALRNRWRRMQLNEELRHEVTPKNILMIGPTGVGKTEIARRLAKLANAPFIKVEATKFTEVGYVGKEVDSIIRDLTDAAIKMVRMQSIDKNRYRAEELAEERVLDVLIPPAKNNWGQTEPSQEPSAARQAFRKKLREGQLDDKEIEIDLAAAPMGVEIMSPPGMEEMTSQLQSMFQNLGGQKQKPRKLKIKDAMKLLIEEEAAKLVNPEELKQEAIDAVEQHGIVFIDEIDKICKRGGNTSGPDVSREGVQRDLLPLVEGCTVSTKHGMVKTDHILFIASGAFQVASPSDLIPELQGRLPIRVELKALTTHDFERILTEPNASITVQYKALMATEGVNIEFTEDGIKRIAQAAWQVNETTENIGARRLHTVLERLVEDISYDASEMNGQTVTIDAEYVSKHLDVLVADEDLSRFIL

SEQ ID NO: 12246 - protein, 172 aa, Klebsiella pneumoniae
RLHIMKKPTSATRGKSGRKSREELNQEARDRKRQKKHRGHAAGSRANGGDAASAGKKQRQAQDPRVGSKKPIPLGVSESSAPAPKQHKPKSEKPMLSPQAELELLENDERLDALLERLEEGGTLNAEEQSWVDAKLDRIDELMQQLGLSYDDEDEEEEERQEDMMRLLKGGN

SEQ ID NO: 12247 - protein, 325 aa, Klebsiella pneumoniae
INSFAYPVSVTSSGYTKRIAGEGAYMNQSYGRLVSRAAIAATAMASALLLIKIFAWWYTGSVSILAALVDSLVDIAASLTNLLVVRYSLQPADEEHTFGHGKAESLAALAQSMFISGSALFLFLTGIQHLVRPEPLQAAGVGVVVTLIALVSTLALVTFQRWVVRKTQSQAVRADMLHYQSDVMMNGAILVALGLSWYGWHRADALFALGIGIYILYSALRMGYEAVQSLLDRALPDEERQDIITIVTAWPGIRGAHDLRTRQSGPTRFIQIHLEMEDNLPLVQAHVIADQVEQAILRRFPGSDVIIHQDPSSVVPAAQQGFFER

SEQ ID NO: 12248 - protein, 894 aa, Klebsiella pneumoniae
QNKMRWGVWGNMNEQYSALRSNVSMLGKVLGDTIKDALGENILDRVETIRKLSKSSRAGNEANRQELLTTLQNLSNDELLPVARAFSQFLNLANTAEQYHSISANGEAASNPEVIARTLRKLKDQPNLNEETIKQAVESLSLELVLTAHPTEITRRTLIHKMVEVNNCLKQLDNKDIADYEHHQLMRRLRQLIAQSWHTDEIRKHRPSPVDEAKWGFAVVENSLWEGVPNYLRELNEQLEANLGYQLPVDFVPVRFTSWMGGDRDGNPNVTADITRHVLLLSRWKATDLFLKDVQVLISELSMVECTDELRALAGAEGAQEPYRYLMKKLRSQLMETQAWLEARLKGQKLPKPAGLITQNEQLWEPLYACYKSLQACGMGIIANGELLDTLRRVKSFGVPLVRIDIRQESTRHTEALGEMTRYLGIGDYESWSEADKQAFLIRELNSKRPLLPRQWEPSEETREVLDTCKVIAEAPRGSIAAYVISMAKTPSDVLAVHLLLKEAGIGFALPVAPLFETLDDLNNANDVMTQLLNIDWYRGFIQGKQMVMIGYSDSAKDAGVMAASWAQYQAQDALIKTCEKAGIELTLFHGRGGSIGRGGAPAHAALLSQPPGSLKGGLRVTEQGEMIRFKYGLPEITISSLSLYTSAILEANLLPPPEPKAEWRDIMAELSDVSCKMYRGYVRENKDFVPYFRSATPEQELGKLPLGSRPAKRRPTGGVESLRAIPWIFAWTQNRLMLPAWLGAGAALQKVVEGGKQSELEAMCRDWPFFSTRLGMLEMVYSKADLWLAEYYDQRLVKPELWALGSELRKLLAADINVVLAIANDSHLMADLPWIAESIQLRNIYTDPLNVLQAELLHRSRQAEEEGKDPDPRVEQALMVTIAGVAAGMRNTG

SEQ ID NO: 12249 - protein, 260 aa, Klebsiella pneumoniae
GVMMNPLIIKLGGVLLDSEEALERLFTALVNYREAHQRPLIIVHGGGCVVDELMKQLNLPVQKKNGLRVTPAEQIDIITGALAGTANKTLLAWAKKHGISSVGLFLGDGDSVKVTQLDAELGHVGLAQPGSPALINTLLAGGYLPVVSSIGVTDEGQLMNVNADQAATALAATLGADLILLSDVSGILDGKGQRIAEMTAEKAEQLIEQGIITDGMIVKVNAALDAARALGRPVDIASWRHAEQLPALFNGTPIGTRILA

SEQ ID NO: 12250 - protein, 300 aa, Klebsiella pneumoniae
LTGMGYAMARKSDPLAFGGLALLTLIWSFSWIAMKQVTSYIGAFDFTALRCIFGAVVLWIVMLIRGKALKPTPFGYTLAIALLQTCGMVGLAQWALMSGGAGKVAILSYTMPFWVVVMAALFLGERMRRWQYIAIGVACVGLILVLQPWQLDFTSLKSALLAILSGVSWGAGAIVAKRMYTRYPQVDLLALTTWQMLYAAVVMSVVAWLVPQRAVDWQPDVFWALAYSAILATALAWSLWLFVLRNLPASIAGLSTLAVPVCGVLFSWWLLHENPGKVEGCGIALIVLALAMISIKRGGA

SEQ ID NO: 12251 - protein, 610 aa, Klebsiella pneumoniae
GKVVIENLRNIAIIAHVDHGKTTLVDKLLQQSGTFDARTEAQERVMDSNDLEKERGITILAKNTAIKWNDYRINIVDTPGHADFGGEVERVMSMVDSVLLVVDAFDGPMPQTRFVTKKAFAHGLKPIVVINKVDRPGARPDWVVDQVFDLFVNLDATDEQLDFPIVYASALNGIAGLDHEDMADDMTPLYQAIVDRVPAPDVDLDGPLQMQISQLDYNNYVGVIGIGRIKRGKVKPNQQVTIIDSEGKTRNGKVGKVLTHLGLERIESDVAEAGDIIAITGLGELNISDTICDPQNVEALPALSVDEPTVSMFFNVNTSPFCGKEGKFVTSRQILDRLNKELVHNVALRVEETEDADAFRVSGRGELHLSVLIENMRREGFEMAVSRPKVIFREIDGRKQEPFENVTLDVEEQHQGSVMQALGERKGDLKNMNPDGKGRVRLDYVIPSRGLIGFRSEFMTMTSGTGLLYSTFSHYDDVRPGEVGQRNNGVLISNGQGKAVAFALFGLQDRGKLFLGHGAEVYEGQIIGIHSRSNDLTVNCLTGKKLTNMRASGTDEATVLVPPVKMTLEQALEFIDDDELVEVTPTSIRIRKRHLTENDRKRAMRGAKEE

SEQ ID NO: 12252 - protein, 461 aa, Klebsiella pneumoniae
RKHVMALWGGRFTQAADQRFKQFNDSLRFDYRLAEQDIVGSVAWSKALVTVGVLSAAEQQQLEEALNVLLEEVRANPQQILASDAEDIHSWVEGKLIDKVGQLGKKLHTGRSRNDQVATDLKLWCKDTVVELLSANRQLQSALVETAQQNQDAVMPGYTHLQRAQPVTFAHWCLAYVEMLARDESRLQDALKRLDVSPLGCGALAGTAYEIDREQLAGWLGFASATRNSLDSVSDRDHVLELLSDAAIGMVHLSRFAEDLIFFNSGEANFVELSDRVTSGSSLMPQKKNPDALELIRGKCGRVQGALTGMMMTLKGLPLAYNKDMQEDKEGLFDALDTWLDCLHMAALVLDGIQVKRPRCAEAAQQGYANATELADYLVAKGVPFREAHHIVGEAVVEAIAQGKPLEALTLADLQKFSPVIADDVYPILSLQSCLEKRAAKGGVSPQQVAQAINEAKARLS

SEQ ID NO: 12253 - protein, 92 aa, Klebsiella pneumoniae
AAAVDQENMTTAILLEQIVEQPVILETFNRNDLSTKRRPSSKVREQRFHDVDIFLVDVTKLGSIVFHRLNVQLLREFLVYPANRIVGKIINC

SEQ ID NO: 12254 - protein, 296 aa, Klebsiella pneumoniae
GMSFFHANQREALNQSLAEVQGQINVSFEFFPPRTSEMEQTLWKSIDRLSSLKPKFVSVTYGANSGERDRTHSIIKGIKERTGLEAAPHLTCIDASRDELRTIAQDYWNNGIRHIVALRGDLPPGSGKPDMYAADLVTLLKEVGDFDISVAAYPEVHPEAKSAQADLLNLKRKVEAGANRAITQFFFDVESYLRFRDRCVSAGIDVEIIPGILPVSNFKQAKKFADMTNVRIPVWMSKMFEGLDNDAETRQLVGANIAMDMVKILSREGVKDFHFYTLNRAEMSYAICHTLGVRPA

SEQ ID NO: 12255 - protein, 494 aa, Klebsiella pneumoniae
TTTVVAASEMAAQPAHDPRCGGAGTAYPSAAPSEGVSMSEQIIDWDLALIQKYNYSGPRYTSYPTALEFSPQFGAAEFDAAVARYPQRPLSLYVHIPFCHKLCYFCGCNKIVTRQQHKADQYLDVLEQEIIHRAPLFATRQVKQLHWGGGTPTYLNKAQISRLMDLLRSHFHFSAEAEISIEVDPREIELDVLDHLRAEGFNRLSMGVQDFNKEVQRLVNREQDEAFIFDLLNHAREIGFTSTNIDLIYGLPKQTPESFAFTLQKVSELNPDRLSVFNYAHLPTLFAAQRKIKDADLPSAEQKLEILQETIGSLTTAGYQFIGMDHFARPDDELAVAQRHGVLHRNFQGYTTQGDTDLLGMGVSAISMIGDSYAQNQKELKQYYQQVAEQGNALWRGIALTRDDCLRRDVIKALICNFQLDIAAVKAQWDVDFASYFAEDLKLLAPLAHDGLVAVDDKVIQVTAKGRLLIRNICMCFDAYLRQKARMQQFSRVI

SEQ ID NO: 12256 - protein, 316 aa, Klebsiella pneumoniae
HWILKQYKELHMALEKGIASLVEAFIAAGRPSSRDQHIDDRRAGYIASAVLAGETETRVRVEDITLEGMHFRVVSPPTADGLLPTLIYYHGGCFVSGGFATHDNQLRQLAWFSGCRVIAVQYRLAPEYPFPAAHDDAERGATIIHQHAKQLGVDASRITLAGDSAGGHLALVTALRLKAAGTWQPAQLILIYPMLDATASMASYASNGEDYIITRDTLLSGYEMYLAATPATHPDASPLWREDFHGLPPVHILTAEFDPLRDEGEVLYRRLTEQGVESSCQRYLGVIHGFFQLVGISNAARDAMRDIAWRVASPGR

SEQ ID NO: 12257 - protein, 274 aa, Klebsiella pneumoniae
LAVFTLADVMQSLQRRRRRAENYRDLLAVGAPYRQVAGMVAPAFLLLVGAVMLFVDDDDAEIFKWGKQRGAGADHNGRFAIFRLQPGRETFAVIEPGVQHFHRRVKALAKSGDGLRRQADLRHHHQRLAPLRQHILQHAQIDFRFPGAGNTRQQPGGETIGGAVDRPDGGGLLGIQAQAFAGNRIRAAPVGEGGRFAGQLRQPFTAQRLQRRFIEFQFANLMTPDFALAQRRQRLLLLPGAFQAVKVDNLPLLGGEPVPQRRGAGGFALAQHNG

SEQ ID NO: 12258 - protein, 338 aa, Klebsiella pneumoniae
GSASGNRIIFCFLSSEVVMIKKIGVLTSGGDAPGMNAAIRGVVRAALTEGLEVFGIYDGYLGLYEDRMVQLDRYSVSDMINRGGTFLGSARFPEFREEHIRAVAIENMKKRGLDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFIMVPEVEYTRDDLVAEIKAGIAKGKKHAIVAITEHMCDVDELASYIEKETGRETRATVLGHIQRGGSPVPYDRILASRMGAYAIELLLQGHGGRCVGIQNEKLVHHDIIDAIENMKRPFKNDWLDCAKKLY

SEQ ID NO: 12259 - protein, 429 aa, Klebsiella pneumoniae
LAISAFSCTASCNRRGARLPSSSGDMDSLWWSMNKINASPQAMLIVRLAAAQAPLHWQLFAPGEPHHEASGRWPTDDASPFPALAEQYPAWVLIPASDCAFHSLTLPAGLRKPPLQVAPFLLEEQLADDVEATHFALLHRQQAQCEIVAVQRQKMRDWLARCESLSLQPLALTPDVLALPWQPPAWSAVQVDEQWLIRHQPWGGMAAENVWLTELLQSEAEEHVIDSYSPPPAAPGVWREQPAQTLLTLAARHPAAQKLSLLQGEFAVRRRSAQASWRPARYAALALALLAGANSVLDHRDLARQAEAAQQASRAFYHRWFPTEKKVINPRLQMQQHLQTLTRQAQHAPLVDRLSALQNILSETPGIRLRALSWDAAGNPLQLDIAAVTSRALEQFTQRAQPRFRVRPGDMITKPDGIEGQLTLEENDG

SEQ ID NO: 12260 - protein, 201 aa, Klebsiella pneumoniae
RQPFAASFATMYAILFRSLFMALKATIYKAAVNVADLDRNQFLDANLTLAQHPSETQERMMLRLLAWIKYADERLQFTRGLSSDDEPELWLLNDHLGVDLWIELGLPDERRIKKACSRAQAVALFAYNSRAAEIWWQQNQSKLAAYPKLTIWYLDDAQLALLSAFADRTMTLQATLQEGSIWLSDARNNLEIQLTAWQASA

SEQ ID NO: 12261 - protein, 270 aa, Klebsiella pneumoniae
LSSSGNVMKPTTIALLQKCKQEKKRFATITAYDHSFAKLFADEGINVLLVGDSLGMTVQGHDSTLPVTVEDIAYHTRAVRRGAPNSLLLADLPFMAYATPEQTFANAAIVMRAGANMVKLEGGAWLADTVRMLAERAVPVCGHLGLTPQSVNVFGGYKVQGRGDAAQTLFEDALALEAAGAQLLVLECVPVELAKRITDALTIPVIGIGAGNVTDGQILVMHDAFGITGGHIPKFAKNFLAEAGDIRAAVRQYIAEVESGVYPGEEHSFH

SEQ ID NO: 12262 - protein, 505 aa, Klebsiella pneumoniae
RLQSRRPPMTPAAERRPLLPFAWARAHHLVLLSDGECCEALCRPDTAARALLEARRLADGPMRVSRLAPDAFEKVLVLSYQRDSAEAHRMMADIGNELDLYTLAEELPDTDDLLDSEDDAPIIRLINAMLTEAIKEKASDIHIETYERHLQIRFRVDGVLREILRPQRRLAALLISRIKVMASLDIAEKRVPQDGRMALRIGGRAIDVRVSTLPSSHGERVVLRLLDKNSVNLDLLTLGMPPALLDRVDALIARPHGIILVTGPTGSGKSTTLYAALSRLDARERNIMTIEDPVEYELEGIGQTQVNAKVEMTFARGLRAILRQDPDVVLVGEIRDGETAQIAVQASLTGHLVLSTLHTNSALGAISRLQDMGVEPFLLSTSLLAVMSQRLVRQLCPHCRQPWQADANTARQMAVPVGARLWQPKGCPECNFIGYRGRTGIHELLLIDDRVRAAIHRGENEITLIQQLGPAWQTLRHAGRDKALAGITSWEEVMRVTEQQTTESV

SEQ ID NO: 12263 - protein, 556 aa, Klebsiella pneumoniae
CCSSLVWSSIRSAYGSCAPRCLAAAHCRWWPCGVLIGLFCMLLGLRWQVAELIGMTLALSSTAIAMQAMNERNLTVSQMGRSAFAVLLFQDIAAIPLVAMIPLLAASGGATSLMAFALSALKVAAALALVVVLGRYLTRPLLRFVARSGLREVFSAVALFLVFGFGLLLEEVGLSMAMGAFLAGVLLASSEYRHALESDIEPFKGLLLGLFFIGVGMSIDFGTLVTHPLRIVILLVGFLAIKMLMLWLIARPLGVPRAQRRWFAVLLGQGSEFAFVVFGAARMADVLDGEWAKALTLAVALSMAATPILLVLLTRLEKSSSGQARDADEIDEEQPRVIVAGFGRFGQIAGRLLLSSGVKMVILDHDPDHVDTLRKFDMKVFYGDATRVDLLESAGAEKAEVLINAIDDPHVSLELVARVKEHFPHLQIISRARDVDHYIQLRQAGVEAPERETFEAALKSGRMTLEALGLGAYEARERADLFRRFNLQMVEEMVAMAENDAASRVAVFKRTSDMLTGIINEDRHHLSLVQRHGWQGTEEGRHTGDIADEPENKPSA

SEQ ID NO: 12264 - protein, 85 aa, Klebsiella pneumoniae
ALPSVREIIRTCLCSAVLGNTALKICSKCSFTFCKLRFLTNFFLVYPSLATTINRFFGEESNAKTYRHKKYPDSGRGPDCYRSGV

SEQ ID NO: 12265 - protein, 436 aa, Klebsiella pneumoniae
NAQSLAGISTQAGYCSASAGKGLASSVGHRPLASWCGSPGAKSCQCSGACAAARRTISMAWGEALILFIDHHRESISPLDDGKRAPLLLQDAVQLKAEIASHHGKSGDKACAVHRQPGTGKRGIGFLQRRLREKGGDAAPPGSRAVVQQLLRLLQRQIAGKEGHQQGGLGGAQGVDIDLQRVIRLDADEGEQALIERGVHPGQQAQLADILHRLVGGEIARGLRHIDLVLRPVQPRLAVAVRPVAKGGGDLAGAQRRLAEQRQQPNEDVGRVGRSVASLIRAMVNSIEVEAGVPVADRGADFAIVEGKAAPLLRPGLRQVRLTGRVQRIALQQRGGHVFRRQGVPSGLQIIEGHGGMLIHDRGALGHGAGEDHHQGEDEQHHQERDAALPIYHWPPPGVSKNRRVISPLFASVRVISSPCGSLCGRSQVSCQRPSA

SEQ ID NO: 12266 - protein, 119 aa, Klebsiella pneumoniae
RALPPRSAAAPSARRFPPPCRPTAGGGSATARPPAPRSTPAVARAGPARRASTPGAVRRAIRSAPASRAFFAAVRRRSRTGPAGGGAGQNGWLPHRRPAALPAETGPPAAAVYAGPPVG

SEQ ID NO: 12267 - protein, 104 aa, Klebsiella pneumoniae
THRPGDAQAGKLCQRRNPQPPPAVRGAVAALNAPGADLNCRPVPRHRQRARRRPLDPRRAGCAEVCRAARAELARNAAGRLAGASPPADVGHRPAARYSGSGGD

SEQ ID NO: 12268 - protein, 715 aa, Klebsiella pneumoniae
DSYPIHTVLIALGAVNIGLKARVMTADRAKHQQKIEHRPAFLGDHLSRHQQRNPRRIREDHVGRNPPHQVLQFNSFHLPLDLALPGVMRRHFHFRQDVKGAEHQLRQLMLTDQAVDPLRQILDPHVAVEVGIFGVQIRQHIFHPQIEIVGAFKLGQAAQQPHRPGFIDADTEQEQQIVGACFLYHHAPLVEELRHQRRRDPLFIHIPLLVHARRQNGDLHRIEIHMIRIGIFETVPVLARRYRPALGFIYGFRLPDIKEPAVRLLAQSLHLFAEVQRPLNGALDQTFTGVAAQHRRRGLNRRDDGVARRRRGMHHKGFVKGLFIIVAFNVDQRGLRQRGQHLMRRLRLEDDFPGDPLPAHTAFPLIYRMEMGIGHPGGIEMDRRDIERLLKPGGVIEQTIVGGVGDHRMHGPLRPARVAHFLLNAVAGKFAPGDTAEDPQRVAGRLQPQGNYIAHHQQVGQRFVTVTVNQQGAAGGRRVHADNFIGRRGAVGHHIALLGAKGARDILLRLQVRAGMIQQGAQLGDRNRDIRLQRIPAKKIIEQAAHRAFLIGAAAHMARRTEGIFSLLDIVEQRAGKRRSDILQVLAGVLPNAGGDLFGESQRIFEEPQRHAQILTADIHRRVGVNKGVQRKVFIELIDIAAQIDAVFIPVEDHPADARVVLDKLQQVGAVLRPDGLEALALQRRFQFFDRLVFVVDAVRPHDGDDIHAFLLVFT

SEQ ID NO: 12269 - protein, 510 aa, Klebsiella pneumoniae
KFCPIETMCRKGIFLTTQRAGTAKMPLSSFVLPIIDNGMKAETPSFEAHQFVRVRRGDAVRRLIQRDKTPLAVLFMAAVVGTLAGLVGVAFEKSVNWVQNQRIGALAQVADHWYLVWPLAFILSALLAMVGYFLVRRFAPEAGGSGIPEIEGALEELRPVRWWRVLPVKFVGGMGTLGAGMVLGREGPMVQLGGNIGRMVLDVFRMRSPEARHTLLATGAASGLSAAFNAPLAGILFIIEEMRPQFRYNLISIKAVFTGVIMSSIVFRIFNGEAAIIEVGKLSNAPVNTLWLYLVLGMLFGCFGPLFNFLVLRTQDLFQRIHGGNIKKWVLIGGLIGGLCGLLGLMQPSAVGGGFNLIPIAAAGNFSVGLLLFIFIARVVTTLICFSSGAPGGIFAPMLALGTLLGTAFGMAAIPLFPAYHLDAGTFAIAGMGALLAASVRAPLTGIVLVLEMTDNYQLILPMIITCLGATLLAQFLGGKPLYSTILQRTLAKQEAEQAAKAQQAPRENT

SEQ ID NO: 12270 - protein, 353 aa, Klebsiella pneumoniae
YGGPLLRLSGGPARWRNDCPGDAGGTDAQRHSGTDLRHPDGDPATPGRCGAGKLCLLMMNPTLITRRRLLIAMALSPLLWQMRGAQAADVDPQRVVALEWLPAELLLALGVTPYGVADIPNYRLWVNEPALPDSVIDVGLRTEPNLELLTQMKPSFIVWSAGYGPSPEKLARIAPGRGFTFSDGKRPLAMAQRSLLEMADLLGKTQQAKRHLAEFDALMESLRPRFAGRGDRPLLMISLLDPRHVLVFGENCLFQEVLDRFGIKNAWHGEAAFWGSVSVGIDRLAAFNEADVICFDHGNERDMAQLLATPLWQAMPFVRAGRFQRVPAVWFYGATLSAMHFARVLADAQGRPA

SEQ ID NO: 12271 - protein, 100 aa, Klebsiella pneumoniae
PSIPQPSASLLYPRAAHGPGNTAPGGSTPDTATNGGRPAKQTTPGALFHHGPPGHRPPPPDAPAASPQYAGYHRSRTATGGAASGSAPAMSARRAVRCRR

SEQ ID NO: 12272 - protein, 417 aa, Klebsiella pneumoniae
CGSPNSKRRKASKMALFRYQALDAQGKTRRGLQQADSARHARQLLRDKGWLALEVTTADPARRLWAGGSLTRRTSAGDLALLTRQLATLVAAGIPLEKALDAVAQQCEKPSLRTLMAGVRSKVLEGHSLAEAMRGYPACFDGLFCAMVAAGETSGHLDGVLNRLADYTEQRQQLRARLLQAMIYPIVLTLVAISVIAILLSTVVPKVVEQFVHLKQALPFSTRLLMSLSDIVRSAGPWLALLSLLALLALRYLLRQPARRLAWDRALLRLPVIGRVARSVNSARYARTLSILNASAVPLLLSMRISADVLSNAWARSQLAAASESVREGVSLHRALESTALFPPMMRYMIASGEQSGELTAMLERAAENQDRELSAQIQMALSLFEPLLVVTMAGMVLFIVLAILQPILQLNTLMSM

SEQ ID NO: 12273 - protein, 144 aa, Klebsiella pneumoniae
DRPPGCTPSWSTNCGRRDRSLRTVRLYATAGGKRSSRSGRTRPSGRFPPAMTRRRRRCRGSSGGWPPPSCRRCRPPVRPAAPWAPRRGRSRRYRLAGRRSSAPRRRRHRYRPARRRSVPGWRSSGSHRFPRLSPPSRPAAIHRR

SEQ ID NO: 12274 - protein, 137 aa, Klebsiella pneumoniae
AIMPQIPRLALPTGPDGPELERPSLIPGLPLQNEKALAAGPRHLKHKRVQALVDTERRRSCRAPAKPGVPGSKTSLAALKDYLAVLIDFTRPKGTLNHLAFCREHGKGMVIGTTGFDDADKQAIRDPAQDIAIVFAA

SEQ ID NO: 12275 - protein, 809 aa, Klebsiella pneumoniae
PHSPALIHQANHFLGVVHIGGHHRRHKLGRVVRLKPQRLVGDQRVGGGVRFVKSVTGEFLHQVEDFHRQFAVNAVFLRPILKDRTLLGHLLRLFLTHRTTQHVRAAEGISGQHLGNLHDLFLIQDDAVGWLQHRFQAFMLPLHVRIRDLLAAMLTVDKVIYHPRLQRARAEQSHQRDHIFEAVRLQAFNQIFHAARFKLEDRGGFRALQHVEAFLVIQGDGGDIQRPFAVLLTALVDHLQRPVNDSERTQTEEVEFHQPGVFHVVLIKLGNRMQPLLIAIQWREIGDFGWSDNYPTGMFTGVSRHPFQLTRHVDQRFHFFVRLVDLRQLRLGLKGFRQRHARIGRHQLGDTIDKSVRVTQHATDIADDRFRRHGTEGDDLRYRVAAVHIRHVLDNLVAFLHAEVDVEVGHRDTFRVKETFEQQVELQRVKIGDLQRVGHQRTGAGTASRANRHAVILRPLDKLHHNQEVAREPHLVDNLEFNIQTLVILRALFSTDGRIREEEFQPLFQTLFRFHDQEIFRGHIAGRELRQEIFAKPHGDVAALGNFNAVRQRFRNIGEQLAHLFLAAHILLRRVVARPFRVVERKAVVDRDADFMGVEIAGVEKADIVGRHHRQAARFRQRHGGVEIGLFILSTGTDQLQKIAVREMLFVEGDALFNQRHIAADQADADVTFPAAGEQNQPFLMFHQPVAIDPRPQGAVAALIGTGNQQGQVLVAGVVRRQHGQLGKFVAEQVALHVKVGADDRLNPRAVSRPVELHQSAEVGEIGDRQRWHAKRGRLLHQRPGLCQPIDHGIVAVHPQVYETWFSHL

SEQ ID NO: 12276 - protein, 814 aa, Klebsiella pneumoniae
PPEPFVSSLPVAAVLPELLSALQHAPQVLLNAPTGAGKSTWLPLQILAEGNIAGRIILLEPRRLAARNVAQRLAELLGEKPGETVGFRMRAETCVGPQTRLEVVTEGILTRMIQRDPELTGVGLVILDEFHERSLQADLALALLLDVQQGLRDDLKLLIMSATLDNDRLQRLLPEAPVVVSEGRAYPVERRFSPLSAQQRFDEAVAVAAAELLRHEQGSMLLFLPGVGEIQRVLEQLTERVAEDVILCPLYGALPLSEQRKAILPAPAGKRKVVLATNIAETSLTIEGIRLVVDSAQERVARFDPRTGLTRLVTQRISQASMTQRAGRAGRLSPGICLHLLGKEQAERAAAQSEPEILHSDLSALLLELLQWGCHDPAALAWLDQPPAVNLAAARRLLEALSALDGERLSAFGRKMAALGNEPRLAAMLAAAQTDDEAATAAKLAAILEEPPRGGLVDLGAVFSRQQANWQQRAQQLMKRLARRGGQPDAGLMAGLLASAFADRIARRRGQEGRYQLANGMGAMLDADDALGRHEWLIAPLLLQGSASPDARMLLALPVEIGELIAARPELAKSSDTVEWDEAQGTLKAWRRTVIGQLVIKTQPLAKPSEAELHQAMLNGIREKGLGVLNWTPEAEQLRLRLHCAAQWLPEEAWPAVDDASLLASLETWLLPQMNGVHSLRALKALDLRQALQDWLPWPLRQKLDRELPTHYTVPTGSRLAIRYHAENPPALAVRMQEMFGEATTPVIAEGQVPLVLELLSPAQRPLQITRDLSAFWQGSYREVQKEMKGRYPKHVWPDDPANAAPTRRSKKYS

SEQ ID NO: 12277 - protein, 285 aa, Klebsiella pneumoniae
RPGPDAVAAAGKMVTTGAKMTTLAALSLHFPFVWYGFLLLFGLALGSFYNVVIYRLPRMLTQTADDERITLSTPGSSCPQCRQPIAWRDNIPLLSFLWLGRRARCCQAPIAWSYPLTELATGLLFILAGALLAPGLPLAGGLVLLSFLLILARIDARTQLLPDRLTLPLLWAGLLFNLNEVYIALPDAVAGAMAGYLALWSVYWLFRLLTGKEALGYGDFKLLAALGAWCGWQVLPQVLLLASASGLVWTLLQRLWTRQSLQQPLAFGPWLALAGGSIFLWQQMV

SEQ ID NO: 12278 - protein, 445 aa, Klebsiella pneumoniae
RAGPSLLGMFVDMTADIAHTLHPHRQLLVAFSGGLDSTVLLHQLVLLREQDPSLTLRAVHVHHGLSAHADDWVAHCRQICQQWQVPLVVHHVTLARGGLGVEAHARAARYQAFQDTLNAGEVLVTAQHQDDQCETLLLALKRGSGPTGLSAMAPSSAFAGSRLLRPLLNETRESLRQWALAHQLSWIEDESNQDDTYDRNFLRLRVIPVLRERWPHFSEAVARSASLCAEQEQLLDEMLAAELASLVAEDGSLAIAPLATMSPPRRAALLRRWLAGQQALMPAREVPERLWHEVALAREDASPCLRLGEFTVRSFQQRLYWVKYLPGQTDSVQRWPDWRQPLRLADGLGELTLQPGGRLRPPSADEPVTVRFRASGHLHIVGRHGGRKLKKLWQELGVAPWRRDTTPLLFYGETPIAAADDLFVTTEGEVKDGEGVRLMWRKTGD

SEQ ID NO: 12279 - protein, 749 aa, Klebsiella pneumoniae
FSFTLSFTFIRDIPMARPKTAQPNHSLRKVAAVVATAVSGMSVYAQAAEQPKQEETITVVAAPAAQESAWGPAPTIAAKRSATATKTDTPIEKTPQSVSVVTRQEMEMRQPTTVKEALSYTPSVFSTRGSSTTYDVVTIRGFTTSTTVNTNQYLDGMKLQGNNYSEVSMDPYFLERVEVMRGPTSVLYGNSNPGGIVSMVSKRPTTEPLKEVQFKMGTDNLWQTGFDFSDAIDDAGVWSYRLTGLGRSQDAQQQMAKSTRYAVAPSFSWRPDDKTDFTFLSNFQNDPDAGYYGWLPREGTVVPYYDANGKAHKLPTDFNEGESDNKISRRQKMVGYSFSHQFDDTFTVRQNLRYADVHTLYRSVYGNGYVAPGYMNRAYVRSDEHLNTFTVDTQLQSDFATGAVSHTLLTGVDYSRMRNDVDADYGTADPISMSNPQYGNPNIQVTFPYAVLNRMEQTGLYAQDQMEWDKWVMTLGGRYDYATTSTLTRATNSLAENHDQQFSWRGGINYLFDNGISPYFSYSESFEPVSGSNSRGQPFDPSRGKQYEAGVKYVPKDMPVVVTAAVYQLTKDKNLTADPANQAFSIQTGEIRSRGLELEAKAAVNANINVTAAYSYTDAEYTHDTVFNGKRPAEVPRNMASLWADYTFHETALSGLTIGAGARYIGSTVSYYKNDTSTGKKNDAFSVAGYALMDATVKYDLARFGLPGSSVGVNVNNLFDREYVSSCYSEYACYWGAGRQVVATATFRF

SEQ ID NO: 12280 - protein, 492 aa, Klebsiella pneumoniae
RMNTQDLAKLRSIVPEMRRVRHIHFVGIGGAGMGGIAEVLANEGYQISGSDLAPNPVTQQLSQLGATIYFNHRPENVRDASVVVVSSAISADNPEIVAAHEARIPVIRRAEMLAELMRFRHGIAIAGTHGKTTTTAMVSSIYAEAGLDPTFVNGGLVKAAGVHARLGHSRYLIAEADESDASFLHLQPMVAIVTNIEADHMDTYHGDFENLKQTFINFLHNLPFYGRAVMCVDDPVIRELLPRVGRQITTYGFSDDADVRVEDYRQVGAQGHFRLVRQDKAILQVTLNAPGRHNALNAAAAVAVATEEGIDDRAILRALESFQGTGRRFDFLGEFPLAEVNGKPGSAMLIDDYGHHPTEVDATIKAARAGWPDKNLVMVFQPHRYTRTRDLYDDFANVLTQVDALLMLDVYPAGEAPIPGADSRSLCRTIRGRGKVDPILVPDSAQAAEMLASVLTGNDLVLVQGAGNIGKIARHLAEIKLIPQKAEEERHG

SEQ ID NO: 12281 - protein, 323 aa, Klebsiella pneumoniae
YRNTMSLNFLDFEQPIAELEAKIDSLTAVSRQDEKLDINIDEEVHRLREKSVELTRKIFADLGAWQVAQLARHPRRPYTLDYVRLAFDEFDELAGDRAFADDKAIVGGIARLDGRPVMIIGHQKGRETKEKIRRNFGMPAPEGYRKALRLMEMAERFKMPIITFIDTPGAYPGVGAEERGQSEAIARNLREMSRLSVPVICTVIGEGGSGGALAIGVGDKVNMLQYSTYSVISPEGCASILWKSADKAPLAAEAMGIIAPRLKELKLIDSIVPEPLGGAHRNPEAMAASLKAQLLADLADLDLLSEEELLNRRYQRLMSYGYA

SEQ ID NO: 12282 - protein, 892 aa, Klebsiella pneumoniae
IRNTPMSERLHNDVDPIETRDWLQAIESVIREEGVERAQYLIDQLLSEARKGGVKVAAGASAGNYVNTIAVEDEPEYPGNLDLERRIRSAIRWNAIMTVLRASKKDLELGGHMASYQSSATFYEVCFNHFFRARTEKDGGDLVYFQGHISPGVYARAFLEGRLTEEQMDNFRQEVHGKGLSSYPHPKLMPEFWQFPTVSMGLGPLGAIYQAKFLKYLEHRGLKDTSEQTVYAFLGDGEMDEPESKGAITIATREKLDNLVFVINCNLQRLDGPVTGNGKIINELEGIFGGAGWNVIKVIWGGRWDELLRKDTSGKLIQLMNETVDGDYQTFKSKDGAYVREHFFGKYPETAALVADWTDEQIWALNRGGHDPKKVYAALKKAQETKGQPTVILAHTIKGYGMGDTAEGKNIAHQVKKMNMDGVRYVRDRFNVPVADADLEKLPYVTFPEGSEEHTYLHAQRQKLNGYLPTRQPKFTEKLELPTLADFSALLEEQNKEISTTIAFVRALNVMLKNKSIKDRLVPIIADEARTFGMEGLFRQIGIYSPNGQQYTPQDREQVAYYKEDEKGQILQEGINELGAGASWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLVRMYGEAQENVYYYITTLNENYHMPAMPEGAEEGIRKGIYKLETIEGSKGKVQLLGSGSILRHVREAAQILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFDIDAEKVNPRLA

SEQ ID NO: 12283 - protein, 446 aa, Klebsiella pneumoniae
CGWFTTSSAFAVNRNGKSMKNWKTLLLGIAMIANTSFAAPQVVDKVAAVVNNGVVLESDVDGLMQSVKLNAGQAGQQLPDDATLRHQILERLIMDQIVLQMGQKMGVKISDDQLDQAIANIAKQNNMTLDQMRSRLAYEGINYNTYRNQIRKEMLISEVRNNEVRRRITVLPQEVEALAKQIGDQNDASTELNLSHILIPLPENPTSDEVAAAQEQANSIVEQARNGANFGKLAITYSADQQALKGGQMGWGRIQELPGIFAQALSTAKKGDIVGPIRSGVGFHILKVNDLRGGTQNISVTEVHARHILLKPSPIMNDAQAQAKLEQIAAEIKSGKITFAQAAKTYSEDPGSANQGGDLGWATPDIFDPAFRDALMRLNKGQTSGPVHSSFGWHLIELLDSRQVDRTDAAQKDRAYRMLMNRKFSEEAATWMQEQRASAYVKILSN

SEQ ID NO: 12284 - protein, 302 aa, Klebsiella pneumoniae
KANTHLRALNGCQGLFFTRTVPMTAHLLRSGLLTFALLLLTACTLDVGRSSPSTSAADDHSSSWAVTLQRQSSIAGSGLREIAESDLRSGDLLFSSSLGVTSLGIRAFSASSVSHVALYVGEGQVAEATGAGVQVITLQQALAHSDKLFALRVPDLTPDQATTMKSFAWQVKDSGYNYRGIIQFIPYMVTKPLCSLNPFSRDFRQQCVSGLAKAQLGDAASGDKKAWFCSEFVSEAFVRAGHPLTLAQAAWISPSDLLHMREGDVATFKPETQLQYVGHLKLGVYLQAGKLVGLNKPKDGAE

SEQ ID NO: 12285 - protein, 407 aa, Klebsiella pneumoniae
CKCTMQRDDDSFMLVPSKGEDYMAGWHLDTKMAQDIVARTMRIIDTNINVMDARGRIIGSGDRERIGELHEGALLVLSQGRVVDIDDAVARHLHGVRQGINLPLRLEGEIVGVIGLTGEPESLRKYGELVCMTAEMMLEQSRLMHLLAQDSRLREELVMNLIQAEEHTPALNEWAQRLGIDLNQPRVVAMIEVDSGQLGVDSAMAELQQLQNALTTPDRNNLVAIVSLTEMVVLKPALNSFGRWDADDHVRRVEQLIARMKENGQLRFRVALGNFFTGPGSIARSYRTARTTMMVGKQRMPESRSYFYQDLMLPVLLDSLRGGWQANELARPLARLKAMDNNGLLRRTLQAWFRHNVQPLATSKALFIHRNTLEYRLNRISELTGLDLGSFDDRLLLYIALQLDEQR

SEQ ID NO: 12286 - protein, 219 aa, Klebsiella pneumoniae
SSGTTDVQWESTMLVYWLDIIGTAVFAISGVLLAGKLRMDPFGVLVLGVVTAVGGGTIRDMALANGPVFWVKDPTDLVVAMVTSMLTILLVRQPRRLPKWILPVLDAVGLAVFVGIGVNKAFLAGSGPLVAVCMGVVTGVGGGIIRDVLAREIPMILRTEIYATACIVGGIVHATAHDTFHLPLENSAMMGMVVTLVIRLAAIRWHLKLPTFALDDNGR

SEQ ID NO: 12287 - protein, 324 aa, Klebsiella pneumoniae
IIRFKPLLVPCMNRGPLSAPFFNLRCLAVGRAVSTSPEDFRMAEITASLVKELRERTGAGMMDCKKALTEANGDIELAIENMRKSGAIKAAKKAGNVAADGVIKTKIEGNYGYILEVNCQTDFVAKDGGFQAFADKVLDAAVAGKISDVEVLKAQFEEERVALVAKIGENINIRRIAVLEGDVLGSYQHGARIGVLVAAKGADEELVKQLAMHVAASKPEFVKPEDVSAEVVEKEYQVQLDIAMQSGKPKEIAEKMVEGRMKKFTGEVSLTGQPFVMEPSKSVGQLLKEHNADVTGFIRFEVGEGIEKVETDFAAEVAAMSKQS

SEQ ID NO: 12288 - protein, 122 aa, Klebsiella pneumoniae
NRSTRLNNLLMPPGLFWTRERPVLPGPGSFAGVLCPPRLEPFCASSAGAQRPKPFHSVMADLELNLGVPIQARPVPWEGPTAVFVALWPKLIFFLGNNYRKIGFQEIIQPVKVGPLLKKTPV

SEQ ID NO: 12289 - protein, 546 aa, Klebsiella pneumoniae
RDGLLFGSGVSMSLPFKPHIIALLCSAGLLAAAGTLYVQSRTPATIAEPPAQQAPAPAASTTQPVAATYTQAQIDQWVAPIALYPDSLLSQVLMASTYPDNVLQAVQWSQDNPAMKGDAAVQAVASQPWDPSVKSLVAFPALLAMMGENPPWVENLGNAFLAQPHDVMDSVQRLRAIAQQTGTLKSTPQQKVIVTPAAPVSASSSTTATATAHTGAPAPTQVIKIEPTNPQVVYVPSYNPSTVYGTWPNSAYPPVYLPPPPGEQFTDSFVKGFGYSLGVATTWALFSSIDWDDDDHHHHDDDYHHGDYSHNGDNININVNNFNHITGENLPGNHVNWQHNPAYRGHTPYPDNTVAQRFHQTNVSGGLSATQHAPVDREAQRQAAMTQLQHNVPTATAGNLAANNTSRDAQRQAASAQLKQATQRSNYRGYDSTPTQQQRREAAKTQLKNPTPQQQQRREAARSHEQNRTPQQQQRRQQFQSATPAQRQQTLSHLRANALSGNESRAPSWQAQQERGLQSRQFSGVNRELRDGTRERLSEHHELRRR

SEQ ID NO: 12290 - protein, 537 aa, Klebsiella pneumoniae
RMATRRQPLNLRGLMPGLFAATLLCAVALAAFLALWFSAPGAGWQSVFSDSYLWHVVRFSFWQASLSALISVGPAIFLARALYRRRFPGRTLLLRLCAMTLILPVLVAVFGILSVYGRQGWLASLFHALGWQWEFSPYGLQGILLAHVFFNMPMATRLLLQALENIPGEQRQIAAQLGMRGYAFFRLVEWPWLRRHIPAVAALIFMLCFASFATVLSLGGGPKATTIELAIYQALSFDYDPARAAMLALIQMLCCLGLVLLSQRLSKAVAIGVSHVRGWRDPDDRLHSRLSDGLLIGAALLLLLPPLLAVIVDGINRNMLDVLAQPALWQALSTSLRIAIAAGLLSVTLTMMLLWSSRELRSRQRPLAGQAMELSGMLILAMPGIVLATGFFLLLNNTIGLPESADGIVIFTNALMAIPYALKVLENPMRDIAARYSMLCQSLGIEGFARLRVVELRALRRPLAQALAFACVLSIGDFGVVALFGNEAFRTLPFYLYQQIGAYRSQDGAVTALLLLLLCFLLFTLIEKLPGRDAKTQ

SEQ ID NO: 12291 - protein, 462 aa, Klebsiella pneumoniae
CMKTEQLIPLCRRYHAMLLHSDEQTISIAVVNTPPAELMEALRFATQKRIDIECWSQEQMDKRLQAQEKQAQLAQNDGPENIAERVNQILEQALRQRASDIHIEPTETHLRIRLRVDGVLHALPLLAPELAAPVIARLKVLASLDIAEHRLPQDGQFALNLAGRPLSFRIATLPCRYGEKIVLRLLHQVDQALDLEALGLSSSQLAAFRQALNQPQGLLLVTGPTGSGKTVTLYSALQARNREQVNICSVEDPLEIPIAGMNQTQINPRAGLTFHSVLRALLRQDPDIVMVGEIRDAETAEIALKAAQTGHLVLSTLHTNSTSETLTRLQQMGIARWMISSALSLVIAQRLVRKLCPHCRRNAGSAADLPHSLWPRPLPRWQAAGCEHCYHGYYGRLALFEVLPVTPGLRQGIVQGLNAIEIESLARAAGMMTLFESGCQAIEQGLTSLEEVVRVLGIPHGD

SEQ ID NO: 12292 - protein, 77 aa, Klebsiella pneumoniae
TAVTWKLLTQKVTHLAKVSAKKARLLSISKRYGFLLIIVGIGPWRCTRKGIFVAGFEQKACNILPLTIQLNFNVAFL

SEQ ID NO: 12293 - protein, 308 aa, Klebsiella pneumoniae
SISTARRSVLRSLFSVSQFQRSFIKTMSTYLIGDVHGCYDELIALLAQVEFDPRRDTLWLTGDLVARGPGSLEVLRYVKSLGDSVRLVLGNHDLHLLAVFAGISRNKPKDRLKPLLEAPDADELLNWLRRQPLLQVDEEKKLVMAHAGITPQWDLETAQQCARDVEAVLSSDSYPFFLDAMYGDMPNHWSNELSGLARLRFISNAFTRMRYCFPNGQLDMYSKEAPEDAPAPLKPWFAIPGPVSNAYSIAFGHWASLEGRGTPEGIYALDTGCCWGGELTCLRWEDKQYFTQPSNRQKSLDEGEAVAS

SEQ ID NO: 12294 - protein, 436 aa, Klebsiella pneumoniae
PATTERRQRQQRQHYRAATHYPLRRRTICRPRDPRQDLRHTRIAAGLQHHQQHSEGGAQRHPRQQHPMRREAAAPGGEHNDQQGGRRAKAAGRQQPAKGVARHEEQHQHHAKSRAGADAQHFRAGHRVAGQALDNTAGDRQHDPGEQGRQHPRPAPGQELLQQIAVGPQPAVGIATKGQRHAHRQQQQRDACENKPLHIIALRLHIIAAVHHRGADAAQPRQQPQQQRRANQGGDRASGDFPPYPAQPEDHLIGKPQEQRADQRRQQQPRQQPTGAKHFRQQRREQADKADNPYRVHQQRADDDRQRQGAEARQGQRQPEVTRHPVIEPHQGQRPQQQQGEYCPAKQLRPQALRHAPVGLRQRPGAPQEHALQLVVMENHHQLVKRATVKADHQPRQDQRYRRQALAPRDAKHQRAHQAGPGQRGELRRQHAGNSP

SEQ ID NO: 12295 - protein, 206 aa, Klebsiella pneumoniae
SKETIMAEKFTQHTGLVVPLDAANVDTDAIIPKQFLQKVTRTGFGAHLFNDWRFLDDKGQQPNPEFVLNFPEYQGASILLARENFGCGSSREHAPWALTDYGFKVVIAPSFADIFYGNSFNNQLLPVTLSDEQVDELFKLVQANPGITFEVDLEAQVVKAGDKTYSFRIDDFRRHCMLNGLDSIGLTLQHEAAISDYERKLPAFMN

SEQ ID NO: 12296 - protein, 577 aa, Klebsiella pneumoniae
MISAWSNKMAIAIGLDFGSDSVRALAVECASGAELATSVEWYPRWREGQYCDGANNRFRHHPRDYIESMEAALKSVLASLSAEQRADVVGIGVDSTGSTPAPVDAEGNVLALREEFADNPNAMFVLWKDHTAVEEAEAITRLCHQPGKEDYSRYIGGIYSSEWFWAKILHVTREDSAVAQAAASWVELCDWVPALLSGTTRPQDLRRGRCSAGHKSLWHESWGGLPPASFFDELDPIINQHLAWPLFTDTWTADVPVGTLSAEWAQRLGLPQSVAISGGAFDCHMGAVGAGAQPNALVKVIGTSTCDILIADKESVGERTVKGICGQVDGSVVPHFIGMEAGQSAFGDIYAWFGRILGWPLEQLAQQQPALREQIKASQKQLLPALTEAWANNPSLEHLPVVLDWFNGRRTPNANQRLKGVITDLNLATDAPALFGGLIAATAFGARAIMECFTEQGIPVNNVMALGGIARKNQVIMQACCDVLNRPLQIVASDQCCALGAAIFAAVAAGVYEDIPAAQQRMASQVETTLQPRPAQAQRFEQLYQRYQQWSVSAEQHYLPSAAKAEKAPQSQAALTY

SEQ ID NO: 12297 - protein, 141 aa, Klebsiella pneumoniae
PAAAAADAAPDCVVQGPVSGYATGYRPTPLSPSPPAAPAGRGSALPPDGRSNTGWPAGSREFRYRRSGRGTPRSYTAQGCDPCCSGRRRSAPYTLRWLYASRSVRWRGTGFSPAVGSGYSPPAPFGLPSGSPAPRGRWSRD

SEQ ID NO: 12298 - protein, 132 aa, Klebsiella pneumoniae
FSAAYRREDERMIGRVTEALSKVKGSIGSNERHALPGVIGDDLLRFGKLPLCLFICIIITAITVVTTAHHTRLLTAQREQLVLERDALDIEWRNLILEENALGDHSRVERIATEKLQMQHVDPSQENIVVQK

SEQ ID NO: 12299 - protein, 432 aa, Klebsiella pneumoniae
RFAAGLAGDMAAAADERRSFPAGAEGAGSASGATGLAAMAAAPKAGSRAADALYRADRQPPGDPIPCGEPASAGGAYAGDVRRGHDAGDRRGAGAAGAGAAVACPASAADHPRSERLLARELPRGAERDEGTLSETRLAGRSGQRRPDPPQQKILVAAAAGRHPARPVGSQTLDHLLPEKNTPAGQRQPGAEGQRLLQRLPGPQALQQGPHQPAGRSEQQHLRQNLPAAPGAQRRQQLKIAIAQRLFPGQQAEQPVDRPQRQITGHRPGDRIRQGNVHLVKIEQQPGPQQGQSQAIGQQLGPGVNPRQYQQEREQHQAARQRQARRQQSSGEDKQQAGGQLGQRIAPRDGRLTAAGATAQPEETEQRDIVPPGDRLAALRAGRSRGAEGYPLVVRGLGQHARQTIDHHIVKAAQRQAEQQQKAIPDKGKVQR

SEQ ID NO: 12300 - protein, 126 aa, Klebsiella pneumoniae
RSGARLAHAGSVPDDRHRRETDPRRSAAGHRRQSGSSAPDLQYSNRPGDRRQPDRPGRPLPSAGQYHRNRPNAARSAEAAGGQRPVESAAGSAYRVGSLDHRRRRAPYRLQPCAEPRRYAPVLRAA

SEQ ID NO: 12301 - protein, 119 aa, Klebsiella pneumoniae
TSFAAAAAAGAAAAGAASFFSSCAGAAAAAPSAESKIIISLPVSVLSPTETLISFTTPACGDGTSIEALSPSTVISDCSASTLSPTLTRISVISTSSAPMSGTLISIAIILLPLTPDAG

SEQ ID NO: 12302 - protein, 66 aa, Klebsiella pneumoniae
RSSACSRRGKRLQITLQPCAFQALIDWLDAPAMRGVNAISLSVTGQPSRPGWVTVNHLLLERDDEG

SEQ ID NO: 12303 - protein, 231 aa, Klebsiella pneumoniae
ICYFPLQNAENICVLYPKCSAFSVTISARSAIATIIMTVQALSYLSYVGEELMSVDTPAQAGVSIDALLAAKEQRAARQADWLAHYQQPVISLTLVTPGAVKDSIRYRNMMGVALQACDQLLWKHRWQTLDRQVLWLPTGPEALWCVAHPASEIKAMCSTLEQSHPLGRLWDIDVICPQNGLVGRQSLGESQRRCLLCDEPAHACARSRRHDTDLVVARVEQMIDAWFARD

SEQ ID NO: 12304 - protein, 62 aa, Klebsiella pneumoniae
RQCAGHADRGGQFEEVSTLHIHILLFCGRIFELKPYRNGKVKQKSKNKDRRCVKKYANLKRR

SEQ ID NO: 12305 - protein, 239 aa, Klebsiella pneumoniae
RLGAMSAFQFAQIGVIRSPYKEKFAVPRQPGLVKHGGGELHLVAPYNQADAVRGLESFSHLWILFVFHQTMEGGWRPTVRPPRLGGNARMGVFATRSTFRPNPIGMSLVELKGIRCQKDQVILELGSLDLVDGTPVVDIKPYLPFAEALPDASASYAQQAPLAGMNVSFTPEIDAQLLTLEKRYPHIKAFIREVLAQDPRPAYRKEEQAGKTYAVWLLDFNVRWRVTASGFEVFALEAR

SEQ ID NO: 12306 - protein, 515 aa, Klebsiella pneumoniae
IMGAEHCYLLHTFPSIAYLSISSTSSCNVFLPTAANNSLHTATERPHMAENTLSIREKIGYGMGDAGCNIIFGAIMLFVNYFYTDIFGLAPALVGVLLLSVRVIDAVTDPIMGALADRTRSKYGRFRPWLLWIAFPYALFSVLMFTTPEWTYNSKVIYAFVTYFLLSITYTAINIPYCSLGTVMTADPKERVACQSYRFVMVGIATLLLSLTLLPMADWFGGADKAKGYQMAMTVLAFIGMCMFLFCFATVRERIRPAVQTNDELKKDLKDVWKNDQWVRILLLTLCNVCPGFIRMAATMYYVTWVNGQKHHFANLFTTLGVIGMMIGSMLAKVLTDRWCKLQVFFWTNIVLAVFSCAFYFFNPHATTLIMVLYFLLNILHQIPSPLHWSLMSDVDDYGEWKTGKRITGISFSGNLFFLKVGLAVAGAMVGFLLSWYGYDAGAKAQSASALNGIVLLFSVIPGVGYLITAGVVRLLKVDRTLMRQIQSDLEKRRSNYSELNEYQELKTSEHVRKA

SEQ ID NO: 12307 - protein, 679 aa, Klebsiella pneumoniae
KQTAMNRAATLTLNAPLLMLVAALALSTPFTAGAAPAFLDYAQQQTQQSQAQEKNDAASAKQTQESRQSADNKKTGTSTSQLQKRITSQQAAIAQKDKLIQQLKKQLAATPQTDTAGANEQAALNKRINELQVALSAATAEKEALIKKAGVVQNNNLQQSQAAARQQIQQLTTQIQQAVAENKRLSASFTTLNKDKHALMTQLAAAEKEKQAALEQVKALNADKQPLMTRLAAAEKEKQAVLEQVKALNADKQSLTIRLAAAEKAQQAALDQAKALNADKQPLTTRLAAAEKEKQAVLEQVKALNADKQSLTIRLAAAEKAQQAALDQAKALNADKQPLATRLAAAEKEKQAALEQVKALNADKQSLTIRLAAAEKTQQAALDQVKALNADKQSLSTRLAAADKVPHGPANDAAAPKNEPPEMAAIVAAYRLQADKDNAQLRMKEDEIELLRTQLSVQSKTRSGESAAAKLSASGEQQAYAIGASMGSEALNVLTTRRTQGVTVDAGLVLQGIEDAFRGQLRLGEQERNKALFDVSQQVFQNLNKIEQKNISAGKKYQQAFARKKDVVFKEGVYSRVDYPGKGKISGNDLVTVVIKEMLTDGTVINDMEAKDQALTQKLDAYPPVFREPLKRLQNHGSVTLVVPPEKAYGSKGLPPKIPPGATMVYSVRIVDSQPEQAK

SEQ ID NO: 12308 - protein, 467 aa, Klebsiella pneumoniae
QVEAGRTGIPLTTSTAAQLVIDTARFMTLGTDDVQTACGQYRIVAYLPVGFDFLNLLWRWVFQRSDFRLPATAEHNIGTTTRHVGGDGHRGRVARLGDDIRLAGVEFGVQDVVLDAGFSQFAGNHFRFFDRDSPHQHRLTGSGTSFDIFDNCLNFFRFGHIDQIRHIFTDHRTVGRYNHGVQLIDRAKFKGFGIGCTGHPRQLLVQTEVVLEGDRGQSLVLVLDLHALFGLNGLVQTIGPAAALHRAASVLIDDDNFAIFDNVVNVAGEQRMGAQRGGNVVHQHNVGWRVQGLTFIHNAFLYQQLFNQHQTTFGQVNLTRFFIHREVAFASESIRILFFLADQMRDDFVYLAVHFRAVFRRAGNDQRRTRLIDQDGVHLIHQRIVQFTLNALFRAEGHVVAQVVEAVFVVGAIGDIGSVSFTLRRRRQAGHVDANCHAQKFKQRAVIFGVTLGQIVVDGHYVNAFAG

SEQ ID NO: 12309 - protein, 325 aa, Klebsiella pneumoniae
TVGAPAGFVLIKMMENYKHTTVLLDEAVNGLNIRPDGIYIDGTFGRGGHSRLILSRLGAEGRLLAIDRDPQAIAVAQTIDDPRFSIVHGPFSQLAEYVGERNLTGKIDGILLDLGVSSPQLDDAERGFSFMRDGPLDMRMDPTRGQSAAEWLQTAEEDDIAWVIKTFGEERFGKRIARAIVERNRIQPMTRTKELAEVIAAAMPVKDKHKHPATRTFQAVRIWVNSELEEIEQALKSSLSVLAPGGRLSIISFHSLEDRIVKRFMREQSRGPQVPAGIPMTEAQLKKLGGRELRALGKLMPGEEEVAENPRARSSVLRIAERTNA

SEQ ID NO: 12310 - protein, 214 aa, Klebsiella pneumoniae
LFMAETKSQQSRLLVTLTALFAAFCGLYLLIGGAWLVVLGGSWYYPIAGLVMLGVTVMLFRGKRAALWLYAALLLATMIWGVWEVGFDFWALTPRSDILVFFGIWLILPFVWRRLPVPSAGAVGALVVALLISGGMLTWAGFNDPQEVNGTLSADATPAAPISTVADGDWPAYGRNQEGQRFSPLKQINADNVKNLNEAWVFPHRRPETAERSG

SEQ ID NO: 12311 - protein, 86 aa, Klebsiella pneumoniae
GFAAARISSPPAAFPWPQVSREQVLARQPQAIVVTGDASRIAEAQRFWQHQLTISLIALHSDWFERAGPRIILAAKQLCAALDQVK

SEQ ID NO: 12312 - protein, 180 aa, Klebsiella pneumoniae
AGAAAGAAPSTSKTMIREPVLTLSPVLILISLTVPANGAGTSIEALSPSTVIRDCSAATLSPTLTITSVTSTSSPPMSGTLTSFTPAAAAGAAAAGAAACAGAAAGAAPATSKIIIREPVETLSPVLILISLTVPANGAGTSIEALSPSTVIRDCSAAMVSPTLTMISVTSTSSPPISGT

SEQ ID NO: 12313 - protein, 87 aa, Klebsiella pneumoniae
NTAAENSIWSRPITRPTPCVAWRASAICGSCLCFIRQWKAVGVRRCDLPDWAAMRGWASSPPVQRFALIPSACRSLSSRAFAVRKIR

SEQ ID NO: 12314 - protein, 395 aa, Klebsiella pneumoniae
RSQATGTRRRETMFEPMELTNDAVIKVIGVGGGGGNAVEHMVRERIEGVEFFAVNTDAQALRKTAVGQTIQIGSGITKGLGAGANPEVGRNAADEDREALRAALDGADMVFIAAGMGGGTGTGAAPVVAEVAKDLGILTVAVVTKPFNFEGKKRMAFAEQGITQLSKHVDSLITIPNDKLLKVLGRGISLLDAFGAANDVLKGAVQGIAELITRPGLMNVDFADVRTVMSEMGYAMMGSGVASGEDRAEEAAEMAISSPLLEDIDLSGARGVLVNITAGFDLRLDEFETVGNTIRAFASDNATVVIGTSLDPDMNDELRVTVVPTGIGMDKRPEITLVTNKQVQQPVMDRYQQHGMSPLTQEQKPAAKVVNDNTPQTVKEPDYLDIPAFVRKQAD

SEQ ID NO: 12315 - protein, 502 aa, Klebsiella pneumoniae
LIKAREQVADRNLRDLLAPWVPNAPERILREMTLDSRVAASGDLFIAVQGHQADGRRYIPQAIAQGVAAIIAEAQGEAKDGEIREMHGVPVIYLSQLNERLSALAGRFYHQPSQQLRLVGVTGTNGKTTTTQLLAQWAKLLGETSAVMGTVGNGLLDKVVPTENTTGSAVDVQHVLSSLVGQGATFGAMEVSSHGLVQHRVAALQFAASVFTNLSRDHLDYHGDMEHYEAAKWLLYSTHHCGQAIVNADDEVGRRWLAKLPDAVAVSMEDHINPNCHGRWLKATAVNYHDSGATIQFDSSWGKGEIESRLMGAFNVSNLLLALATLLALGYPLADLLKSAARLQPVCGRMEVFSAPGKPAVVVDYAHTPDALEKALQAARLHCSGKLWCVFGCGGDRDKGKRPLMGAIAEEFADIVVVTDDNPRTEEPRAIINDILAGMLDAGQAKVMEGRAEAVTNAVMQAKENDVVLVAGKGHEDYQIVGNRRLDYSDRVTVARLLGAVA

SEQ ID NO: 12316 - protein, 113 aa, Klebsiella pneumoniae
LAVYAGKLAALQSSFLLRLPGGGAAFVAAKGVGAQMAERLLTLGWRGGLELLPALLLLRCAVLLVAPGGFSTLLLLRRGVFQLRFCRLATLLLGRRTVVTAVITALGGLLQLR

SEQ ID NO: 12317 - protein, 198 aa, Klebsiella pneumoniae
GRLLVIVREQETVVIVRDDSERGIPPLVTHQPPSSMDDAPVIRGRMVQIPGWIIPLYAGLFIALGWFGGEQWRHPAPPQTLPLPVAHAALLPLTAAGEAAPKTPPPAAKASAPAAPEVDSDTLPPVRYSAHVYASRPEKRSIVLNGKAWTEGDSPLPNLVVEQIQQDVTIFSFNGTTFTLAALEDWPGGKIDEEPKEE

SEQ ID NO: 12318 - protein, 285 aa, Klebsiella pneumoniae
ILCYFSATNFKLVRPIDSGLMAETGNMAYSKIRQPKLSDVIEQQLEFLILEGTLRPGEKLPPERELAKQFDVSRPSLREAIQRLEAKGLLLRRQGGGTFVQSRLWQSFSDPLVELLSDHPESQFDLLETRHALEGIAAYYAALRSNDEDRDRIRELHQAIERAQQSGDLDAESGAVVQYQIAVTEAAHNVVLLHLLRCMEPMLAQNVRQNFELLYARREMLPLVSNHRTRIFEAIMAGEPEQAREASHRHLAFIEEILLDRSREQSRRERSLRRLQQRKDENSGS

SEQ ID NO: 12319 - protein, 230 aa, Klebsiella pneumoniae
RPSYSVLTEDERELGVCVVDIGGGTMDIAVYTGGALRHTKVIPYAGNVVTSDIAYAFGTPPSDAEAIKVRHGCALGSIVGKDENVEVPSVGGRPPRSLQRQTLAEVIEPRYTELLNLVNEEILQLQEQLRQQGVKHHLAAGIVLTGGAAQIEGLAACAQRVFHTQVRIGAPLNITGLTDYAQEPYYSTAVGLLHYGKESHLSGEAEVEKRVTASVGSWIKRLNSWLRKEF

SEQ ID NO: 12320 - protein, 67 aa, Klebsiella pneumoniae
TASYAMAPENVFPNTMNCVAAKDEQNEKPIIRCPVYVNAVAACRLRPTAVCHAGTGRNCAGRSDQPA

SEQ ID NO: 12321 - protein, 299 aa, Klebsiella pneumoniae
NDEYGQLVPLIPSGRTTRMAETQNDPLLPGYSFNAHLVTGLTPIEAQGYLDFFIDRPLGMKGYILNLTIRGEGVINNHGEQFVCRPGDMLLFPPGEIHHYGRHPDASEWYHQWVYFRPRAYWHEWLNWPTIFAQTGFFRPDEQWQARFGELFGQIVDAGQGAGRYSELLAINLLEQLLLRRMEAINESLHPPLDNRVRDACQYISDHLADSHFDIASVAQHVCLSPSRLSHLFRQQLGVSVLGWREDQRISQAKLLLSTTRMPIATVGRNVGFEDQLYFSRVFKKCTGASPSEFRAGCE

SEQ ID NO: 12322 - protein, 481 aa, Klebsiella pneumoniae
NGRYYCPLCRRRGVIMAKTLYEKLFDAHVVYEAQNETPLLYIDRHLVHEVTSPQAFDGLRAHGRQVRQPGKTFATMDHNVSTQTKDINASGEMARIQMQELIKNCKEFGVELYDLNHPYQGIVHVMGPEQGVTLPGMTIVCGDSHTATHGAFGALAFGIGTSEVEHVLATQTLKQGRAKTMKIEVQGKAAPGITAKDIVLAIIGKTGSAGGTGHVVEFCGEAIRDLSMEGRMTLCNMAIEMGAKAGLVAPDETTFNYVRGRLHAPKGKDFDDAVAYWKTLKTDDGATFDTVVTLQAAEIAPQVTWGTNPGQVISVTDNIPDPASFSDPVERASAEKALAYMGLKSGIPLTEVAIDKVFIGSCTNSRIEDLRAAAEIAKGRKVAPGVQALVVPGSGPVKAQAEAEGLDKIFIEAGFEWRLPGCSMCLAMNNDRLNPGERCASTSNRNFEGRQGRGGRTHLVSPAMAAAAAVTGHFADIRNLK

SEQ ID NO: 12323 - protein, 160 aa, Klebsiella pneumoniae
RMTLVYIALGSNLASPLEQVQAAIRALGEIPHSRVVAVSSFYRTPPLGPQDQPDYLNAAVALETALPPETLLDHTQRIELQQGRVRKAERWGPRTLDLDIMLFGDAVINSERLTVPHYDMKNRGFMLWPLFEIAPDLHFPDGLALRAVLDNLGAAKPASW

SEQ ID NO: 12324 - protein, 252 aa, Klebsiella pneumoniae
NKQYSGRRSRLARGPHDMLTVASPARCQSSLSACKKYEQSVSGSEDMGYTVALTGGIGSGKSTVADAFAQLGVKVIDADVIARQVVEPGTPALQAIVGHFGPQMIAPDGTLNRRLLREKIFAHVEEKAWLNALLHPLIQQETRRQMQAATSPYLLWVVPLLVENRLSGQADRVLVVDVPKETQIERTMLRDKVSREHAEHILAAQATRQQRLAVADDVIENTGTPDAVASDVARLHEKYLTLASQAASQENS

SEQ ID NO: 12325 - protein, 340 aa, Klebsiella pneumoniae
RQNHEHRRQRDGATHYRWRPRRPQRTGCTGRHGCAGQPRSTTNSLSNLLRIFVMAERITGHTELIGLIATPIRHSMSPTMHNEAFAYLGLDYVYLAFEVGNQELKDVVQGFRAMKLRGFNVSMPNKTEICQYLDKLSPAAQLVGAVNTVVNDDGVLTGHITDGTGYMRALSEAGIDIIGKKMTVLGAGGAATALCVQAALDGVKAISIFNRRDKFFANAEETVAKIRHNTDCEIHLFDLDDHDKLRAEIDSSVILTNATGVGMKPFEGQMLLPDDSFLRPDLIVSDVVYNPRKTHLLEVAEKKGCRTLNGLGMMLWQGARAFEIWTGKQMPVDYIKSILF

SEQ ID NO: 12326 - protein, 1203 aa, Klebsiella pneumoniae
RLSHRCSPAEAAGTRRNRASPAQFWPGEACPGPGVQLSHRDLKMAEPRFVHLRVHSDYSMIDGLAKTGPLVKKAASLGMPALAITDFTNLCGLVKFYGTGHGAGIKPIVGADFHVQCDLLGDEFTELTVLAANNTGYQNLTLLISRAYQRGYGALGPWIDRDWLVEHQEGLILLSGGRKGDVGVSLIRGNMPLVEQCVAFYEEHFPDRYFLELIRTGRQDEEAYLHAAVALAEARGLPVVATNDVRFLDTSDFDAHEIRVAIHDGFTLDDPKRPRNYSPQQYMRSEEEMCELFADIPEALANSVEIAKRCNVTVRLGEYFLPQFPTGDMTTEDFLVMKSKEGLEERLEFLFPDPAVRAEKRPEYDQRLDIELQVINQMGFPGYFLIVMEFIQWSKDNGVPVGPGRGSGAGSLVAYALKITDLDPLEFDLLFERFLNPERVSMPDFDVDFCMEKRDQVIEHVADMYGRDAVSQIITFGTMAAKAVIRDVGRVLGHPYGFVDRISKLVPPDPGMTLAKAFEAEPQLPEIYEADEEVKALIDMARKLEGVTRNAGKHAGGVVIAPTKITDFAPLYCDEQGLHPVTQFDKNDVEYAGLVKFDFLGLRTLTIINWALEMINKRREKNGEGPLDIAAIPLDDKKSFDMLQRSETTAVFQLESRGMKDLIKRLQPDCFEDMIALVALFRPGPLQSGMVDNFIDRKHGREEISYPDVQWQHESLKPVLEPTYGIILYQEQVMQIAQVLSGYTLGGADMLRRAMGKKKPEEMAKQRSIFEDGAKKNGIDGELAMKIFDLVEKFAGYGFNKSHSAAYALVSYQTLWLKAHYPAEFMAAVMTADMDNTEKVVGLVDECWRMGLKILPPDINSGLYHFHVNDDGEIVYGIGAIKGVGEGPIEAIIEARNNGGYFRELFDLCARTDIKKLNRRVLEKLIMSGAFDRLGPHRAALMNSLGDALKAADQHAKAEAIGQADMFGVLAEEPEQIEQSYASCQPWPEQVVLDGERETLGLYLTGHPINQYLKEIERYVGGVRLKDMHPTERGKVTTAAGLVIAARVMVTKRGNRIGICTLDDRSGRLEVMLFTDALDKYQQLLEKDRILIVSGQVSFDDFSGGLKMTAREVMDIDEAREKYARGLAISLTDRQIDDQLLNRLRQSLEPHRSGTIPVHLYYQRADARARLRFGATWRVSPSDRLLNDLRGLIGSEQVELEFD

SEQ ID NO: 12327 - protein, 587 aa, Klebsiella pneumoniae
KQRQKRLKAKRQEEQANFISWRFALLCGCILLALAFLLGRVAWLQVISPDMLVRQGDMRSLRVQEVSTARGMITDRSGRPLAVSVPVKAIWADPKELHDAGGVTLDTRWKALADALNMPLDQLATRINTNPRMRFIYLARQVNPDMADYIKKLKLPGIHLREESRRYYPSGEVTAHLIGFTNVDSQGIEGVEKSFDKWLTGQPGERIVRKDRYGRVIEDISSTDSQAAHNLALSIDERLQALVYRELNNAVAFNKAESGSAVLVDVNTGEVLAMANSPSYNPNNFAGTAKDTMRNRAITDVFEPGSTVKPMVVMTALQRGIVNENTVLNTVPYRINGHEIKDVARYSELTLTGVLQKSSNVGVSKLALAMPSSALVDTYSRFGLGKATNLGLVGERSGLYPQKQRWSDIERATFSFGYGLMVTPLQLARVYATIGSYGIYRPLSITKVDPPVPGERVFPESLVRTVVHMMESVALPGGGGVKAAIKGYRIAIKTGTAKKVGPDGRYINKYIAYTAGVAPASHPRFALVVVINDPQAGKYYGGAVSAPVFGAIMGGVLRTMNIEPDALATGEKSEFVINQGEGTGGRS

SEQ ID NO: 12328 - protein, 159 aa, Klebsiella pneumoniae
MISLIAALAVDRVIGMENAMPWNLPADLAWFKRNTLNKPVVMGRLTWESIGRPLPGRKNIVISSKPGSDDRVQWVSSVEEAIAACGDVEEIMVIGGGRVYEQFLPKAQKLYLTHIDAEVEGDTHFPDYDPDEWESVFSEFHDADAQNSHSYCFEILERR

SEQ ID NO: 12329 - protein, 151 aa, Klebsiella pneumoniae
NLAHQPDRQPDLQYADPGEQGHRRHRRLRPLLRHSPGRRAEEPRKLRDHDPGIYRPEPGATEPDFPLRPRGGETPDGRDGLPGERLQPGSSVRRIPEAGGQKRPGLRLRSGSAGLYQQAAGRARAFPPGLLQRPIRIQRYRHRLDQTGLRG

SEQ ID NO: 12330 - protein, 1111 aa, Klebsiella pneumoniae
FNKHIRDYRMLRYTCHALFLGSLVLLSGCDNSSSSSTSGSPGSPGNPGNPGTPGTPDPQDVVVRLPDVAVPGEAVQASARQAVIHLVDIAGITSSTPADYATKNLYLWNNETCDALSAPVADWNDVSTTPTGSDKYGPYWVIPLTKESGCINVIVRDGTNKLIDSDLRVSFSDFTDRTVSVIAGNSAVYDSRADAFRAAFGVALADAHWVDKTTLLWPGGENKPIVRLYYSHSSKVAADSNGEFSDKYVKLTPTTVNQQVSMRFPHLASYPAFKLPDDVNVDELLQGETVAIAAESDGILSSATQVQTAGVLDDTYAAAAEALSYGAQLTDSGVTFRVWAPTAQQVELVVYSADKKVVASHPMTRDSASGAWSWQGGSDLKGAFYRYAMTVYHPQSRKVEQYEVTDPYAHSLSTNSEYSQVVDLNDSALKPEGWDGLTMPHAHKTKADLAKMTIHESHIRDLSAWDQTVPAELRGKYLALTAQESNMVQHLKQLSASGVTHIELLPVFDLATVNEFSDKVADIQQPFSRLCEINSAVKSSEFAGYCDSGSTVEEVLTQLKQNDSKDNPQVQALNTLVAQTDSYNWGYDPFHYTVPEGSYATDPEGTARIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMGYHPKAQILSAWERIKALNPDIYFFGEGWDSNQSDRFEIASQINLKGTGIGTFSDRLRDAVRGGGPFDSGDALRQNQGVGSGAGVLPNELTTLSDDQARHLADLTRLGMAGNLADFVLIDKDGAVKRGSEIDYNGAPGGYAADPTEVVNYVSKHDNQTLWDMISYKAAQEADLDTRVRMQAVSLATVMLGQGIAFDQQGSELLRSKSFTRDSYDSGDWFNRVDYSLQDNNYNVGMPRSSDDGSNYDIIARVKDAVATPGETELKQMTAFYQELTALRKSSPLFTLGDGATVMKRVDFRNTGADQQTGLLVMTIDDGMQAGASLDSRVDGIVVAINAAPESRTLQDFAGTSLQLSAIQQAAGDRSLASGVQVAADGSVTLPAWSVAVLELPQGESQGAGLPVSSK

SEQ ID NO: 12331 - protein, 336 aa, Klebsiella pneumoniae
NSEQLISMPETRKVVITPGEPAGIGPDLVVQLAQRDWPVELVICADGALLTDRAKRLGLPLSLLPYDPAQPPVPQRAGTLTLLNVPLNVPAEPGVLNVQNGAYVVETLARACDGCLSGEFAALVTGPVHKGNINDAGIAFTGHTEFFEERAKASKVVMMLATEELRVALVTTHLPLKAISEAITPELLREIITILDHDLRTKFGIAQPHVLVCGLNPHAGEGGHMGTEEIDTIIPVLEEMRAKGMNLSGPLPADTLFQPKYLDHADAVLAMYHDQGLPVLKYQGFGRGVNITLGLPFIRTSVDHGTALELAGQGKADVGSFITALNLAIKMIVNTQ

SEQ ID NO: 12332 - protein, 280 aa, Klebsiella pneumoniae
KHWHAGCSGIGCCPPARKVFNAGIAGRLTGKLVMHTPVLFEHPLNEKMRTWLRIEFLIQQMAFRPQIASHADALHFFRNAGDLLDVLERGEVRTDLVKELERQQRKLQSWAEVPGVDQERINELRHQLKQSSSTLMAAPRIGQFLREDRLIALVRQRLSIPGGCCSFDLPTLHIWLHMPQAHRDEQVASWLASLDPLVQSLSLILDLIRNSALFRKQTSLNGFYQDNGEDADLLRLRLDLAHSFYPQISGHKSRFAIRFLALDSEYGIVPERFDFELACC

SEQ ID NO: 12333 - protein, 182 aa, Klebsiella pneumoniae
RYRQLDPREEIVSQRGFTLLEMMLVLLLIGVSASMVLLAFPSARTQEATQILARFQAQLDFVRERGQQTGQLFGIIIHPERWQFMRLQPADDSAPAAADDRWGNAQWLPLQAGRVTTAETLPRARLTLRFPDGQAWTPGEQPDVLIFPGGEVTPFQLRIDAARGINVDAQGDSQPLAAREQP

SEQ ID NO: 12334 - protein, 579 aa, Klebsiella pneumoniae
AWRQTMEMLSGAEMVVQSLVDQGVKQVFGYPGGAVLDIYDALHTLGGIDHVLVRHEQAAVHMADGLARATGEVGVVLVTSGPGATNAITGIATAYMDSIPLVILSGQVATSLIGYDAFQECDMVGISRPVVKHSFLVKQTEDIPGVLKKAFWLAASGRPGPVVVDLPKDILNPAKKLPYVWPDAVSMRSYNPTTSGHKGQIKRALQTLVAASKPVVYVGGGAINAHCEPQLRELVEKLKLPVASSLMGLGAFPATHSQALGMLGMHGTYEANMTMHHSDVIFAVGVRFDDRTTNNLAKYCPNATVLHIDIDPTSISKTVPADVPIVGDARLVLEQMLELLEQEEAQQPLDDIRDWWQQIEQWRARHCLRYDDQSDKIKPQAVIETIWRLTQGDAYVTSDVGQHQMFAALYYPFDKPRRWINSGGLGTMGFGLPAALGVKMALPDEMVVCVTGDGSIQMNIQELSTALQYELPVLVLNLNNRYLGMVKQWQDMLYSGRHSQSYMESLPDFVRLAEAYGHVGIRISEPQELETKLAEALEQVRQRRLVFVDVTVDGSEHVYPMQIRGGGMDEMWLSKTERT

SEQ ID NO: 12335 - protein, 344 aa, Klebsiella pneumoniae
LMIKLSNITKVFLQGNRSIQALNNVSLHVPAGQIYGVIGASGAGKSTLIRCVNLLERPTEGSVQVDGQELTALSEKELTRARRQIGMIFQHFNLLASRTVFGNVALPLELDNTPQAEIKRRVTELLDLVGLGDKHDSYPANLSGGQKQRVAIARALASNPKVLLCDEATSALDPATTRSILELLKDINRRLGLTILLITHEMDVVKRICDCVAVISNGQLIEQDTVSEVFSHPKTPLAQQFIQSTLHLDIPDDYQARLKPTATADSVPMLRMEFTGHSVDAPLLSETARRFNVNNNIISAQMDYAGGVKFGIMLTEMHGTQEDTQAAIAWLQEHHVKVEVLGYV

SEQ ID NO: 12336 - protein, 167 aa, Klebsiella pneumoniae
KTNKISLFIYCKIKSTLLESGKNIPTSWTEIVNISLTLRVIPLAALLVAGCSNTSSRQPVKPIATPLTSQQQAEQERAASEQARIESCRQALDSLKEVNPQQATKLSNDFNALVRAASQYNSVREKVADPTRLGIDSMYQFKSIKLCADIQKTLIDSLVQRGESKQP

SEQ ID NO: 12337 - protein, 289 aa, Klebsiella pneumoniae
LTNNVIGRQHSFLQEGNNMAFNFKTFAAVGALIGSLALVGCGQDEKDPNHIKVGVIVGAEQQVAEVAQKVAKEKYGLDVELVTFNDYVLPNEALSKGDIDVNAFQHKPYLDQQIKDRGYKLVAVGNTFVYPIAGYSKKIKSLDELQPGSQIAVPNDPTNLGRSLLLLQQVGLIKLKDGVGLLPTSLDIVENPKNLKIVELEAPQLPRSLDDAQIALAVINTTYASQIGLTPAKDGIFVEGKESPYVNLIVAREDNKDAENVKKFVQAYQSDEVYEAANKIFNGGAVKGW

SEQ ID NO: 12338 - protein, 395 aa, Klebsiella pneumoniae
YANKVSGYSLEDVLIKSALLVLEDGTQFHGRAIGATGTAVGEVVFNTSMTGYQEILTDPSYSRQIVTLTYPHIGNVGTNAADEESSQVHAQGLVIRDLPLIASNFRSTEDLSSYLKRHNIVAIADIDTRKLTRLLREKGAQNGCIIAGDSPDAQLALEKAKAFPGLNGMDLAKEVTTAETYSWTQGSWTLAGDLPEAKAESELPFHVVAYDFGAKRNILRMLVDRGCRLTVVPAKTSAADVLALNPDGIFLSNGPGDPAPCDYAIEAIEKFLETDIPVFGICLGHQLLALASGAKTIKMKFGHHGGNHPVKDIDNNVVMITAQNHGFAVDEATLPANLRVTHKSLFDGTLQGIHRTDKPAFSFQGHPEASPGPHDAAPLFDHFIELIELYRQSAK

SEQ ID NO: 12339 - protein, 178 aa, Klebsiella pneumoniae
NPDKNPGTRFPGSFSPPRLRPSIPSQCSCHNKERLMDKQRGFTLIELMVVIGIIAILSAIGIPAYQNYLRKAALTDLLQTFVPYRTAIELCALDHGGLTPCDGGSNGIPSPTTTRYLSAMSVAKGVVTLTGQESLNGLGVTLTPTWDNAEGVTGWQRVCTITGNSALQQACEDVFRVK

SEQ ID NO: 12340 - protein, 342 aa, Klebsiella pneumoniae
GSLKILCHPFFLRCKVLKKLLPLLALVAMPALAKPVLTVYTYDSFSADWGPGPAVKKAFEAECGCELKFVALEDGVSLLNRLRMEGKNSKADVVLGLDNNLLEAAAQSKLFAKSNVPASAVSVPGGWDNDTFVPYDYGYFAFVYDKNKLANPPKSLKELVEGPQKWRVIYEDPRTSTPGLGLLLWMQKVYGDQAPEAWQKLAAKTVTVTKGWSEAYGLFLKGESDLVLSYTTSPAYHMIEEKKDNYAAASFAEGHYLQVEVAARTAASKQPELAEKFLKFMVSPGFQNAIPTGNWMYPVTKVTLPAGFDTLVKPQTTLSFTPQQVASERQTWISAWQRAVSR

SEQ ID NO: 12341 - protein, 134 aa, Klebsiella pneumoniae
QSANEGELTMIHSPRVCVQVQSVYIESQSSPEEERYVFAYTVTIRNLGRSQVQLLGRYWLITNGHGRETEVQGEGVVGEQPHIPAGGEYQYTSGAVIETPLGTMQGHYEMIDIDGAPFRIEIPVFRLAVPTLIH

SEQ ID NO: 12342 - protein, 195 aa, Klebsiella pneumoniae
RHDNINWENNDTTGSLVWAGDTYWRIADEWGLRGGIQYDTRLDNVATGNGTIEYRRDENRLVQLNYRYASPEYIQATLPSYSTAAQYKQGISQVGMTASWPIVDRWSVVGAYYYDTNTRKAANQMLGVQYNSCCYAIRLGYERKVNGWNSNDNGGESKYDNTFGINIELRGLSSNYGLGTQQMLRSNILPYQSSL

SEQ ID NO: 12343 - protein, 346 aa, Klebsiella pneumoniae
WLCLALLTQGAIVKLDEIARLAGVSRTTASYVINGKAKQYRVSDKTVEKVMAVVREHNYHPNAVAAGLRAGRTRSIGLVIPDLENTSYTRIANYLERQARQRGYQLLIACSEDQPDNEMRCIEHLLQRQVDAIIVSTSLPPEHPFYQRWANDPFPIVALDRALDREHFTSVVGADQDDAEMLAAELRTFPGETVLYLGALPELSVSFLREQGFRKAWQDDPREVHYLYANSYEREAAAQLFEKWLETHPMPQALFTTSFPLLQGVMDVTLRREGKLPSELAIATFGDNELLDFLQCPVLAVAQRHRDVAERVLEIVLASLDEPRKPKPGLSRIRRNLYRRGSLNRR

SEQ ID NO: 12344 - protein, 435 aa, Klebsiella pneumoniae
CCGKARARSKSGRANRCRLITSRAFCSKRRMMKNKYIPTAAGLYLNYLIHGMGVLLITLNMAHLQEQWGTDKAGVSIVISSLGIGKLATIVTGFLSDRFGRKPFIYLGILSYLIFFVGILLTKNIYLAYVFGIMAGLANSFLDSGTYPALMESFPHSASRANVLIKAFVSAGQFLLPFIISFLIWANLWFGWSFVIAAALFVLSGIYLLKMPFPDSQAAKKEEAPTAQAETAVRPQANKLDMVIFTLYGYIGMATFYLVSQWLAQYGQFVVGLPYASAIKLLSIYTVGSLVCVFVTAAFVKEVFSSAIAMIIYTGLSMISLLLVCLFPTPMMVTGFAFVIGFAAAGGVLQLGATIMAMSFPNGKGKATGIFYTAGSIASFTIPLITAKLSQISIASIMWFDFLIAVIGFVIALYIGYRQLQARAAQKVSRTAVTA

SEQ ID NO: 12345 - protein, 594 aa, Klebsiella pneumoniae
SRKKRRRSAMADKIAVLFGGTSAEREVSLNSGAAVLAGLREGGVDAHPVDPRDVDITQLKKQGFKKAFIALHGRGGEDGTLQGLLELIQLPYTGSGVMASAISMDKLRSKWLWQGAGLPVAPWVALTRAQFAAGLSTDVEQQIAALGLPVIIKPSREGSSVGMSKVSESCDLASALALAFQHDDEVLVEKWLSGPEFTVAIVGEEILPSIRIQAAGTFYDYEAKYLSDETQYFCPGFEDPARESAIQNLVLKAWNVLGCKGWGRIDVMLDSDGQFYLLEANTSPGMTSHSLVPMAGVSGQGLSFFPSLLYEFWTWRGDMSQAALNTRNHEEEASSSRRSNGTRLAGIVFLLAVLFTVLVSGWMVLGWMEDAQRLPLSKMVVTGERHYTRNDDIRQAILALGSPGTFMTQDVNIIQSQIERLPWIKQASVRKQWPDELKIHLVEYVPIARWNDQHMVDAEGNAFSVPADRTSKQNLPMLYGPEGSENEVLQGYRDMGQVLAKDKFTLKVAAMTARRSWQLTLNNDIKLNLGRGDTMKRLQRFMELYPVLQQQAQTDGKRISYVDLRYDSGAAVGWVPAPAEETNQQQNQAQAEQQ

SEQ ID NO: 12346 - protein, 372 aa, Klebsiella pneumoniae
RKRKRLATRWWCVRLMCSAAGRWRSSMTSRICAATSRPRSASPTTRRCCWIASSTMRLKWMSMPICDGEMVLIGGIMEHIEQAGVHSGDSACSLPAYTLSKEIQDVMREQVQKLAFELQVRGLMNVQFAVKDNEVYLIEVNPRAARTVPFVSKATGVPLAKVAARVMAGKTLAQQGVTKEIIPPYYSVKEVVLPFNKFPGVDPLLGPEMRSTGEVMGVGRTFAEAFAKAQLGSNSTMKKQGRALLSVREGDKERVVDLAAKLLKFGFELDATHGTAIVLGEAGINPRLVNKVHEGRPHIQDRIKNGEYTYIINTTAGRQAIEDSKLIRRSALQYKVHYDTTLNGGFATAMALNADATEKVISVQEMHAQITK

SEQ ID NO: 12347 - protein, 78 aa, Klebsiella pneumoniae
GAGNGAYRLDAAGPAVSTGVIPAHLPQPAVSGLCAGDYRQADERRARRTAGLSQTPAPAAGGVSAQRTAARARRPACR

SEQ ID NO: 12348 - protein, 266 aa, Klebsiella pneumoniae
TKLKKLKLHGFNNLTKSLSFCIYDICYAKTAEERDGYIAYIDELYNANRLTEILTETCSIIGANILNIARQDYEPQGASVTILVSEEPVDPKLIDQTEHPGPLPETVVAHLDKSHICVHTYPESHPEGGLCTFRADIEVSTCGVISPLKALNYLIHQLESDIVTIDYRVRGFTRDINGMKHFIDHEINSIQNFMSDDMKSLYDMVDVNVYQENIFHTKMLLKEFDLKHYMFHTRPEELTAEERKVITDLLWKEMREIYYGRNIPAV

SEQ ID NO: 12349 - protein, 361 aa, Klebsiella pneumoniae
KKLKTKTSATANPAAWRSAFAVWKRVPQRICALNAKPWRKFAKNRWRVIPWCFTFWRESLPPGSVVRTMTDSRYIGVNAPSPSGELHFGSLIAALGSYLQARANQGIWRVRIEDIDPPREVPGAADTILRQLDHYGLHWDGDVLWQSQRHEAYREALTWLGEQGLSYYCTCTRARIHAVGGIYDGHCRDLGLGAENAALRLRQTRPVLQFSDRLRGTLIANEPLAREDFIIHRRDGLFAYNLAVVVDDHFQGITEIVRGADLIEPTVRQISLYQHFGWQAPDYLHLPLALNGDGNKLSKQNHAPALPEGDPRPEIVRALRFLNQAIPEEWQALGIDDLLVQAVANWQPAKIEHSQMAPAEL

SEQ ID NO: 12350 - protein, 289 aa, Klebsiella pneumoniae
KRLKIALPPLVALLVRGDHELNEVKAEKLPQVASPLTFATEEEIRALVNAGPGSLGPVNMPVPVIIDRTVAVMSDFAAGANIDGKHYFGINWDRDVATPEVADIRNVVAGDPSPDGKGTLLIKRGIEVGHIFQLGTKYSEAMKAAVQGEDGRNQILTMGCYGIGVTRVVAAAIEQNFDDRGIVWPDAIAPFQVAILPMNMHKSYRVQELAEKLYAELSAQGIEVLMDDRKERPGVMFADMELIGIPHTIVLGDRNLDNDDIEYKYRRNGEKQLIKTGDIVEYLVKAIKG

SEQ ID NO: 12351 - protein, 275 aa, Klebsiella pneumoniae
YPMNNRVHQGHLARKRFGQNFLNDQFVIDSIVSAINPQKGQAMVEIGPGLAALTEPVGERLDQLTVIELDRDLAARLQTHPFLGPKLTIYQQDAMTMNFGELAEKMGQPLRVFGNLPYNISTPLMFHLFSYTDAIADMHFMLQKEVVNRLVAGPNSKAYGRLSVMAQYYCQVIPVLEVPPSAFTPPPKVDSAVVRLVPHSTMPYPVKEIRVLSRITTEAFNQRRKTIRNSLGNLFSVEVLTELGIDPAMRAENISVAQYCLMANWLSDNLPTKES

SEQ ID NO: 12352 - protein, 536 aa, Klebsiella pneumoniae
KDVNMQRRDFLKLTAAVGMASALPLWSRAVFAASRPALPIPSLLAADARNRIALRIQAGKTRFGALNATTWGYNGSLLGPALQLTQGKTVTVDITNQLAEETTLHWHGLEVPGEVDGGPQGVIAPGATRTVSFTPTQRAATCWFHPHQHGSTGRQVAMGLAGLVLIEDEESGRLLLPKQWGIDDVPVIVQDKKFTAAGEIDYQLDVMSAAVGWFGDTLLTNGALYPEHAAPRGWLRLRLLNGCNARSLNFATSDKRPLYVVASDGGLLAEPVKVDELPVLMGERFEVLVDTSDGKPFDLVTLPVSQMGMAIAPFDKPQPVLRVQPLVIPASGKLLDTLAALPALPSLTGLTQRQLQLSMDPMLDRMGMQALMEKYGDQAMAGMDHGMMGHGDMSDMGNMHHGDMSMNHGSGMEHGMSSGKGFDFHNANRINGKAFDMNEPMFAAARGQYERWVISGKGDMMLHPFHIHGTQFRILSENGKPPAAHRRGWKDTVRVEGDVSEVLVKFDHPAPKEFAYMAHCHLLEHEDTGMMLGFTV

SEQ ID NO: 12353 - protein, 129 aa, Klebsiella pneumoniae
RIALAEEKTMDYEFLRDITGVVKVRMSMDHEAIGHWFNEEVKGNLALLDEVEQAARTVKGSERSWQRAGHEYTLWLDGEEVMIRANQLEFSGDEIEEGMSYYDEESLSLCGVEDFLQVVAAYREFMQQR

SEQ ID NO: 12354 - protein, 414 aa, Klebsiella pneumoniae
PASKRWCGCWGSPMATKRLWRWRGIDVQGAPCQGMLWQTKRLEVLQHLQQQRVIPLAVRRCAVKQSLWHPRYSCETIRQLASLLQAGLPLAEGLSLLAQQQSHAQWQALLEALGRELAQGVAFSAALAQWPQAFPPLYLAMISTGELTGKLDICCLQLANQQQEQQRLASKVKKALRYPLIVLSLALLVVLGMLYFVLPEFTAIYQTFSTPLPLLTRMVVAAGDMLSRGWPLLLALLLSPLLLNQLIRRRSDWLLRRQRLLNALPLIGSLIGGQQLSLIFTILALTQSAGISFLQGLQSVEKSLSCPLWRQRLAQARALIVQGEPIWQALSRCGGFTPLCLQLIRTGESAGALDQMLENLAHHHRQQTYQRADSLAAHLEPMMLVITGSLVGILVVAMYLPVFHLGDAIGGAGG

SEQ ID NO: 12355 - protein, 106 aa, Klebsiella pneumoniae
RPPKAPTPHRSPTAYAALPDCACGKRPAPCAQCCRQAVPSVLHDPAPSRRQGSPCRQRISPAARATSAPAAAPPARLQFPESRSRRLPAQSDAPENSRPSPAAPTG

SEQ ID NO: 12356 - protein, 223 aa, Klebsiella pneumoniae
RNANMAMENYNPPQDPWLVILYQDEHIMVVNKPSGLLSVPGRLEEHKDSVMTRIQRDFPQAESVHRLDMATSGVIVVALNKAAERELKRQFREREPKKQYVARVWGHPQPAEGLVDLPLICDWPNRPKQKVCYETGKAAQTEYEVLEYAEDNTARVRLKPITGRSHQLRVHMLALGHPILGDRFYATPEALAMAPRLLLHAETLTITHPAYGNAMTFRAPIDF

SEQ ID NO: 12357 - protein, 1003 aa, Klebsiella pneumoniae
YSALSIPGPNFDASPIVHGDDQLLPAIKELKSRTYMPFTLGQRWISDTESELGLGTVVALDARMVTLLFPAIGENRLYSRNDSPITRVMFNPGDTITSHEGWQLHVDKVNEENGLLSYTGTRLDTQETNVTLREVLLDSKLVFSKPQDRLFAGQIDRMDRFALRYRARKFQSEQYRMPWSGLRGQRTSLIPHQLHIAHDVGRRHAPRVLLADEVGLGKTIEAGMILHQQLLSGAAERVLIVVPETLQHQWLVEMLRRFNLRFSLFDDERYAEAQHDAYNPFETEQLVICSLDFVRRSKQRLEHLCDAEWDLMVVDEAHHLVWSEEAPSREYQAIEQLAERVPGILLLTATPEQLGMESHFARLRLLDPNRFHDFEQFVEEQQNYRPVADAVALLLAGNKLSDSELNTLGDLIGEQDIEPLLQAANSDREDAQAARQELISMLMDRHGTSRVLFRNTRNGVKGFPKRELHTIRLPLPTQYQTAIKVSGIMGARKTAEERARDMLYPEQIYQEFEGDTGTWWNFDPRVEWLMGYLTSHRSQKVLVICAKAATALQLEQVLREREGIRAAVFHEGMSIIERDRAAAWFAEEDTGAQVLLCSEIGSEGRNFQFASNLVMFDLPFNPDLLEQRIGRLDRIGQAHDIQIHVPYLEKTAQSVLVRWYHEGLDAFEHTCPTGRTVYDSVHDELINYLAAPESTDGFDDLIKSCRQQHDALKAQLEQGRDRLLEIHSNGGEKAQALAESIEEQDDDTSLIAFSMNLFDIVGINQDDRGENLIVLTPSDHMLVPDFPGLPEDGCTITFERDVALSREDAQFITWEHPLIRNGLDLILSGDTGSSTISLLKNKALPVGTLLLELIYVVEAQAPKQLQLNRFLPATPVRMLLDKNGNNLAAQVEFESFNRQLSAVNRHTGSKLVNAVQQDVHAILQQGEAQIAKAAQGLIDAARNEADEKLTAELSRLEALKAVNPNIRDDELAAIESNRQQVMDALAQAGWRLDALRLIVVTHQ

SEQ ID NO: 12358 - protein, 159 aa, Klebsiella pneumoniae
GYQKKAGRQAGFFDYITKRRMSLRVLLMMVMKRAPSAPSMTRWSKDREIGSIRRGTNSLPFHTGSIADLDTPRMATSGALTIGAKWVVPRPPMLEMVKQPPCISPAVSLPSRAFFEMVVNSRDSSVMLFLFTSLKTGTTRPFGVSTATPMLMYFFSVRR

SEQ ID NO: 12359 - protein, 71 aa, Klebsiella pneumoniae
DVQKSGNRIKSKTPPASPYAATIGDKAAALGLQLSAKGYKASGRNAIPRIERTVFCTAFQILLRPEPVWPE

SEQ ID NO: 12360 - protein, 164 aa, Klebsiella pneumoniae
RWRKTMANLLIWWRQRTPSEQRLLLGLTGLLAACAFWYGLWQPWRAREAQWRQTLVKEQASLRWMTEQAPRLQQLSQQPAPAAKEALTALVMREAASHGLTVIRLQPQGKTSADHPSALRFPGADRLAGRSGDARRQRDLAVRDRAAVATRLGHGQPSAAGARR

SEQ ID NO: 12361 - protein, 490 aa, Klebsiella pneumoniae
RALDSRTWWYSRSYRQPDGGGTGLRLSATVGLQDDLTEGYMLSVLWNLAAFIIALGVLITVHEFGHFWVARRCGIRVERFSIGFGKALWRRMDKQGTEFVIALIPLGGYVKMLDERVEAVAPEMRHYAFNNKTVGQRAAVIAAGPIANFIFAIFAYWLVFIIGVPGVRPVVGEITPNSVAAQAQIAKGTELKAIDGIETPDWDAVRLQLVAKIGNPQTIVTVAPFGTNQRQDKIVDLRHWSFEPDKQDPVTSLGIQPRSAQIDTVLAEVQAGSAAQKAGLQAGDRIVKVDGQPLTQWMTFVNLVRDNPGKALALEIERQGSALPLTLTPDAKTVKGKAEGFAGVVPKVIPLPEEYKTVRQYGPFAAIAEATDKTWQLMSLTVRMLGKLITGDVKLNNLSGPISIAQGAGMSAEFGLIYYLMFLALISVNLGIINLFPLPVLDGGHLLFLAIEKLKGGPVSERVQDFSYRIGSILLVLLMGLALFNDFSRL

SEQ ID NO: 12362 - protein, 263 aa, Klebsiella pneumoniae
YVIDKTAFVHPTAIVEEGAVIGANVHIGPFCIVGANVEIGEGTVLKSHVVVNGHTKIGRDNEIYQFASIGEVNQDLKYAGEPTRVEIGDRNRIRESVTIHRGTVQGGGLTKVGNDNLLMINAHVAHDCTLGDRCILANNATLAGHVSLDDYVIIGGMTAVHQFCVIGSHVMVGGCSGVAQDVPPFVIAQGNHATPFGVNIEGLKRRGFSREAITAIRNAYKLLYRSGKTLEEAKPEIAELAAQHPEVQPFVDFFARSTRGLIR

SEQ ID NO: 12363 - protein, 174 aa, Klebsiella pneumoniae
NVVEQNGEDLIMRRILSVLLENESGALSRVIGLFSQRGYNIESLTVAPTDDPTLSRMTIQTVGDEKAIEQIEKQLHKLVDVLRVSELGQGAHVEREIMLVKVQASGYGREEVKRNTEIFRGQIIDVTPSIYTVQLAGTSDKLDAFLASLRDVARIVEVARSGVVGLSRGDKIMR

SEQ ID NO: 12364 - protein, 497 aa, Klebsiella pneumoniae
NDSDSHVHSNFRYLILRLKLMKKTTLAMSALALSLGLALSPLSASAAETASSATNAQQMPSLAPMLEKVMPSVVSINVEGSTTVNTPRMPRNFQQFFGDNSPFCQDGSPFQSSPFCQGGGQGGQPDGGQQQKFMALGSGVIIDAAKGYVVTNNHVVDNATTIKVQLSDGRKFDAKVVGKDPRSDIALIQIQDPKNLTAIKLADSDALRVGDYTVAIGNPFGLGETVTSGIVSALGRSGLNVENYENFIQTDAAINRGNSGGALVNLNGELIGINTAILAPDGGNIGIGFAIPSNMVKNLTEQMVKYGQVKRGELGIMGTELNSELAKAMKVDAQRGAFVSQVMPGSAAAKAGIKAGDVITSLNGKAISSFAALRAQVGTMPIGSKVELGLLRDGKPVTVTVELQQSNQTQVDSSTIFNGIEGAEMSNKGQDKGVVVNNVKAGTPAAQIGLKKGDVIVGANQQPVKNIADLRKIFDAKPSVLALNIQRGDASIYLLLQ

SEQ ID NO: 12365 - protein, 316 aa, Klebsiella pneumoniae
SPSDTTRCTIFTRVANFCRKVLSREEREAEAAVEPTPMTVIPREQHAISRKDISENALKVMYRLNKAGYESWLVGGGVRDLLLGKKPKDFDVTTNATPDQVRKLFRNCRLVGRRFRLAHVMFGPEIIEVATFRGHHEGHTTDRVTSQRGQNGMLLRDNIFGSIEEDAQRRDFTINSLYYSVADFTVRDYVGGMKDLQDGVIRLIGNPETRYREDPVRMLRAVRFAAKLNMTISPETAEPLPRLAALLHDVPPAPLFKKVLKLLQARVWYQTYLLLAGIQPVPAAVPDHHPLLYRARRQPDGADHQPGAEEYRYPHS

SEQ ID NO: 12366 - protein, 147 aa, Klebsiella pneumoniae
AIHDGPARRRRPASRPCRSPAGSAPPDRGGGRCDRRRPTPAAPPLARHRAGRRGGPGVSSAAALAAASWPADGKRRPPNPPVRRAAAPRGSPPALPLSPPRHRSARRPASPPAAARCQALPFCGQTPTAARRPAPTAPPAGDARRPD

SEQ ID NO: 12367 - protein, 67 aa, Klebsiella pneumoniae
ACREGPAPTGIAVRYTVCFNQANQMVKNNTPAGEGIGAFFSIHQVNLYDCSVKKVKIAVLRGPDSRV

SEQ ID NO: 12368 - protein, 124 aa, Klebsiella pneumoniae
SVGDLMVEKMKTLFRTMVLGSLLALSANSYALSESEAEDMADLTAVFVFLKNDCGYQNLPNTQIRRALVFFAQQNQWDLSNYDSYNMKALGEDSYRDLSGINIPTAKKCKALARDSLSLLAYVK

SEQ ID NO: 12369 - protein, 92 aa, Klebsiella pneumoniae
NNIETGRCAGGVALCTSPLISRLPLAGGRNPAIRFSRVLFPAPLGPSTAMRSPRATSRVKRIGRCWYSQVTSLSFSITPRKFFNQRKQQETE

SEQ ID NO: 12370 - protein, 87 aa, Klebsiella pneumoniae
TGIDAAVSARRRRDPARSGTTDGARGGGCHSLPAVWRVALKRTAQSDPPGAGREAQSGAGHQYCRDQFDHRGDPPGGRQRPGAGRPL

SEQ ID NO: 12371 - protein, 558 aa, Klebsiella pneumoniae
QGADRQRLVLQQGNGAAAGIAGKDQVQTVAYQRVFPGNKLRIFTRQRHVTFEGDGATVFRQAREIRHQHMVGRGEDDQVFAAVVLVDADDIEQVHRESDQAGVVILLFDALRQGLGFLAAVGVDLQQTVAALLQLRLQGIMLLAAGFDQIVKAVGGFRRRKIVDQFIVNAVVNGATGRAGMFEGVEPFVIPAHQHRLRGFFQVRNVDLDIVRLADTVETTDTLLQQIRVKRQVEHHQVAGELEVASFGADLGAQQHLGAGVFFSKPRRGAVAFDNRHPFMEHRGADAFALAQHLFQLQGGGGLSADYQHLLRAMAGQVTHQPLDARVEVPPGTGITFKFLIDLLRIEHVARALFRGFARAHNAGHFDGRLVLGRQRQTNGVQLAFRETFDAVTGITEQHAAGAVAVHQHRDQLLARGLGIFAIAVGGLQQRLDILLADQIAQGIEFAIAQLVARQQQRDGVGHRTVVLLFFDKLFKIVEAVRIQQTQARKMALHSQLFRRRGQQQDTRHALSQLFNSLIFTARRLFAPHQVVRFVDHHQVPLGVAQVLQALLAATHEV

SEQ ID NO: 12372 - protein, 784 aa, Klebsiella pneumoniae
PSHEQDFYSPVTGGTLRRAPSSPSGWPPTTVRCRSPSRRRSPSPLFPKRSGRRLNGCCRGEKGLRFAPLALKDFHRQPIVGLYCRAHRQLMRLEKMLRDSGVTVYEGDIRPPERYLMERFITAPVWVEGETRGSQLVNARMKPNPDYRPPLKWVSLDIETSRHGELYCIGLEGCGQRVVYMLGPEPETPPDVDFELVFIASRPLLLEKLNAWFAEHDPDVLIGWNVVQFDLRVLQKHAERYRIPLRLGRGNSELEWREHGFKNGVFFAQANGRLIIDGIDALKSAFWNFSSFSLEAVARELLGEGKAIDNPWDRMDEIERRFHEDKPALAIYNLQDCELVTRIFHKTEIMPFLLERATVNGLPADRHGGSVAAFSHLYFPRMHRLGYVAPNLGDVPPQASPGGYVMDSRPGLYDSVLVLDYKSLYPSIIRTFLIDPVGLVEGLAQPDDQHSIEGFLGARFSRDKHCLPGIVSQIWHGRDEAKRQHNKPLSQALKIIMNAFYGVLGTSACRFFDPRLASSITMRGHAIMRQTKALIEAKGYDVIYGDTDSTFVWLKRPHSEAQAAEIGRELVSDVNAWWAQELSKSQLTSALELEYETHFCRFLMPTIRGADTGSKKRYAGMIQEGDAQRMVFKGLETVRTDWTPLAQQFQQELYLRIFRNQPYQDYVRETIARLMNGELDEQLVYRKRLRRPLAEYQRNVPPHVRAARLADEHNLKLGRAQQYQQRGTIKYVWTTSGPEPVDYQQSPLDYDHYLTKQLQPVAEGILPFVNDDFATIVTGQLGLF

SEQ ID NO: 12373 - protein, 547 aa, Klebsiella pneumoniae
NPRLGAGFFMLVNKAPGHRLRIQTMSQQVIIFDTTLRDGEQALQASLSVKEKLQIALALERMGVDVMEVGFPVSSPGDFESVQTIARTIKNSRVCALARCVEKDIDVAAESLKVAEAFRIHTFIATSPMHIATKLRSTLDEVIERAIYMVKRARNYTDDVEFSCEDAGRTPIADLARVVEAAINAGATTINIPDTVGYTMPFEYANIISGLYDRVPNIDKAIISVHTHDDLGIAVGNALAAVHAGARQVEGAMNGIGERAGNCALEEVIMAIKVRKDIMNVHTNINHHEIWRTSQTVSQICNMPIPANKAIVGTGAFAHSSGIHQDGVLKNRENYEIMTPESIGLNQVQLNLTSRSGRAAVKHRMEEMGYQESDYNLDHLYDAFLKLADKKGQVFDYDLEALAFINKQQEEPEHFRLDYFNVQSGSSDIATASIKLVCGDEIKTEAANGNGPVDAIYQAINRVTDYNIELVKYGLSAKGHGKDALGQVDIVVDYNGRRFHGVGLATDIVESSAKAMVHVLNNIWRAAEVEKELQRKAQNKENNKETV

SEQ ID NO: 12374 - protein, 273 aa, Klebsiella pneumoniae
RRRDGFGESGLRFLTGYIMQALLEHFITQSTVYSLLAVMLVAFLESLALVGLILPGTVMMAGLGALIGGGEVNFWQAWLAGIVGCLLGDWISFWLGWRFKKPLHRWSFMKKNRALLEKTEHALHQHSMITILIGRFVGPTRPLVPMVAGMLDLPVAKFVLPNIIGCLLWPPLYFLPGILAGAAIDIPADENSASFKWLLLGAALLAWLAGWLCWRLWRSAKTSGDRLTRWLPRGRLLWLSPLMVALAATALTFVFRHPLMPVYLAILHKVIAR

SEQ ID NO: 12375 - protein, 230 aa, Klebsiella pneumoniae
PISDITVRTSAKSTFIRPGRVISSAIPCTAPFRTSFAAPNASSREIPRPRTFSSLSFGMVISESTCLDSWVIPCSANAMRFLPSKLNGLVTTATVRIPRSFATSATTGAAPVPVPPPMPAAMNTMSAPSRAARSASRSSSAALRPTSGFAPAPRPLVIPLPIWIVWPTAVLRSACASVFTAKNSTPSMRSRTMCSTALPPPPPTPMTLITASLVSSIGSNIVSLRLVPVA

SEQ ID NO: 12376 - protein, 478 aa, Klebsiella pneumoniae
RLPDRRQPPSGLFRPRDRRASAGSGSMIRFTLSQLAAIAHGEWQGSDVAIDEVTTDTRKVTAGCLFVALKGERFDAHDFAEQAKAAGAGALLVSRPLACDLPQVIVNDTRQAFGELAAWVRQQVPTRVVALTGSSGKTSVKEMTAAILSQCGNTLYTAGNLNNDIGVPMTLLRLTKEHQYAVIELGANHQGEIAWTVSLTRPEAALVNNLAAAHLEGFGSLAGVAKAKGEIYTGLPENGIAILNADNNDWLNWQAVIGDRKVWRFSPNAANSDFTATNVQITSHGTEFTLQTPTGNVDVLLPLPGRHNIANALAATSLAMAVGADLAAVKAGLAQLQAVPGRLFPIRLTESQLLLDDSYNANVGSMTAAVQVLSEMPGFRTMVVGDMAELGAESAACHREVGEAAKAAGLDCVLSVGALSADISRASGVGEHFNDKAAVVARLRELLAEHKIMTILVKGSRSAAMEEVVRALQETGTC

SEQ ID NO: 12377 - protein, 88 aa, Klebsiella pneumoniae
SSPDIGAEKPGATAPARQRTPRPGPARGPAPQAAPATGHATAAAPAAITLPPAAGRPAAGTPAGGSFRNCSAGARGSASPHSGVRPAV

SEQ ID NO: 12378 - protein, 213 aa, Klebsiella pneumoniae
STTESGTGRTTMIKATDRKLVVGLEIGTAKVAALVGEVLPDGMINIIGVGSCPSRGMDKGGVNDLESVVKCVQRAIDQAELMADCQISSVYLALSGKHISCQNEIGMVPISEEEVTQDDVENVVHTAKSVRVRDEHRVLHVIPQEYAIDYQEGIKNPVGLSGVRMQAKVHLITCHNDMAKNIVKAVERCGLKVDQLIFAGLAAQLFGINRRRT

SEQ ID NO: 12379 - protein, 325 aa, Klebsiella pneumoniae
ICQEFPCRSGRHPRRGAAVYCRSRIRSLSGRRTQFPLRSLVVLIIESVLLLRQHIRRLRQEGKRIALVPTMGNLHDGHMKLVDEAKASADVVVVSIFVNPMQFDRVDDLARYPRTLQDDCEKLNKRHVDFVFAPTPAEVYPQGTEGQTYVDVPGLSTMLEGASRPGHFRGVSTIVSKLFNLVQPDVACFGEKDFQQLALIRKMVADMGYDIEIIGVPIVRAKDGLALSSRNGYLTADQRKIAPGLYKVLSAVAEKLAAGDRQLDEIIAIAEQELNEKGFRADDIQIRDADTLLELTDASQRAVILMAAWLGQARLIDNRIVTLAQ

SEQ ID NO: 12380 - protein, 139 aa, Klebsiella pneumoniae
SAADAGQATAAPAPAAPAPRRSPASWPRRTSPAYAPPALAGSPHGIGSPGGCRSARYSASAARDPAFGAAAMAASPVAPDADPAPSAPAGNERRSSAAAAMSPARPAAKRHPLRAMPLPAATAPHSAAAGAAAQPLASS

SEQ ID NO: 12381 - protein, 284 aa, Klebsiella pneumoniae
RIFFSEWKETMQQLQNVIESAFERRADITPANVDTVTREAVNQVIALLDSGALRVAEKIDGQWVTHQWLKKAVLLSFRINDNQVIDGAESRYFDKVPMKFADYDEARFQKEGFRVVPPAAVRQGAFIARNTVLMPSYVNIGAYVDEGTMVDTWATVGSCAQIGKNVHLSGGVGIGGVLEPLQANPTIIEDNCFIGARSEVVEGVIVEEGSVISMGVYLGQSTKIYDRETGEVFYGRVPAGSVVVSGNLPSKDGKYSLYCAVIVKKVDAKTRGKVGINELLRTID

SEQ ID NO: 12382 - protein, 247 aa, Klebsiella pneumoniae
QSQERNMATNAKPVYKRILLKLSGEALQGSEGFGIDASILDRMAQEIKELVELGIQVGVVIGGGNLFRGAGLAKAGMNRVVGDHMGMLATVMNGLAMRDALHRAYVNARLMSAIPLNGVCDNYSWAEAISLLRNNRVVILSAGTGNPFFTTDSAACLRGIEIEADVVLKATKVDGVFTADPAKDPSATMYDQLTYSEVLEKELKVMDLAAFTLARDHKLPIRVFNMNKPGALRRVVMGEKEGTLITE

SEQ ID NO: 12383 - protein, 322 aa, Klebsiella pneumoniae
TRKESLMNNWPNPFIEQRADPFILRHLSYYYFIASVPEYDRLEIRRAVTLEGLRDAEPVVVWRAPQSGPMSQLIWAPELHEIDGKWYIYFAATHTHDLDALGMFQHRMFVLECADSDPLTGRWQEKGQVVTPFDTFALDATTFTHQGKRWYLWAQKSPHIEGNSNLYLAEMANPWTLKGEPVMLSKPEFDWECRGFKVNEGPAVLMHGDKLFISYSASATDENYCMGLLWIDRQADPLQPANWHKAPQPVFRTSYENRQYGPGHNSFTQTPEGEDVLVYHARNYTEIEGDPLYDPNRHTRLKLVSWREDGMPDFGIPPADTL

SEQ ID NO: 12384 - protein, 442 aa, Klebsiella pneumoniae
TLKELAMSMSNSQEVLTSTSGAKKRSRVRIVILLLLSVGTMINYLDRTILGIVAPQLSKEIHIDPAMMGIIFSAFAWTYALAQIPGGMFLDRFGNKLTYALSIFFWSLFTLLQSFTLGLKSLLLLRLGLGVSEAPCFPANSRIVSTWFPQHERARATATYTVGEYIGLAAFSPLLFLILEHHGWRTLFFLTGGLGILFTLVWWRFYHEPHESRTANQAELEYIGENSINNKIQNVPFNWRDARRLLGCRQILGASLGQFAGNTTLVFFLTWFPSYLANERHLPWLHVGFFATWPFLAAAIGILFGGWISDRLLKRTGSVNISRKLPIISGLLLSSCIIAANWVSANSTVIIIMSVAFFGQGMVGLGWTLISDIAPENMAGLTGGIFNFCANMASIIAPLIIGVIISATGNFFYALIYIGLTALIGVIAYIFIIGDIKRIELK

SEQ ID NO: 12385 - protein, 551 aa, Klebsiella pneumoniae
TVREVTGRGGNHRRAVGHARLVTHTQGTARDFDTRPALTKHAIVAFFGQLRGIHTGWRRHPQASRQLAFVAVQQLTGGTEVADVGHAGADEHFVDLLALHIRQQAGIVRIVRRAQNRLFDIRQIDVDHCRVFRVSIGFQQLRIRQPFFHALDTTLQGTAVAVAFGDHPLQQNDVGVQILNDRLFIQFDGAAGGRTLSRGIGQLERLLDFQIRQTFDLEDATREDVFLTFLLHGQQALLDGVQRDGVDQVTQGDPRLHFTFETHQHRFRHIQRHHAGRGGEGHQTRARREGDADWETGVGVTAGTHGIRQQHAVQPGVNHAIARTQRNTAAVHDEVRQSVVRGNVNRLRVGRGVAEGLHHQVCREAQARQVFQLITGHWTGGVLRTDGGHFRFAISARTDTGNAAGAANHFLRQREAAGAFRHVFRLTEDIAVRQAQRFTRFGGQTATDDQRNTAAGAHFVDQHIGFQLEAGQQFVGLVVTHFAFERVNVDYVAHVQVRHINFDRQRARIFHGVEENWRDFTAQTQAAAALVRHVRDIVAHKPQHRVGGGFT

SEQ ID NO: 12386 - protein, 820 aa, Klebsiella pneumoniae
AGREQAESPEWTPACSICSMMPPISTISPSQMGIDIHFNRIVEEAIQQHRRVVGDADRGLEVAAQILLVIDDLHRPAAEHIRRTHHQRVANLFRFLYRLLNGGDGGVRRLLQLQTVNRVLEALTVFRPVDSVRTGTDNRHAGSFQGTSQFQRGLAAVLDDNAFWLLDAHDFQHVFQGHRLKIQTVGGVVVGRDGFRVTVDHDGLVTVLAQRQRGVYAAVVEFDTLTDTVRAAAEDHDFIAVNGRVGLTLFFISGVHVGGIGSKFRSAGVHALVDRVQVILVAQLADFRFPHARQLRQTRIGKAFTLQGAQEVSVEAVDAHFRHFLFQTDQLFNLYQEPAVDVGQVEDAVNREARAERVSDIPDTLSAGIFQLAADFGQRFRVVEAHFRFEAGSAHFQTAQRFLQGFLLGTTNRHHFADRLHLGGQTVVGAGEFFKVKAWDFSDHVVDGRFKGSRGAAAGDVVHQLVKGITYRQLGCHFSNREAGGLRGQRRGAGDARVHFDNDQATVFRVDRELHVRAAGFDADFTQHRHRGVTHDLVLFVGQGLRRGNGDGVTGVDPHGVEVFDGADDDAVIVLIAHHFHLVLFPADQRFIDQQFAGRREIQAAFADFFELFAVIGDTAAGAAHGEGRTDDARETNVGGNRQRLFHRVGDTRARGVEADFFHCDIETATVFGFINRIGGGANHGHAEFSQDPLTLQLERAVQRRLAAHGRQHRIRALFFDDFTHHFPVNRLDVGGIGHFRVGHDGRRVRVHQDNAVALFAQRFTGLGAGVVKLTRLTDNNRARAQNQDTFYVCTFWHCFLLRRTCLWSSRAMGRQGKNL

SEQ ID NO: 12387 - protein, 280 aa, Klebsiella pneumoniae
TVGESMQYLGKVIGVAVALLMGGGFWGVVLGFLVGHMFDRARSRRLNLFANQQERQSLFFSTTFEVMGHLTKSKGRVTEADIHVANVLMDRMNLHGASRTAAQQAFRDGKADNYPLREKMRQLRSVCFGRFDLIRMFLEIQLQAAFADGELHPNEREVLFVIADELGISRAQFDQFLRMMQGGAQFGGGSQQRSYGQHGGNAGWQQAQRGPTLEDACNVLGVKPTDDAATVKRAYRKLMNEHHPDKLVAKGLPPEMMEMAKQKAQEIQKAWELIKEQRGF

SEQ ID NO: 12388 - protein, 666 aa, Klebsiella pneumoniae
CPGETGMNTRLSPLAIILLAGLLGVAFALSIVNLNVALPYAQWRQALWQPDVDDIAQMLFHYSLLPRLAVALLVGAGLGLVGVLFQQVLRNPLAEPTTLGVATGAQLGITVTTLWAIPGVLASQFAALAGASLVGALVFGVSWGKRLSPVTLILAGLVVSLYCGALNQLMVIFHHDQLQSMFLWSTGTLTQTDWSVAQRLWPQLLGGAILTLLLLRPLTLMGLDDGVARNLGLALSLARLGALTLAIVISALLVNAVGIIGFIGLFAPLLAKMLGARRLLARLLLAALIGALLLWLSDQVILWLSRVWREVSTGSVTALIGAPLLLWLLPRLRSISAPVMNGGDNVQPERYYVQWFVLAGVALLLLAVSVALAFGRDAHGWLWAHGDLLEQLLPWRWPRVLSALFAGVMLAVAGCIIQRLTGNPMASPEVLGISSGAAFGVVLMLFFVPGDAFGWLLPAGSLGAAATLLIIMLAAGRGGFSPHRMLLAGMALSTAFTMLLMMLQASGDPRMAQILTWISGSTYSATPERVVRSGAVMLALLALAPLCRRWLTILPLGGEAARAVGMALTSSRIVLLLLAACLTAAATLTIGPLSFVGLMAPHIARMMGFRRTLPHMVISGLTGGLLLVFADWCGRMMMFPYQIPAGLLSTFIGAPYFIYLLRKQSR

SEQ ID NO: 12389 - protein, 281 aa, Klebsiella pneumoniae
QDLLYYCRKYRHCWTYSMAISIKTSEDIEKMRVAGRLAAEVLEMIEPYVKPGVSTGELDRICNDYIVNEQKAISACLGYHGYPKSVCISVNEVVCHGIPDDGKLLKDGDIVNIDVTVIKDDFHGDTSKMFIVGKPTILGERLCRITQESLYLALRMVKPGINLRTIGAAIQKFVEAEGFSVVREYCGHGIGRGFHEEPQVLHYDSPETNVVLKPGMTFTIEPMVNAGKKEIRSMKDGWTVKTKDRSLSAQYEHTIVVTDNGCEILTLRKDDTIPAIISHDE

SEQ ID NO: 12390 - protein, 289 aa, Klebsiella pneumoniae
WGSLLLKYRLISAFVLIPIVIAALFLLPPMGFAIVTLVVCMLAAWEWGQLSGFTSTSQRVWLAVLCGLLLAAMLFLLPEYHYDVHQPMVEGSLWASFAWWIVALLLVLSYPASAAFWRHSKVLRLIFGILTIVPFFWGMLALRAWHYADNHYSGALWLLYVMILVWGADSGAYMFGKMFGKHKLAPKVSPGKTWQGFFGGLLTAAVISWAYGVWAHLDVTPTVLLVCSVVAALASVLGDLTESMFKREAGIKDSGHLIPGHGGILDRIDSLTAAVPVFACLLLLVFRTI

SEQ ID NO: 12391 - protein, 193 aa, Klebsiella pneumoniae
LSTLLLITTRANAGQSMILIIYAHPYPQHSHANKRMLEQAGTLEGVEIRSLYQLYPDFNIDVAAEQAALARADLVIWQHPMQWYSVPPLLKLWMDKVLSHGWAYGHNGIALRGKSLMWAVTTGGGESHFDIGSFPGFPVLAQPLQATALYCGMKWLPPFAMHCTFICDDETLQAQARRYRQRLIDWQEAHQNG

SEQ ID NO: 12392 - protein, 74 aa, Klebsiella pneumoniae
INLWARSFDRAFYFIAEKIAISRTKTNFNLLIVRPYRHPALPPKEELFRFPPLLQHCLCIFPALQVKIRHEYLI

SEQ ID NO: 12393 - protein, 186 aa, Klebsiella pneumoniae
FIIWSHDISGLLHSLKDCRRPCYYCLLVHLDRKSILTTDTHTLHIEKIVELLPHRYPFLLVDRVLDFEEGRFLRAVKNVSVNEPFFQGHFPGKPILPGVLILEAMAQATGILAFKSVGKLEPGELYYFAGIDEARFKRPVVPGDQMIMEVTFEKTRRGLTRFKGVALVDGKVVCEATMMCARSREA

SEQ ID NO: 12394 - protein, 597 aa, Klebsiella pneumoniae
TDRCRLSPPISAARWGRLSSPPSPPASMRIFQPPNSGWQARWKLPCSRVRRRHSVSNNSISATSNGRSARNNTISLRLQRRKKPRNLRQRSPIKDTKMTIFDNYEVWFVIGSQHLYGPEALRQVTKHAEHVVNSLNAEAKLPCKLVLKPLGTTPDEITHICRDANYDDKCAGLVVWLHTFSPAKMWINGLTILNKPLLQFHTQYNAALPWDSIDMDFMNLNQTAHGGREFGFIGARMRQQHSVVTGHWQDKEAHQRIGGWMRQAVSKQDTRHLKVCRFGDNMREVAVTDGDKVAAQIKFGFSVNTWAVGDLVQVVNSISDGDISALVDEYESSYRLTPAAQVHGEKRQNVLDAARIELGMKRFLEQGGFHAFTTTFEDLHGLKQLPGLAVQRLMQQGYGFAGEGDWKTAALLRIMKVMSTGLQGGTSFMEDYTYHFDNGNDLVLGSHMLEVCPTIATAEKPILDVQPLGIGGKADPARLIFNTQTGPAIVASLIDLGDRFRLLVNTIETVPTPHDLPKLPVANALWKAQPDLRTASEAWIIAGGAHHTVFSHALNLDDMRQFSELHDIELTVIDNDTRLPSFKDALRWNEVYYGSKR

SEQ ID NO: 12395 - protein, 472 aa, Klebsiella pneumoniae
RRRCPFTLKMNNNDRAEFMSTTDNAFSATLEPIDTPKTTLKQRWWHIMDNWKVGIVPLPLFLLAGGLIALDCLGGKLPSDIVVMVATLAFFGFACGEFGKRLPVLGKLGAAAICATFIPSALVHYGLLPDVVIESTTKFYKSTNILYLYICCIIVGSIMSMNRTTLIQGFLKIFFPMLCGEVVGMLVGIGVGTLLGMEPFQVFFFIVLPIMAGGVGEGAIPLSMGYAALMHMEQGVALGRVLPMVMLGSLTAILISGCLNQLGKRFPHLTGEGQLMPNRSHETRSLSESEGVSGKTDVGTLASGALLAVLLYMMGMLGHKLIGLPAPVGMLFLAVLLKLANVVSPRLQEGSQMVYKFFRTAVTYPILFAVGVAITPWQELVNAFTLTNLLVIVSTVSALVATGFLVGKKIGMHPIDVAIVSCCQSGQGGTGDVAILTAGNRMSLMPFAQIATRIGGAINVSLGLLFLSHYLA

SEQ ID NO: 12396 - protein, 311 aa, Klebsiella pneumoniae
LSKWPTAASASAPISASAFLNAASPPKPVAITALVCILLNIMSLRRAAPSKSPITRRGERSSPYLSRPTRTPVRNRRPTMHHDLVDVLIIEDESELARLHAELVQKHPRLRLAGMAASLAQARQLLHATPPQLVLLDNYLPDGKGVTLMTDPALATSQCSVIFITAASDMETCSQAIRNGAFDYILKPVSWKRLSQSLERFIQFYDQQREWKIVDQQNVDSLYQLQAKNYRVDSGSKGIEEKTLALVQGLFSDREAHCFSVDEVVSAAGLSKTTARRYLEHGVETGFLEVEMLYGKIGHPRRLYRRAKVKS

SEQ ID NO: 12397 - protein, 853 aa, Klebsiella pneumoniae
IPPRAWKKGETLESLIPEAFAVVREASKRVFGMRHFDVQLLGGMVLNDRCIAEMRTGEGKTLTATLPAYLNALTGKGVHVVTVNDYLAQRDAENNRPLFEFLGMTVGINMSGLPAPAKREAYAADITYGTNNEYGFDYLRDNMAFSPEERVQRKLHYALVDEVDSILIDEARTPLIISGPAEDSSEMYRKVNKIIPHLIRQEKEDSDTFTGEGHFSVDEKARQVNLTERGLVLIEELLVQEGIMDEGESLYSPTNIMLMHHVTAALRAHALFTRDVDYIVKDGEVIIVDEHTGRTMQGRRWSDGLHQAVEAKEGVEIQNENQTLASITFQNYFRLYEKLAGMTGTADTEAFEFSSIYKLDTVVVPTNRPMIRKDMADLVYMTEAEKIQAIIEDIKTRTAAGQPVLVGTISIEKSEVVSRELTKAGIKHNVLNAKFHASEADIVAQAGYPSAVTIATNMAGRGTDIMLGGSWQAEVAALENPTPEQIEKIKADWQVRHDAVLAAGGLHIIGTERHESRRIDNQLRGRAGRQGDAGSSRFYLSMEDALMRIFASDRVSGMMRKLGMKPGEAIEHPWVTKAIANAQRKVESRNFDIRKQLLEYDDVANDQRRAIYTQRNELLDVSDVSETINSIREDVFKATIDAHIPPQSLEEMWDIEGLQERLKNDFDLDLPIKEWLDKEPELHEETLRERILQSAVETYQRKEEVVGAEMMRHFEKGVMLQTLDSLWKEHLAAMDYLRQGIHLRGYAQKDPKQEYKRESFSMFAAMLESLKYEVISTLSKVQVRMPEEVEAMEQQRREEAERLAQMQQLSHQSDDEAAAQDLAAQTGERKVGRNDPCPCGSGKKYKQCHGRLS

SEQ ID NO: 12398 - protein, 243 aa, Klebsiella pneumoniae
PSARKRLNRCRAWPPCSTMCRRRLCSKKCSNCCRPGYGTKPTCCWREYSLFQPLFPTITRYFTERGDSPMERIISQVLKNTDTRIHNDMRVNPAFLFAVMFWYPLLETAQKIAQESGLAYYDAFALAMNDVLDEACRTLAIPKRITTLIRDIWQLQLRMSRRQGKRAWKLMEHPKFRAAYDLLELRAGAENNHELQRLTKWWGEFQVAAPPAQKDMLNDLGDDPAPRRRHRRPRKRAPRQGSA

SEQ ID NO: 12399 - protein, 117 aa, Klebsiella pneumoniae
AGHRLFHHHFAQLTHDQESDKTGDSVTKNDTRAGGLNDGRAPQKQAGADSPAQRDELNVTVFQAALQPIAVLLTFHMKPRVWLFFVYVIRQVAASLLSLPESIASENLGEVAHFLPE

SEQ ID NO: 12400 - protein, 131 aa, Klebsiella pneumoniae
PAHRPDPAGDAAHQPGIDDAACRTRRSSLPGDLPAFARQRTGGTGGGAERAGDPAQRSVGAVAGAAAVGLPRSGRAGLAGSAARGQSGRRASPAGGAVGAGRRAAVGVWPQNGSAWQRAAAGGDAGRRADR

SEQ ID NO: 12401 - protein, 268 aa, Klebsiella pneumoniae
PGSRRDPAGSRSTICCWSATMKANWIAGGLLLVLYLLWLTATAPARLLAPMLPPGVQVGQFSGSVWRGAAQPVYWHGERLERLAWSLTLAGWQVSLSDPRGVMGQARLWGLRDLRLQEGRLTAPASLLSRWLMSTMPVKAAGEVTFSLTEGRFSDGRCRHIIAGGAQWRQARLHSPVGSLELAQVNGTFRCTEDGAVALTLRQDSHQLSLSGQGTLSPDGRYLFRGTLQPRQGMPPLLALLVTRPTANNAPGPTPWQLQGKWLPQEQK

SEQ ID NO: 12402 - protein, 285 aa, Klebsiella pneumoniae
SVLRFKTLRGRPLTLPLSPLGRGDRPGAMPPFSLSRRERVGVRDTRLACYSEHTMLEDLKRQVLEANLALPKHNLVTLTWGNVSAVDREKGVFVIKPSGVDYRVMTADDMVVVSLESGEVVEGNKKPSSDTPTHRLLYQAFPTLGGIVHTHSRHATIWAQAGQSIPATGTTHADYFYGPVPCTRLMTDAEINGDYEWETGNVIVETFRQQGIDPAQMPGVLVHSHGPFAWGKNAEDAVHNAIVLEEIAYMGIFCRQLAPQLPAMQQTLLDKHYLRKHGAKAYYGQ

SEQ ID NO: 12403 - protein, 145 aa, Klebsiella pneumoniae
ISVRRIIGISRASTSRIIPPPTPVTTPMHTATSGPLPARKALLTPMPTNTARPTASRTGRIHFGSRRGWRTSRMVSMLVTIATTRSVGSLTQNTGPFASAMSRMVPPPTAVTTPNTSTPNGSIRSFPASSTPEIAKTAVPIISSQ

SEQ ID NO: 12404 - protein, 696 aa, Klebsiella pneumoniae
LRTRLGPAYRPPGLLWREEMSHYPHLFSPLTINGMTLKNRIIMPPMGTNMATLNGEVSQEQLEYYELRAKGGTGLITIENICIDFPFASNGTTQLRIDNDQYIPRLFKLTETLHKHGACVSIQLNHAGASAYAYRLEGQTPLSSSTTPSKKHGNIPRPMTHEEIYHAVEKFGDAAERVRRAGFDCVEIHAGHSYLISQFLSPLFNKRTDEFGGSVENRTRILSLIVDKVRACVGPRFPVSLRISADDFLKGGNTLEDSLRILELCQEKVDIINVSAAQNDNLNLQIDQMSLEDGWKRYLSRAVRDKFHKPTVIAGNIRTPQVAEDILASGDADLIAIGRGLIAEPEWVQKVQGGKERLMRKCISCNIGCADHRIARSRPLRCSINPDIIHGDAYKMRRVNRDTNVVVIGAGTAGMEAACTAAEVGCHTWLLEAKNHVGGLAREISRLPEKKRIADFPQFMKNRIASLDNLMLQIGKRADVASVSALRPHLIVNATGSTPLLPPIEGLRENIDVENGKIFSITGMIDNLAKFTDIKGKRIAVVGAGAVGLDVIEYFTARGAQAVLIEMQDAAGRDLDIITKNAMLTMLDEHQVEQHMNTQLMAVAADHFQVKNTQQTFDIPFDYGFVCLGMRANRTGLDEIERWANANNVKIMNIGDSVMARRIIDGVREGRNVLDALEDMGALGSREAQRIPFLTY

SEQ ID NO: 12405 - protein, 74 aa, Klebsiella pneumoniae
VRTLTGGHVDHYCELIRKRYAEIASGDLGYIPDALGCVLKVLNEIAADEALSESVREKAAYAAANLLVSDYVNE

SEQ ID NO: 12406 - protein, 531 aa, Klebsiella pneumoniae
IYSRCVRFSCIVYHALKGKRIARAGEAMAKIDFRNKINWRRRFRSPPRVETERDILRIFESDRGRIVNSPAIRRLQQKTQVFPLERNAAVRTRLTHSLEVQQVGRYIAKEVLSRLKELRLLEEYGLEELTGPFESVVEMACLMHDIGNPPFGHFGEAAINDWFRQRLAPGDALGQPLTDDRCEVQALRLHDGETSLNALRRKVRQDLCSFEGNAQGIRLVHTLMRMNLTWAQVGCILKYTRPAWWSEETPASHSYLMKKPGYYLAEEEYVARLRKELDLAPYNRFPLTWIMEAADDISYCVADLEDAVEKRIFSAEQLYQHLYDAWGSHEKGSLFSQVVENAWEKSRANYLKQSAEDQFFMYLRVNTLNKLVPYAARRFIDNLPAIFTGDFNHALLEDDSDCSQLLELYKNVAMKQVFSHPDVEQLELQGYRVISGLLDIYQPLLKLSLEDFSELVAQERVRRLPIASRLYQKLSTRHRLAYVEAVNKLARTAPEFALMEYYYRCRLIQDYISGMTDLYAWDEYRRLMAVE

SEQ ID NO: 12407 - protein, 186 aa, Klebsiella pneumoniae
AITRLSPRHANNGTPGYSWDGKEFIVKKWLLAAGLGLAMVTSAQAADKIALVNMNSLFQQVAQKTGVSNTLENEFKGRASELQRMEGDLQSKMQRLQSMKPGAERTKLEKDVMAQRQTFSQKAQAFEQDRARRSNEERGKLVTRIQTAVQSVAKDQSIDLVVDANAVAYNSSDVKDITADVLKQVK

SEQ ID NO: 12408 - protein, 261 aa, Klebsiella pneumoniae
STTRKIMDTYMTNAVTVKNITFQEGETLICVPLIGKTLDEILGNAHGLVDAGADIIEWRVDHFAQVREMAQVMAALAEIRGALKALPLLFTFRSKKEGGETELSDEAYFALNREAARSGLVDVIDIELFNNEAQIRALVDDAHAAGVKVIMSNHDFHKTPAQEDIIYRLRRMQDLGADLPKIAVMPQSPQDVLTLLAATLTMKEKYATRPLITMSMGKSGGVSRVTGRLFGSAMTFGTVGQSSAPGQIAIAKLREVMDILS

SEQ ID NO: 12409 - protein, 187 aa, Klebsiella pneumoniae
TIWRFAASMAKGWSSAPPVLTTLTNRRFAIPRRTLPLFSPHNFSVGVNVLLKLLEKAAKVMGDYTDIEIIEAHHRHKVDAPSGTALAMGEAIAGALNKDLKDCAVYSREGYTGERVPGTIGFATVRAGDIVGEHTAMFADIGERIEITHKASSRMTFANGAVRSALWLKDKKNGLFDMRDVLDLNSL

SEQ ID NO: 12410 - protein, 246 aa, Klebsiella pneumoniae
RRRRTGEMDDKESKVKKIVFSLIAACSLFALFGCNHRAETDTVQPAAMEELKPMQQSWRGVLPCADCEGIDTSLFLEKDGTWVMNEHYQGARREPSSFASYGTWARTADKLVLTNSKGEKSYFRAKGDKLEMLDRNGSPIQSPLNYTLEPVKASLPTTPMVMRGMYFYMADAATFTDCATGKRVAVANNAQLERDYAAARGTDTRPVLLVVEGHFTLEANPDTGEMMKTLMTDQAGKFIPGKDCSH

SEQ ID NO: 12411 - protein, 439 aa, Klebsiella pneumoniae
TTGRDVCPSGEGVRLMRFSLPRLRMPQLSLPRLRLPRLPGMFIFAWLFAALKGWVMGSRPKDNDSLVMYDRMLLWLTFGLAAIGFIMVTSASMPVGQRLANDPFLFAKRDGLYIVLAFALAMITLRLPMDFWQRHSTAMLIASIVMLLIVLVVGSSVNGASRWIALGPLRIQPAEFTKLSLFCYIANYLVRKADEVRNNLRGFLKPMGVIFVLAILLLAQPDLGTVVVLFVTTLAMLFLAGAKLWQFIAIIGMGISAVVLLILAEPYRIRRVTSFWNPWEDPFGSGYQLTQSLMAFGRGEMWGQGLGNSVQKLEYLPEAHTDFIFAIIGEELGYIGVVLALLMVFFVAFRAMSIGRKALEIDHRFSGFLACAIGIWFSFQALVNVGAAAGMLPTKGLTLPLISYGGSSLLIMSTAIMLLLRIDYETRLEKAQAFTRGVR

SEQ ID NO: 12412 - protein, 403 aa, Klebsiella pneumoniae
ASELRSAGSADRQPADGPGAAARGHGVSPAVLRRRALAGNLGPPAEAAAGAGDHPDAGEQRGDNPPVFTHPGRRPVINRQRGVALLMVLFILALMMILASAMTERTAVMYQHTAVTLDNLQARWYALAAENMAAALLQRDALDSPSQTNLAQTWAQEGRRFTLDDGEIRATIRDGHACFNLNAIDHRADEAGDGTPYPTDVFVRLLALLGEPPLRASQIAAALGDWTDSDGQPRLNGAEDEVYMAQTPGYLAANQPMQDVSELRLLAGMDAALYQRLLPFVCVQPDDALQVNVNTLRPSQAALLVALLPGDLTLQEAQQLLHNRPRTGWSSVAAFLAQPTLQKTDTTLARPWLTVHSARFIAAFTVVTGNLRFQLHSVLQQEGRTFTVVQRRYGLSMVVDEQD

SEQ ID NO: 12413 - protein, 422 aa, Klebsiella pneumoniae
LLRRGLLAAFCFLFCFHSSGRLMKQLTVLGSTGSIGCSTLDVVRHNPGRFSVAALVAGKNVDRMVEQCLEFTPRYAVMDDAQSAERLRTRLHEHGCRTEVLSGQQAAAEVAALDEVDQVMAAIVGAAGLVPTLAAIRAGKTVLLANKESLVTCGRLFMEAVQQSGARLLPVDSEHNAIFQSMPETIQQHLGYADLARNGVSSILLTGSGGPFRETAVAELAAMTPDQACRHPNWSMGRKISVDSATMMNKGLEYIEARWLFNASAQQMEVLIHPQSVIHSMVRYQDGSVLAQLGEPDMRTPIAHTMGWPQRLNSGVKPLDFCQLSNLSFSAPDYTRYPCLKLAMDAFDVGQAATTTLNAANEESVAAFLHGDIRFTDIAAVNLAVLDKMDLQEPQSIDDVLVIDAEARAIAHQQLQRLVAQA

SEQ ID NO: 12414 - protein, 139 aa, Klebsiella pneumoniae
RGWLNRRSLTMLGLKRVHHIAIIATDYARSKAFYCDILGFTLQSEFYRAERDSWKGDLALNGEYVIELFSFPFPPARPSRPEACGLRHLAFSVDDIDAAVAHLTAHGVECEAIRVDPFTGKRFTFFSDPDDLPLEIYQQ

SEQ ID NO: 12415 - protein, 79 aa, Klebsiella pneumoniae
PPNRGHRAALDTHFYPVPGLQPIAENNQKLYAKKPCFVTATVIFNNKMQRSGGADYITEALRPQISPRYACATNRCSCW

SEQ ID NO: 12416 - protein, 559 aa, Klebsiella pneumoniae
VLRRSSPFMSSGRLQQQFIRLWQCCDGKSQETTLNELAEMLSCSRRHMRTLLNMMESRGWLTWEAEAGRGKRSRLTFLYTGLALQQQRAEDLLEQDRIDQLVQLVGDKAAVRQMLVSHLGRSFRQGRHILRVLYYRPMKNLLPGSALRRSETHIARQIFSALTRVNEENGELEADIAHHWQQLSPTHWRFFLRPGIHFHHGRELEMADVIASLQRSNALPLYSHIERIESPTAWTLDIHLRQPDRWLPWLLGQVPAMVLPQEWQTMNHFSSMPVGTGPYAVVRNNQNQLKIHAFEDYFGYRALIDEVNVWVLPEISEEPNGGLTLQGNTESEKAVESRLEEGCYYLLFDSRSPLGANDAVRRWLSYLFQPANLLYHAGEHYQGNWFPAYGLLPRWHHASNHACEKPAGLETVTLTYYRDHVEHRVIGGIMRDLLAAHQVKLEIQELEYDAWHRGEVVSDIWLNSVNFTLPIEFSLFAYLYEVPLIQRCIPIDWQADACRWRAGEFNPATWSQRLLAGQHIVPLIHHWLMIQGQRSMRGVRMNTLGWFDFKSAWFAPPEP

SEQ ID NO: 12417 - protein, 143 aa, Klebsiella pneumoniae
STGRRHTRMDSHTLIQALIYLGAAALIVPIAVRLGLGSVLGYLIAGCIIGPWALRLVTDAEAILHFAEIGVVLMLFVIGLELDPQRLWKLRASVFGGGALQMVALRGVDRPVLHAAGPALAGGRADWYDSGAFLNRDRYAGDE

SEQ ID NO: 12418 - protein, 471 aa, Klebsiella pneumoniae
TERLAGAARYRALLDYFADAGADWPGDAEGTLIMADYQGKKVVIIGLGMTGLSCVDFFMARGVTPRVMDTRVAPPGLDKLPESVECHVGGLNDTWLLAADLIVASPGIALAHPSLSAAADAGVEIVGDIELFCREAQAPIIAITGSNGKSTVTTLVGEMAKAAGVNVGVGGNIGLPALMLLDTDRELYVLELSSFQLETTSSLQAVAATILNVTEDHMDRYPLGLQQYRAAKLRIYENAKTCVVNADDALTMPVRGADERCISFGVDVGDYHLNRQQGETWLRVKGEKILNVKEMPLTGQHNYSNALAALALADAAGLPRASSLKALTTFTGLAHRFQLVLEHNGVRWINDSKATNVGSTEAALNGLQLDGTLYLLLGGDGKSADFTPLKRYLGGDRIRLYCFGRDGAELAELRPEVAVQTETMEQAMRQIAPLVKAGDMVLLSPACASLDQFKNFEQRGEMFARLAKELG

SEQ ID NO: 12419 - protein, 180 aa, Klebsiella pneumoniae
CVLRRSNMQEGQNRKTSSLSILAIAGVEPYQEKPGEEYMNEAQLAHFKRILEAWRNQLRDEVDRTVSHMQDEAANFPDPVDRAAQEEEFSLELRNRDRERKLIKKIEKTLKKVEDEDFGYCESCGVEIGIRRLEARPTADLCIECKTVAEIREKQMAGNPLVLHFLAGVSPAWFCCPYHD

SEQ ID NO: 12420 - protein, 146 aa, Klebsiella pneumoniae
NKQRRRVLRLFYGAHSMKKLQIAVGIIRNPQGEIFITQRAADAHMANKLEFPGGKIESDETPEQALIRELQEEVGITVTTSSLFDKLEYQFPDRHITLWFFLVESWQGEPWGKEGQPGRWMAGPTLDPAAFPPANEPVISKLIAQG

SEQ ID NO: 12421 - protein, 133 aa, Klebsiella pneumoniae
WLKRSGYSLTGRKYQWEQKMSDDVALPLEFTEAAANKVKHLIADEDNPNLKLRVYITGGGCSGFQYGFTFDDQVNEGDMTIEKQGVGLVVDPMSLQYLVGGSVDYTEGLEGSRFIVTNPNAKSTCGCGSSFSV

SEQ ID NO: 12422 - protein, 204 aa, Klebsiella pneumoniae
GHKRLRGLTFRGSHCSIPLIHYRVSIMSEPKRLFFALELPSAVQKQIVQWRATHFPEDAGRPVAADNLHLTLAFLGEVSAEKQRALAALAGRLRQPGFTLTLDDAGQWLRSRVVWLGTRQPPRGLLQLASMLRAQAARSGCYQSPQPFHPHITLWRDARRAVPIPAPGFRWTFPVNEFVLYESSFSRGRTRYTALERYPFDKES

SEQ ID NO: 12423 - protein, 194 aa, Klebsiella pneumoniae
VRERRSRMQLNEGWLVGARRVPSPHHDCRPDEETPSLLVVHNISLPPGEFGGPWIDALFTGTLDPHAHPFFAEIAHLRVSAHCLIRRDGEIVQYVPFDKRAWHAGVSCYQGRERCNDFSIGIELEGTDTLAYTDAQYRQLAAVTDLLIAIYPAIAENIAGHSDIAPVRKTDPGPAFDWIKYRALLSAPSEKETS

SEQ ID NO: 12424 - protein, 62 aa, Klebsiella pneumoniae
PAGSAPFFMLLKNILFPILLRAQEVKCWLRMSHFSAILYALNITCYVLTYSADDAFNTMILW

SEQ ID NO: 12425 - protein, 294 aa, Klebsiella pneumoniae
VFLSCFNSRAMVIKYLFSCRDTSLTRLTHVCAGPALTPPTHLQPEVSRVKMVLKKVSLPYISATHLLGYRPITSMNDIDTLISNNALWSKMLVEEDPGFFEKLSQTQKPRFLWIGCSDSRVPAERLTGLEPGELFVHRNVANLVIHTDLNCLSVVQYAVDVLEVEHIIICGHYGCGGVQAAVENPELGLIDNWLLHIRDIWFKHSSLLGEMPEERRLDTLCELNVMEQVYNLGHSTIMQSAWKRGQKVTIHGWAYGIHDGLLRDLDVTAVSRETLEQRYRHGISNLKIKHINHR

SEQ ID NO: 12426 - protein, 495 aa, Klebsiella pneumoniae
AGVRYVELWGRSQNEKSPCPRRGKGLGSERWRLLQQQIDRGVAALNVQRQYGRFGVEDFPQIGDVFHRLLIRPDDDVAFLEANLCRRGTGFHIIDHHALILTLIAHFRPFNPVEDSAGVNLGLVALLQFDGYGHRFAVAQQTKLNFAADRHGADLGTQRGEAADRFPVEGGDNIAGFNARFRGRRTWHYLADEGPALGIDFHRFRQLRVQFGAHNAELTAFHLAIFHHLLGQVFHHVARDSKTDTDVAAVRRQNGGVDTDQLAVEVHQRTAGVPAVNRRIGLDKVFVVFHVEAATAQRGDNPGGHGFAQTERVADSHGVITDAQRIGVGKLNRRQIFWILNLNQRDIRARIFADDFGIKLTAIAQLNLNRGGVVHDVVVGHHIPFGGINDDAGAQRHKFLLLAAVRLTALSAALAKRRTLERRPILAERRIIAKELLEVTWHPWGINGGATFNVNAHHRRHHLLQHRGQAWHLLCISGRRCRFCRARRERGQRQT

SEQ ID NO: 12427 - protein, 462 aa, Klebsiella pneumoniae
PHTRFHMEGQQHGDRLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWWPEIPTWASAAVFFIAINAINLTNVKVFGEMEFWFAIIKVVAVVAMILFGGWLLFSGNGGPQATVRNLWDQGGFLPHGFYGLVMMMAIIMFSFGGLELVGITAAEADNPEQSIPKATNQVIYRILIFYVGSLAVLLSLLPWTRVTADTSPFVLIFHELGDTLVANALNVVVLTAALSVYNSCVYCNSRMLFGLAQQGNAPKALLSVDKRGVPVNTILVSALVTALCVLINYLAPESAFGLLMALVVSALVINWAMISLAHMKFRRAKKQQGVVTRFPALFYPLGNWLCLLFMAAVLVIMLMTPGMAISVWLIPVWIAVLGVGYLFKEKAAATIKAQ

SEQ ID NO: 12428 - protein, 238 aa, Klebsiella pneumoniae
HIASKSMKIGIIGAMEEEVTLLRDKIENRQTITIGGSEIYTGQLHGVDVALLKSGIGKVAAAMGATLLLERCQPDVIINTGSAGGLASTLKVGDIVVSDEARYHDADVTAFGYEYGQLPGCPAGFKADEKLVAAAESCIKALDLNAVRGLIVSGDAFINGSVGLAKIRHNFPQAIAVEMEATAIAHVCHNFKVPFVVVRAISDVADQQSHLSFEEFLAVAARQSTLMVENLVQNLARG

SEQ ID NO: 12429 - protein, 855 aa, Klebsiella pneumoniae
TLRRKSMAGDDREPIGRKGRPSRPTKQKVTRRRVREEDYDDEYDDDDYEDEKPVPRKAKGKGGKPRRKRSWLWLLVKLGIVFAVLIAAYGVYLDQKIRSRIDGKVWELPAAVYGRMVNLEPDMQISKNEMVRLLNATQYRQVSAMTRPGEYTVQANSIEMIRRPFDFPDSKEGQVRARLTFDGDHLETIENMDNNRQFGFFRLDPRLITMLQSPNGEQRLFVKRSGFPDLLVDTLLATEDRHFYEHDGISLYSIGRAVLANLTAGRTVQGASTLTQQLVKNLFLSSERSYWRKANEAYMALIVDARYSKDRILELYMNEVYLGQSGDNEIRGFPLASLYYFGRPVEELSLDQQALLVGMVKGASVYNPWRNPKLALERRNLVLRLLQQQQVIDQELYDMLSARPLGVQPRGGVISPQPAFMQMVRQELQAKLGDKVKDLSGVKIFTTFDSVAQDAAEKAASEGIPVLKKQRKLADLETAMVVVDRFTGEVRAMVGGAEPQFAGYNRAMQARRSIGSLAKPATYLTALSQPNQYRLNTWIADAPVTIRLSNGQTWSPQNDDRRFSGQVMLVDALTRSMNVPTVNLGMALGLPAVVDTWTKLGAPKNQLNAVPSMLLGALNLTPIEVAQAFQTIASGGNRAPLSALRSVIAEDGTVLYQSYPQAERAVPAQAAYMTLWTMQQVVQRGTGRQLGAKYPGLHLAGKTGTTNNNVDTWFAGIDGSQVTITWVGRDNNQPTKLYGASGAMSIYQRYLANQTPTPLVLTVPEDVVDMGVDSNGNFVCSGGMRSLPVWTTQPDALCRQGEMMQQQQLQQQEAKNPFNQSGQQQQQQQQQQQPPKQQEKSDGVAGWIKDMFGSN

SEQ ID NO: 12430 - protein, 262 aa, Klebsiella pneumoniae
AKRRISMMQLYWVALKSIWTKEIHRFMRIWVQTLVPPVITMTLYFVIFGNLIGSRIGEMHGFTYMQFIVPGLIMMAVITNAYANVASSFFSAKFQRNIEELLVAPVPTHVIIAGYVGGGVARGLCVGILVTAVSLFFVPFQVHSWLFVALTLLLTAVLFSLAGLLNAVFAKTFDDISLIPTFVLTPLTYLGGVFYSLTLLPPFWQGLSHLNPIVYMISGFRFGFLGINDVPLATTFAVLVVFIVAFYLLCWSLIQRGRGLRS

SEQ ID NO: 12431 - protein, 292 aa, Klebsiella pneumoniae
RRRSLIVADNPLWHETLHDHFGQYFSVDNVLYHEKTDHQDLIIFDNRAFGRVMALDGVVQTTERDEFIYHEMMTHVPLLAHGNAKHVLIIGGGDGAMLREVSRHRSIETITMVEIDAGVVSFCRQYLPNHNAGAYDDPRFTLVIDDGVNFVNQTTQTFDVIISDCTDPIGPGESLFTSAFYEGCKRCLNPGGIFVAQNGVCFLQQDEAVGSHRKLSHYFRDVSFYQAAIPTYYGGIMTFAWASDNEALRHLSSEIIQARFHKANLTCRYYNPAIHTAAFALPQYLHDALSAP

SEQ ID NO: 12432 - protein, 338 aa, Klebsiella pneumoniae
ESIGSWASALFVLNWLPDSGVHFGWIGKLVRLYDDQTKDLKRIVQATGVGLHTGKKVTLTLRPAPAYTGVIYRRTDLNPPVDFPADAKSVRDTMLCTCLVNEHDVRISTVEHLNAALAGLGIDNIIVEVDAPEIPIMDGSAAPFVYLLLDAGIDELNCAKKFVRIKETVRVEDGDKWAEFKPYNGFSLDFTIDFNHPAIDASTQRYTLNFSADAFMRQISRARTFGFMRDIEYLQSRGLCLGGSFDCAIVVDDYRVLNEDGLRFEDEFVRHKMLDAIGDLFMCGHNIIGAFTAYKSGHALNNKLLQAVLAKQEAWEYVTFEDDAKLPMAFRAPSMVLA

SEQ ID NO: 12433 - protein, 170 aa, Klebsiella pneumoniae
TPSGGNLWGKVAKRGEAGMFRGATLVNLDSKGRLAVPTRYREGLIEDAAGQLVCTIDIHHPCLLLYPLPEWEVIEQKLSRLSSMNPVERRVQRLLLGHASECQMDNAGRLLIAPVLRQHAGLTKEVMLVGQFNKFELWDETTWYQRVKEDIDAEQSATGELSERLQDLSL

SEQ ID NO: 12434 - protein, 642 aa, Klebsiella pneumoniae
PASGVRGKRIMAIEIKVPDIGADEVEITEILVKVGDKVEAEQSLITVEGDKASMEVPSPQAGVVKEIKVSVGDKTETGKLIMIFDSAEGAAAAAPAQEEKKEAAPAAAAPAAAAAAKEVHVPDIGGDEVEVTEIMVKVGDTIAAEQSLITVEGDKASMEVPAPFAGTVKEIKINTGDKVSTGSLIMIFEVAGAAPAAAPAQAAAPAAAAPAAAAGVKDVNVPDIGGDEVEVTEVMVKVGDKVAAEQSLITVEGDKASMEVPAPFAGTVKEIKISTGDKVKTGSLIMVFEVEGAAPAAAPAQAAAPAPAAAPAQAAKPAAAPAAKAEGKSEFAENDAYVHATPLIRRLAREFGVNLAKVKGTGRKGRILREDVQAYVKDAVKRAESAPAAAAGGGIPGMLPWPKVDFSKFGEVEEVELGRIQKISGANLSRNWVMIPHVTHFDKTDITDLEAFRKQQNAEAEKRKLDVKFTPVVFIMKAVAAALEQMPRFNSSLSEDGQRLTLKKYINIGVAVDTPNGLVVPVFKDVNKKSITELSRELTTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 12435 - protein, 370 aa, Klebsiella pneumoniae
NASGKSPGVYTGCAMSGQEKRLMVMAGGTGGHVFPGLAVAHHLMDQGWQVRWLGTADRMEADLVPKNGIEIDFILISGLRGKGIKAQLLAPVRIFNAWRQARAIMKRFQPDVVLGMGGYVSGPGGLAAWSLGIPVVLHEQNGIAGLTNKWLAKIAKKVMQAFPGAFPHADVVGNPVRTDVLALPLPGQRLVGRQGPIRVLVVGGSQGARVLNQTMPQVAAKLGATVTIWHQSGKGGQQTVQQAYAAAGQPQHKVTEFIDDMAAAYAWADVVVCRSGALTVSEIAAAGLPALFVPFQHKDRQQYWNALPLEKAGAAKILEQPEFTVEAVASTLASWDRETLLDMAERARGASIPDATERVAEEVSAVALAR

SEQ ID NO: 12436 - protein, 602 aa, Klebsiella pneumoniae
MKPGCSRTGDLKQPNDPGEITNEVTPIKVGDTLFLCTAHQRLFALDAATGKEKWHFDPQLNADPSFQHVTCRGVSYHEAKADNAPADVVADCPRRIILPVNDGRLFAVNADNGKLCETFANKGILNLQTNMPVTTPGMYEPTSPPIITDKTIVIAGAVTDNFSTREPSGVIRGFDVNTGKLLWAFDPGAKDPNAIPSDEHHFTLNSPNSWAPAAYDAKLDLVYLPMGVTTPDIWGGNRTPEQERYASSIVALNATTGKLAWSYQTVHHDLWDMDMPSQPTLADIEVNGKTVPVIYAPAKTGNIFVLDRRNGELVVPAPEKPVPQGAAKGDYVTKTQPFSDLSFRPKKDLTGADMWGATMFDQLVCRVIFHQLRYEGIFTPPSEQGTLVFPGNLGMFEWGGISVDPNRQVAIANPMALPFVSKLIPRGPGNPMEPPKDAKGSGTESGVQPQYGVPYGVTLNPFLSPFGLPCKQPAWGYISALDLKTNEVVWKKRIGTPQDSLPFPMPVKLPFTMGMPMLGGPISTAGNVLFIGATADNYLRAYNMSNGEKLWEARLPAGGQATPMTYEVNGKQYVVISAGGHGSFGTKMGDYIVAYALPDDAK

SEQ ID NO: 12437 - protein, 179 aa, Klebsiella pneumoniae
ASAGGHHGRHGAVYRAGHPAADPATEHPYEYVTVLMEKTMQRQRGFTLLEIMVVIVILGILASLVVPNLMGNKEKADRQKVVSDLVALEGALDMYKLDNSRYPNTEQGLQALVTAPAAEPHARNYPEGGYIRRLPQDPWGNEYQLLSPGQHGAIDVFSVGPDGMPDTNDDIGNWTLGKK

SEQ ID NO: 12438 - protein, 832 aa, Klebsiella pneumoniae
SAAGCGSDGHYRPASERAEADRFYRSGTAGRRSPQPGSDGGKPEGAAAGRPGRPRSAQRRRAAEPPLSASDELRLRLTFSSGLNTKGRIFRPFFYVRCARGIAMMLDLGEYQEESVNIIAIMGPHGVYHKDEPIKELEAALQRQGFQTIWPQNSADLLQFIEHNPRICGVIFDWDEYSVDLCSDINQLNEYLPLYAFINAHSTMDVSSQDLRMTLWFFEYALGLSEEIATRIGQYTREYLENITPPFTRALFNYVQEGKYTFCTPGHMGGSAYQKSPVGCLFYDFFGGNTLKADVSISVTELGSLLDHTGPHLEAEEYIARAFGAEQSYMVTNGTSTSNKIVGMYSAPAGSTLLIDRNCHKSLAHLLMMSDVVPLWLKPTRNALGILGGIPRREFTRDSIQQKVRDTGGAQWPVHAVITNSTYDGLLYNTTWLKETLDVPSIHFDSAWVPYTHFHPIYQGKSGMSGERIPGKVIFETQSTHKMLAALSQASLIHIKGNYDEETFNEAFMMHTSTSPSYPIVASIETAAAMLRGNSGKRLIQRSIERALDFRKEVQRLREESDGWFFDIWQPEAVDKAECWPVAPGEDWHGFKDADADHMYLDPVKVTILTPGMDEQGNMDEEGIPAALVAKFLDERGVVVEKTGPYNLLFLFSIGIDKTRAMGLLRGLTEFKRAYDLNLRVKNMLPDLYAEDPDFYRNMRIQDLAQGIHRLIRQHQLPQLMLSAFDVLPEMKMTPHHAWQRQIKGEVETIELENLVGRISANMILPYPPGVPLLMPGEMITEESRAVLDFLLMLCSIGRHYPGFETDIHGAKRDEDGVYRVRVLKNDERLAR

SEQ ID NO: 12439 - protein, 343 aa, Klebsiella pneumoniae
CRHGRGSTRITGDWDMLVWLAEHLVKYYSGFNVFSYLTFRAIVSLLTALFISLWMGPRMIARLQKLAFGQVVRNDGPESHFSKRGTPTMGGIMILTAITVSVLLWAYPSNPYVWCVLTVLIGYGIIGFVDDYRKVVRKDTKGLIARWKYFWMSVIALGVAFALYLAGKDTPATELVVPFFKDVMPQLGLFYILLAYFVIVGTGNAVNLTDGLDGLAIMPTVFVAAGFALVAWATGNMNFANYLHIPYLRHAGELVIVCTAIVGAGLGFLWFNTYPAQVFMGDVGSLALGGALGIIAVLLRQEFLLVIMGGVFVVETLSVILQVGSFKLRRSAHLPHGADSPPL

SEQ ID NO: 12440 - protein, 140 aa, Klebsiella pneumoniae
LFNGYDAIKGTVMYDNLKSLGITNPDEIDRYSLRQEANNDILKIYFQKDKGEFFAKSVKFKYPRQRKTVVADGVGQGYKEVQEISPNLRYVIDELDQICQRDRTEIDLKRKILDDLRHLESVVTNKISEIEADLEKLTRK

SEQ ID NO: 12441 - protein, 249 aa, Klebsiella pneumoniae
NHRGGRRDALVCPLAGSGNRAAAAAGAGRGGPAAKKRSRAAGHPAHLGDAAMITKMRGFTLIETLLALAILAVLSAAAVMVLQNVIRADGLTREKSQQIAALQRAFRQIADDVTHIIPRRARNSDTFFFAGRFQLQSDDWGLAFSRSGWPNPLGILPRSEIQNVSYRLRQQQLERLSFDQQDPLTGSQPTVRVLLREVTAFRLRFYADGRWQETWDRPQRLPQGLEITLTLANSGEITRLFLLTPGGGQ

SEQ ID NO: 12442 - protein, 89 aa, Klebsiella pneumoniae
PLSGIVQRQGKARLAQPASESGQRPLFFRAHLAEKRQRQMKIIRRDGPAGIFGEVCCPPLDNLLLDGRRQFKRKKQPFRLRHDRDSVMN

SEQ ID NO: 12443 - protein, 422 aa, Klebsiella pneumoniae
WYNGLMRMLARFLTLLLFLTSLSASASLLSQQGKAVRYMQTTEDAVIWAQVGNHVVSVGNVRAGQILAVVPTAAHYYEFRFGFGTGFIDKGHLEPVQGKQRVEDRLGDLNKPLSNQNLLTWKDTPLYDAPSVSSAPFGTLANNLRYPILSKLKDRLNQTWFQIRIGDRLAWVSSLDAQEDHGIPVLTYHHILRDEENTRFRHTSTTTSVRAFTNQMTWLRDQGYTTLTLYQLEGYVRNKINLPARAVAITFDDGLKSVNRYAYPVLKQYGFHATAFIISSRIKRHPQKWDPKSLQFMSISELRQIQDVFDIQSHTHFLHRVDAGRRPILFSRNYHNILFDFARSRRALSQFNPHVLYLSYPFGGYNATAVQAANDAGFHMAVTTVRGKVKPGDNPFLLKRLYILRTDSLETMSRLISNQPQG

SEQ ID NO: 12444 - protein, 710 aa, Klebsiella pneumoniae
TTNGKRFCPLLLIIPNSLRLSEKSRPSGRLFRLHHQAANVAQGVVNDGNEAGTISTVDDAVVEGQRDRQHQARHKLFTIPYRLHRGLRHAEDGHFRRVNNRREVGGTQAADAGDGEATALHFASRQFAIARFLRDGGQFTRQLGDALLVHVFEDRNHQTVRGIHRHTDVDVFLQRQALTIFGERAVEARHLLKRSGNRFHDEDHWSEFHVQFTLLSFGILLLAERFQIGDIGFVEVGNVRDHHPVTAQVGARDFLDTTQLHFFDFAKLAEVNLRPRQHARDTAACGSSRCGFSAFNRVFHVGLNVFAQDTTFTAGAFHFRQVNTELARQAANQRGRVNVGIVFSEFAFTFCFRSRRSGRLSGLSRGSSWCRCSSLSRSGGRRSAFHFEDHDQGTGFDFIAGADFDLFNGTRERRRNFHRGFVALYGDQGLFCRDFIADFNHHFGDFNFVAADVRDVNIFHACCGSRSRSSRRGSLCRSGCRRSARHFEDHNQGAGGNFIAGIDFDLFDGTGERRRNFHRGFIAFYGDQGLLSGDGVAHFNHDLGDFDFIAADIRDVNFFRCRGSRWSSGGRSGFFLLFLRRCSGGCTFGGIENHNQFASLGFVADGDFNLFHDASLRRRDFHRGFVAFYGDQRLFSFYFVANFDQDLGDFNFISPDVRYFDFDSHYSFTSYARRGLTFSASMSNFAIASATTFLSISPRLASSPSAATTT

SEQ ID NO: 12445 - protein, 211 aa, Klebsiella pneumoniae
AGGGRRTGVSKTMMEFVYPHTHLVAGVDEVGRGPLVGAVVTAAVILDPAKPIVGLNDSKKLSEKRRLALFDEIKEKALCWSLGRAEPHEIDELNILHATMLAMQRAVAGLSIVPEFVLIDGNRCPLLPMPSQAVVKGDSRVAEISAASILAKVTRDAEMATLDLAFPHYGFAQHKGYPTAVHLQKLQEHGATEHHRRSFGPVKRALGLASN

SEQ ID NO: 12446 - protein, 880 aa, Klebsiella pneumoniae
RRVGRIMTMRARRTVVLEEYRKHVAERAAMGIVAKPLDATQMAALVELLKNPPAGEEEFLLDLLINRVPPGVDEAAYVKAGFLAAIAKGEATSPLVTPEKAVELLGTMQGGYNIHPLIDALDDAKLAPIAAKALSHTLLMFDNFYDVEEKAKAGNEHAKQVMQSWADAEWFLNRPQLAEKITVTVFKVTGETNTDDLSPAPDAWSRPDIPLHALAMLKNPREGIEPDQPGVVGPIKQIEALQQKGYPLAYVGDVVGTGSSRKSATNSVLWFMGDDIPNVPNKRGGGLCLGGKIAPIFFNTMEDAGALPIEVDVSNLNMGDVIDVYPFKGEVRNHETNELLASFELKTDVLIDEVRAGGRIPLIIGRGLTTKAREALGLPHSDVFRQAKDVAESTRGFSLAQKMVGRACGVAGIRPGAYCEPKMTSVGSQDTTGPMTRDELKDLACLGFSADLVMQSFCHTAAYPKPVDVTTHHTLPDFIMNRGGVSLRPGDGVIHSWLNRMLLPDTVGTGGDSHTRFPIGISFPAGSGLVAFAAATGVMPLDMPESVLVRFKGKMQPGITLRDLVHAIPLYAIKQGLLTVEKKGKKNIFSGRILEIEGLPDLKVEQAFELTDASAERSAAGCTIKLNKEPIVEYLNSNIVLLKWMIAEGYGDRRTLERRIQGMEKWLADPQLLEADADAEYAAVIDIDLADIKEPILCAPNDPDDARLLSDVQGEKIDEVFIGSCMTNIGHFRAAGKLLDSHKGQLPTRLWVAPPTRMDAAQLTEEGYYSVFGKSGARIEIPGCSLCMGNQARVADGATVVSTSTRNFPNRLGTGANVYLASAELAAVASLLGKLPTPEEYQTFVAQVDKTAEDTYRYLNFNQLDQYTEKADGVIFQTAV

SEQ ID NO: 12447 - protein, 208 aa, Klebsiella pneumoniae
  UNSURE (208): Identity of amino acid at the above locations are unknown.
SFSGANRWQSQYPQFFFDRDGTINVDHGYVHEIDNFEFIDGVIDAMRELKEMGYALVLVTNQSGIARGKFTEAQFETLTEWMDWSLADRGVDLDGIYYCPHHPQGAVEEYRQTCDCRKPHPGMLISARDYLHIDMAASYMVGDKLEDMQAAAAADVGTKVLVRTGKPLTEEAEKAADWVLNSLAELPAAIKKQQKSFSPHGQEPHRGX

SEQ ID NO: 12448 - protein, 65 aa, Klebsiella pneumoniae
PPSGMTATRLSAAETTLSINKGMECTFKVLFSKIGPKNIRKVKFGIGNLPNQKVTYSVLSPGPNN

SEQ ID NO: 12449 - protein, 286 aa, Klebsiella pneumoniae
ISKGIKMPVSVMRLTNINKGIIKLLPQIVTLIILITAIPQLAKLTWRVVFPVSPEDISALPLTMPPAADPELKNVRPAFTLFGLAVKNSPTPTDAASLNQVPVSSLKLRLAGLLASSNPARSIAIIEKGNQQVSLSTGDPLPGYDARIAAILPDRIIVNYQGRKEAILLFNDSRAPSPPPTAAGNPPLVKRLREQPQNILTYLSISPVLSGDKLLGYRLNPGKDASLFRQSGLQANDLAIALNGIDLRDQEQAQQALQNLADMTEITLTVEREGQRHDIAFALGDE

SEQ ID NO: 12450 - protein, 207 aa, Klebsiella pneumoniae
FGGGAPHDGRHRQRARPLYPRRRAAGHRRSARQRGRRADHPPDQRHANRGHQRESLGYSYRNLRAPSADPLSRRRRAAGNSAPAAAAGRPVNFPHQGDGQPGHCRKAGPSGWPHGAAHRRASNRRARLHPALQPRRTRRPASAGQKQRQPGSADAGHAARPARSGRCADRPPARHHPGHRSDRLREKHDALRRPQPPRRPGAQHHDH

SEQ ID NO: 12451 - protein, 280 aa, Klebsiella pneumoniae
PPTGAVRRALYQVIAMQEQTPHAETTFALDRVTFRVPGRTLLHPLSLTFPSGKVTGLIGHNGSGKSTLLKMLGRHQPPSAGEVLLDGQPLESWGSKAFARKVAYLPQQLPPAEGMTVRELVAIGRYPWHGALGRFGAADREKVEEAIALVGLKPLAHRLVDSLSGGERQRAWIAMLVAQDSRCLLLDEPTSALDIAHQVDVLALVHRLSQQRGLTVIAVLHDINMAARYCDYLVALRGGEMIAQGTPAELMRSDTLEQIYGIPMGILPHPAGAAPVSFVY

SEQ ID NO: 12452 - protein, 69 aa, Klebsiella pneumoniae
SWAGFSWWKRCRLFCRSAPLSCAGQRIFRMAPIHHHYELKGWPEPRVIVRFWIISLMLVLIGLATLKVR

SEQ ID NO: 12453 - protein, 143 aa, Klebsiella pneumoniae
RREGHQRRRPGRQPAAGGAGAAMKREAGMTLIEVMVALVIFALAGLAVMQSTLQQTRQLGRMEEKILASWLADNQLVQLRLEKRWPALSWSETTVEAAGTRWFVRWQGVETALPQLRALDVEVRRQKSDPAPLATLRTWVTPP

SEQ ID NO: 12454 - protein, 262 aa, Klebsiella pneumoniae
LILIMDLKRVMLSANQTVSEISPTHGCRHVAIIMDGNGRWAKRQGKIRAFGHKAGAKSVRRAVSFAANNGIEALTLYAFSSENWNRPAQEVSALMELFVWALDSEVKSLHRHNVRLRIIGDTTRFNARLQERIRKAEALTANNTGLTLNIAANYGGRWDITQGVRLLAKQVQDGTLLPEQITEDMLSQQVCMHELAPVDLVIRTGGEHRISNFLIWQIAYAELYFTDVLWPDFAEQDFEGALHAFVNRERRFGGTEPGGSHA

SEQ ID NO: 12455 - protein, 655 aa, Klebsiella pneumoniae
PLFFYLLRQTRVNFFCIDVEFRDSVSHHFLIDFTTFSQFAQRCYDHIGSIDFEVVTQVFTAVGTTEAIGTQYAVIISRYVSTNLLSEQFHIVSGCHCRSVVHYLSDIRHARGFQRVQHVPAFAILAITRQFGEGGNAIHVGTHAVVFRQDLRCFTHVTQDRTGAQQLNFTFATFDGFEFVDTFTDTFLGAFRHGRHVVVFVQRSDVVVNVLLRFAVHTDQTIMHDDSHFIGVRRVVRDTVRDSQRLNVAVTIFVLQTFAVQGSTTGSPANQEAASLLIASRPAQIADTLEAEHRVVDIERDHRQVVGAVRGRSSQPGCACAQLVDPFLQNLAFLVFFVVSNLLTVLRGILLAVRAVNTDLTEQTFHTEGTRFVGDDRHQTIFDRLVLQHHVQGANESDSGRDFFVLLFQQRAEVGQGRQLEFLSELRLTSRQIAVQLLTLSVQVSVLFGTFREGYVRQFFEIGIRHRHIETIADVANTVHVHFLNLVRDVLTFSGIAHTITFNGMRQDHGRLTFGLLRFLQCSVDFLRIVTTAVQSPDLLVSPVSDQGSGFRIFAEEVLTNVSAVFGFEGLVVAVNGFVHQLNQLTAGVFTQQLIPTAAPDNLDNVPASTTEDAFQFVNDFAVTGDRAVQTLQVAVDDEDQVVQFFTGGDGDSAF

SEQ ID NO: 12456 - protein, 305 aa, Klebsiella pneumoniae
ILSIWSFIMSPRRYNPDRRRDVLLERINLDITDAVAHSLREDLGGEVDANNDISAQLLPQDARSHAVVITREDGVFCGKRWVEEVFIQLAGDDVNITWHVADGDAVKADQPLFELEGPSRILLTGERTALNFVQTLSGVASVVRRYVDLLAGTKTQLLDTRKTLPGLRTALKYAVLCGGGANHRLGLFDAFLIKENHIIASGSIRQAVEKAFWLHPDVPVEVEVETLDELEQALKAGADIIMLDNFTTDLMREAVKITAGQAALEVSGNVTFDTIREFADTGVDYISVGALTKHVQALDLSMRFR

SEQ ID NO: 12457 - protein, 93 aa, Klebsiella pneumoniae
ALSIDDEPNSDNPTPPADRDGALAAAVADARRAGGRRRPAARGRPGVAARGAAAGARRDALWRGRYSQLSLVGERTRAARLGDRCWSAYRTQP

SEQ ID NO: 12458 - protein, 138 aa, Klebsiella pneumoniae
GNTMRALPICLLALMLSGCSMLSRSPVEPAQSTATPPVKSEPSKPRATRPAPVRIYTDASELVGKPFRDLGEVSGESCQASNQDSPPNIPTARKRLQINAARMKANAVLLHRCEVTSGTPGCYRQAVCLGSALNVSAQ

SEQ ID NO: 12459 - protein, 108 aa, Klebsiella pneumoniae
RDAIRNTSGRTIRPTPPRPAAAKNTRSRRCRAASCPASRFANARPSAAREKYSRRPAPARGRRPAAAAATAGSTGVAAGSTPARWPKRATAPAAEPASRTRRPAPPAA

SEQ ID NO: 12460 - protein, 161 aa, Klebsiella pneumoniae
NQAIIRPGFLSARIPVTQPRAGFLLTRHWRDTPQGTELSFWLATDDGPLQVTLPPQESVAFIPEAQRAQAERLLQGGERAPLRPAGPERFPPSANCWPLLPRPSPVDASGEDAPRQRRHRLRRRYPPAGALSDGALYHRPGVGGRRNARLAAGQRAHEAEP

SEQ ID NO: 12461 - protein, 652 aa, Klebsiella pneumoniae
IQRMKKRIPSLLATMIASALYSQQGLAADLATQCMLGVPSYDRPLVEGRPGDLPVTINADHAKGNYPDNAVFTGNVDINQGNSRLRADEVQLHHQQAAGQAQPVRTVDALGNVHYDDNHVILRGPKAWSNLNTKDTNVWQGDYQMVGRQGRGTADLMKQRGENRYTILENGSFTSCLPGSDTWSVVGSEVIHDREEQVAEIWNARFKLGSVPIFYSPYLQLPVGDKRRSGFLIPNAKYSTKNGVEFSLPYYWNIAPNFDATITPHYMNKRGGVMWENEFRYLTQLGSGLTEFDYLPSDKVYEDDHSSDSNSRRWLFYWNHSGVIDQVWRLNADYTKVSDPDYFNDFSSKYGSSTDGYATQKFSAGYVNQNFDATVSTKQFQVFDRESSNSYSAEPQLDVNYYQNDVGPFDTHLYGQVAHFVNSNNNMPEATRVHFEPTINLPLSNGWGSLNTEAKLLATHYQQSNLDKYNAANGTDYKESVSRVMPQFKVDGKMVFERDLQEGFTQTLEPRVQYLYVPYRDQSEIGNYDSTLLQSDYTGLFRDRTYSGLDRIASANQVTTGLTSRVYDAAAVERFNISVGQSTILTDQRTGEDMTTSTGRTTIPRVHWSGPAIPTGALPMNGVCAGGSSTIRVWITLPLVTAPLNTVAMRTA

SEQ ID NO: 12462 - protein, 370 aa, Klebsiella pneumoniae
FARMITSLELCSHIHAINPRNSHMRIEEDLKLGFKDVLIRPKRSTLKSRSDVELEREFTFKHSGLTWSGVPIIAANMDTVGTFSMAKALATFGILTAVHKHYTAEEWLAFTQGASADVLKHVMVSTGTSDADFEKTQQILSQNPQLNFVCIDVANGYSEHFVQFVAKAREAWPQKTIIAGNVVTGEMCEELILSGADIVKVGIGPGSVCTTRVKTGVGYPQLSAVIECADAAHGLGGQIISDGGCTMPGDVAKAFGGGADFVMLGGMLAGHEESGGTIVEENGEKFMLFYGMSSESAMTRHVGGVAKYRAAEGKTVKLPLRGPVENTARDILGGLRSACTYVGASRLKELTKRTTFIRVQEQENRVFNSL

SEQ ID NO: 12463 - protein, 171 aa, Klebsiella pneumoniae
PLIFDSHHRYVIFTLLHYSLAKEGSMLGWVITCHDELAQEMLDRLEQKFGPLAQCRAVNYWRNLSSNMLSRMMCDALHATDSGDGVIFLTDKTGAAPYRAAALMSHKHTHCEVISGVSYPLLERMYLLRGTLSSVAFRQAIVSAGGPVVSSLWHQQQKNPPFRLRHDAWGN

SEQ ID NO: 12464 - protein, 326 aa, Klebsiella pneumoniae
REFIVTAELDMLIETPEYKSAPGQEVVKPQLRMVDLNLLTVFDAVMQEQNITRAAHTLGMSQPAVSNAVSRLKVMFNDELFVRYGRGIQPTARAYQLFGSVRQALQLVQNELPGSGFEPLSSERVFHLCVCSPLDNILTSVIFNKVAEIAPNIHLVFKSALNQNTEHQLRYQETEFVIGYEEFRRPEFACVPLFKDEMVLVASRNHPRISGPMMEADIYREEHAAVALDRYASFSLPWYDTADKQARIAYQGNAMVSVLNVVSQTQMVAIAPRWLADEFADKLALQILPLPLKVNSRTCYLSWHEAAGRDKGHQWMEELLVDICKR

SEQ ID NO: 12465 - protein, 397 aa, Klebsiella pneumoniae
GHSMLWLMTMGRRLNGVYAAFMLVAFMMGVAGALQAPTLSLFLSREVGAQPFWVGLFYTVNAIAGILVSLWLAKRSDSRGDRRRLIMFCCLMAVGNALLFAFNRHYLTLITCGVMLASIANAAMPQLFALAREYADSSAREVVMFSSVMRAQLSLAWVIGPPLAFMLALNYGFTTMFSIAAGIFVISLALIAIKLPSVPRVEQPSEEAAALAQAGGWQDKNVRMLFIASTLMWTCNTMYIIDMPLWISSDLGLPDSLAGILMGTAAGLEIPAMILAGYYVKRFGKRKMMVAAVAAGVLFYAGLILFHGRTALLALQLFNAIFIGIIAGIGMLWFQDLMPGRAGAATTLFTNSISTGVILAGVMQGALSQSYGHASVYWTIAAISLVTLFLTSKVKDI

SEQ ID NO: 12466 - protein, 660 aa, Klebsiella pneumoniae
LPTMKSLRKMLPALLILTPLLFSPAAAEEFSASFKGTDIQEFINTVSKNLNKTVIIDPSVRGTITVRSYDMLNEEQYYQFFLSVLDVYGFAVINMNNGMLKVVRAKDAKTSAVPVASAAAPGEGDEVVTRVVPLTNVAARDLAPLLRQLNDNAGAGSVVHYEPSNVLLMTGRAAVIKRLLTIVERVDNAGDRSVVTVPLSWASAAEVVKLVTELNKDTSKSALPGSMVANVVADERTNAVLVSGEPNSRQRIIAMIKQLDRQQAVQGNTKVIYLKYAKAADLVEVLTGISSSLQSDKQSARPVAAIDKNIIIKAHGQTNALIVTAAPDVMNDLERVIAQLDIRRPQVLVEAIIAEVQDADGLNLGIQWANKNAGMTQFTNSGLPISTAIAGANQYNKDGTISSSLASALGSFNGIAAGFYQGNWAMLLTALSSSTKNDILATPSIVTLDNMQATFNVGQEVPVLTGSQTTSGDNIFNTVERKTVGIKLKVKPQINEGDAVLLEIEQEVSSVADSASSTSSDLGATFNTRTVNNAVLVGSGETVVVGGLLDKTVTDTADKVPLLGDIPVIGALFRSDSKKVSKRNLMLFIRPTIIRDRDEYRQASSGQYTAFNNAQTKQRGKESSEASLSNDLLHIYPQQETQAFRQVSAAIDAFNLGGRP

SEQ ID NO: 12467 - protein, 67 aa, Klebsiella pneumoniae
GDNMSEETIVNCPTCGKTVVWGEQSPFRPFCSKRCQLIDLGEWAAEEKRIPSAGDLSDSDDWSEQQP

SEQ ID NO: 12468 - protein, 311 aa, Klebsiella pneumoniae
RQCIYSYIIRVKIMNLKQLYYFKRLSETEHYTEAASSLCITQPSLSHAISELEKELGVALFARQGRNVKITQNGKRFLPYVEDALASLENGRMILQKNGAENKENIRIAFIYTMGEYVVPQLINKYSLSPECHNVTFSFTQGTSLTLLQELKAGKVDLAICSYIADEPDIDFIPVIQQELVVVTAKDHPLARLYEHEVDLVETIHYPYIYFSENSGLRPFIDNVFMQQKLVPEIACYVDEDTAMAGLVSIDYGIAIMPRITALSYYNVHILKIKNTIPPRYIYLATMKDKGLSPALESFKNVVIHDSQKIC

SEQ ID NO: 12469 - protein, 815 aa, Klebsiella pneumoniae
EERIITMAMKKLLIASLLFSSATVYGAEGFVVKDIHFEGLQRVAVGAALLSMPVRPGDTVTDDDISNTIRALFATGNFEDVRVLRDGDTLLVQVKERPTIASITFSGNKSVKDDMLKQNLEASGVRVGESLDRTTIADIEKGLEDFYYSVGKYSASVKAVVTPLPRNRVDLKLVFQEGVSAKIQQINIVGNHAFSTDELISHFQLRDEVPWWNVVGDRKYQKQKLAGDLETLRSYYLDRGYARFNIDSTQVSLTPDKKGIYITVNITEGDQYKFSGVQVTGNLAGHSAEIEALTKVEPGELYNGAKVTKMENDIKKLLGRYGYAYPRVQSQPEINDSDKTVKLHVNVDAGNRYYVRKIRFEGNDTSKDAVLRREMRQMEGAWLGSDLVDQGKDRLNRLGFFETVDTDTQRVPGSPDQVDVVYKVKERNTGSFNFGIGYGTESGVSFQAGVQQDNWLGTGYAVGINGTKNDYQTYTELSVTNPYFTVDGVSLGGRVFYNDFDANDADLSDYTNKSYGTDITLGFPVNEYNTLRAGVGYVHNSLSNMQPQVAMWRYLNSMGQYPDNTNDRNSFSANDFTFNYGWTYNKLDRGFFPTEGSRVNLNGKVTIPGSDNEYYKATLDTATYVPIDNDHQWVVLGRTRFGYGDGIGGKEMPFYENFYAGGSSTVRGFQSNTIGPKAVYFPASSRHDDDDSYDNECKSTESAPCKSDDAVGGNAMAVASLELITPTPFISDKYANSVRTSVFWDMGTVWDTHWDSSAYAGYPDYSDPSNIRMSAGIAVQWMSPLGPLVFSYAQPFKKYDGDKAEQFQFNIGKTW

SEQ ID NO: 12470 - protein, 68 aa, Klebsiella pneumoniae
DVLIPATLYVAFQRGHYKQLAEFTKWAQKEAALRRLLFLKIKTAWTSQQLLLQSQSQLSQCLRPLQSG

SEQ ID NO: 12471 - protein, 80 aa, Klebsiella pneumoniae
PLLMTATQSQIRLTTSISWVINRMVSPRRRLMSFSSSRMERVVAGSRALVASSHSNTLGLLASARAIATRCFWPPERLAG

SEQ ID NO: 12472 - protein, 301 aa, Klebsiella pneumoniae
LDKIPCAAQRPVRKGDLMTLFTTLLVLIAERLFKLGEHWQLDHRLEVAFRRIKHFSLPGTLLMTLVAVAVVYIIQRLLQGQLFNIPLLVFWILLGLLCIGAGKVRLHYHAYLKAASRNDSRACDAMASELTLIHGVPPGCDEREYLSELQNALLWINYRYYLAPLFWFVVGGAWGPLTLIAYSVLRAWQTWLARYQTPHHRLQSGIDGILHIVDWLPVRLVGVVYALVGHGEKALPAWFASLGDRHSSQYQVLTRLAQYSLAREPHVDKVATPKAAVSMAKKTSLVVVVIMALLTIYGTLV

SEQ ID NO: 12473 - protein, 118 aa, Klebsiella pneumoniae
SIKIKTAPRVNCNLSNNKVFYFSLHKINKSLSLKNSPLAFEYIHRKNKFNIFIQIPFFVPSLATPVRRCLECKALFQMKQLGINRLRSKIGTSAKWGLHQHILLIHLVSPKRFFHARG

SEQ ID NO: 12474 - protein, 254 aa, Klebsiella pneumoniae
WWRIWYRTWHVAKSLSFALAALLLLAPAWLLAAPRVITLSPANTELAFAAGITPVGVSSYSDYPSQAKTIEQVASWQGMNLERIVALKPDVVLAWRGGNAERQVNQLQSLGIHVLWVQTSTIEEIIATLRELAQWSPQPEKAQQAAQAMQQEYDALKARYANAPKKRVFLQFGSAPLFTSGPGSIQDQVLRLCGGENIFATSRVPLAAGEPRTGAGPPAAGDRGDRGCQPHCRSAALLATSAHHFVDCVTQRLV

SEQ ID NO: 12475 - protein, 241 aa, Klebsiella pneumoniae
GKLMQFDPPLQPAILLKRYKRFLADVVTPDGRELTLHCPNTGAMTGCAAPGDTVWYSTSDNAKRKYAHTWELTETQQGAVICVNTLRANSLAKEAISAGIIPELSGYNQLKSEVKYGEENSRIDIMLQADDRQNCYIEVKSVTLAEKEYGYFPDAVTTRGQKHLRELMAVAANGDRAVILFAVLHSAIDRFSPAHHIDARYAQLLTEAQDKGVEILAWKAELSTTRMTLNKPIAVVLNPGK

SEQ ID NO: 12476 - protein, 135 aa, Klebsiella pneumoniae
RPVIHYFDYSMMRIPLIFPLCMVALLSGCQQKPASTLSPAISSQAQLEQLSSVAAGTRYLKNKCNRSDLPADETIYRAAVNIGKARGWGNIDVATLSQNSDRLYQQLLQDSTPEATQCSQFNRQLAPFIASLRSD

SEQ ID NO: 12477 - protein, 120 aa, Klebsiella pneumoniae
RARMFGLVNQLGIDRLFADQNGHAGALGFIILTGDIQDIGANNRTGFCQDLRQAIGIIEFVDIGDVAVALFCRFGVTDIVDTKTQAFGQVVKAVQLQFFQFSSPPYFASRCGQSIMQILW

SEQ ID NO: 12478 - protein, 240 aa, Klebsiella pneumoniae
LKNFRGVMLKLNDVTWLYQHLPMRFTLDVARGERIAVLGPSGAGKSTLLNLIAGFLPPASGSLLINGEVHNATPPAQRPVSMLFQENNLFNHLTIRQNISLGIHPGLKLNREQQAQVTAIAGQMGIDALLERLPGELSGGQRQRAALARCLVRQQPVLLLDEPFSALDPALRQEMLSLVADVCEQQQLTLLMVSHSVEDAARIAPRSMVVAEGRIVWDGATAELLSGHSSASHLMGISAR

SEQ ID NO: 12479 - protein, 557 aa, Klebsiella pneumoniae
QKNVRVPVWLIRRPGPMKLSFQYKLFISLVAFFSVLFIALGIYYYFDASRQLYQEMSARAKIQAEEIALMPNLRQQVSRHDPQAIQAFMQQIAAHSDASFIVIGDRQGVHLFHSVHPEWVGTRLVGGDNQAVLEGKSITTIRKGGLGVSLRSKTPIVDDAGRVIGIVSVGYLTSYLDSITLTKVINIFIAAVLLLIALFIFSWYFTRSIKKQIFSLEPREIGLLVRQQKAMMESIFEGVIVIDRQRRIEVINHAARSLLGLSQPARQLRGQSIDSVISPQPFFASGDMLERDTHDELCRFNQLTVLASRVRIMLENTLQGWVITFRDRNEINALTAQLSQVKRYVDNLRIMRHEQLNRMTTLSGLLHMGHYDEAIRYIQAQSEHAQELLDFISSHFHSPTLCGLLLGKATRAREKGVALSFDPACRIDRPLPSLMESELISIIGNLLDNAIEATQRAELPHEPVEVLIQLNARELIIEVADRGVGIRPDIRERIFERGVTTKTRGDHGIGLYLIEHYVTQAGGTIEVADNAPRGTIFTLFIPADAHACPQPEAHDAS

SEQ ID NO: 12480 - protein, 367 aa, Klebsiella pneumoniae
GNRVMSKNYHIAVLPGDGIGPEVMNQAMKVLEVVRQRFAMHITTSQYDVGGAAIDRQGTPLPQATVAGCEQADAILFGSVGGPKWEHLPPAEQPERGALLPLRKHFKLFSNLRPAKLYQGLEEFCPLRADIAANGFDILCVRELTGGIYFGQPKGREGSGQHEKAFDTEVYHRFEIERIARIAFESARKRRHKVTSIDKANVLQSSILWREIVSEIGKEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADEAATAIENAINRALEEGVRTGDLARGTAAVSTDEMGDIIARYVAEGV

SEQ ID NO: 12481 - protein, 401 aa, Klebsiella pneumoniae
GSAVCRFLRSFYPRLDSLMAEQRPLTIALVAGETSGDILGAGLIRALKARIPNARFVGVAGPLMQAEGCEAWYEMEELAVMGIVEVLGRLRRLLHIRADLTRRFGELRPDVFVGIDAPDFNITLEGNLKKQGIKTIHYVSPSVWAWRQKRVFKIGRSTDLVLAFLPFEKAFYDKFNVPCRFIGHTMADAMPLDPDKGAARDRLGIPHSVRCLALLPGSRGAEVEMLSADFLKTAQLLRATYPDLQVVVPLVNAKRREQFERIKAETAPDMIVHMLDGQARDAMIASDAALLASGTAALECMLAKCPMVVGYRMKPFTFWLAKRLVKTDYVSLPNLLAGRELVKELLQDECEPQALAAALQPLLADGKTSHEMHETFRALHQQIRCNADEQAADAVLELAKQ

SEQ ID NO: 12482 - protein, 383 aa, Klebsiella pneumoniae
LYDVDGKAYIDYVGSWGPMVLGHNHPAIRNAVIEAASRGLSFGAPTEMEVKMAALVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCIPPQPEFLPGLRALCDEFGALLIIDEVMTGFRVALAGAQAYYGVEPDLTCLGKIIGGGMPVGAFGGRREVMDALAPTGPVYQAGTLSGNPIAMAAGFACLNEVAQPGVHETLTELTNQLAQGLLDAARDAGIPLVVNNVGGMFGIFFTDAETVTCYQDVVKCDVERFKRFFHLMLEEGVYLAPSAFEAGFMSVAHSEEDIDNTIDAARRVFAKL

SEQ ID NO: 12483 - protein, 478 aa, Klebsiella pneumoniae
GRGVIVTAAQGHHPFIPLHLILRVQAGLLHPVEDRVREGDLNIRIAVLRIAHADRIRRPVVGIHIVTHPRVVHAGQQRMADRAGGEIRLQLGIDGEGVQVLVGAHVGAIHVARRDIAVAVYGTIERMHIGIAQVLPHGKGVIELMGEAVAHHLLAAGDFIIGLAFVEIGRQLVRLTVGVVIRHHGAFARQPAVVARIRVILEVAQEGEVSFIVRTPAKGGRHRVAGRFRHLLLGILTAAKAGQAIRPDAGIINGVAKVKPGLPQIVGAHLKLHFFQRLGSRALADHADDTARVAVAVQHRGWPAHHFHTLEEVRIHGDFRVVIPLQLHAVQILVGVDGRRGGEAANGDHVIGGRTAASGEDAWRIGERLFYRRRLAHLHLLARHHRHRLRRFFNRGIGFGRRGGAFCRDSRRRSPGAFLGGRGGNDGDGFFLLRLFCCLCVDRHAANRRGYYSCDFTQRVIWLSSFWTRHGYISDESE

SEQ ID NO: 12484 - protein, 68 aa, Klebsiella pneumoniae
AGGVGSRGSKSIKGMTTRNRKLIMIRHAYRHSPAINNSKANNHLPVSVGYYANVQKIKLAKELKCQFL

SEQ ID NO: 12485 - protein, 180 aa, Klebsiella pneumoniae
  UNSURE (40): Identity of amino acid at the above locations are unknown.
RESVMVRTTEPGGRDSRQKVKHQGITRHLFFANFRHGFAXNAQIRCGTRFQTANADLHAAGFAVAEVFVFNFFQRFLDLFDQFTFAVAVTQFQAELFFLGGTVYRVREVSCFILHVRYGAIHFIPELITPCFKNTLEVRQLGFVHILFARFLLVRLHPSDGENTQGRCFTVLPFLHVASP

SEQ ID NO: 12486 - protein, 153 aa, Klebsiella pneumoniae
RSTVAPPGSDTGTSSSVRTSRRRPAAARQSALKSPYAVGFAGSPSSARYAAPSARQSSAGRWSASPPPSGRPPAAAEQSAMTSAPCPPLAPPPRPAAGWLTSDDRAAPAPAAPALPRRYALPSPASHYMSTPRSTSGSAPYADRRWPAASSAA

SEQ ID NO: 12487 - protein, 130 aa, Klebsiella pneumoniae
RVEVMMRNMLQGKLHRVKVTQADLHYEGSCAIDQDFLDAAGILENETIHLWNVTNGNRFSTYAIAAERGSRIISVNGAAAHCASVGDILIIASFVTMSDEEARSWQPNIAYFEGDNEMKRQAKAIPVQVA

SEQ ID NO: 12488 - protein, 91 aa, Klebsiella pneumoniae
HDLVHDQSFEDLMAQGGVIRQLLASLTSIELNRLHQTIDVAFQHDAIIDDGRYFIDHLGGSETGIRDHGDTEKQRFPVLHTFSISINRKCG

SEQ ID NO: 12489 - protein, 87 aa, Klebsiella pneumoniae
AVMVAKRFFSCLHFCSRAMVVGFITFPDDESHINRHSNSSIQRGNDFGQPITTIAANAKKGRGDYQLAGFAAPRLSSTARSAKPSGK

SEQ ID NO: 12490 - protein, 184 aa, Klebsiella pneumoniae
NQMVSIMKHTVEVMIPESEIKARIAELGRQINEHYQNSGSEMVLVGLLRGSFMFMADLCREVQVPHEVDFMTASSYGSGMSTTRDVKILKDLDEDIRGKDVLIVEDIIDSGNTLSKVREILSLREPKSLAICTLLDKPSRREVNVPVEYVGFAIPDEFVVGYGIDYAQRYRHLPYIGKVTLLDE

SEQ ID NO: 12491 - protein, 401 aa, Klebsiella pneumoniae
RRQVHAFLQHQMEEALEAFNVALHHVLIAGDGFGIGKEDAEHAADVIDHQRDPSVTRRIQQALRQLVSQFSQGFMDPRLRHFVQAGEASRHGDRVAGEGARLIDRTGGRQSVHYLTAAAEGTYRHPAADDFPQTGQIRLHAVVSLSACQRHAEAGHHFVDNQQGAKFVAQGAQARQEFRLRRNAVHISGHRLDDDAGDLLRILLERRAHRGEVVISAGQGMFGEIGRDARRVRLAEGQRAGTGFHQQAVGMAVVAAFELNDFVATGEAARQANGAHGGFGTGVHHPHHIHGRHQLGHQGRHFHFHFGRRAKAQAAGCRLDHRIADSRVVVAQHHRTPGTDIIDIGFPIHVIELSAIRALDKQRCASDAGESAHRRVNSAGYQFARSVIQIFRFAHGQGPGS

SEQ ID NO: 12492 - protein, 171 aa, Klebsiella pneumoniae
QRKVMNVSGLLTRWRQFGRRYFWPHLLLGMVAASLGLPALSNGHETAAPAKATASNHNPSKVNFSQLALLETNRRPSFTVDYWHQHAIRTVIRHLSFAMAPQALPVAEETSPLQAQHLALLDTLSALLTQDSTPPVVIRQAGYIPSSYSAFRVSAWISQVAGIRAGPQRLS

SEQ ID NO: 12493 - protein, 247 aa, Klebsiella pneumoniae
SIEVLNMATVSMRDMLKAGVHFGHQTRYWNPKMKPFIFGARNKVHIINLEKTVPMFNEALAELNKIAARKGKILFVGTKRAASEAVKDAALSCDQFFVNHRWLGGMLTNWKTVRQSIKRLKDLETQSQDGTFDKLTKKEALMRTRELDKLENSLGGIKDMGGLPDALFVIDADHEHIAIKEANNLGIPVFAIVDTNSDPDGVDFVIPGNDDAIRAVSLYLGAVAATVREGRSQDLASQAEESFVEAE

SEQ ID NO: 12494 - protein, 479 aa, Klebsiella pneumoniae
ITEVMMSTEIKTQVVVLGAGPAGYSAAFRCADLGLETVIVERYSTLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKSVPKRMLVMGGGIIGLEMGTVYHALGSEIDVVEMFDQVIPAADKDVVKVFTKRISKKFNLMLETKVTAVEAKEDGIYVSMEGKKAPAEAQRYDAVLVAIGRVPNGKNLDAGKAGVEVDDRGFIRVDKQMRTNVPHIFAIGDIVGQPMLAHKGVHEGHVAAEVISGLKHYFDPKVIPSIAYTEPEVAWVGLTEKEAKEKGISYETATFPWAASGRAIASDCADGMTKLIFDKETHRVIGGAIVGTNGGELLGEIGLAIEMGCDAEDIALTIHAHPTLHESVGLAAEVFEGSITDLPNAKAKKK

SEQ ID NO: 12495 - protein, 221 aa, Klebsiella pneumoniae
RYWVMSEAMMWLLLRGVWETLAMTFVSGFFGFVLGLPVGVLLYVTRPGQIVANAKLYRTLSALVNIFRSIPFIILLVWMIPFTRVIVGTSIGLQAAIVPLTVGAAPFIARMVENALLEIPTGLIEASRAMGATPLQIVRKVLLPEALPGLVNTATITLITLVGYSPMGGSVGTGGLGQIGYQYGYIGYNATVINTVLVMLVVLVYLIQFSGDRIVRAVTHK

SEQ ID NO: 12496 - protein, 323 aa, Klebsiella pneumoniae
VRRVNDVSRHEKRYLMTIALELKQLKKTYPGGVQALRGIDLQVEAGDFYALLGPNGAGKSTTIGIISSLVNKTSGQVNVFGYDLEKDVVNAKRQLGLVPQEFNFNPFETVQQIVVNQAGYYGVERKEALSRSEKYLKQLDLWEKRNERARMLSGGMKRRLMIARALMHEPKLLILDEPTAGVDIELRRSMWGFLKDLNDRGTTIILTTHYLEEAEMLCRNIGIIQHGELVENTSMKALLSKLKSETFILDLAPKSPVPKLEGYQYQLVDTSTLEVEVLREQGINSVFAQLSAQGVQVLSMRNKANRLEELFVTLVHERKGESA

SEQ ID NO: 12497 - protein, 88 aa, Klebsiella pneumoniae
RYLLMKRQEDTMRNNILVASALAAAAIMFVAGCSSNQSIKTTDGKTIVTSGKPQVDDDTGLVSYKNAETGRVEQINRDQVKSMDELDN

SEQ ID NO: 12498 - protein, 410 aa, Klebsiella pneumoniae
TTFFVSGWATSLFRSFNWNRYNMRTSQYLLSTLKETPADAEVISHQLMLRAGMIRKLASGLYTWLPTGVRVLKKVENIVREEMNNAGAIEVLMPVVQPSELWQESGRWEQYGPELLRIADRGDRPFVLGPTHEEVITDLIRNELNSYKQLPLNFYQIQTKFRDEVRPRFGVMRSREFLMKDAYSFHTSQESLQETYDAMYAAYSKIFSRMGLDFRAVLADTGSIGGSASHEFQVLAQSGEDDVIFSDSSDYAANIEFAEAVAPKEPRAAATQEMTLVDTPNAKTIAELVEQFNLPIEKTVKTLLVKAVEDSASPAGCPAGARRSRAERSESGKTAAGRQPADLRHRRRDPRPGERRSGLPGPGEHAGSGDYRPYCSSDERFRRWRQHRWQTLLRHQLGPRCRDAGSGRHP

SEQ ID NO: 12499 - protein, 895 aa, Klebsiella pneumoniae
IVFSYGDAMSNSLPDTASPLLPVPPEHPVSWPQGDLNCAAIKAHIDTFQHWLGEAFDSGIVAEQLIAARTEFIDQLLQRLWSACGFESVSDLALVAVGGYGRGELHPLSDVDLLILSRKKLPDDQAQKVGELLTLLWDVKLEVGHSVRTLEECLLEGLSDLTVATNLIESRLLIGDVALFLELQKHIFSDGFWPSEKFFAAKVEEQNVRHQRYHGTSYNLEPDVKSSPGGLRDIHTLQWVARRHFGATSMDEMVGFGFLTEAERNELNECLHQLWRIRFALHLELTRYDNRLLFDRQLSVARRLGYEGDGNQPIEHMMKDFFRVTRRVSELNQMLLQLFEEAILALTEDEKPRPIDDDFQLRGTLIDLRDDTLFIREPQAILRMFYIMVRNSTITGIYSTTLRHLRHARRHLTQPLCYIPEARTLFLSMLRHQGAVSRGLLPMHRHSVLWAYMPQWSHIVGQMQFDLFHAYTVDEHTVRVMLKLESFAKEETRSRHPLCVELWPRLTHPELILIAALFHDIAKGRGGDHSILGAQDVLKFAELHGLNSRETQLVAWLVRHHLLMSVTAQRRDIQDPEVIKQFAEEVQTENRLRYLVCLTVADICATNETLWNSWKQSLLRELYFATEKQLRRGMQSTPDMRERVRHHQLQALALLRMDNINEEALHQIWNRCRANYFVRHTPTQLAWHARNLLRHDLNKPMILLSSQATRGGTEIFIWSPDRPYLFAAVCGELDRRNLSVHDAQIFTTRDGMAMDTFIVLEPDGSPLSADRHEAIRQGLEQTITQRSWQPPAPRRQAAKLRHFSVDTEVNFLPTHTDRKSFLELIALDQPGLLARVGQVFADLGISLHGARITTIGERVEDLFIIATADRRALNNELQQEVQQRLTAALNPNDKG

SEQ ID NO: 12500 - protein, 193 aa, Klebsiella pneumoniae
DKLSRIRNVISDIRKDAEIRMEKCVEAFKNQISKIRTGRASPSLLDGIVVEYYGTPTPLRQLASVTVEDSRTLKINVFDRSMSAAVEKAIMASDLGLNPSSAGSDIRVPLPPLTEERRKDLTKIVRGEAEQARVAVRNVRRDANDKVKALLKEKEISEDDDRRSQDDVQKMTDAAIKKVDAALADKEAELMQF

SEQ ID NO: 12501 - protein, 842 aa, Klebsiella pneumoniae
TGSSEKKAMPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLAEFGVTMIGATADAIDKAEDRRRFDIAMKKIGLDTARSGIAHTMEEALAVAADVGFPCIIRPSFTMGGTGGGIAYNREEFEEICERGLDLSPTSELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFEPKVSLDDPEALTKIRRELKDAGAERIWYIADAFRAGLSVDGVFNLTNIDRWFLVQIEELVRLEEKVAEVGINGLDADFLRTLKRKGFADARLAKLAGVREAEIRKLRDQYDLHPVYKRVDTCAAEFATDTAYMYSTYEEECESNPSVDRDKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVDRLKLKQPANATVTAIEQAVEKAKEIGYPLVVRPSYVLGGRAMEIVYDEQDLRRYFQTAVSVSNDAPVLLDRFFDDAIEVDVDAHLRWRNGADWRHHGAYRAGRRPLRRLRLFPAGLHPEQRDSGCDARAGAEAGLRAAGSRPDERPVRGER

SEQ ID NO: 12502 - protein, 342 aa, Klebsiella pneumoniae
VMPSIRLADLAQQLDAELHGDGDIVITGVASMQSAKTGQITFMVNPKYREHLAACQASAVVMTQDDLPFAHSAALVVRNPYLTYARMAQILDTTPQPAQDIAPSAVIDPSAKLGSNVAIGANAVIESGVVLGDNVVIGAGCFVGKNTKIGAGSRLWANVTVYHEIEIGENCLIQSSTVIGADGFGYANDRGNWVKIPQLGRVIIGDRVEIGACTTIDRGALDDTVIGNGVIIDNQCQIAHNVVIGDNTAVAGGVIMAGSLKIGRYCMIGGASVINGHMEICDKVTVTGMGMVMRPISEPGVYSSGIPLQPNKAWRKTAALVMNIDEMSKRLKAIERKVNQQD

SEQ ID NO: 12503 - protein, 149 aa, Klebsiella pneumoniae
SGNSAYRLASVGMITISRSVALADDEIVLSGIRAQGAGGQHVNKASTAIHLRFDIKASSLPEFYKERLLAASHHLISADGVVIIKAQEYRSQEMNREAAIARLVALIKELTAVQKSRRETRPTRASKERRLASKAQKSSVKALRGKVRQ

SEQ ID NO: 12504 - protein, 281 aa, Klebsiella pneumoniae
LACSVKRKSAGCSISNLLRRIENAMSDNKLNVIDLHKRYGEHEVLKGVSLQAKAGDVISIIGSSGSGKSTFLRCINFLEKPSEGTIVVSGQNIGLVRDKDGQLKVADKNQLRLLRTRLTMVFQHFNLWSHMTVLENVMEAPIQVLGLSKQEARERAVKYLAKVGIDERQQAKYPVHLSGGQQQRVSIARALAMEPEVLLFDEPTSALDPELVGEVLRIMQQLAEEGKTMVVVTHEMGFARHVSSHVIFLHQGKIEEEGHPDALFGAPKSPRLQQFLKGSLK

SEQ ID NO: 12505 - protein, 235 aa, Klebsiella pneumoniae
SVTSALPIWEIINDFTAVSMAIPMLKAEHLIQFGGSAPVAGKPIAVYGAGTGLGVAHLVHVDKRWVSLPGEGGHVDFAPNSEEEGIILEELRAELGHVSAERVLSGPGLVNLYRAIVKSDGRLPENLQPREVTERALADSCTDCRRALSLFCVIMGRFGGNLALTLGTFGGVYIAGGIVPRFLEFFKASGFRGGFEDKGRFKAYVQDIPVYLIVHDNPGLLGSGAHLRQTLGQVL

SEQ ID NO: 12506 - protein, 454 aa, Klebsiella pneumoniae
ANLSRGQAFRDNQRQTQGLAFHAKGEHCAWVDAKLRGIRRVQLDVRLRHPALEHRRALRQLIAAEQMVVRRNSPFALFRLEAGRHRREVLQSAGGRFKQTNARIAVAQFPAHFILELVPCLRGVPARRPGERDLRTRGGRLVVPFHGEGEHRVFILRLTRLVHADVSAHRRAAAVAVRFTRQLLAADAEGRIRRGVFNARQLRQRRNRRINDVVQLSPVNLTVVDGAVQRMQPAPAFQHYGFRVVVSRIVNLEETLGAAFVVHHGTVAFRKACRGEHQVRFVHNRGALMIHHHHQRRFRQRSVNARGGSMTVKVVFQHDNRVCGAAFQFVQRLFKRAAADHAQSDAVNRPGDHGHPDIGAAAFQSFRHVSGGLDDLHAAGVGPGDDQRFFRPGQRLNDNVDFTLQVLAQAVNRRRAVVQRMGNSKAETRLIFYRRAVGPRRDVIQAGVIDVGDE

SEQ ID NO: 12507 - protein, 203 aa, Klebsiella pneumoniae
LRVPMSQSHFFAHLSRLKLINRWPLMRNVRTENVSEHSLQVAMVAHALAAIKNRKFGGQVNAERIALLAMYHDASEVLTGDLPTPVKYFNSQIAQEYKAIEKIAQQKLVDMVPDELRDIFEPLIDEHHYSEEEQSIVKQADALCAYLKCLEELSAGNNEFLLAKGRLEKTLASRRSAEMDYFMQVFVPSFQLSLDEISQDSPL

SEQ ID NO: 12508 - protein, 84 aa, Klebsiella pneumoniae
RKNPTRLAGGTAWPAAGFRRDAAFTAADRGQHRAGYDAHWQAAAAAAGAEGRSGGRGGAAGDFTAGGGGVGAEGTTDQPGGACS

SEQ ID NO: 12509 - protein, 569 aa, Klebsiella pneumoniae
RGAPMHEIFTMMLAVYDRAALMLICLFFLIRLRLFRELLHKSAHTPKELLAVTAIFSLFALFSTWSGVPVEGSLVNVRIIAVMSGGILFGPWVGAIVGAIAGVHRYLIDIDGVTAVPCFITSIVAGLLSGLINRKVAREQRWKIGILAGMMCETLTMILVVVWAPSLSLGVDIVSKIGIPMILGSVCIGFIVLLVQSVEGEKEASAARQAKLALDIANKTLPLFRHVNSDSLRQVCEIIRRDITADAVAITNTEHVLAYVGVGEANYQRHDDMISPTTRQAIRYGKIIIKNNDEAHRTPEIHSLMVIPLWEKGVVTGTLKIYYCHAHRITSTLQEMAIGLSQIISTQLEVSRAEQLREMANKAELRALQSKINPHFLFNALNAISSSIRLNPDTARQLIFNLSRYLRYNIELKDDEQIDIKRELYQIKDYIAIEQARFGDKLTVIYDIDDDVSCVIPSLLIQPLVENAIVHGIQPCKGKGVVTIGINECGNRVRISVRDTGNGIDPAVVARVEADEMPGNKIGLLNVHHRVKLLYGEGLHIRNLTPGTEIAFYVPNNSTPQALTESLLS

SEQ ID NO: 12510 - protein, 408 aa, Klebsiella pneumoniae
LEEPMAESSPERRFTRIDRLPPYVFNITAELKMAARRRGEDIIDFSMGNPDGATPPHIVEKLCTVAQRPDTHGYSTSRGIPRLRRAISRWYEERYNVDIDPESEAIVTIGSKEGLAHLMLATLDHGDTVLVPNPSYPIHIYGAVIAGAQVRSVPLVEGVDFFNELERAIRESYPKPKMMILGFPSNPTAQCVELDFFEKVVALAKQYDILVVHDLAYADIVYDGWKAPSIMQVPGARDVAVEFFTLSKSYNMAGWRIGFMVGNKTLVNALARIKSYHDYGTFTPLQVAAIAALEGDQQCVRDIAEQYKRRRDVLVKGLHEAGWMVECPKASMYVWAKIPEPYAAMGSLEFAKKLLNEAKVCVSPGIGFGDYGDTHVRFALIENRDRTRQAIRGIKAMFRADGLLASAS

SEQ ID NO: 12511 - protein, 715 aa, Klebsiella pneumoniae
IMDTVSAFKLEVRADKIAVITIDAPGEKMNTLKAEFGSQVRGLIRHLRDDKSVRGVVFISAKADNFIAGADINMIARCRSAQEAEALARQGQQIMAEIHGLSIPVIAAIHGACLGGGLELALACHGRICIDDEKTRLGLPEVQLGLLPGSGGTQRLPRLIGVSTALDMMLTGKQLRPRQALKAGLVDEVVPQAILLQAAVELALKGRPTSREVPVRERVLAGPLGRHLLFQFVGKQTQRKTQGNYPAVKRILQVVENGLAHGCSSGYAEEARAFGELAMSPQSQALRSIFFASTDLKKDPGAEAGPGPLRSVAVLGGGLMGGGIAYVTACKGGLPVRIKDIQPRGINHALKYSWDLLNKQVRQRRLRPVERDRQMALISGTTDYQGFAHRDVVIEAVFEDLALKQRMVSEVEQYGGPQTIFASNTSSLPIGDIAAHASRPGQVIGLHFFSPVEKMPLVEVIPHKGTDPQTIATVVQLAKRQGKTPIVVADKAGFYVNRILAPYINEAMRLLVEGEPIEVIDNALVKFGFPVGPIQLLDEVGIDTGTKIIPVLESAFGERFSPPANIIDAILKDDRKGRKNNRGFYLYETKGRKSKKRPDPAVYPLLGIGRPQSRLSAQQVAERCVMMMLNEAARCFDEQIIRSARDGDIGAVFGIGFPPFLGGPFRYMDTIGAGEVAAILQRLAAQFGPRFTPCDTLLRMAEQGTTFWPADERLT

SEQ ID NO: 12512 - protein, 116 aa, Klebsiella pneumoniae
RRNTFRGRKTCTKAAHYMTRGKMMIAEFESRILALIDNMVDHASDDELFAGGYLRGHLTLAVAELEGEGEHSADAVHSRVSQSLEKAISAGELSPPDQILVQGMWHNLYQQAKNQA

SEQ ID NO: 12513 - protein, 78 aa, Klebsiella pneumoniae
VNKTGQDGDKEEYHQHQRRYGKQLDKTIHYSTCSSSSAWQEGGSGGGVFFTGGVDPGLGGSNQLCSSAPQPSPGGGGA

SEQ ID NO: 12514 - protein, 648 aa, Klebsiella pneumoniae
TRRTYCSDQSADAGRDLICACGRENHFANQSTTARSLAGSHHGPFAMVNNMTDLTAHDAAPAWQTRDHLDDPVIGELRNRFGPDAFTVQPTRTGVPVVWVKREQLLEVGDFLKKLPKPYVMLFDLHGMDERLRTHRDGLPAADFSVFYHLISIDRNRDIMLKVALSENDLHLPTFTKLFPNANWYERETWEMFGITFDGHPNLRRIMMPPTWEGHPLRKDYPARATEFDPFELTKAKQDLEMEALTFKPEEWGMKRGTDNEDFMFLNLGPNHPSAHGAFRIILQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLEWMPKRLDSYEKAALRNTILKGRSVGVAAYTAKEALEWGTTGAGLRATGIDFDVRKWRPYSGYENFDFEVPTGGGVSDCYTRVMLKVEELRQSLRILQQCLDNMPEGPFKADHPLTTPPPKERTLQHIETLITHFLQVSWGPVMPANESFQMIEATKGINSYYLTSDGSTMSYRTRVRTPSFAHLQQIPSAIRGSLVSDLIVYLGSIDFVMSDVDR

SEQ ID NO: 12515 - protein, 105 aa, Klebsiella pneumoniae
AIVTITVTTGTVAAGATVITGVVTMNGVITVGIVMTTAGTKAGIKAEIKPGSAAIVLAGTTAMTTAAAGDAARVGAVTVMDMAITNKRKGEPIGSPLLYSASGIN

SEQ ID NO: 12516 - protein, 372 aa, Klebsiella pneumoniae
PFTAPMRLQRRAPPAIARGALYPLLSQHDPALARFFPAAFTFARRMYDALPVMFDHQWCGVTQLGWDEKSTHKIAQMLALNLPPDIACAVTAEQVAGLTGVDTGCGGITYPAGGWLCPQQLTAELLALAATRGLHVHYGYPVETLSAEGDGWLLNQQRYHQAVVLANGHRITGFGQTAQLPVYPVGGQVSHIPTTPRLAALRQVLCYDGYLTPQNPQNQQHCIGASYHRGKTDTTFSEEDQQHNRQRLIDCFPGAEWPQDVDISANDARCGVRCATRDHLPMVGNVPDYAATLTQYASLHEQPDIADSAPVCRNLFMLGALGSRGLCTAPLSAELLAAQMSAEPLPLDSDTLAALNPNRLWVRKLLKGKAVK

SEQ ID NO: 12517 - protein, 242 aa, Klebsiella pneumoniae
FTGAANGPAVSGGLIGSLRVKTNMDLIHFLIDFILHIDVHLAELVAQYGVWVYAILFLILFCETGLVVTPFLPGDSLLFVAGALSALPTNDLNVHLMVLLMVIAAIVGDAVNYTIGRLFGEKLFSNPNSKIFRRSYLDKTHSFYERHGGKTIILARFVPIVRTFAPFVAGMGHMSYRHFAAYNVVGALLWVLLFTYAGYLFGDLPVVQENLKLLIVAIIVLSVLPGVIEIIRHKRAAAKQAK

SEQ ID NO: 12518 - protein, 243 aa, Klebsiella pneumoniae
RLVAWLPGRLRNFSRVAQLHLYSNSLRPTTAGNIMIDLYYAPTPNGHKITLFLEEAELAYRLIRVDIGKGEQFHPQFLAISPNNKVPAIVDHMPADGGAPLSVFESGAILLYLAEKSGKLLSGELRERYVTLQWLFWQVGGLGPMLGQNQHFSHSAPQTVPYAIERFQVETQRLYGVLNQRLGCSPWLGGDHYSIADIAAWPWVNCHVRQSIDLANYPAVHNWYERIKQRPATAEAMLKIQLY

SEQ ID NO: 12519 - protein, 96 aa, Klebsiella pneumoniae
AYYFMSKCMGISCPCYSILLREKVTCLTSDCDKARNVSKLPAFSAIESGRIILPLTPERGIHIMPPVNTTRFTLRGYSSAGRALAWHARGQRFDPA

SEQ ID NO: 12520 - protein, 392 aa, Klebsiella pneumoniae
CMSAVTETTSNSSANFSLFRITFAVFLTYMTVGLPLPVIPLFVHQELGFGNTVVGVAVGIQFLATVLTRGYAGRLADQYGAKRSVLQGMLACALAGAAWLAAALLPLPVLARLGLLLLGRLILGFGESQLLTGNLSWGMGLVGPARSGKVMSWNGMAMYGSLAVGAPLGLLIYSHFGVAVLACVTMGLPLVAWLINGTVRKVAAHGGERPSLWSVIGMIWRPGIGLGLQGVGFAVIGTFVSLYFASHSWPMAGFTLTAFGGAFVLMRVLFGWMPDRFGGVKVAMVSLLIEAVGLTLLGLAPNAWLALAGAALTGCGCSLIFPSLGVEVVKRVPAQVRGTALGGYAAFQDISYGLTGPLTGLLATSLGYSSVFLAGALCAALGILVTLISFRR

SEQ ID NO: 12521 - protein, 637 aa, Klebsiella pneumoniae
LQTAAAAATVLHRLISRGACLVNHSSSADKTGCVYVYTKQCSAWSTLLFLRNYCFTLPLSPPIWTGGSLIQYSNYTCTKMRIMDMQPTYTIGDYLLDRLVDCGIDRLFGVPGDYNLQFLDRVIAHSALGWVGCANELNAAYAADGYARIKGAGALLTTYGVGELSALNGIAGSYAEHIPVLHIVGAPSTGAQQRGELLHHTLGDGDFRHFARMSEQITCSQALLTAGNACHEIDRVLRDMLTHHRPGYLMLPADVARAAAIAPAQRLLVEPAPADENQLAGFCEHASRLLRGSRRISLLADFLAQRYGLQKTLREWVAKTPVAHATMLMGKGLFDEQQSGFVGTYSGIASAPQTREAIENADTIICIGTRFTDTITAGFTQHLAREKTIEIQPFAVRVGDHWFSGVPMDKALAALMTLSAPLAAEWATPQVVAPEAEEGAEGELTQKNFWATVQGALRPGDIILADQGTAAFGIAALKLPSEASLIVQPLWGSIGFTLPAAYGAQTAAAERRVVLIVGDGAAQLTIQEMGSMLRDKQKPLILLLNNEGYTVERAIHGPEQRYNDIALWDWQRLPEAFAPDVASRCRRVTQTSELREAMTESITSDTLTLVEVMLPKMDIPDFLRAVTQALEERNSRV

SEQ ID NO: 12522 - protein, 262 aa, Klebsiella pneumoniae
LYAAGADGVAVVMSGEKMKVIIVEDEFLAQQELSWLINTHSQMEIVGSFDDGLDVLKFLQHNKVDAIFLDINIPSLDGVLLAQNISQFAHKPFIVFITAWKEHAVEAFELEAFDYILKPYQESRIINMLQKLTTAWQQQNNAASGLASAAPRENDTINLIKDERIIVTSIHDIYYAEAHEKMTFVYTRRESFVMPMNITEFCSKLPTAHFFRCHRSYCVNLSKIREIEPWFNNTYVLRLRDLEFQVPVSRSKVKEFRQLMNL

SEQ ID NO: 12523 - protein, 408 aa, Klebsiella pneumoniae
TLSALGGTAVMTQALRQNLTLAVLVLTGINMRPLLTSIGPLLPDIRAASGMSYTLAALLTALPVIAMGVLALAAGWVDRYIGQKRSIALSLLIIAAGALLREIAPNSGLLLTSALAGGIGIGIIQAAIPAVIKHLFPRRTPLVMGLWSAALMGGGGLGAAFTPWLASHSAAWHDALAWWALPALLALLSWLAICRQLPRAPHQTSASPRVAIIGQRRAWTLGLYFGLINAGYASLIAWLPPYYIQLGDSAQYSGSLLALLTVGQTAGALLLPALARQEDRRQLLLLALALQLIGFCGFIWLPEHFSALWAIACGVGLGGAFPLCLVLALDHAGQPAVAGRLVAFMQGIGFIIAGLSPWLSGLLRSLSGNYTLDWSWHAICVLLLMALTLRFIPAHYPAEWRQRASDLP

SEQ ID NO: 12524 - protein, 112 aa, Klebsiella pneumoniae
IRPAAAANVACRCDGGSDAGLCADPRRDHGHRGRLSDRPYPRPVPDDAGSAASGRYRRGGHPGVGGLRRASADRYQTRSRLLYHEPDWLHVPRAGRAGMGRGDFPPDDSRVL

SEQ ID NO: 12525 - protein, 197 aa, Klebsiella pneumoniae
CWKAGAGCIRCTAPSTTVRLTGLSWTTSLMRRLRRCRSWRALKTPRRMRPSASAARSWRVNRTATAAARRCALTSACTSRVSRRIKTRCSPSPWKGTTSRPPRVRRSRSPGRRAGTPRRHGTSSRMKWAGNCATAIRAFVCLKRPPADWSTSRRCRPASRRKRANGELRRTTICSAAMSCLSARRCSRAGCLSRTSS

SEQ ID NO: 12526 - protein, 451 aa, Klebsiella pneumoniae
PAGAVQMKTVIRTAETHPLTWRLRDDKQPVWLDEYRSKNGYEGARKALTGMAPDEIVTAVKDAGLKGRGGAGFSTGLKWSLMPKDESMNIRYLLCNADEMEPGTYKDRLLMEQLPHLLVEGMLISAFALKAYRGYIFLRGEYIEAAQHLRRAIAEATEAGLLGKNILGTGFDFELFVHTGAGRYICGEETALINSLEGRRANPRSKPPFPASSGVWGKPTCVNNVETLCNVPAILANGVEWYQNISTSKDAGTKLMGFSGRVKNPGVWELPFGTTAREILEDYAGGMRDGLKFKAWQPGGAGTDFLTEAHLDLPMEFESIGKAGSRLGTSLAMAVDHEINMVSLVRNLEEFFARESCGWCTPCRDGLPWSVKILRALERGEGQPGDIETLEQLCRFLGPGKTFCAHAPGAVEPLQSAIKYFREEFEAGIKQQFSNTHAINGIQPNLLKTRW

SEQ ID NO: 12527 - protein, 183 aa, Klebsiella pneumoniae
ISLLTYETRDVPSSHDPQHISPLTSFYAGVTMSAHDHYLQRALVLAKQNIADGGRPFGAVLVRNDEIVAESVNTFHLSGDPTAHAELNAVRDLAARLGSAVLRECVIYASGQPCPMCLSALYLTGVREVFFANSNQDGEPFQLSTAAIYQQLQQPLAQQTLPIHHRPQPEGTELYQRWAERQS

SEQ ID NO: 12528 - protein, 429 aa, Klebsiella pneumoniae
PSILTGIMEKDPIPQATSPLATWLSYLEHLHSKTIDLGLARVSEVAGQMDIVKPAPFVFTVAGTNGKGTTCRTLETILMAAGYKVGVYSSPHLVRYTERVRIQGAELPEAAHTASFAEIEAARGDISLTYFEYGTLSALWLFKQAQLDVVILEVGLGGRLDATNIVDADVAVVTSIALDHTDWLGPDRESIGREKAGIFRAGKPAVVGEPDMPLTIAEVASEKGALLQRRGVDWRYEVEGETWSFRDTAGALSHLPLPQVPLPNAATAVAALRASGLAVDDAILRAGIRDAMLPGRFQIISDAPRVILDVAHNPHAAAYLAGRLKTLAKTGRVLAVIGMLHDKDIAGTLANLAPEVDAWYCAPLEGPRGATAEQLVEHLRCGTVYSSVAQAWRAPMADAKVEDTVLVCGSFHTVAQVMEEIDAGRIGGE

SEQ ID NO: 12529 - protein, 285 aa, Klebsiella pneumoniae
AGPYRLDSNWSFGLGFDAVYAKAKIERYAGDLGQIVAGSGALPPALAGQVAKIPADTQIAHLNGNAWGFGWNAGILYELDKNNRYGLTYRSEVKIDFDGNYRSSLPAAYNQILGNFGLPAGTSGQTTNGSLTLNLPEMWELSGYNRVAPQWAVHYSLTYTSWSQFQELKATGSNGQTLFYKEEGFKDAYRLALGTTYYYDDNWTFRTGIAFDDSPVPANNRSISIPDQDRLWLSAGTTYAFNKDASVDVGVSYMHGQHVEIKEGPYTFRSEGTAWLYGANFNYRF

SEQ ID NO: 12530 - protein, 481 aa, Klebsiella pneumoniae
AMRYCVFHGLSRPFCWWYITKTFSQGVQSEYSLSFVLSVLISFTICLFYMADIYARSDRNKRRWRSQAEEDPLTGLPNLRALESHLQSCPQQAICSLRIDNLDFLSRHYGLMMGVDCKRQIIRALQPLLGAADKVFQVPGSELILVLDGPEPSSRLNHMVAVLNHKKFSWHNQPLDLEFGAAWGRDDGQGEGLYQMLGQLSWLSEQAGSERRVLALDEEQDLVVDQTTEQVRLLMRVKQVLKDRALMLYAQPIQNPEGEGYHEILTRMRCGDSVIMPDRFIPLIVQFNLSQRFDMLVLETLFSMLHKHPGQRFSVNLLPATLMQKNSAGQIIALFQRYSVSPELITIEVTEEQAFSNADTSRQNLEALRAFGCAIAIDDFGTGYANYERLKHLQADIIKIDGCFVRDILTDPLDAIMVKSIVEMARAKQMSVVAEYVESEPQKARLLELGVNYLQGYLIGIPQPLGECQAKKSRALPGSDD

SEQ ID NO: 12531 - protein, 422 aa, Klebsiella pneumoniae
QRLYFQRQKMTSSRVENSSSRAARKVKLALMGPAFVAAIGYIDPGNFATNIQAGASFGYQLLWVVVWANLMAMLIQVLSAKLGIATGKNLAEQIRDHYPRPVVWFYWVQAEIIAMATDLAEFIGAAIGFKLVLGVSLLQGAVLTGVATFLILMLQRRGQKPLEKVIGGLLLFVAVAYVVELIFSQPALAPLTKGLVIPTLPNGEAVFLAAGVLGATIMPHVIYLHSSLTQHLHGGTRKERYNATRWDVAIAMTIAGFVNLAMMATAAAAFHFNGHTGVADLDQAYMTLEPLLSHAAATIFGLSLIAAGLSSTVVGTLAGQVVMQGFIRFHIPLWFRRAITMLPSFVVILLGLDPTRILVMSQVLLSFGIALALVPLLIFTSNAKLMGDLVNTRWVRGIGWAIVAIVVSLNGWLIVGSLLGVD

SEQ ID NO: 12532 - protein, 229 aa, Klebsiella pneumoniae
SNYQRLREVPVQCKGFLFDLDGTLVDSLPVVERSWCKWGDRFAIDHDEILSFIHGKQAITSIRHFMPGRSEEDIQAEFRYLEQIEATDIEGIVALPGALALLNTLNEAGIPWAIVTSGSIPVAHARHRAAGLPMPEVFVTAEQVKHGKPAPDAYLLGAERLGLPAGECAVVEDAPAGLLSGLAAGCRTIAVNVPADAPRLDEADLVLSSLEDLVVERQTDGVVNVRLKA

SEQ ID NO: 12533 - protein, 118 aa, Klebsiella pneumoniae
RRHHMLAIAGDQVQRLRLQQLGRCPARLRQLEEDIDIEARLVAGVPAVKAPARRHPHVANQHGSHSFIVHLITQALNKLNQIRMTEVATLIGTHHLIAGGTQGERLGANDTAIGKRAD

SEQ ID NO: 12534 - protein, 268 aa, Klebsiella pneumoniae
NDSLSRIVMKKLALSLSLALALSSVSTVFAAIPQKIRIGTDPTYAPFESKNAQGELVGFDIDLAKELCKRINTQCTFVENPLDALIPSLKAKKIDAIMSSLSITEKRQQEIAFTDKLYAADSRLVVKKGSPVTPDLATLKGKRVGVLQGTTQETYGNEHWAPKGIEIVSYQGQDNIYSDLTAGRIDAAFQDEVAASEGFLKQPIGKDYQFGGPSIKDEKLFGVGTGMGLRKEDNELREALNKAFAEMRKDGTYDKLAKKYFDFNVYGE

SEQ ID NO: 12535 - protein, 413 aa, Klebsiella pneumoniae
CDLQRYLMKRAVITGLGIVSSIGNNQQEVLASLREGRSGITFSQELKDSGMRSHVWGNVKLDTTGLIDRKVVRFMSDASIYAYLSMEQAVADAGLAPEAYQNNPRVGLIAGSGGGSPKFQVFGADAMRSPRGLKAVGPYVVTKAMASGVSACLATPFKIHGVNYSISSACATSAHCIGNAVEQIQLGKQDIVFAGGGEQLCWEMACEFDAMGALSTKYNDTPEKASRTYDANRDGFVIAGGGGMVVVEELEHALARGAHIYAEIVGYGATSDGADMVAPSGEGAVRCMQMAMHGVDTPIDYLNSHGTSTPVGDVKELGAIREVFGDNSPAISATKAMTGHSLGAAGVQEAIYSLLMLEHGFIAPSINVEELDEQAAGLNIVTKPTDAKLTTVMSNSFGFGGTNATLVMRKYNA

SEQ ID NO: 12536 - protein, 82 aa, Klebsiella pneumoniae
ISVHILCNGFKENEINCTLLQGTVTNGKNSDPTSTFVMLRKGFKSCILVLLLIAGWISFSDARISFPASYCSLLSQQSLSPF

SEQ ID NO: 12537 - protein, 326 aa, Klebsiella pneumoniae
IMTHPLADMPDRPPGRGPSGTAATGEPSLSMQQRTVLERLITRLVALTSQQNAEVWACVKHDLGLKGDSPLLACHFSAAEASLNQRLAAAQDNHHHRQTLAQLSDLLGQGNNRQAVSDYIRQHYGQTALHALSQTQLETILHLLQHGQLSIPQPQQRPPTLRPLLPAEHNTLNQLVTKLAAATGEPSKLIWQSMLELCGVKSGELIPATHFLPLSYWLQARQTLSAQSAPTLTSLQGALKQPLEAAEWQTIVDFASRSWQVTPRTTLSPAQILALLNKVFVLRVARAQETLAIPQEEPVARRTWSVKPWQLALGAVVLLLVLWLLL

SEQ ID NO: 12538 - protein, 420 aa, Klebsiella pneumoniae
LPRQGVAITAKRSRFMSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLQEIVEIARQHNLIIFADEIYDKILYDEAQHHSIAALAPDLLTVTFNGLSKTYRVAGFRQGWMVLNGPKKHAKGYIEGLEMLASMRLCANVPAQHAIQTALGGYQSISEFIIPGGRLYEQRNRAWELINDIPGVSCVKPKGALYMFPKIDAKRFNIHDDQKMVLDFLLQEKVLLVQGTAFNWPWPDHVRIVTLPREDDLEMAISRFGRFLSGYHQL

SEQ ID NO: 12539 - protein, 358 aa, Klebsiella pneumoniae
CLLNAPAGYSGGAALFLELTTMSEGWNIAVLGATGAVGEALLETLAERQFPVGEIFALARNDSAGEHLRFGGKSVIVKDAAEFDWTQAQLAFFAAGVEASAAYVEEATNAGCLVIDLSGLFALEPDVPLVVPDVNPFVLGDYRNRNLIAVPNSLTSQLLTALKPLIDQGGLSRISVTNLLSASGQGKKAVDALAGQSAKLLNGIPIDEDDFFGRQLAFNMLPLLPDREGSVREERRIVDEARKILQDDGLMISASVVQSPVFYGHAQMVSFEAMRPLAAEEARDAFTRGEDIELSEEGEFPTQVGDASGNARLSIGCVHNDYGMPEQIQFWSVADNVRFGGALMAVKIAEKLIEEYLY

SEQ ID NO: 12540 - protein, 135 aa, Klebsiella pneumoniae
YQVNRPLTAPIVKEKSMFRSLILAAVLLAAGPLVANAGEITLLPSVKLQIGDRDNYGNYWDGGSWRDRDYWRRHYEWRDNRWHRHDNGWHKGWYKGRDKAWERGYRAGWNDRDDHRGGWGRGPGGRGHGHGHGHH

SEQ ID NO: 12541 - protein, 364 aa, Klebsiella pneumoniae
WQCKAIITQKKQCTPRRTLFSVNVYTSCFVGGGRMVYQASTTRYQTMEYRRCGRSGLQLPAISLGLWHNFGDETRVETSRQMLLHAFDLGITHFDLANNYGPPPGSAESNFGRILKESLLPYRDELIISTKAGYTMWDGPYGDWGSRKYLVASLNQSLKRMGLEYVDIFYHHRPDPQTPLMETMRALDHLVRQGKALYVGISNYPLAQAREAVKILNDLGTPCIIHQPRYSMFERGVEEGLLDFLQTEGIGSIAFSPLAGGQLTDRYLNGIPADSRAASSSRFLQPEQLTPARLEKIRQLNRQAEARGQKLSQMALAWVLREEKVTSVLIGASKTAQLDDAVGMLQNRHFTTEECAAIDAILAL

SEQ ID NO: 12542 - protein, 103 aa, Klebsiella pneumoniae
RSRNGMTKFALVGDVGGTNARLALCDLASGEISRAKTYSGLDYPSLEAVVRVYLEEHQVTVNEGCIAIACPITGDWVAMTNHTWAFSIAEMKRNLGFAHLGDN

SEQ ID NO: 12543 - protein, 289 aa, Klebsiella pneumoniae
TSFNVLLQSLTSLRAEALSFRHGWQLAIAIKTRETSMNYRLSALALGATLLVGCASSSSGDRPQGRSDPLEGFNRTMFNFNFNVVDPYVLRPVAVAWRDYVPQPARNGLSNFTSNLEEPAVMVNYFLQGDPYKGMVHFTRFFLNTILGMGGLIDVAGMANPQLQRVEPHRFGSTLGHYGVGYGPYVQLPFYGSFTLRDEGGDMADGLYPVLSWLTWPMSIGKWAVEGIETRAQLLDSDGLLRQSSDPYILMREAYFQRHDFIANGGKLTPADNPNAQAIQDELKDIDSQ

SEQ ID NO: 12544 - protein, 70 aa, Klebsiella pneumoniae
PFVNFNKSFHNINLHWNLFINIKCPFLRNNLAYCSVLVLLNRVRFRRKSKIPSILTGFSLDSSPQRGVFS

SEQ ID NO: 12545 - protein, 229 aa, Klebsiella pneumoniae
KRGNKMDYTLTRIDPNGENDRYPLQKQEIVTDPLEQEVNKSVYMGKLEHALHDMVNWGRKNSIWPYNFGLSCCYVEMVTSFTAVHDVARFGAEVLRASPRQADLMVVAGTCFTKMAPVIQRLYDQMLEPKWVISMGACANSGGMYDIYSVVQGVDKFIPVDVYIPGCPPRPEAYMQALMLLQESIGKERRPLSWVVGDQGVYRANMQSERERKRGERIAVTNLRTPDEI

SEQ ID NO: 12546 - protein, 377 aa, Klebsiella pneumoniae
RLKKQHANITKKIGAVMAGNTIGQLFRVTTFGESHGLALGCIVDGVPPGIPLTEADLQHDLDRRRPGTSRYTTQRREPDQVKILSGVFEGVTTGTSIGLLIENTDQRSQDYGAIKDLFRPGHADYTYEQKYGLRDYRGGGRSSARETAMRVAAGAIAKKYLAAKFGIVIRGCLTQMGDIPLAIKDWDQVEQNPFFCPDPDKIDALDELMRGLKKEGDSIGAKVTVVADGVPPGLGEPVFDRLDADIAHALMSINAVKGVEIGDGFEVVKLRGSENRDEITKAGFQSNHAGGILGGISSGQQIVANIALKPTSSITVPGHTINRFGEEVEMITKGRHDPCVGIRAVPIAEAMLAIVLMDHFMRQRAQNGDVTTTIPRW

SEQ ID NO: 12547 - protein, 191 aa, Klebsiella pneumoniae
QNVKRLIIGISGASGAIYGVRMLQVLRDVPDIETHLILSQAARQTLAMETDYSVREVQALADVVHDARDIAASISSGSFKTAGMVILPCSMKTLSGIVHSYTDGLLTRAADVVLKERRPLVLCVRETPFHLGHLRLLVQAAELGAVIMPPVPAFYHRPQSLDDVINQTVNRVLDQFDISLEHDLFTRWQGA

SEQ ID NO: 12548 - protein, 72 aa, Klebsiella pneumoniae
TGSKWDCYCGAVYRDAHRWRYRELCDRPAGGEDRFVGNRQGIGDLLRRATWGADHRRYPVLPGHLYRDGEER

SEQ ID NO: 12549 - protein, 66 aa, Klebsiella pneumoniae
TSSKLLLFTGIRDGSNDGAAASPARTSSAAPSGGCEGNAWVAAGNISGSSRSPGFGTSGIAANSSW

SEQ ID NO: 12550 - protein, 491 aa, Klebsiella pneumoniae
GAENHVVFQLLTRDRFGHAFVLTQFDQATHIAFANHFRIDDFNAGAKLNALGRGYAVDLIRVTQQDAGGDPAFGANRRRFHGTRFVAFRQNDTFAGFARQLGQLVAEGWRRETAAALGGRGQRFDPVGVDVVGHVFLNFLDTLVIVNRYFEVKALQAQGGLPGVGVDHEYRQAGRESAFTQLADARVHFIAAGQQNGADFHAVHCRQAGRNQHVRTVCGGNQQRTRAEVFQHVRDAARAESHGFHAAGIDIAFVDDGRIQMVRHVDRAGRDQIEAPWHCAQHRQRAAFLQLSRVNLHDFCFRRVVENFRQVRTGTALIVDRGIQFVDDNAGDAGIFGAAKAVTGQFDTLVQLFWRVGALRHHEDDFSVQRFGDFKVQRLGELMLTGRYQAFHQHHFRVLSIRVVVGNDLFHQHIFLIAGEQRLNMAHLQRFSGGGGGGAGANDGGGLVWGIATGTRLGDRFKDAQTNAFAFHSADHTEADAGQTYAGTGRN

SEQ ID NO: 12551 - protein, 239 aa, Klebsiella pneumoniae
PVIEIIQEYWKSLLWTDGYRFTGVAITLWLLISSVVMGGILAVFLAIGRVSSNKFIQFPIWLFTYIFRGTPLYVQLLVFYSGMYTLEIVKGTELLNAFFRSGLNCTVLALTLNTCAYTTEIFAGAIRSVPAGEIEAARAYGFSSVKLYRCIILPSALRIALPAYSNEVILMLHSTALAFTATVPDLLKIARDINSATYQPFTAFGIAAVLYLIISYVLISLFRKAEKRWLQHIKPSSTH

SEQ ID NO: 12552 - protein, 77 aa, Klebsiella pneumoniae
YAVDLYCNRYPKFNQCGINFYDVSLLSNADDYQSALRATFLAAGMFTVAGTAISLLYPILVYRVGGDINAIVCAVSV

SEQ ID NO: 12553 - protein, 508 aa, Klebsiella pneumoniae
RTVEGRKKARRPFGTAGPRRVNGLTLVVHLEVFDFVLQLDRFGIIVTQGVKIVEVLLVDIPGHIYAVEHRAFKLLNIRVLRAHRVDQIVEILENQAVGANDLADLIHFAAMGDQFVGGRHIDTVHVRETNFRRSGGEIHFFRPCFTRHLNDLLRGGAAYNGIIDQQHVLIAEFRTVGVELTANRFTTQLLTGHDKRPADVAVLHEALTIRFVENAGDFQRDVAGGLRDRNNNVNIQIFPLASNLFAQLSPHVDAGAVDGNFVNKRVRTGKIDVLEQARVADRIIGTLTGIELALLGNIDRFARRDIAQEFKTKRIKGHALRGHHILGATVANVTFTQHQRTNAVRVAEGHHAMPDDHRHARVRAANQAVGRRNRREDVVRFQRVVTEVIQLTGENIEEDFGIRGGIDMAAFFFKQLFTQLVRIGQVAVMRQCDAIRRVNVKRLRLGGAGAARRRITHVANTHIALHTLHVAGLEYVAYQPVSLTQPEAVVGINGDDASGILSTVLEHR

SEQ ID NO: 12554 - protein, 96 aa, Klebsiella pneumoniae
HLSEEFILCRPSTRHALRYGAIAQLGERLHGMQEVSGSIPLSSTKFCTQRIWFVKKSCGAIAQLGERLHGMQEVSGSIPLSSTKIQNPRFGGGFCF

SEQ ID NO: 12555 - protein, 234 aa, Klebsiella pneumoniae
TRGESVASKFQNRLVGTIVLVALGVIILPGLLDGQKKHYQDEFAAIPLVPKPGDRDEPDMLPAATQALPSQPPEGAAEEVRAGDAAAPSLDPSRIPVNSNSFDDVQEPVVAAKPQPKPQPKPQPQQQASTPTPPPAKPQQQQPPQQQAALPAPTGKAYVVQLGALKNADKVNEIVGKLRASGFKVYTSPSTPVQGKITRILVGPDASKDKLKGQLGDLQQISGLSGVVMGFTPN

SEQ ID NO: 12556 - protein, 312 aa, Klebsiella pneumoniae
CLLEFLIGGPMLLRQLSYFIVVAEHCGFSRAAAALHVSQPALSQQIRQLEAMLEVQLFDRSGRRIRLTDAGEIWLEYARRALRELEEGRRALHDAEDLQHGKLRIAMTPTFTTYMLGPLMEAYYRRYPGVKVLIQEMNQERMEAMLLEDELDVGIAFDDCRSQEIVVQPLLTETLALVVSRAHPLAGERDLQLQALDAQPLILLSSEFATREQIDRYCRLHRLEPDVRMEANSIGAVLSVIRSTTLATLLPAAIAGQFDDVVAIELRPALLQRTACLLQRQGAWQSAAAREFITLARENAITIEQENRQSLA

SEQ ID NO: 12557 - protein, 193 aa, Klebsiella pneumoniae
FTTENAYKRRRMIYAPSLFHALPCYRSHNMEMTNAQRLILSNQYKMMTMLDPDNAERYRRLQTIIERGYGLQMRELDREFGQLTEETCRTVIDIMEMYHALHVSWTNLKDAAGIDERRVTFLGFDAATEARYLGYVRFMVNVEGRYSHFDAGTHGFNSQTPMWEKYQRMLSVWHACPRQYHLSSNEINQIINA

SEQ ID NO: 12558 - protein, 452 aa, Klebsiella pneumoniae
PVKDAPDIRCHLNFIVSAPFASTVSADEGKVVLQHFYKDISMLHPRARTMLILSVPAILIGIACSLILIVAMKVAALLQRVLWSNLPAQLGVSADSPLWIIAMLTATGIAVGLVIRYSPGHAGPDPATESLIGAPIATGALPGLLAALILGLAGGVSLGPEHPIMVVNIALAVAVGSRLFPRVSSLDWTILAASGTIGALFGTPVAAALIFSQTLNSSNDTPLWDRLFAPLLAAAAGALTTGLFFHPHFSLPIPHYGQMRFVDILSGIIVALIAIAVGMVAVWCLPRLHALMHRLKNPILTLGIGGLLLGIVGTIGGPLTLFKGLDEMQQLAFSQTLTAADFLLIALVKLAALVLASASGFRGGRIFPAVFVGVALGLMLHAHVDAVPAAITVSCAILGMVLVVTRDGWLSLFMAAVVVPDTTLLPLLCMVMLPAWLLLAGRPLMIAKRHTD

SEQ ID NO: 12559 - protein, 186 aa, Klebsiella pneumoniae
GRLFFLRIDCFMTTITTPRLSLTRFVTDDWPFFLRLRQDPQVMRFMGEVLSEEALRSVFVSRCADPGVFVLRDKFGEALGDIGLRISPKNPHEADVGYALLPQAQGKGYASEALRAVCEYGFTTLGVQAINAWVLGENRGSSRLLEKQGFVRTQVLEKAYHLNGVDYDDWIYRLEREAHPASADAG

SEQ ID NO: 12560 - protein, 178 aa, Klebsiella pneumoniae
YRFCYVRRGPLIMHENQQPQTEAFELSAAEREAIEHEKHHYEDPRAASIEALKIVQKQRGWVPDGAIYAIADVLGIPASDVEGVATFYSQIFRQPVGRHVIRYCDSVVCHITGYQGIQAAIEKKLNIKPGQTTFDGRFTLLPTCCLGNCDKGPTMMIDEDTHSHLTPEAIPDLLEQYK

SEQ ID NO: 12561 - protein, 97 aa, Klebsiella pneumoniae
RLKLIGKIVAVIDLFLQQTLRSNLGNFLALRAVNNSVLFDLPRAGHQLTEQRLILLAKRCLLFHCPLSFILCASLPDSISLRARKTCFFPRPLSQEC

SEQ ID NO: 12562 - protein, 356 aa, Klebsiella pneumoniae
FTRLNIPSGKENLFFPPPLIARMLIYRRLHGTLAAEFIAECALEDVVDKIFVDEAVNELHTIQDMLRWAVSRFSAANIWYGHGTDNPWDEAVQLVLPSLYLPLDIPEDMRTARLTSSEKHRIVERVIRRVNERIPVAYLTNKAWFCGHEFYVDERVLVPRSPIGELINNQFAGLINHKPQHILDMCTGSGCIAIACAYAFPEAEVDAVDISPDALAVAEHNVESHGLIHHVTPIRSDLFRDLPKLQYDLIVTNPPYVDEEDMADLPEEYEHEPVLGLASGSDGLKLTRRILGNAPDYLSDDGILICEVGNSMVHLMEQYPDVPFTWLEFDNGGDGVFMLTKQQLIDARAHFGIYKD

SEQ ID NO: 12563 - protein, 71 aa, Klebsiella pneumoniae
LADCLGLARQTINCWVPEKQGGTEALPGVKRGRTPTGGYGPTRTASFDQQSLPKPFVYRQLFSRNPRGIPW

SEQ ID NO: 12564 - protein, 228 aa, Klebsiella pneumoniae
DRLCWIIVLSTTLEEAMSQPVITLWSDADFFSPYVMSVYVALQEKSLPFTLKTVDLNRGEHLQAGWTGYAATRRVPLLEVDDFALSESSAITEYLDERFAPPEWERIYPHDLQKRARARQIQAWLRSDLMPIREERSTAVVFGGAKMPDLSEAGRQSAEKLFATATMLLAHGGQNLFGEWSIADADLALMLNRLVLNGDKVPEALADYASFQWQRASIQRYVALSAKR

SEQ ID NO: 12565 - protein, 166 aa, Klebsiella pneumoniae
QKRCNMQVFIMRHGDAALDAASDSVRPLTVCGCDESRQMATWLKGQKVDIERVLVSPYLRAEQTLDIVGECMNLPKHVDVMPELTPCGDVGMVSAYLQALANEGVATALVVSHLPLVGYLVSELCPGETPPMFTTSAIACVTLDADGKGEFLWQKSPCNLKMANAI

SEQ ID NO: 12566 - protein, 119 aa, Klebsiella pneumoniae
NSMLKERMTPEEIAHLTGYSRQTINKWVRKEGWQTSPRPGVQGGKTRLVHVNEQVREFIRSAQRVAETPGIYSPHDSDLESLLLTLNKELTPSEQKQLMSLLLREGITGLLLRLGIRDR

SEQ ID NO: 12567 - protein, 177 aa, Klebsiella pneumoniae
NAPRTGRQGVNRGTYMVWIDYAIMAVLGLSCLVSLIRGFVREALSLVTWGCAFYVASHYYADLSVWFTGFEDERVRNGIAIAALFIVTLIVGAIVNYVIGQLVEKTGLSGTDRVLGICFGALRGVLIIAAILFFLDTFTGMAKSDDWHQSQFIPYFTPVIRWFFEYLQSSSSFLPKV

SEQ ID NO: 12568 - protein, 733 aa, Klebsiella pneumoniae
LAVLFCIPPDTGGNERGYTVSRTIMLIPTGTSVGLTSVSLGVIRAMERKGVRLSVFKPIAQPRSGGDAPDQTTTIVRASSSTTTAAEPLKMSHVESLLSSNQKDVLMEEIIANYHANTQDAEVVLVEGLVPTRKHQFAQALNFEIAKTLNAEIVFVMSQGTDTPEQLNERIELTRNSFGGAKNTSITGVIVNKLNAPVDDQGRTRPDLSEIFDDSSKAKIVKIDPAQLQKGSTLPVLGAVPWSFDLIATRAIDMAHHLNATIINEGDINTRRVKSVTFCARSIPHMLEHFRPGSLLVTSADRPDVLVAACLAAMNGVEIGAILLTGGYEMDARISKLCERAFATGLPVFMVNTNTWQTSLSLQSFNLEVPVDDHERIEKVQEYVANYINADWIESLTATSERSRRLSPPAFRYQLTELARKAGKRVVLPEGDEPRTVKAAAICAERGIATCVLLGNPDEINRVAAAQGVELGAGIEIVDPEVVRESYVGRLVELRKNKGMTEAVAREQLEDNVVLGTLMLEQDEVDGLVSGAVHTTANTIRPPLQLIKTAPGSSLVSSVFFMLLPEQVYVYGDCAINPDPTAEQLAEIAIQSAESAIAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 12569 - protein, 423 aa, Klebsiella pneumoniae
RLDRARRVRAEGFTRAQESTQLLKGFDIARLAFAALQGAQDLHAPRQTIAARRTPAAGLAGKELFKVTHQRDHVDLVVNGHRQRGAQTAARFTNAFEFHRQIEVRFGEEVGPCSARLPGFKLQAIAHTAGVIFEDLAGSGAERQLPDARILHPAGEAHQLGASIFAGGNVLVPLDAVGEDRWHVAQGFYVVDAGRLAPDAGARRERRLGSRVGAAAFQRVDQRRLFAADIAPCPGVHEQLEVKPGAEDVFPQQTRFGGFSNRATQMLGRFNIFPAQEDVAAVRFQRKRGDQHAFHQQVRQLLHQQAVFIGARLHFIGVTQQVTDVHGFVFRHQAPLQTSGEARAAAPFQASVFYRRDNLIRGHPGQGFTRPFIAIFTAILVQPHRLLVVAQAPGERMRFRSTNYGFHLYCSSRSGIASGVRWL

SEQ ID NO: 12570 - protein, 414 aa, Klebsiella pneumoniae
YGTRYILFRYRQYQAGYKTAPPAIRHISSCTCVGSTCSPRWRTRCTRPGFCCVAAFLQLELLRVRAGDVELCGQTAGVLRDDQLFVGRDNHGRTGAFFVDEARLAEAGSKVTLMVNFKAQYAQFAQRQLTHHRGVFTDTTGENNGVKTAVHQRGVGTDVFRQAVAVNVHRAFSVGFFLIVVFHVAAVAGDFGQTQQAGLFGQHFVDRVNAHAQGVVQMEDDGRIDVTGAGTHHQAFQRGQTHGGVNAFTVTDSGNRTTVAEVAGDDVQLFHRLVEDLSGFLSHVEVAGAVRAVTTNAVLFVQAVRQGVEIGFFRHGLMERRIEYSHVFVFQVREGFQRFSDADQVCRVVQRCERRGVFNTLNYGLVDHHGAGVFFTAVYDTVADCGQLSRQFWFLCQNSVNDKVQRFTVRGARA

SEQ ID NO: 12571 - protein, 198 aa, Klebsiella pneumoniae
ANRRQEPVTVRRGAMEFAFYICGLIAILATLRVVTHTNPVHALLYLIISLLAIAGVFFSLGAYFAGALEIIVYAGAIMVLFVFVVMMLNLGGTEIEQERKWLQPGIWIGPAILSAVLLVVIVYAILGINDQGIDGAAINAKEVGIALFGPYVLAVELASMLLLAGLVVAFHIGREERAGEELSNRLNDSDKRKTEEHA

SEQ ID NO: 12572 - protein, 235 aa, Klebsiella pneumoniae
MTDRVGSMLYGFSQVILQGALVTLELALSSVVLAVLIGLAGAGAKLSSNRPLALVFEGYTTLIRGVPDLVLMLLIFYGLQIALNSVTDALGMAQFDIDPMIAGIITLGFIYGAYFTETFRGAYLAVPKGHIEAATAFGFSGGQTFRRILFPAMMRYALPGIGNNWQVILKATALVSLLGLEDVVKATQLAGKSTWQPFYFAIVCGLIYLVFTTVSNGVLLLLERRYTVGVKRADL

SEQ ID NO: 12573 - protein, 65 aa, Klebsiella pneumoniae
HRCSLDHQGKSTGPNDDHKREAHKEVFHDSSLHALVRRSNELIVLFFKGCRQCNFTLQQPVILCV

SEQ ID NO: 12574 - protein, 510 aa, Klebsiella pneumoniae
TRKRRMCGIVGIAGVMPVNQSIYDALTVLQHRGQDAAGIITIDANNCFRLRKANGLVSDVFEARHMQRMQGNMGIGHVRYPTAGSSSASEAQPFYVNSPYGITLAHNGNLTNAHELRKKLFEEKRRHINTTSDSEILLNIFASELDNFRHYPLEADNIFAAIAATNRLIRGAYACVAMIIGHGMVAFRDPNGIRPLVLGKRDVGDGRTEYMVASESVALDTLGFEFLRDVAPGEAVYITEKGQLYTRQCADNPVSNPCLFEYVYFARPDSFIDKISVYSARVNMGTKLGEKIAREWEDLDIDVVIPIPETSCDIALEIARILDKPYRQGFVKNRYVGRTFIMPGQQLRRKSVRRKLNANRAEFRDKNVLLVDDSIVRGTTSEQIIEMAREAGAKKVYLASAAPEIRFPNVYGIDMPTANELIAHGREVDEIRQIIGADGLIFQDLNDLIDAVRAENPDIQQFECSVFNGVYVTRDVDQQYLDYLDSLRNDDAKAVQLQNEVENLEMHNEG

SEQ ID NO: 12575 - protein, 159 aa, Klebsiella pneumoniae
RQRSGHCAVWAVRPGGGAGLHAAAGGPGGCLPHWPRRARRRGAEQPSERQRQTKNGGTRMIPLTHGLILAAILFVLGLTGLVIRRNLLFMLISLEIMINAAALAFVVAGSYWGQADGQIMYILAISLAAAEASIGLALLLQLHRRRQNLNIDSVSELRG

SEQ ID NO: 12576 - protein, 304 aa, Klebsiella pneumoniae
GDAGDRSDGSLYASARAEWRRDDDNSTLVTMKNTVIALLALLASAGSLAATPWQKITQPIGGSAQSIGAFSNGCIVGAEALPLSAPGYQVMRTDQRRYFGHPDLVQFIQRLSNQVHNKGMGTVLIGDMGMPAGGRFNGGHASHQTGLDVDIFLQLPQTRWTSSQLLKPQALDLVASDGKHVVPSLWSPQISQLIKLAAEDSEVTRIFVNPAIKQQLCLDAGSDRQWLRKVRPWFQHRAHMHVRLRCPAGSLECEDQAPPPPGDGCGAELQSWFEPPKPGSTPPVKKTPPPLPPSCQALLDEHVL

SEQ ID NO: 12577 - protein, 158 aa, Klebsiella pneumoniae
AAAGNGGSDVKNSALLTPCSPVALCCMIAGLTPRRKPAMSQPDAIIRIKNLRLRTFIGIKEEEIANRQDVVVNVAIHYPADKARDSEDINDALNYRTITKRIISHLENGRFSLLEKLTQDVLNIACEHHWVTYAEVEIDKLHALRYADSVSMTMSWRR

SEQ ID NO: 12578 - protein, 414 aa, Klebsiella pneumoniae
NVHGNLTCLIFGATMDRVLHFVLAIVVVAILALLVSHDRQKIRIRYVVQLLVIEVLLAWFFLNSDIGLGFVKGFSEMFEKLLGFANEGTNFVFGGMNDKGLAFFFLKVLCPIVFISALIGILQHIRILPIVIRAIGTVLSKVNGMGKLESFNAVSSLILGQSENFIAYKDILGKMSRNRMYTMAATAMSTVSMSIVGAYMTMLQPKYVVAALVLNMFSTFIVLSLINPYRVEESEENLQMSNLHEGQSFFEMLGEYILAGFKVAIIVAAMLIGFIALISALNALFATVTGWFGYSISFQGILGYIFYPVAWVMGVPASEALQVGSIMATKLVSNEFVAMMDLQKIASTLSPRAEGIISIFLVSFANFSSIGIIAGAIKGLNEEQGNVVSRFGLKLVYGSTLVSVLSASIAALVL

SEQ ID NO: 12579 - protein, 355 aa, Klebsiella pneumoniae
RNRGAPILPERQKSDVTIFAISEYAQPDGRESRYAITIQIDSEGHEMDELDNNKLKAEDDEREVESEENQRGEEIEVNEDRLPSRAMAIHEHIRQEGEKEMERDALALLWSAIAAGLSMGASLLAKGIFHVKLEGIPGGFLLENLGYTFGFIIVIMARQQLFTENTVTAVLPVMHNPTLGNVGLLMRLWSVVLAGNLIGTAVAAWAFNYMPIFDEPTRQAFVSIAEDVMKNSPTEMFANAIISGWLVATMVWMFPVAGAAKIVVIILMTWLIALADTTHIVVGSVEILYLVFNGNLPWSDFIWPFALPTLAGNICGGTFIFALLSHAQIRNDMSSKRKAEARAQAAEKGKKADRT

SEQ ID NO: 12580 - protein, 332 aa, Klebsiella pneumoniae
FTAGGESMSWLTPDLIDILLSILKAVVILLVVVTCGAFMSFGERRLLGLFQNRYGPNRVGWGGSLQLVADMIKMFFKEDWIPRFSDRVIFTLAPVIAFTSLLLAFAIVPVSPTWVVADLNIGILFFLMMAGLAVYAVLFAGWSSNNKYSLLGAMRASAQTLSYEVFLGLSLMGVVAQAGSFNMTDIVNNQAHLWNVIPQFFGFVTFAIAGVAVCHRHPFDQPEAEQELADGYHIEYSGMKFGLFFVGEYIGIVTVSALIVTLFFGGWNGPWLPPFIWFALKTAFFMMMFILIRASLPRPRYDQVMSFGWKVCLPLTLVNLLVTAAVILWQAQ

SEQ ID NO: 12581 - protein, 303 aa, Klebsiella pneumoniae
PCQGGGMKILLTGGTGLIGRHLIPRLLELGHSVTVSTRHPDTARARLDPRVTLWRDFEGHHHLNDIDAVINLAGEPIADKRWTAEQKQRLCHSRWDLTQRLVGLIHASDTPPSVLISGSAIGYYGDLGEVVVTEEEPPHNEFTHKLCARWEQIACEAQSERTRVCLLRTGVVLAPRGGILGKMTPAFKLGLGGPIGNGRQYLAWIHIDDMVNGILWLLDNDLRGPFNMVSPYPVHNEQFAHALGHALHRPAIFRVPAAAIRLLMGESAVLVLGGQRALPKRLEAAGFAFRWYDLDEALKDVLS

SEQ ID NO: 12582 - protein, 917 aa, Klebsiella pneumoniae
RFFIFGSTQMATIHVDGKEYEVNGADNLLEACLSLGLDIPYFCWHPALGSVGACRQCAVKQYQNAEDTRGRLVMSCMTPASDGTFISIDDSEAKQFRESVVEWLMTNHPHDCPVCEEGGNCHLQDMTVMTGHSFRRYRFTKRTHRNQDLGPFISHEMNRCIACYRCVRYYKDYADGTDLGVYGAHDNVYFGRPKDGTLESEFSGNLVEVCPTGVFTDKTHSERYNRKWDMQFAPSICQQCSIGCNISPGERYGELRRIENRYNGTVNRYFLCDRGRFGYGYVNLKDRPRQPVQRRGDDLITLNAEQAMQGAADILRQSKKVIGIGSPRASIESNFALRELVGADNFYTGIAKGEQARLQMMLKVLREGGIHTPSLRDIESYDAVLVLGEDITQTGARVALAVRQAVKGKAREMAAAQKVADWQIAAILNIGQRAKHPLFVTNVDDTRLDDIAAWTYRAPVEDQARLGFAIAHALDDSAPAVDGLSQDLQGKVDVIVQALAGAKKPLIISGTNAGSMEIIQAAANVAKALKGRGADVGVTMVARAVNSVGLGMIGGGSLEEALDELESGAADAVIVLENDLHRHASAARVDAALAKAPLVMVVDHQRTAIMDKAHLVLSAASFAESDGTVVNNEGRAQRFFQVYDPAYYDAKTVMLESWRWLHSLHSTVNNRQVDWTQLDHVIDAAIAALPQLAGIKDAAPDATFRIRGQKLAREPHRYSGRTAMRANISVHEPRQPQDKDTMFAFSMEGNNQPSAPRSQIPFAWAPGWNSPQAWNKFQDEVGGKLRHGDPGVRLFEASASGLEYFTAVPASFQAEEGKWRIAPYYHLFGSDELSQRAPVFQSRMPEPYIKLNPADAAKLGVNPGAMLSFSVEGQTLRLPLVISEGLTAGQVGLPMGMPGIAPVLTGSRIDSLQEAKA

SEQ ID NO: 12583 - protein, 92 aa, Klebsiella pneumoniae
YIVITGFYCSFSAGKLRQKSDFLSITDRVPAATYGAWLVVVINNNEKYEQYITPQFCAFAQTSTLACNNVRPVVYPPSDGEHEAQGIAGNLA

SEQ ID NO: 12584 - protein, 72 aa, Klebsiella pneumoniae
INVMKTFVKVDKRLKKGVKSHGIWASHIDQGRFFARLFFIPPVKRCGVHLPVRAEGFGATLFWLSNAYVNIH

SEQ ID NO: 12585 - protein, 263 aa, Klebsiella pneumoniae
GYCMKKTILALSLLVGMSSTASVFAALPQSIRIGTDATYAPFSSKDAKGDFVGFDIDLGNELCSRIKVKCTWVGSDFDSLIPSLKAKKIDAIISSLSITEKRQQEIAFSDKLYAADSRLIAAKGSPIQPTLEALKGKHVGVLQGSTQEAYANDRWRSQGVDVVAYQNQDLIYSDLAAGRLDAALQDEVAASEGFLKQPAGKDFAFAGPSVKDKKYFGDGTGIGLRKDDAELKAAFDKALGEMRKDGTYDKMAKKYFDFNVYGD

SEQ ID NO: 12586 - protein, 149 aa, Klebsiella pneumoniae
AMRMSTSTEVIAHHWAFAIFLIIAIGLCCLMLVGGWYLGGRARARSKNTPFESGIDSVGSARLRLSAKFYLVAMFFVIFDVEALYLYAWSTSIRESGWVGFVEAAIFILVLLAGLVYLVRIGALDWTPARSRRTLVNPETDSPTNRHMQ

SEQ ID NO: 12587 - protein, 314 aa, Klebsiella pneumoniae
MIVIDAFAHHGDLFFHRHTILMNITERNIWKLNNLPPMEYCSLARAQKLLNCELEDILHWHDIGAINLCLKLNPTPGILKIAVLSHQEKEVTSAFNPFTSVEAGETVWSQHSHIRSILRLEGDIPTMETLRGNTVTQFNVKVFASGLWHPHCRNLMALLEAPDDILFENRLSMMLPDKPFVYCHFIPEEDERPSISLNRIYITSQAIEKIYAHSISARPMDVTKNPLLDQTRYIQQELTVLPQSEVLLEFIHYLVQSHTVFNEKLQSMAEPDKTQLFHHVLERLKEEGMLIENAQPDEGDIGSEASRESQFAGE

SEQ ID NO: 12588 - protein, 154 aa, Klebsiella pneumoniae
GKAMSTPEKRPVSFFSLFNRGQHYAKTWPLDKRLAPVFIENRIIRATRYAIRIMPPIAIFTLCWQIALGGQLGPAVATALFALSLPMQGLWWLGKRSVTPLPPSILNWFYEVRGKLQEAGQALAPVEGKPDYQALADTLKRAFKQLDKTFLDDL

SEQ ID NO: 12589 - protein, 112 aa, Klebsiella pneumoniae
NRHIIFLAPKVHLQRKSTMSKCSADETPVCCCMDVGTIVDNTDCTASYSRVFANRAEAEQTLAALSEKARNVESEPCQINPTFTDVDGGVQLDIDFVFSCEAESLIFQLGLR

SEQ ID NO: 12590 - protein, 324 aa, Klebsiella pneumoniae
LTIMLDKININIKKTLLAFIICLVAIPLARFISPQTIIDGNLIYIAWLPISVMFSVIFIFGRYAIAPLILAFAITNSFLIKLTLPQAFILLFCQLFAVFASCAILRLLVGKRWRCGPTAKHMGARIFWGGFFAPVLLKITMYLAGQYFAFPLAITSYFGSMPLIYTVIDIQSLISAALIFTTFLYYPMRMIISPRYARRFWQQECLPWLAPQYRSFTLYWFIALAVILTLLCAPYQSEFIAGYLVPVIFIVYFIGISRIGHALLRISWSVSAFLLVVYNKNFLPGGAKRVFTLLCAVGSDLLYYLFVLYGRHLCPQRPQQTPLA

SEQ ID NO: 12591 - protein, 186 aa, Klebsiella pneumoniae
ERTMKKKTSLSEEDQALFRQLMTGTRKIKQDTIVHRPQRKKITEVAPKRLLQEQVDNSHYFSDEFQPLLNTEGSTKYVRPDVSHFELKKLRRGDYSPELFLDLHGLTQQQAKQELGALIAACRREHVFCACVMHGHGKHILKQQTPLWLAQHPHIMAFHQAPKEYGGDAALLILIEVEEWQPPELP

SEQ ID NO: 12592 - protein, 589 aa, Klebsiella pneumoniae
HNKIDTTQIDDQVGYQAAADRRRDLLQVRKARRTHAGAVAHGAAVAGQVVTVDPFGRLNHLERFVGRHHRAPRYLQEVGDQGFDMLQRALFRRRRGQRVIRFERAFRHVIEALLKNAQALAQLFYFQHHAGVAVRDATPGRDFEVEVFIARVRTPFTHVEVDTGGAQACAGGAPLQRLFGGIGCHADGTAFQNGVAQGGLLIGVQTLRHPLEELTQQAIPATRQIVRDAADAEPRRVHTEPGNRFHQIVNFLPIGKGEEDRRHRADVLNKGRDIQQVAVDAEQLGEHHADHVHAIRYGDPSQFFHRQHVRHLVDAAAEIFNTVGIWDVAVPGLTLAHLLGAAVVITDIRYAVDDLFAVQLQNNAERTMRRWVVRTEVEEHEVLVVGAALHAPLFRFKGQRLHLQILFGFGQLKRVELGGTRRIIFTQRVTFPGRRHHDATQVRVTIEGNAKHFPGFTLIPVGVGEQFGEGRQMQIVFRQRHLEHDVAVAIDGDQVIENGKIRGGQAIAVRAQTFVHAVQVKQHHVRLRQFLQEITHLQQLFTLHPYHRYAGTGWLNGKGIRPKAVAQFANHRVIKVIAGLPGWCGVMRG

SEQ ID NO: 12593 - protein, 330 aa, Klebsiella pneumoniae
EAKMALCAPYDKTGIDQVQAERLSMSWIERIKSNITPTRKASIPEGVWTKCDSCGQVLYRAELERNLEVCPKCDHHMRMSARNRLHSLLDEGSLVELGSELEPKDVLKFRDSKKYKDRLASAQKETGEKDALVVMKGTLYAMPVVAAAFEFSFMGGSMGSVVGARFVRAVEQALEDNCPLICFSASGGARMQEALMSLMQMAKTSAALAKMQERGLPYISVLTDPTMGGVSASFAMLGDLNIAEPKALIGFAGPRVIEQTVREKLPPGFQRSEFLIEKGAIDMIVRRPEMRLKLASILAKLMNLPAPVAVSEAPHEGVVVPPAPDQEPEA

SEQ ID NO: 12594 - protein, 81 aa, Klebsiella pneumoniae
CRKMTCEETWRAKPISWVTTTMVFPSSASCCIMRNTSPTSSGSSAEVGSSNSSTSGSIASARAIETRCCWPPERCTGYFAC

SEQ ID NO: 12595 - protein, 379 aa, Klebsiella pneumoniae
TVKILVDENMPYARELFSRLGDVQAIPGRPVPADALTDADALMVRSVTRVNEALLAGKAIKFVGTATAGTDHVDQAWLQQAGIGFSAAPGCNAIAVVEYVFSSLLMLAERDGFALRDRTVGIVGVGNVGGRLQKRLEALGIKTLLCDPPRADRGDEGDFRSLEALVQEADVITFHTPLYKEGQYKTLHLADEALISRLKPGTILINACRGPVVDNAALLKRLEAGQPLSVVLDVWEPEPDLNVELLKRVDIGTAHIAGYTLEGKARGTTQVFEAYSAFIGHPQQVALDTLLPAPEFGRITLHGPLDQPTLKRLVHLVYDVRRDDAPLRKVAGVAGEFDKLRKNYQERREWSSLYVQCSDEQAATLLRQLGFNAVHHPVR

SEQ ID NO: 12596 - protein, 186 aa, Klebsiella pneumoniae
GFLMAEQNHLASTEWVDIVNENNEVIAQSSREQMRAQCLRHRATYIVVHDGMGKILVQRRTETKDFHPGMLDATAGGVVQADEQLLESARREAEEELGIAGVPFADHGQFYYEDKFCRVWGSLFSCVSHGPFALQEEEVSEVCWLTPEEITARCDEFTPDSLKALALWMTRNAGNEYDDAEESERE

SEQ ID NO: 12597 - protein, 310 aa, Klebsiella pneumoniae
RKMINTTRPILNLDLDLLRTFVAVADLNTFAAAAAAVCRTQSAVSQQMQRLEQLVGKELFARHGRNKLLTEQGIQLLGYARKILRFNDEACMSLMYGSLQGALSIGASEETADTILPFLLNRIGCFYPRMTLEIKVHPHAAIMEMLAEGLVDLALTTHQPPGFTSFTLRTSPTLWYCAAEYVLAKGESIPLILHEEPSPFRQDIIAALETARVSWHLAHGASSLSGVKAAVKAGLGVTARPVEMMSPDLRVAGISEGLPALPDTRYVVSCNPRTVSELPQAIFQSLSQEIHPWETGTALTPEEGGNTLVL

SEQ ID NO: 12598 - protein, 189 aa, Klebsiella pneumoniae
PVEMEPMKLMFASDIHGSLPATERVLERFAQSGARWLIILGDVLNHGPRNALPEGYAPGEVAERLNSVAERIVAVRGNCDSEVDQMLLRFPMTAPWQQVLSERYRLFLTHGHLYSPDNLPPLAAGDVLAYGHTHIPVAEKRGAIYLFNPGSVSIPKGGYSASYGLLDQGRLQVLALNDNQVIAEVAIYP

SEQ ID NO: 12599 - protein, 616 aa, Klebsiella pneumoniae
VAWMNMLALTILLPLIGFVLLAFSRGRWSENLSAAVGMGSVGLAALVTAYVGVDFFANGKQAVSVPLWTWMSVGDFNIGFNLVLDGLSLTMLSVVTGVGFLIHMFASWYMRGEEGYSRFFAYTNLFIASMVVLVLADNLLLMYLGWEGVGLCSYLLIGFYYTDPKNGAAAMKAFVVTRVGDVFLAFALFILYNELGTLNFREMVELAPQHFANGSTTLQWATLMLLGGAVGKSAQLPLQTWLADAMAGPTPVSALIHAATMVTAGVYLIARTHGLFLMTPEVLHLVGIVGAVTLVLAGFAALVQTDIKRVLAYSTMSQIGYMFLALGVQAWDAAIFHLMTHAFFKALLFLSSGSVILACHHEQNIFKMGGLRKSIPLVYVCFLVGGAALSALPLITAGFFSKDEILAGAMANGHINLMVAGLVGAFMTSLYTFRMIFIVFHGKEQIHAHAGKGITHHLPLIVLLVLSTFVGALIVPPLEGVLPQTTELAHGSVMTLEIASGIIAIAGILIAAWLWLGKRTLVTSIANSAPGRFFGTWWFHAWGFDWLYDKVFVKPFLGIAWLLKRDPLNSLMNIPAILSRFAGKGLLVSENGYLRWYVASMSIGAVVVLALLMVLR

SEQ ID NO: 12600 - protein, 275 aa, Klebsiella pneumoniae
GVPVLMSEMEQQPICKIALGIEYDGSKYYGWQRQNEVRSVQEKLEKALSQVANEPITVFCAGRTDAGVHGTGQVVHFETRAQRKDAAWTLGVNANLPGDIAVRWVKHVPADFHARFSATARRYRYVIYNHRLRPAVLSHGVTHFHQPLDAERMQRAAQCLLGENDFTSFRAVQCQSRTPWRNVMHINVTRYGAYVVVDIKANAFVHHMVRNIVGSLMEVGAGNQPESWMAELLAAKDRTLAAATAKAEGLYLVSVDYPAHYDLPVLPMGPLFLAD

SEQ ID NO: 12601 - protein, 273 aa, Klebsiella pneumoniae
ACAVMDSFIELFAVSPLVLVVLFFVAILAGFIDSLAGGGGLLTVPALMAAGMPPAQALATNKLQACGGSLSATLYFVRRKVVNLADQKLNILMTFIGSTAGALLVQHVQSDILKQILPLLVIGIGLYFLLMPKLGEADRQRRLYGLPFALVAGGSVGFYDGFFGPGAGSFYALAFVTLAGFNLAKSTAHAKLLNATSNVGGLLLFIIGGKVIWATGFVMMAGQFIGARAGSRLVLSKGQSLIRPMIVIVSAVMSAKLLYDSHGAEILQWLGIH

SEQ ID NO: 12602 - protein, 216 aa, Klebsiella pneumoniae
PGNVLWLEGMPAVNAGQLVGNGGCHSLAGAIRGELNMTLKELLVGFGTQVRSIWMIGLHAFAKRETRMYPEEPVYLPPRYRGRIVLTRDPDGAERCVACNLCAVACPVGCISLQKAETVDGRWYPEFFRINFSRCIFCGLCEEACPTTAIQLTPDFELGEYKRQDLVYEKEDLLISGPGKYPEYNFYRMAGMAIDGKDKGEAENEAKPIDVKSLLP

SEQ ID NO: 12603 - protein, 440 aa, Klebsiella pneumoniae
QGSVMSQALPLITRQGDRIAIVTGLRTPFARQATAFHGVPAIDLGKMVVGEMLARSDIPAEVIEQLVFGQVVQMPEAPNIAREIVLGTGMSVHTDAYSVSRACATSFQAVANVAESLMAGTIRAGIAGGADSSSVLPIGVSKTLARTLVDANKARTLSQKLKLFSRLRPRDLLPVPPAVAEYSTGLRMGDTAEQMAKSWGISREQQDALAHRSHQLAAKAWEEGKLSAEVMTAYAPPFREPLEQDNNIRKNSTLADYQKLRPAFDRKHGTVTAANSTPLTDGAAAVILMTESRAKELGLRPLGYLRSYAFTAIDVWQDMLLGPAWSTPLALERAGLTLADLTLIDMHEAFAAQTLANLQCLASDRFAREVLGRSQATGEVDESKFNVLGGSIAYGHPFAATGARMITQTLHELRRRGGGFGLVTACAAGGLGAAMIVEAE

SEQ ID NO: 12604 - protein, 395 aa, Klebsiella pneumoniae
SLHVSLNTSVSRTILSFVSHNSVHLYAEQVRSDILCINLRPQAHIVKIVLRLVIRVTYVKQNAIQPANLEFNAEGTPVSRDFDDVYFSNDNGLEETRYVFLGGNRLPERFPSHPRPLMIVAESGFGTGLNFLTLWQAFDVFVRDNPDVTLQRLHFISFEKYPLKAEDLRLAHQRWPELAPWAQQLQAQWPSAFGGCHRLLLDGGRVTLDLWFGDINELTRELDDSLNQQVDAWFLDGFAPAKNPDMWTQDLFSAMARLARPGGTLATFTSAGFVRRGLQEAGFTMRKSKGFGRKREMLTGEMAQTLSFPARAPWFARSSSDAREAAIIGGGIASALLSLALLRRGWQVTLYCADEAPAQGASGNRQGRAVSAVKSARSGAGALFSGRLYLRPPNV

SEQ ID NO: 12605 - protein, 614 aa, Klebsiella pneumoniae
QGNVVNGELIWVLSLLAIAVVLFATGKVRMDAIALMVIVAFVLSGTLTLNEAFSGFSDPNVILIAALFIIGDGLVRTGVATKMGAWLVSVAGNSETKMLIYLMLTVAGLGAFMSSTGVVAIFIPVVLSVSARMNTSPSRLMMPLSFAGLISGMMTLVATPPNLVVNSELLREGLHGFSFFSVTPIGLVVLILGIVYMLAVRFMLKTDNGDSARDGRKRSTFRDLIREYHLTGRARRLAIRPGSPMIGQRLDDLKLRERYCANVIGVERWRRFRRVIVNVNGVSEFRARDVLLIDMSASDVDLRQFCGEQMLEPMVLRGEYFADQALDVGMAEVALIPDSEMIGKTVREIAFRTRFGLNIVGMKRDGKAMDGSVVDEPLQLGDILLVVGNWRQIALLAKRGRDFVVLNMPVEVDDASPAHSQAPHAIFCLVLMVALMLTDEIPNPIAAIIACLLMGKFRCINAESAYKAIHWPSIILIVGMMPFALALQKTGGVDLVVKGLMDVAGGEGPYLMLGCLFVMCAAIGLFISNTATAVLMAPIALAAAKSMGVSPYPFAMVVAMAASAAFMTPVSSPVNTLVLGPGKYSFSDFVKIGVPFTILVMVVCVLLIPVLFPF

SEQ ID NO: 12606 - protein, 191 aa, Klebsiella pneumoniae
DFAVVGNSLMQQQHHYQQLIDLFDSCFAEEFNTRLIKGDDEPIYLPADDETPYHRIVFAHGFFASALHEISHWCVAGKARREQVDFGYWYCPDGRDAMTQSQFEDVEVKPQAFEWLFCVAAGFPFNVSCDNLEGDVEPDRIAFQRRVHARVMTLLEQGIPERPARFIRALQHYYQTPPLTAKHFPWPEDLH

SEQ ID NO: 12607 - protein, 63 aa, Klebsiella pneumoniae
NDKVKVTSDIRRVLYRLPCIDYKLNVTCVAKQGASARWTLLLSRHEFTVCQKIYFDFSGAVTE

SEQ ID NO: 12608 - protein, 130 aa, Klebsiella pneumoniae
PGTVILEVGFSAMLATICWPLLMPPRMPPAWLLWNPALVISSRFSLPRSFTTSKPSPISTPFTALMLISAWAISASRRSKTGSPRPGGTPSATTVTFAPMESPSFFRPRISSSRASILSGSGQKKGFCST

SEQ ID NO: 12609 - protein, 74 aa, Klebsiella pneumoniae
TPAVTMVAAWISAETGVGPAIASASHVCSGSWADLPTAPPSSISVAHCSVVLPLAKCCGASSTISRKFRVPSSL

SEQ ID NO: 12610 - protein, 177 aa, Klebsiella pneumoniae
LNEVMGMSQKTRFTQSALAVAVALVSTQAWSAGFQLNEFSASGLGRAYSGEGAIADDAGNASRNPALIMMFDRPTMSAGAVFVDPGVNVSGTSPTGKSLKADNIAPTAWVPNFHFVAPINDQFGWGASITSNYGLATEYNDDYAAGSMGGKTDLTTANFNLSGALPPRQQLELRLRL

SEQ ID NO: 12611 - protein, 404 aa, Klebsiella pneumoniae
KGTSMSSKLVLVLNCGSSSLKFAILDAVNGDEYLSGLAECFHLPEARIKWKMDGSKQEAELGAGAAHSEALNFIVNTILAQKPELSAQLTAIGHRIVHGGEKYTSSVVIDESVIQGIKDAASFAPLHNPAHLIGIAEALKSFPHLKDKNVAVFDTAFHQTMPEESYLYALPYSLYKEHGVRRYGAHGTSHFYVTQEAAKILNKPVEELNIITCHLGNGGSVSAIRNGKCVDTSMGLTPLEGLVMGTRSGDIDPAIIFHLHDTLGMSVDAINKMLTKESGLLGLTEVTSDCRYVEDNYQEKADAKRAMDVYCHRLAKYIGSYTALMDGRLDAVIFTGGIGENAAMVRELSLGKLGVLGFEVDHERNLAARFGKSGFINKEGTRPAVVIPTNEELVIAQDASRLTA

SEQ ID NO: 12612 - protein, 149 aa, Klebsiella pneumoniae
TYHPLLLMELHMNPFKGRHFQRDIILWAVRWYCKYGISYRELQEMLAERGVNVDHSTIYRWVQRYAPEMEKRLRWYWRNPSDLCPWHMDETYVKVNGRWAYLYRAVDSRGRTVDFYLSSRRNSKAAYRFLGKILNNVKKWQIPRFINHG

SEQ ID NO: 12613 - protein, 81 aa, Klebsiella pneumoniae
TYHPLLLMELHMNPFKGRHFQRDIILWAVRWYCKYGISYRELQEMLAERGVNVDHSTIYRWVQRYAPEMEKRLRWYWRNPS

SEQ ID NO: 12614 - protein, 102 aa, Klebsiella pneumoniae
GRVTPVPAQPFFHFRRITLNPAVNRGVIDIHSAFSQHLLQLTVTDAVFAVPAYGPQNDVTLKMPAFEWVHVQLHQQKGMISLSPPTICNSAVQRISALKDDG

SEQ ID NO: 12615 - protein, 103 aa, Klebsiella pneumoniae
MGSCAAPSAKGDDKFITTDYLQQCLYFYYSGNIDKGGIMDLNTAANALRELGHPTRLSIYRELVRAGHEGLPVGELQKHLEIPASTLSHHLSALISAGRHCCK

SEQ ID NO: 12616 - protein, 179 aa, Klebsiella pneumoniae
AEQGRDHKAGALSVVDESRDLPLLHVVEDFTQKPVCSFAVTTGGEIKIDSAAPAVDGPVQIRPAAIDLHVGFIHVPRAKIGRVTPVPAQPFFHFRRITLNPAVNRGVIDIHSAFSQHLLQLTVTDAVFAVPAYGPQNDVTLKMPAFEWVHVQLHQQKGMISLSPPTICNSAYISIILEI

SEQ ID NO: 12617 - protein, 98 aa, Klebsiella pneumoniae; identical to SEQ ID NO: 9193

SEQ ID NO: 12618 - protein, 63 aa, Klebsiella pneumoniae; identical to SEQ ID NO: 11322

SEQ ID NO: 12619 - protein, 174 aa, Klebsiella pneumoniae; identical to SEQ ID NO: 9228

SEQ ID NO: 12620 - protein, 77 aa, Klebsiella pneumoniae; identical to SEQ ID NO: 9235

SEQ ID NO: 12621 - protein, 94 aa, Klebsiella pneumoniae; identical to SEQ ID NO: 9277

SEQ ID NO: 12622 - protein, 61 aa, Klebsiella pneumoniae
NLLVQCARVFIQKLEHQSGKLADWVRDLLCRKSNFVVTCALANKLARIAWALTARQQTYVA

SEQ ID NO: 12623 - protein, 292 aa, Klebsiella pneumoniae
CWRSSSPTSSHRCSIIWWCRPILSGGSRVAEKKSNDSIGKTLLVVLVLCLVCSIVVAGSAVGLKSRQQAQRALDKQRNILAVSGLMHPGMDADAVADTFAARITPRLVNLATGELLEKDPGKFNQAQALKDPQQSMALDASQDPAGIKRRSNLAEIYLVRDAQQKIEQVVLPIYGNGLWSMMYAFVALDVDGRTVKGITYYDQGETPGLGGEVENPNWRQQFVGKQVLDDNGMPALKVVKGGARAGDLHAVDGLSGATLTSNGVQHSFDFWMGELGFGPFLKKVREGELNNG

SEQ ID NO: 12624 - protein, 180 aa, Klebsiella pneumoniae
KTMFKKTTLALLTASLFISTSALAISNNTITFRGEVSDETCSVAINGNQAKPVVILPTVSAKELAKGGDVAGQVTFDIGLTGCTGNTDRATKISTVFVGNQVTSNGNLGNTGDATNVEVQLLDTANKVINLTNGFKGEGDLQLKPGETEASATYTAQYYATGAASAGTVEATLQYAVSYL

SEQ ID NO: 12625 - protein, 268 aa, Klebsiella pneumoniae
NSDPGRVAARAYGSQGENLMIDIPRIFTISESEHRIHNPFTPEKYATLGRALRMAPGTTILDLGSGSGEMLCSWARDHQIVGTGVDMSLLFSQQAAARAEELGVSDRVTFVHQDASGYVASQPCDVAACVGATWIGGGVAGTIELLKQSLTPGGMLLIGEPWWRKRPATAEEAIACGAQSPDDFLTLPALVAHFGELGYDVVEMVLADQEGWDRYEAAKWLTMRRWLEANLHDDFAPEVRQQLTTAPLHHVTWTREYLGWGVFVLMAR

SEQ ID NO: 12626 - protein, 524 aa, Klebsiella pneumoniae
EAKPVKLKLSYIICAVLVPLVMMLTLALLVSVLQFKQDVALSAKTLLRFSEDVSTASWRVTGQAVKLADRPCAEILSELNRTRAFTPYIRDIGLLEKGNLLCSFVSREQAHPFPLPPGKTLPTPLPARWVRSFSWMAGGPGRPAVVYTQQVAADKAAFVIVDSRYVQELMDVLSEEREAVFSLRFGKGDAIISQPAQYDRIVMTQNYVTDDGKISLTVAAPLGTLTAVWMKSLLIFIPLSFCFSFLTLVLYRHWSKMRMSMAREIIRGMKNAQFTVHYQPVFNVNRGNCGGVEALMRWPLPDGRFITPDIFITAAENEGMIVPLSRHLFKLIAEDVERWQVAEGFYISVNISPEHLVHESFIEDVELLQARLGNLRLMLELTERSLIVQPALVSDKLIRLREKGILIAIDDFGTGYCSLSYLQQLPVDYLKIDRTFVDTIDTSGSDVPILDTIIMLSHKLGLNIVAEGVSSEHQLSYILDHNVGFIQGYLYAKPMCSSDFTRWLDTCANEQNDRIKCKKCSINQ

SEQ ID NO: 12627 - protein, 289 aa, Klebsiella pneumoniae
AARPNSVSLAWAMTSASSLKRNSGASGPKVSSFATLALSGTLTRMVGWKKLPPRACGLPPVTTFAPLAMASAMCSSTLATAFSSISGPVVTPSCRPSPMRSFSTACCSFSAKRSYTPSWTYRRLAQTQVCPALRNFDASAPSTALSRSASSKTINGALPPSSRETFLMSFAHCSISWRPISVEPVKESLRTSGLLVSSPPTAPAEPVTTLNTPAGIPARFASSASASAENGVWLAGFRTMVQPAASAGPALRVIIAAGKFHGVMAAVTPMGCLITSRRLSAWWPGMVSP

SEQ ID NO: 12628 - protein, 174 aa, Klebsiella pneumoniae
SRATIFPLEHYLSRITQAGTLHMSEKYVVTWDMLQIHARKLASRLLPVEQWKGIIAVSRGGLVPGALLARELGIRHVDTVCISSYDHDNQRELKVLKRAEGDGEGFIVIDDLVDTGGTAVAIREMYPKAHFVTIFAKPAGRPLVDDYVVDIPQDTWIEQPWDMGVVFVPPIAGR

SEQ ID NO: 12629 - protein, 482 aa, Klebsiella pneumoniae
PAQTGGHVGVLHFFADPRHRHDRQHPANAGAEAVDDGLREVVIALHHERHAAENRTVNRNQRQEDAQRVVQCRKILIEDHLEDLHQRGDHSDKGDEVKKAEIHPLNQRAVAQHQVIDQVIDWHGKPQHYRHRDAEAEGGGDLFRHRKKGAHPEEEGQRHVLNEHRADKQADVMSHYRLLLFLLLRLPATQGPDQQTDNEERARRQQEQAVRLIPAAVLHRLQHRDTEQLAATDKLAQEADDNQDRAIAETVANTIHKARQRRRLHGVGFGAAHHDAVGDDKPDEYRQLFGGLIGESPQQLIHHDHQRGDDRHLHDDAHAIGNMVADHRDKHAGERRHQGHRNGHHEGGFQFGGYRQCGADAQHLQGDGVIGDERPHQHALHLFHIALFSHYSALPHEPFSGTDQSPVRPSRNQSYAVRHWTSAWRRINRQPRGDRLRARRLSPPSAPACRCHPAPACRQTAGASWGFPPRRPAPAFRPDRSK

SEQ ID NO: 12630 - protein, 272 aa, Klebsiella pneumoniae
IQKTLISGLSCRPGNVAILFYQGTSSMRKIALFIAMLLLPCVSFAGLLSSNSPTTPVSKEYKQQLMGSPVYIEIFKEERMLDLYVKMGETYQLLDSYRICNYSGGLGPKQRQGDFKSPEGFYNVTRSQLKPDSRFYKAINIGFPNAYDRAHGYEGKYLMIHGDCVSVGCYAMTDSGIDEIFQFVTGALVFGQPSVQVSIYPFRMTNANMERHKYSYYADFWKQLKPGYDYFQQTHKPPVVSVTDGRYVVSKPLSHEVVQPQLASNYTLPETK

SEQ ID NO: 12631 - protein, 299 aa, Klebsiella pneumoniae
GFLAICIESVWENPYNRITSRRRAGFCYRGLMPKLRKNTYAMRYVAGQPAERILPPGAFAGVSPVYPAGTPLSSDEKIRVLVWNIFKQQRAEWQSVLKNFGKDAHLVLLQEAQTTPELVRFATSNYLAADQVPALVLPQHPSGVMTLASAHPIYCCPLREREPILRLPKSALVTVYPLPDARLLMVVNIHAVNFSLGVDVYSKQLLPIGDQIAHHSGPVIMAGDFNAWSRPRMNALYRFAREMSLREVRFSDDQRRRAFGRPLDFVFYRGLSVHDASVLVTRASDHNPLLFEFSPGKPD

SEQ ID NO: 12632 - protein, 132 aa, Klebsiella pneumoniae
YQYFCSVSESTECFGAQMHHYQRTVLNSITLLILAISFALLILHVRQQRYPLSDLNVFLCTTRTVTSVQPGNFHADGNIVLDFKNKRITLQYDIITAQQIKKVLYRDVYIKNLKMPGAEFIHLMLIQKRCFY

SEQ ID NO: 12633 - protein, 487 aa, Klebsiella pneumoniae
RQEAFMQLNDMTLFRQQAMIDGQWRDAPNGDVIAVTNPANGEQLGSVPKMGADETREAIEAANRALPAWRALTAKERANILRRWFDLMMENQDDLARLMTLEQGKPLAEAKGEISYAASFIEWFAEEGKRIYGDTIPGHQADKRLLVIKQPIGVTAAITPWNFPAAMITRKAGPALAAGCTMVLKPASQTPFSALALAELANRAGIPAGVFNVVTGSAGAVGGELTSNPLVRKLSFTGSTEIGRQLMEQCAKDIKKVSLELGGNAPFIVFDDADLDKAVEGALASKFRNAGQTCVCANRLYVQDGVYDRFAEKLQQAVEKLRIGDGLQDGVTTGPLIDEKAVAKVEEHIADAIAKGAKVVTGGKPHALGGNFFQPTILVNVPDSAKVAKEETFGPLAPLFRFKDEADVIAQANDTEFGLAAYFYARDLSRVFRVGEALEYGIIGINTGIISTEVAPFGGVKASGLGREGSKYGIEDYLEIKYMCIGL

SEQ ID NO: 12634 - protein, 200 aa, Klebsiella pneumoniae
SVMAHYISLFVRAVFVENMALAFFLGMCTFLAVSKKVSTAFGLGVAVTVVLGLAVPINNLVYNLVLRDGALVEGVDLSFLNFITFIGVIAALVQILEMILDKYFPALYNALGIFLPLIAVNCAIFGGVSFMVQRDYNFPESIVYGFGSGIGWMLAIVAMAGIREKMKYANVPAGLRGLGITFITTGLMALGFMSFSGVQL

SEQ ID NO: 12635 - protein, 244 aa, Klebsiella pneumoniae
RKVAMKPARIPHTVTAPEHWSSMPWGEYYRETLEQQMKPWLAKLYGFHLLKIGNLSAEINTEACAISHQVNVSLAGNPMQVRADPLHLPFAEKSVDACLLAHTLPWCSDPHRLLREADRVLIDDGWMILTGFNPVSLMGLRKLVPVLRKGTPYNSRMFTLMRQLDWLALLNFEVLHYGRYQVLPWSRHGGKLLSTHLPALGCLQLIVARKRTIPLTLNPMKSGKAKTQLRPAVGATRQWRKGQN

SEQ ID NO: 12636 - protein, 242 aa, Klebsiella pneumoniae
QKKASATFAGCRWSCRKWRRPENDLLETRTTPRGLLRVDAATPVMLHFLMPLVKPFRERYPEMTLSLVSSETFINLIERKVDVAIRAGTLTDSSLRARPLFTSYRKIVASPDYVARYGMPQHPSDLKQHHCLGFTEPVSLNTWPVSCCDGQLLEIEAAVSSNSGETLKQLCLTGNGIACLSDYMVDKEIASGEFVELLADKRLPVEMPFSAVYYSDRAVSTRIRAFIDFLSDHVKQLPKELS

SEQ ID NO: 12637 - protein, 214 aa, Klebsiella pneumoniae
FHNFLSIFMVILLPQSVFYGDCLLISIELFTSKELYMQRIFSPWIMAALLFSPALAVAMENNTLSVGYAQTHLSALKNSASKDLRGLALKYRYEFNSDWGVLTSLTATRHEVQNYKWDAGKLHKDGDNTTSYSSLMIGPTYRFNDYISLYGNVGMAEMKIKNRDNHSSSENAFAYGAGVIFNPLTNLSLGLSWETAKLLFVDTNTFGVSVGYRF

SEQ ID NO: 12638 - protein, 209 aa, Klebsiella pneumoniae
SAHYLLRHQQCGRLPHGDRTGRRRGDGGFSGAGEKLAVRESTAKKAAKAASHCWHVVAGWRLAPYPAYKTEAAAPASAAPPGTEPLYAGWRLAPYPAYKTEAAVPASAAPPGTEPLYAGWRLAPYPAYKTEAAGPACAAPPGITKYAAADAAPRGRGAFYARRTVADNRRLSPAPARRSHRSCPGCSCASPGSPATCRRSPAQKSQRSR

SEQ ID NO: 12639 - protein, 153 aa, Klebsiella pneumoniae
MRSYRQWLVFSKALLALLLLAGITPAPFAAVNVDRTRLVFAANDVVQSLTLTNDSVTPMLLQVWTDAGETASSPDSSRTPLVVLPPVFKMQPDELRTLRVMLSSRRSLPGDRESIFWLNIYQIPPEQNATDSVTRKLVLPLRLRLKVFIRPHG

SEQ ID NO: 12640 - protein, 311 aa, Klebsiella pneumoniae
KNEYFFILASIISIQRGNMDLRRFITFKTVVEEGSFLRAAQKLCCTQSTVTFHIQQLEQELAIPLFEKIGRRMCLTAAGKKVLPHVYDLTKVMASIRQAARQDDEPGGELRVATGETLLAYKMPRVLQRFKQRAPKVRLSLQSLNCYSIRDALLADEVDLGVFYRVGNDDALTIMELGQQSLALVASVEQAPVDFMRPRQHIPLSFIINEPQCVFRQIFESTLRQREITLENTIELWSIESIKQCVAGNLGVSFLPRFAVEDELKRGTLVELPFSETPLTIHALCAHHAGKAISPAMRVFMQCMQEEQEVR

SEQ ID NO: 12641 - protein, 459 aa, Klebsiella pneumoniae
KRDLSHDYLREEIVSCVIFAERCCLQLACFSAPRPGANCVKVTDNSFLSEAAIKAGYTARYWRGAYDDNIGHLGLPSVISVSANNKFQPSGTVLASAVANFLTAGVQTPYSAKQVLYRCDLKDAGQLYELYSTNADNPFVGGRRAKEVEGAYYDAERNVAVRMTNLSTGEYYSRYWKQRQLTADSWFQDDRAIYIPAGAFSNVLYEMIKIAASDQYIYSDRINKDLYTQPRGYIAFKGPGLITSAVQPGMDHASSYYGWPAYWPGAWSSYNQVTYIRGAACTIEDYPATVLLPTISAEALTSGESSEAPFSITLECEAGAMSSTHPTTQVANVAMGFLVNQPAAVAAARRLGLTTTGGGLTWLLDTHYGEKGVASGVGIRIYDERGAPLNLLPDKTSSGTGNARGWYGYKELTVQTGKKDHGSVEIWHGDFTASLEALGGQTVTVGSVNAQLQAVVSFQ

SEQ ID NO: 12642 - protein, 68 aa, Klebsiella pneumoniae
HLHLIRILCRLKTVTGITISLGLIPILRYTPPALFRNFHHHLIPPSALLNNCCQITKWKQKGHFVRIL

SEQ ID NO: 12643 - protein, 169 aa, Klebsiella pneumoniae
  UNSURE (143): Identity of amino acid at the above locations are unknown.
FMNLISIPAFQDNYIWVLSENNGRCIIVDPGEAAPVLAAIEENQWQPEAILLTHHHQDHVGGVKQLREKFPSIVVYGPAETQDKGVTQVVGDGDRLSILGHDFSIFSTPGHTLGHICYYSETYLFCGDTMFSGGCGKLFESTXKQMYQSFMKINALPEETSYVAHMNIR

SEQ ID NO: 12644 - protein, 294 aa, Klebsiella pneumoniae
KINQEDVIMKKILTALCLLATAGAWAAPQLIAHRGGTGDAPENTLPAIKLALENNAEAIWVTVQLSRDGVPVLYRSSDLSALTNSEGKVSSLTAGELAKVDAGWKWGDDSHPWRGKQATIPTLQSVLQQWPHTFFYIDIKSPDADPTVMGQRLLEVLKTTDSLDRVRVYSTEDRYIAALPPAIPRFVTRSETRTRLANISLSHQCQPASQRDGEQWYGLELKRKVEVVEKFTLGEGISPATLTWDKEAMDCFRSQDKAHIIFFGINSAEDYRTAIELGADGVMVDSPAQAKSWQ

SEQ ID NO: 12645 - protein, 117 aa, Klebsiella pneumoniae; identical to SEQ ID NO: 8757

SEQ ID NO: 12646 - protein, 837 aa, Klebsiella pneumoniae
KRMHYNQYITSGQTSYKLREHFSMMILSIVATVVLLGALFYHRVSLLLSSVILLAWTAALGAAGVWNIWLLLPLAIILLPFNFAPMRKSMISAPAFRTFRKVMPPMSRTEKEAIDAGTTWWEGDLFRGNPDWQKLHNYPQPRLTAEEQAFLDGPVEEACRMANDFAITHEMADLPPELWAYLKEHRFFAMIIKKEYGGLEFSAYAQARVLQKLSGVSGILAITVGVPNSLGPGELLQHYGTEEQKNHYLPRLARGLEIPCFALTSPEAGSDAGAIPDTGVVCMGDWQGQQVLGMRLTWNKRYITLAPIATVLGLAFKLSDPDRLLGGEEELGITCALIPTSTPGVEIGRRHFPLNVPFQNGPTRGKDIFVPIDYIIGGPSMAGQGWRMLVECLSVGRGITLPSNATGGLKSVAMATGAYAHIRRQFKISIGKMEGIEEALARIAGNAYVMDAAASLITYGIMLGEKPAVLSAIVKYHCTHRGQRSIIDAMDITGGKGIMLGEGNFLARAYQGAPIAITVEGANILTRSMMIFGQGAIRCHPYVLEEMAAAQNNDLNAYDKLLFKHIGHVGSNKVRSFWLGLTGGRTSSAPTRDATRRYYQQMNRLSANLALLSDVSMAVLGGSLKRRERISARLGDVLSQLYLASAVLKRYDDEGRNEADLPLVHWGVQDALHQAEQAIDDLLDNFPNRLVAGVMRLVIFPTGRHHHAPSDRLDHQVAKILQVPSATRSRIGRGQYLTPSEHNPVGLLEEALLEVMAADPIHQRICKELGKNLPFTRLDELAHNALAKGLISQDEAAILTRAEHSRLRSINVDDFAPEELATKPVKLPEKVRKVEAA

SEQ ID NO: 12647 - protein, 408 aa, Klebsiella pneumoniae
HAAQRRAIFILSRANIGAQRQIFFIQLQTAQRLSAVGVSGQQIAQQYGRQDIQRHHPLVVADRHHRPLAAVGIGGKMKALALEEMAQRGAGNREFLFARHHPAEELFFPPFFDHAHLQMEAPQEGVRAMGAGAAKHRAGNDPVFPLLQLTCQQILQAGAERRFDQPRRCYLRAAERNYPFAVELPVEEKLTNGDRVLIIEVPDLLIQAHRLQEVNMRSRQPRRVRPAELIETDLAERMTAQLAAAGLADVHFPVGQAREHGKTGVEGGTFGQNNRLRLRRQRIGVHGVNKDSGGRAPRERRFAERSGTQRRPLARRQQLLLYGVARQFGQRVRGVTGKRHRVIALDINHHRLQHAPFAAVDRADDPARRGGKADARDLFIFEQDLTFFDPIAFFNRHRGAHANVLFAE

SEQ ID NO: 12648 - protein, 141 aa, Klebsiella pneumoniae
MMGQLSQSQDLGAGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAIILHSWVPGVPVWLFSPGHHSRPHRQ

SEQ ID NO: 12649 - protein, 151 aa, Klebsiella pneumoniae
FIAKFYWFGKTVASLKEIAMTLPSGHLKSKLIKKFTALGPYIREEQCHDNRFFFDCLAVCVNVKPAPEKREFWGWWMEMEAQESRFTYSYQFGLFNKEGSWQAVDIDDPEVSDRLEKTLREFHERAAALLTTFNLKLEPADDFSEPVRLRA

SEQ ID NO: 12650 - protein, 197 aa, Klebsiella pneumoniae
RIILMYQDLIRNELNEAAETLANFLQDEANIHAIQRAAVLLADSFKAGGKVLSCGNGGSHCDAMHFAEELTGRYRENRPGYPAIAISDVSHLSCVSNDFGYEYVFSRYVESVGRAGDVLLGISTSGNSGNVIKAIEAARAQGMKVITLTGKDGGKMAGSADVEIRVPHFGYADRIQEIHIKVIHILIMLIEKEMAKG

SEQ ID NO: 12651 - protein, 260 aa, Klebsiella pneumoniae
GQDNMTTRSHHDNVEKQFGSQASAYLTSAVHASGRDLQRLAERLADFPQAKVLDMGCGAGHASFTAAGQVAEVTAYDLSSQMLEVVAAAAKEKGFSNIVTQQGYAETLPFADVSFDVVISRYSAHHWHDVGQALREVKRVLKPGGVIIMMDVMSPGHPVRDVWLQTVEALRDTSHVRNYSSGEWLTLATEAGLVVNQLLTDRLPLEFSSWVARMRTPEPLVEAIRLYQQSASAEVKAYFELQEDGSFTSDTILFEAHKAV

SEQ ID NO: 12652 - protein, 96 aa, Klebsiella pneumoniae
PNPLMRMELTIVPGLKISLLQQPLVWMDGLANLRHFDRQLEGITGRRCDCFTRDVYHRLCHGSGKTVFTRGRRGGVDACPGCAIPGADCRQRCAAN

SEQ ID NO: 12653 - protein, 257 aa, Klebsiella pneumoniae
WFNLNDAFLTEGLMSKKKYLIDKKVILDCEKMTLSCDRESLRISESECNLLIAFHEGLFKKDDLIAWVWGRKGVVVSSASYYKLINQLRGSFEKVGLPPSAVLTRPKVGVTLSVSIESLPDASTSAMQNIASYTVAPVADASPEPTQISQFTIRKEWFFLIGATLFFLVMIYIYHNSKPDYFSELGTYNGYTFYGVTEDNRTLEDAVGAFSELSPQVYKQNGNFIYYIRVPNTNIFVQCLNQLNVSEPKCITIKERY

SEQ ID NO: 12654 - protein, 461 aa, Klebsiella pneumoniae
ATIDTHMKARAILLASVLLVGCQASKHDGTVEQRAQSLSAAGQGEAGKFTSQARWLDDGTFYAQDQDLWTSIGDELKMGIPDNPRIREQKQKYLRNKSYLHDVTLRAEPYMYWIAGQVKKRNMPMELVLLPIVESAFDPHATSGANAAGIWQIIPSTGRNYGLKQTRSYDARRDVVASTTAALDMMQRLNKMFDGDWLLTVAAYNSGEGRVMKAVKANRSRGKPTDFWSLSLPHETKIYVPKMLALSDILKNSKRYGVKLPTADESRALARVRLDSPVDISQLADMAGMPVSKLKTFNAGVKGSTLGASGPKYVMVPQKHAAQLRESLASGDIAAVQPTQLADNTPLTSRSYKVRSGDTISGIASRLGVTTRDLQQWNNLRGSGLKVGQNLVIGAGSSAQRLANNSDSITYRVRKGDSLSSIAKRHGVNIRDVMRWNSDTDNLRPGDQLTLFVKNNDRPES

SEQ ID NO: 12655 - protein, 118 aa, Klebsiella pneumoniae
LDSETQPARFFQTKSMISSFLYIPRWKARSRFVSDSEILIILLPLANVILALSNITFLAINNNSSSMENPFFNTLTLSPVILTQGEMISPTLTFAIFSQNTVTNINSATLIAYSSPNQ

SEQ ID NO: 12656 - protein, 213 aa, Klebsiella pneumoniae
IMAEQSDMKEVKRVLVGPLIANNPIALQVLGVCSALAVTTKLETAFVMTIAVTLVTAFSSMFISMIRHHIPNSVRIIVQMAIIASLVIVVDQLLRAFAYETSKQLSVFVGLIITNCIVMGRAEAYAMKSPPLASFMDGIGNGLGYGAILIIVGFLRELIGSGKLFGITVLETVQNGGWYQPNGLFLLAPSAFFIIGLLIWALRSWKPEQQEKE

SEQ ID NO: 12657 - protein, 264 aa, Klebsiella pneumoniae
PSDLFDSNGVVAMKKDAPRSGLRYLVLLIALFFPVTGAWASVTIVGSRIIYPSTVASVDVQLKNNDDFPYIVQTWFDNGDLHIGPENASGIPFISTPPVFRIQPKSGQIVRVVYSQRKALPHDRESVFWFNALQVPPANIGGRQQNKVLVMLRTRIKLFYRPEGIGSPGNLAKKLHITVVRNARKGAGIVISNPQPWYASLSNLSVKVNGTSRELNVDMVPPFSSRTFWIPGNVSANSLNGTVTVTVVNDQGARISERYHVAEG

SEQ ID NO: 12658 - protein, 411 aa, Klebsiella pneumoniae
VIFDAVLRPFAAEAGGLNAAERRDFGGDNAGIDADYAVLQRFADAEDAAQIAGVEIGGETELGIVGLGNDVGFIFKAEQRGQRAEGLLFRHFGAVGNVDQDGRLEEVATQGVRFAAGDHLRAFGDGIGNVFFNFGHGFLVDQRAGGDAVLQAVANAQFFHRLLQLLGETVIHPVLDVQAVGADAGLSGVAELRRQRPLDGFIEVGIVKDDKRRVAAQLQGDFFDVFRALLHQLAANLGRAGKGELAHQRVAGQFAADRAGGAGDHIEHSGGDPGAIRQFGQRQRGKRRLAGRFQDHGAAGGQRRARFAGDHRRREVPRRDGGGNADGLLNHQQALVGLVAGNGVAVDALTFFGEPLNKGGGVADFAFGFRQRFSLLEGHQASEIVLILHHKIEPAAQNVRPLFGGQGAPGG

SEQ ID NO: 12659 - protein, 256 aa, Klebsiella pneumoniae
SMCELLGMSANVPTDICFSFTGLVQRGGGTGPHKDGWGITFYEGKGCRTFKDPQPSFQSPIAKLVQDYPIKSCSVVAHIRQANRGRVALENTHPFTRELWGRNWTYAHNGQLKGYKSLKTGNFHPVGETDSEKAFCWLLHRLTERYPRTPGNMLGVFKYIATLAGELREKGVFNMLLSDGRYVMAFCSTNLHWITRRAPFGVAKLLDQDVEIDFQRETTPNDVVTVIATQPLTANETWHKIMPGEWALFCLGERVV

SEQ ID NO: 12660 - protein, 125 aa, Klebsiella pneumoniae
YLPDPPRAECNRQRHSQISVTPAITVKGIYSSARLKGPTSNDERKLRFSIASQGITITNPTPWYMSLAVAPIKGISIGNIMLAPYEQRDVALSNMPAVGSTVDYAVINDSGNWRTYTATIMDKEI

SEQ ID NO: 12661 - protein, 205 aa, Klebsiella pneumoniae
CLPDKRRKPVTPTLISAFLTYTLITALTPGPNNILALSSVTSHGLRRSLRVLAGMSVGFIITMLICAALTFSLVELDSRFTLVLGWIGAAYILWLAWQIAKSKPATGTPSVEPVGFWASLGLQFVNVKIILYGITALSTFVLPVTREPVWLISVSLLLAAIGALGNLCWALAGHLFQRLFLLYGRQLNWMLAALLVYCAVRIVVE

SEQ ID NO: 12662 - protein, 397 aa, Klebsiella pneumoniae
IMPLALFALTIGAFAIGTTEFVIVGLVPTIAQQLSISLPSAGLLVSIYALGVAIGAPVLTALTGRMPRKQLLLALMVLFTAGNILAWQAPGYETLILARLLTGLAHGVFFSIGSTIATSLVAKEKAASAIAIMFGGLTVALVTGVPFGTFIGQHFGWRETFLAVSILGVIALISSLILVPNNIPGRASASLRDQLKVLTHPRLLMIYAITALGYGGVFTAFTFLAPMMQELAGFSPSAVSWLLLGYGVSVAIGNVWGGKLADKHGAVSALKFIFAALVVLLLVFQLTASVHYAALATVLVMGVFAFGNVPGLQVYVVQKAEQYTPGAVDIASGLNIAAFNVGIALGSIVGGQTVERYGLAQTPWIGAMIVLVALLLVVLSGRLDKLPRRSAALSPEG

SEQ ID NO: 12663 - protein, 501 aa, Klebsiella pneumoniae
PSSCNRCMQESVRRLTVSELSQLSPQPLWDIFAKICSIPHPSYHEEQLAEHIMGWAKEKGLHAERDQVGNILIRKGATAGMENRKPVALQAHLDMVPQKNNDTVHDFVKDPIQPYIDGEWVKARGTTLGADNGIGMASALAVLADDSVAHGPLEVLLTMTEEAGMDGAFGLQANWLQADILINTDSEEEGEIYMGCAGGIDFTSNLELTREAIPAGFQSFKVTLKGLKGGHSGGDIHLGLGNANKLLSRFLAGHADELDLRLVDFNGGTLRNAIPREAYATVAVAADKADALKALVNTYQALLKNELEAKEKNLVVLVEAVDNDKAALTQASRDNFIRLLNATPNGVIRNSDVAKGVVETSLNVGVVTMTDDNVQIHCLIRSLIDSGKDYVVSMLDSLGKLAGAKTEAKGAYPGWQPDANSPVMHLVRETYQRLFNKTPNIQIIHAGLECGLFKKPYPEMDMVSIGPTITGPHSPDEQVHIESVGQYWTLLTELLKAIPAK

SEQ ID NO: 12664 - protein, 252 aa, Klebsiella pneumoniae
KFRCCNNRWSGWTALPTCAILIANWKESPGADVIVLPEMFTTGFAMEAAKQSLPEADVVEWMHARAAQSQALIAGSAALQTEHGAVNRFVLVEPDGTVHHYDKRHLFRMADEHHHYEAGNQRVVFEWRGWRILPLVCYDLRFPVWSRNQNDYDLALYVAKWPAPRSLHWQSLLIARAIENQAYVAGCNRVGTDGNGHHYRGDSRIINPQGEIIATADPHQATRLDAELSLSTLQEYREKFPAWRDADPFTIG

SEQ ID NO: 12665 - protein, 406 aa, Klebsiella pneumoniae
LCVCWPKWRSPRRIPAPFPPTPIKPSAAGRGIPSAGCTGGSGSWLFRWKPISRRLFCIRGCRASRCGCSPLVITLALTGSNLLSVKNYGEFEFWLALCKVIAILAFIVLGAVAITGFYPYAEVSGISRLWDHGGFMPNGFGAVLSAMLITMFSFMGAEIVTIAAAESDTPDKHIMRATNSVIWRISIFYLCSIFIVVALIPWNMPGLKSIGSYRSVLELLHIPYAKLIMDGVILLSVTSCLNSALYTASRMLYSLSRRGDAPAIMGRTNRSKTPYVAVLLSTGAAYLTVVVNYYAPAKVFKFLIDSSGAIALLVYLVIAVSQLRMRKILQAQGGEIRLRMWLYPYLTWLVIAFITFVLVVMLFRPAQQLEVISTGLLALGIICTVPIMSRWKKLVLWQKLPLQNTR

SEQ ID NO: 12666 - protein, 121 aa, Klebsiella pneumoniae
AAHRRYRRHHAVELPGGDDHPQSGPGAGRRLHHGPETGQPDAVFRAGAGRTGESRRDPRRSVQCGHRLRRRGRRRTDQQPAGAQALLYRLYRDWPPADGAVRERHQKSLPGAGRQRAVYRL

SEQ ID NO: 12667 - protein, 245 aa, Klebsiella pneumoniae
PCSRRPPGRVFRSKNMTAIHQATAIDGYRWLKNDIIRGVYQPDEKLRMSLLTSRYALGVGPLREALSQLVAERLVTVVNQKGYRVAPMSEQELLDIFDARANMEAMLVRLAIERGGDEWEAELLARAHLLNKLESCEASEHLLDEWDQRHQAFHTAIVAGCGSQYLLQMRERLFDLAARYRFIWLRTTVLSVEMLEDKHVQHQTLVDAILARDAEQASALMREHLLTPIPIIQQAMAGKLSPQAG

SEQ ID NO: 12668 - protein, 123 aa, Klebsiella pneumoniae
FLRRAQKGTFFDNSFEGDEASQIHISSLYRYYRSENEKIFIFLNYQLRVVSARQEEKTRDTYPDKRLFNLHFDHRPDTRAQQYPGAEQRHLPWSTPQPAGAGRDERRVYYHYVDLRGFNLFAG

SEQ ID NO: 12669 - protein, 156 aa, Klebsiella pneumoniae
VAERTGLEPATPCVTGRYSNRLNYRSTEFLRFITTGCHPGLLQFDAWQFPTLTWGDPTLPSALRRFTSEFGMGSGGTTALVPPGKFFVLSTQFFIASAALPALVKSVTYFSMLLPFRRLSPCCCANYCVLNSESKLKILSIRQNIFGVVRLSLTVH

SEQ ID NO: 12670 - protein, 431 aa, Klebsiella pneumoniae
QERRMNSNKAMMARRSDAVPRGVGQIHPIFAERAENCRVWDVEGREYLDFAGGIAVLNTGHLHPQVVSAVEDQLKKLSHTCFQVLAYEPYLALCEKMNQKVPGDFAKKTLLVTTGSEAVENAVKIARAATGRSGAIAFTGAYHGRTHYTLSLTGKVNPYSAGMGLMPGHVYRALYPCALHGVSDDEAIASIHRIFKNDAAPEDIAAIIIEPVQGEGGFYAASPAFMQRLRALCDEHGIMLIADEVQSGAGRTGTLFAMEQMGVAADITTFAKSIAGGFPLAGVTGRAEVMDAIAPGGLGGTYAGNPIACAAALAVLQIFEQENLLEKANQLGDTLRQGLLAIAEDHPEIGDVRGLGAMIAIELFEEGDRSRPNARLTADIVARARDKGLILLSCGPYYNVLRILVPLTIEEAQIEQGLKIIADCFSEAKQA

SEQ ID NO: 12671 - protein, 181 aa, Klebsiella pneumoniae
APRRTGRAPGWAPRDVARSAAGKAAFIRDLAMHIRAYRDSDLPLLCQIFLRAVRETASRDYTPGQIAAWAQVDETRWRQKLADSIGLVAVVNSQPVGFITAIGTHIDLLFVSPDRARQGIGGALIEALCAQYPAQILTVDASITAKPCFTAHGFKVVAEQQVAARGEWFINYRMEKRVALR

SEQ ID NO: 12672 - protein, 292 aa, Klebsiella pneumoniae
SLFFPSTPSAIISSVNRNEEITRKIMAIPAFGLGTFRLKDDVVIASVKTALELGYRAIDTAQIYDNEAAVGQAIAESGVPRNELFITTKIWIENLSKDKLIASLQESLQKLRTDYVDLTLIHWPSPNDAVAVEEFMAALMEAKKLGLTRQIGISNFTIPLMERAIAAVGAENIATNQIELSPYLQNRKIVDWAREHGIHITSYMTLAYGKALKDEVIARIAAKHNATPAQVILAWAMGEGYAVIPSSTKRDNLASNLKALDLQLDDEDRQAIAALDCNDRLVSPEGLAPQWD

SEQ ID NO: 12673 - protein, 89 aa, Klebsiella pneumoniae
TGFSMNLSRQEQRTLHVLAKGGRIAHVRDTSGRITAVECYTREGLLLSDCTLAVFKKLKTKKLIKSVNGQPYRINTTGLNNVRAQADNR

SEQ ID NO: 12674 - protein, 82 aa, Klebsiella pneumoniae
VPPSPPGAMASITSARPVTPASGKPPAMDLAKVVISAATPICSMANRVPVRPAPLWTSSAISIMPCSSHRARRRCIKAGEAA

SEQ ID NO: 12675 - protein, 101 aa, Klebsiella pneumoniae
SRRLALARPGMLFGTRIRLLISAITPRIDTARKVSRQPKCWPIKVPKGTPVTSATVRPPNIMAMAEAAFSFATRLVAIVEPIEKNTPCARPVSSRARISVS

SEQ ID NO: 12676 - protein, 411 aa, Klebsiella pneumoniae
GRISMEIILGVVMFTLIVLVLSGLILAARSKLVNAGDVVIEINNEADKQIRTPAGDKLLNTLSSNGIFVSSACGGGGSCGQCRVTVKEGGGDILPTELSHITKRDAKAGCRLACQVAVKQNMKIELPEEIFGVKKWECEVISNDNKATFIKELKLRIPEGEVVPFRAGGYIQIECPPHKVAYADFDVPDEYRSDWDKFNLFRYVSEVKEPTLRAYSMANYPEEKGIIMLNVRIATPPPKVPDAPPGIMSSYIWSLKPGDKVTISGPFGEFFAKETDAEMVFIGGGAGMAPMRSHIFDQLKRLHSTRKISFWYGARSLREMFYDEEFEQLARDNPNFTFHVALSDPLPEDNWTGHTGFIHNVLYENYLRDHPAPEDCEFYMCGPPVMNAAVIKMLKDLGVEDENILLDDFGG

SEQ ID NO: 12677 - protein, 92 aa, Klebsiella pneumoniae
DAQRSGRRGREYSPRRLWRLTMLTVFIATFVIFALVIFGMSLGYLVKRKSIQGSCGGISALGLEKVCDCPQPCDARKKRLAREAQRQQRRIL

SEQ ID NO: 12678 - protein, 374 aa, Klebsiella pneumoniae
NKKSIKFASDFAMLYGYTVLSLTMRKIIHVDMDCFFAAVEMRDNPALRDIPLAIGGSRVQRGVISTANYPARKFGVRSAMPTATALKLCPHLTLLPGRFDAYKEASNHIREIFSRYTSRIEPLSLDEAYLDVSDSEHCHGSATLIAQEIRQTIERELRLTASAGVAPVKFLAKIASDMNKPNGQFVIAPHQVAEFVRALPLAKIPGVGKVSAAKLENMGLRTCGDVQNSDLAMLLKRFGKFGRILWERSHGIDEREIHNDRQRKSVGVERTLAEDIHEWPECEAIIENLYPELERRLAKVKPDLLIARQGIKLKFNDFQLTTQEHVWPRLNKEDLIATAHKAWDERRGGRGVRLVGLHVTLLDPQLERQLLLGI

SEQ ID NO: 12679 - protein, 431 aa, Klebsiella pneumoniae
GFSGEGIERMYDFVIIGGGIIGMSTAMQLIEIYPDARIALLEKEAGPACHQTGHNSGVIHAGVYYTPGSLKAQFCLAGNRATKAFCEQNGIRYDVCGKMLVATSPLEMERMRALWDRTAANGLQREWLSAGELREREPNITGLGGIFVPSSGIVSYREVAAAMAKNFEAKGGTIVYNAEVSALKEHASGVVIRTRQGGEYEASTLIACSGLMADRLVKMLGVDPGFIICPFRGEYFQLAPQHNQIVNHLIYPIPDPAMPFLGVHLTRMIDGSVTVGPNAVLALKREGYRKRDISLADTLEILTSPGIRRVLQNNLRSGLGEMKNSLCRSGYLRLVQKYCPSLTLSDLRPWPAGVRAQAVSPQGKLIDDFLFVTTARSIHTCNAPSPAATSAIPIGAHIVSKVQTLLASQSNPGRTLRAARSVETLHAAFTR

SEQ ID NO: 12680 - protein, 460 aa, Klebsiella pneumoniae
PASGLKLRIPANDMIKITKGLDLPIAGMPLQQISPAPAVKRVALLGEEYVGMRPAMAVKEGDRVKKGQILFEDKKIPGVCFTAPASGIVSAIHRGERRVLQSVVIDIEGNDAVAFTRYAADALAELPRDTVQQQLLASGQWTALRTRPFSKTPLPGSTPAAIFVNAMDTNPLAAEPQPIILAERAAFDAGLTVLTRLTDGKVHVCQPSGGKLGGHPLGQVCFNQFSGPHPAGLPGTHIHFLEPVSLNKQVWHLNYQDAIAIGKLFLDGELYCERIIALGGPQVTSPRLVKTTLGASLEDLLAGELQEGENRVISGSVLSGARAHGPHAFLGRFHLQVSVVKEGREKELFGWVMPGKEKFSITRTTLGHFFKRKRFHFSTDTNGGERAMVPIGNYERVMPLDILPTILLRDLLAGDTDSAQALGCLELDEEDLALCTYVCPGKYEYGPALRSVLTRIEQEG

SEQ ID NO: 12681 - protein, 855 aa, Klebsiella pneumoniae
ASVIMSLKVKFSRQNIFVILAVACVGQAFGEEYYFDPSLLQGTAYGQGMASVNGPDTPAGEYLVDVIVNGTLIKSGVKIRFSPVNGGQRTEPCLPLSLMQAAQVKSLPDNALQNSCRPLRDWVSRGEWQFDSAMLQLRLTLPMSELMHRPRGYIPPSQWDSGALALFLRHNTNWTHTDNTSQHFRYHYLWSGINVGSNIGLWQLRHQGNLRYADSNQSGSAWHYNRVRTWVQRPLTAIDSIMAFGDNYTDSSLFGSLSFNGIKLATDERMWPQGKRGYAPEVHGVASSSARVVIKQLGKVIYETHVPPGPFYIDDLYNTRYQGDLQVKVIEANGKVSRFTVPYSAVPDSVRPGNWHYAFALGKVRQYYRIDNRFLEGTLQHGVNNHLTLNLGSRLAHDYQAWLAGGVLATRLGAFGMNATWSGAQVEHNDRQQGWRAEFSYSKTFSTGTNLVLAAYRYSTGGFRDLEDVFGVRQQEHNSIVYYSDTLHQRQRLSATVSQPLGRLGTLNLSASTADYYNNRSRITQLQLGYSNQWRKVSYGFNLARQRSTWDDGRFYHSVNEPQDLNQRQKYTETTLSFTLSIPFNWGDNPTSVAMNYNQSRANRSSTLSMNGTRGEQNELSWSVYGGYDRYRNGDEGTATTFGGNVQQNTRFGALRVGYDQGKDYRQVALGSSGSVVLHSGGVTFGPYASDTFALIHADGAQGAVVQNGQGAVIDRFGYAILPSLSPYRRNNVSLDTRQMRSDAELTGGSQQVVPYAGAIARVNFSTITGKAVLIAVKMADGGIPPMGAEVMNSEGAVIGMVGQGGQVYARISTPSGSLLVRWGKGANRRCRVPYQFDMHSPENVIYLTTTCERK

SEQ ID NO: 12682 - protein, 136 aa, Klebsiella pneumoniae
NFAIGAIMRATSEEIAIFVAVVESGSFSRAAEQLGQANSAVSRAVKKLESKLGVSLLNRTTRQLSLTEEGERYFRRMQVVLQEMAAARERSAGDAHDAAGPAAGRCRDAGDAAFSHAAGEAISRALPGNDAVARLV

SEQ ID NO: 12683 - protein, 246 aa, Klebsiella pneumoniae
MTAMSTAITRQIVLDTETTGMNQIGAHYEGHKIIEIGAVEVINRRLTGNNFHVYLKPDRLVDPEAFGVHGIADEFLLDKPTFADVADEFMDYIRGAELVIHNASFDIGFMDYEFSKLNRGIGKTETFCKITDSLALARKMFPGKRNSLDALCSRYEIDNSKRTLHGALLDAQILADVYLMMTGGQTSMAFSMEGESQQQAGELGIQRVVRAGSQLRVVYASDEELANHESRLDLVQKKGGSCLWRA

SEQ ID NO: 12684 - protein, 94 aa, Klebsiella pneumoniae
RNLICCAHEYTLANMKFALSILPDDRDINDYYHKVNELRAKKQKTLPVTLKNERRINLFLRVNDIDLIDKINKETNLQHSVARFAWLRSKKDDF

SEQ ID NO: 12685 - protein, 123 aa, Klebsiella pneumoniae
CRAMSIAPSTRARCTASVMTRRSPASIASSKTMPRRKISPPSLLSQCRVKAGSMPPPRPLCSACAPCATSTALCLSPMRSRAARAAPVPCSPWSRWASRRISPPSPNPSPAVSRWRASPAARR

SEQ ID NO: 12686 - protein, 346 aa, Klebsiella pneumoniae
IFLIYGYEMNITLTLQRGTILMNALTAVKPTPAPVAQQYPGFSFTPSAQSPRLLELTFSAETTTQFLQQVAQWPVQALEYKSFLRFQVGKILDDLCGNQLQPLLIKTLLDRAEGALLINGEGIDHVSQAEEMVKLATAVAHLIGRSNFDAMSGQYYARFVVKNVDNSDSYLRQPHRVMELHNDGTYVEEQTDYVLMMKIDEQNMQGGNSLLLHLDDWEHLDEFFRDPLARRPMRWAAPPSKNVSKDVFHPVFDVDSLGRPVMRYIDQFVQPKDFEEGTWLSRLSDALETSKNILSIPVPVGKFLLINNLFWLHGRDRFTPHPDLRRELMRQRGYFAYSTNHYQTHQ

SEQ ID NO: 12687 - protein, 74 aa, Klebsiella pneumoniae
LPLIATEQVSSETSPRKVIVLLDMASALVEIKSEAVNKASVVFLNMVFYSFVAIHLYMMRLALQLGQIKTTSFS

SEQ ID NO: 12688 - protein, 428 aa, Klebsiella pneumoniae
QVTISGVALRRRLHMSQANLSETLFKPRFKHPETSTLVRRFSAGKPQAMQSALSGNHVDHWYRLINRLMWIWRGVTPQEILDVQARIVMSEAERTDPELFDTVIGYRGGNWIFEWAKEAMQWQQKAGQEADPLLSGRHWLHASNLYSIAAYPHIKGDELAEQAQALANRAYEEAAQRLPGSLRELEFTIPGGSPITGFLHMPKGEGPFPTVLMCGGLDSLQTDYYNLYENYFSPLGIAMLTIDMPSIGFSSKWTLNQDTSLLHQHALRHLENVPWIDHTRVAAFGFRFGANIAVRLGYLEPQRLKAVACLGPVVHGLLVDPLHQGRVPEMYLDVLASRLGMHDASDEALRVELNRYSLKTQGLLGRRCPTPMLSGFWKDDPFSPEEESRLITSSSADGKLLEIPFNPVYRNFDHALRQIARWINHRFG

SEQ ID NO: 12689 - protein, 60 aa, Klebsiella pneumoniae; identical to SEQ ID NO: 8602

SEQ ID NO: 12690 - protein, 200 aa, Klebsiella pneumoniae
CAPIWFIPVVSVSRTIWRVIAVLIAVIYVRLIVYKSISITGSLPEMLKQVEIFTDGSCLGNPGPGGYGAIMRYRQHEKTFSAGYRLTTNNRMELMAAIVALEALKEHCEVVLSTDSQYVRQGITQWIHNWKKRGWKTAEKKPVKNVDLWQRLDAALGQHKIKWEWVKGHAGHPENERCDELARAAASHPTLDDVGYLPES

SEQ ID NO: 12691 - protein, 156 aa, Klebsiella pneumoniae; identical to SEQ ID NO: 8616

SEQ ID NO: 12692 - protein, 413 aa, Klebsiella pneumoniae
EMGLKHLIEKLEPHFTHGGKLEKYYPLYEAAATIFYTPGQVTRGAAHVRDAIDLKRMMILVWFAVFPAMFWGMYNVGLQTIPALHKLYGAEQLQQAIANNWHYSVAQWLGVSFSADAGWLSMMTLGAVFFLPIYITVFIVGGFWEVLFAIVRKHEINEGFFVTSILFALIVPPTLPLWQAALGISFGVVIAKEIFGGTGRNFLNPALAGRAFLFFAYPAQISGDLVWTAADGFSGATPLSQWASGGGEALVNVATGVPVSWMDAFLGNIPGSIGEVSTLMIFIGGAIILFGRVASWRIVAGVMIGMIATATLFNVIGSDTNPMFAMPWYWHLVLGGFAFGMMFMATDPVSASFTDKGKWSYGVLIGVMCVLIRVVNPAYPEGMMLAILFANLFAPLFDYLVVQANIKRRKSRG

SEQ ID NO: 12693 - protein, 157 aa, Klebsiella pneumoniae
GEGVETLVILAVVVWVLFKLVQKVTSKLYPPDSVKVQEKPDTTPATDAWGNYPKAEGHVVLFEQYRREQALRQQAAKEADTFYRSREWRRLRYQAFQRYGNKCCVCGRGASDGMVMHVDHIKPRSLYPHLALDIANLQIMCNECNVSKGNRDEVEWQ

SEQ ID NO: 12694 - protein, 293 aa, Klebsiella pneumoniae
AIRVAELMLVTVFCEKIANVKVGEIISPCVNMTGDRVSVLKNGFSMDEELLLIAKKVIFDSARMTLANGNKIIKISESETNLLLAFHRGIYKKEDIIDFVWKNRAGCVSESSYYKLINQMRNNFSLVGLKADDIVTRPRIGVSLSLPLEPFKKQRSEAGEQASDTARGKDSRQTHLAEGKKFTAKIRLLVLTMLLMLLTAIAMLFQHAPVQNKHKSTFRMLGDKDGYIFFKMASDKVTFKEVVSAYNTLTLPLCRQNGHYLYYLREPNMNLFLQCLNPVETAVPKCITIKERY

SEQ ID NO: 12695 - protein, 70 aa, Klebsiella pneumoniae
DSVSLRLPYPVNLATEYKSLTHYTKGTQSHPKVLPLLVRTRFQVLFHSPRRGSFRLSLTVLVHYRSVRSI

SEQ ID NO: 12696 - protein, 103 aa, Klebsiella pneumoniae
PARSGGAPAPPPHGRAPGRGRSVFRNRPPCPPWRRLPAVRHATGLNWRSAPRRWRRYGSPRSRSPPGRHSGRPAPGRAPGRHRPPSSANFLHDEQDWRHEPDR

SEQ ID NO: 12697 - protein, 385 aa, Klebsiella pneumoniae
RAGSAKRPEQSRAPRCRRALLSQGSSMIKTFRFALLACGLVGGALTATAAPAVPVRVATVELAPHAEERAIPGRVEAIRAVDIRARTEGVIVQRHFQDGQYVTEGDLLFTLDDAQPRAALALAQAELKSAEASLRQSQQLLTRYERLINNHSISRNDVDTARMQRDVAAAAVQQAKARVEAQRIVLSYTQIAAPVTGRVGHSAFHVGTLVNSSSGVLVDIVQLDPVRVSFALDEAAFFSKTGQHADIHALKQAWLAQIEIDGKRRDGVLTSIDNRIDARTGSVAVRAEFANPQHRLLPGGSVTILFRPQELPSRVMVPAAAVQQDPQGFFSWVLKPDHTAGQRRLTLAGQQGQQFAVEKGLQAGEQVITDGAQRLREGAAVQVLN

SEQ ID NO: 12698 - protein, 337 aa, Klebsiella pneumoniae
LSISTCCRREKCRRCRPRRRWACRWARCCASLSRCAAAVSCRRWIWWSLTRCLTLTVRALARRPVWHGKSPIGGASDPRYYFRFPAPLITHKESQAMFAQQPRSAPAPFYEKVKQAISEKIHSGVWRPHDRIPSEAELVAQFGFSRMTINRALRELTDEGLLVRLQGVGTFVAEPKGQSALFEVRSIAAEIVARHHQHRCEVLLLEETRADHIQATALSVPEGTRIFHSLMVHYENEVPVQIEDRCVNAAVVPDYLHQDYTATTPHDYLSLIAPLTEGEHIVEAVQATAEECALLHIHAHDPCLLIRRRTWSTTHIVSHARLLFPGSRYRLQGRFGS

SEQ ID NO: 12699 - protein, 131 aa, Klebsiella pneumoniae
PSASPLTPRPRRVRKPLTSGNGPSAALSRIARASGWLEPCSSAAARRSAVCSSTPAKVFTATTCGLPSVRVPVLSNTRVSSSLARCSASASRTSTPYSAARPTPEIIDIGVARPKAHGQAIISTVVAMTRV

SEQ ID NO: 12700 - protein, 106 aa, Klebsiella pneumoniae
PDNSRPWWELLFCRNTGADMKTKLNELLEFPTPFTYKVMGQALPELVDQVVEVVQRHAPGDYSPSVKPISKGNYHSVSITINATHIEQVETLYEELGNIDIVRMVL

SEQ ID NO: 12701 - protein, 285 aa, Klebsiella pneumoniae
LSCSSPARGCWGKKRFGRWEEGTAAMAENNVILQVQDVTMQFGGLRAIDNVSFHVDEAEIFGLIGPNGAGKTTLFNVITANYKPTSGSVTLAGTSLKGLKPNQVVNAGIARTFQNIRLFNSMTVLENVMVGLDRASRYSLLEAALHIGRYFPAERAAKAKAMAILEDIGIAHFAHMQATNLSYGNQRKVEIARALATAPKLLLLDEPAAGMNPKETEDLAELIFRMRHDYQLSVLLIEHDMPFVNRLCERVMVLEYGKPLFSGLMAEAIQHPDVISAYLGEANYA

SEQ ID NO: 12702 - protein, 451 aa, Klebsiella pneumoniae
QHRSRQRQQHPQAPVRRPGKIKDFRLQHRQRHFRAYRRHQAGNQPQQGKLRPQRSAQQRFSCPQRAPDHQLLMALTHTDLHLRQQQQHAAGRHQAYHHLQRPADLGEHLADLTQDGADIQQTDGGKLAVQLGQHRGTVIPAEAGEPALRLPVQRPGGENKEEVWPQALPVYFARAADLRAELLGIAGKGHCIADLYPQPLRQPLLNRYLARLRRPAAGHQRIMIRTLFAPGEIKLAIQRFVFVSVRRLTVDLRQTGPDDRIEFRRPRLVFGEEGLHRHYLLRGDIDQKVVRALRGQLLLPAVKQIAAQHQQERQQHKRQGKRRQLAEGRPRLAQQAVHRQTQRQGFERQAFEQPQQSPAHQAAQQRQHHRPGQHRPQQRAAAQQPGQQAHHHDANRRDPDFQRPDVSHHILTQHSQRQGRQQQSIGSQAHQQGNDACRPDSPQPRPTAGSG

SEQ ID NO: 12703 - protein, 121 aa, Klebsiella pneumoniae
SRRSSPARRGRRPADDGLHRGPAAGFSAPAAPLRSPSPPSPAHGWPPPLPPPEFPAAPQRTGTHDSSGSCGSGSWPYRCSAGSIAHRRWLCRYGRAGRPSGSCRDPASGSRTASAPPDYSG

SEQ ID NO: 12704 - protein, 619 aa, Klebsiella pneumoniae
TTGSAPGSATGYRCGVGGLRSLWICCGVGCVMKLPVREFDAVVIGAGGAGMRAALQISQSGQTCALLSKVFPTRSHTVSAQGGITVALGNSHEDNWEWHMYDTVKGSDYIGDQDAIEYMCKTGPEAILELEHMGLPFSRLDDGRIYQRPFGGQSKNFGGEQAARTAAAADRTGHALLHTLYQQNLKNHTTIFSEWYALDLVKNQDGAVVGCTALCIETGEVVYFKARATVLATGGAGRIYQSTTNAHINTGDGVGMAIRAGVPVQDMEMWQFHPTGIAGAGVLVTEGCRGEGGYLLNKHGERFMERYAPNAKDLAGRDVVARSIMIEIREGRGCDGPWGPHAKLKLDHLGKEVLESRLPGILELSRTFAHVDPVKEPIPVIPTCHYMMGGIPTKVTGQALTVNEKGEDVVIPGLFAVGEIACVSVHGANRLGGNSLLDLVVFGRAAGLHLQESIAEQGTLRDASESDIEGSLDRLNRWNNTRSGEDPVAIRKALQECMQHNFSVFREGDAMHKGLEQLKVIRERLKNARLDDTSSEFNTQRVECLELDNLMETAYATAVSANFRTESRGAHSRFDFPDRDDENWLCHSLYLPESESMTRRSVNMEPKLRPAFPPKIRTY

SEQ ID NO: 12705 - protein, 311 aa, Klebsiella pneumoniae
TRLSGISKVRLLNWRRQAALNAMPGIRPGEIHTPWHEFWRRFRRQPVAMGAGIFVLLLIAVAIVAPWIAPYDAENYFDYDRLNEGPSLVHWFGVDSLGRDIFSRVLVGAQISLAAGVLAVLIGAAIGTVLGLLAGYYEGWWDRLIMRLCDVLFAFPGILLAIAVVAVMGSGMANVIIAVAIFSIPAFARLVRGNTLVLKQQTFIESARSIGASDATILFNHILPGTVSSIVVYFTMRIGVSIISAASLSFLGLGAQPPTPEWGAMLNEARADMVMSPHVALFPAVAIFVTVLAFNLLGDGLRDALDPKLKG

SEQ ID NO: 12706 - protein, 176 aa, Klebsiella pneumoniae
ASISRGYETMSTAKLVKSKASNLVYTRNDVADSEKKATIELLNRQVIQFIDLSLITKQAHWNMRGANFIAVHEMLDGFRTALTEHLDTMAERAVQLGGVALGTTQVINSKTPLQSYPLDIHHVQDHLKALADRYAVVANDVRKAIDEAKDEDTADIFTAASRDLDKFLWFIEANIE

SEQ ID NO: 12707 - protein, 286 aa, Klebsiella pneumoniae
LLISAPEALFLVLPLPAAAALFPLAPPPVLGAFLPELRSPSRLSTPSASFAAAAFFAAAAFAAAALAALSAAAFSAAAAFSAAAAFSAAAFSAAAFCAAAFSAAFSAAAFSAAACLAASCWAFFSASCCAFFAAAASAFFCASAAAFAASASACFFASAAAFAAAASACFFASAAALAAACSAAFAWASAFAFASAAALAAASCASFACASALAFAAAAALAAASSACFCCSFASFAASCACSRSCSSCFSRSCSAACFSRNSSACCCACFSRCSAARRALACCCC

SEQ ID NO: 12708 - protein, 189 aa, Klebsiella pneumoniae
RHSSGADPSMSALTLFSVTDPQTPLWHSTDAKAIQDQLNAKGVRFERWQADRDLGANPSPETVIAAYQHAIDKLVAEKGYQSWDVISLRADNPQKEALREKFLNEHTHGEDEVRFFVEGAGLFCLHIGDEVFQVLCEKNDLISVPAHTPHWFDMGSEPNFTAIRIFDNPEGWIAQFTGDDIASAYPRLA

SEQ ID NO: 12709 - protein, 272 aa, Klebsiella pneumoniae
PIPSPIWRRTPASTISSSKTRVNAIANPASAGFVLYAMSSHYLRIFQQPKSAILLLLGFASGLPLALTSGTLQAWMTVENIDLKTIGFFSLVGQAYVFKFLWSPLMDRYTPPFLGRRRGWLLTTQVLLLLAIATMGFLEPVTQLRWMAALAVVNRLLLGVAGYCVRRLEKRRVASRRAWRPAPRSACWAIAWGCWSPVELALWLADRYLGWQGMYWLMGGAAGTLHYRHAAGARTERRYPGPQIARAGGSRTAARFFRPQQRLADSAAHRPL

SEQ ID NO: 12710 - protein, 209 aa, Klebsiella pneumoniae
TAQSGRWLSAGGSVRYLVTMLLSLAVLVTAGCGWHLRSTTKVPATMKTMIFQSSDPNGPLSRAVRNQLRLNGVELIDASTLRKDVPSLRLDGSSIQKDTASVFQDGRTAEYQMVMTVHASVLIPGHDIYPITTKVYRSFFDNPQAALAKDAEQDMIIQEMYDKAAEQLIRKLPSVQVADVEATQQEEKPAASSAAPASSGNRVSTTLGQ

SEQ ID NO: 12711 - protein, 265 aa, Klebsiella pneumoniae
VRQSFCPFLLILQGILMLKRLLLLSLLPLCSHAEELPAPVKAIEKQGITIIKPFEAPGGMKGWLGKYQDMGVAIYLTPDGKHAISGYMYDENGSNLSEQLFQKELYTPAGQEMWKKMASAHWLQDGRKDAPIVLYVFADPFCPYCKQFWQQSRPWVEAGKVQIRTLLVGVIKPESPATAAAILASSDPAKTWHDYEQSNGKMALTIPKAIPPKKMKMLNVNQQLMDDLGANVTPAIYYMNKDNMLQQVVGLPDKEKLHIMMGEKE

SEQ ID NO: 12712 - protein, 225 aa, Klebsiella pneumoniae
KIESTFEGIFVMRIILLGAPGAGKGTQAQFIMEKYGIPQISTGDMLRAAVKSGSELGKQAKDIMDAGKLVTDELVIALVKERIAHEDCRNGFLLDGFPRTIPQADAMKEAGITVDYVLEFDVPDELIVDRIVGRRVHAASGRVYHIKFNPPKVEGKDDVTGEELTTRKDDQEETVRKRLVEYHQMTAPLIGYYTKEAQAGNTKYAKVDGTKAVADVRAELEKILG

SEQ ID NO: 12713 - protein, 86 aa, Klebsiella pneumoniae
RLRSKHSCWGSMLTIMAALAKMELSVLDERRKAGIKRAKSQGIHCGRLAKASTEDILLLIAQDKSRREIEKELGISKATYFRLKKF

SEQ ID NO: 12714 - protein, 339 aa, Klebsiella pneumoniae
PAGSTSIAGSAGFMSIQKIARLAGVSVATVSRVLNNSDTVKAKNRERVLQAIKESNYQPNLLARQLRTARSNMILVMVSNIANPFCAEVVKGIEEEAEKNGYRILLCNSGSDLARSTSGLQLLSGKMVDGIITMNALSSLPELTTMIGDAPWVQCAEYADTGSISCVGINDVEAAQGAVSRLADSGRRRIALINHDLSYRYARLRERGYKSVLHVHGLAYQQVTYAQDLSAAAGKRAMEQLLSQDEKPDAVFAVSDSLAAGALRAIAQAGLRVPEDIAVIGFDGTELAEVVSPQLTTVEQPSRAIGRTAVSLLMKRIDDPDAAVERVMMDWRVIDRASV

SEQ ID NO: 12715 - protein, 422 aa, Klebsiella pneumoniae
SITFLRASNMVTTTEGRESVRVSHRFLVPRLSLMMFMQFFIWGSWSVTLGLVMTRYEMSLLIGDAFSAGPIASILSPFVLGMLVDRFFASQKVMAVMHLAGAAILWFVPQALVAQNGALLIGLLFGYTLCYMPTLALTNNIAFHSLANVDKTFPVVRVFGTIGWIIAGICIGVTGISDTTGIFTLAALCSVALALYSLTLPHTPAPAKGMPVQFRDLLCADAFALLKTRHFLIFSLCATLISVPLGTYYAYTASYLADAGVKDVSTAMSFGQMSEIVFMLVIPLLFRRLGVKYMLLIGMAAWFVRYAFFALGVSEEGRFLLYLGILLHGVCYDFFFVVGFIYTDRVAGEKVKGQAQSMIVMFTYGIGMLLGSQISGALYNHLVAGQSVPQAWVTFWWIPAVAAAVIALIFLFSFQYNEKEPH

SEQ ID NO: 12716 - protein, 134 aa, Klebsiella pneumoniae
RSPSNRPPDPGRLYSSWLSAYADVLPVTGQKMAPHDTFPQRVWHIVASIPEGYVTTYGEVARLAGSPRAARQVGGVLKRLPEGSTLPWHRVVNRHGDISLTGPDLQRQRQALLAEGVQVSGSGHIDLQHYRWVY

SEQ ID NO: 12717 - protein, 199 aa, Klebsiella pneumoniae
KTASLSAHTRASRTGKISVEPRCSYRQRRSTPRCCTKLARWRQSYTPRGASCGTSNRMACCTTRRRKSRPLADAIARAVRDADADLVLVGLAGSELIRAGQHYQLTTRQEVFADRGYQADGSLVPRSQPGALIESEEQALAQTLEMVQHNRVRSLSGEWAHVKAETVCLHGDGAHALDFARRLRAAFAGRNIDVSADLE

SEQ ID NO: 12718 - protein, 233 aa, Klebsiella pneumoniae
SQASGALGTGDIMNQWGVIWSVRDSFIAGVFATLELFITAALAALIIGIALCYFSEYQKKVINRIIIGFVSLMRAIPFLILAYLLYYGLPQLGISMEPWTAGLLALIIYHGAYFFEILRSQRRVFSGGYIEAAIAQGFSRYAIFRRIILPNIVSSALPLIGNQLIICLKDTAFLSIITVQEITAAANSVQATYFIPFNAFIVAIGLYWAISILLELLIKRLTAWGAKRGMSHA

SEQ ID NO: 12719 - protein, 215 aa, Klebsiella pneumoniae
WLKSISSLFASSDITGKIARALRNQLSFRDNKLSYAALQVLCNAKETEGEEKMPSFDIVSEVDLQEARNAVDNASREVESRFDFRGVEATFELNDANKTIKVLSESDFQVNQLLDILRAKLLKRGIEGTSLDVPEDIVHSGKTWFVEAKLKQGIESAVQKKIVKLIKDSKLKVQAQIQGEEIRVTGKSRDDLQSVMALVRGGDLGQPFQFKNFRD

SEQ ID NO: 12720 - protein, 582 aa, Klebsiella pneumoniae
TGESVVNKKAMAAAVSMILAGGAHAAQQERPNVIVIIADDMGYSDISPFGGEIPTPNLQAMAEQGMRMSQYYTSPMSAPARSMLLTGNSNQQAGMGGMWWYDSTIGKEGYELRLTDRVTTMAERFKDAGYNTLMAGKWHLGFVPGATPKDRGFNHAFAFMGGGTSHFNDAIPLGTVEAFHTYYTRDGERVSLPDDFYSSEAYARQMNSWIKATPKEQPVFAWLAFTAPHDPLQAPDEWIKRFKGQYEQGYAEVYRQRIARLKALGIIHDDTPLPHLELDKEWEELTPEQQKYTAKVMQVYAAMIANMDAQIGTLMETLKQTGRDKNTLLVFLTDNGANPAQGFYYESTPEFWKQFDNSYDNVGRKGSFVSYGPHWANVSNAPYANYHKTTSAQGGINTDFMISGPGITRHGKIDASTMAVYDVAPTLYEFAGIDPNKSLAKKPVLPMIGVSFKRYLTGEVQEPPRGNYGVELHHQAAWVDGEWKLRRLVPRGLTAGDAPWQLFNLHNDPLETHDVAAEHPDRVKAMSEAYEAFAKRTMVTRAQGKMIDYVGIDSKTGHYLAVDPATMKPVPAPQAIPVSEIH

SEQ ID NO: 12721 - protein, 641 aa, Klebsiella pneumoniae
SRWSPSPAVFVQKTARCWRMRGLTTISAVPAPMKTASLSWTWIRNTPLSISATAAIKPAKWRWSSARRAAPSGSGMWSAAASRRGRRCSSQEKRIKVNALMALAILALLWPAAALRAAVTKTTWSDAPAREFVFVENNSDDNFFVTPGGALDPRMTGANRWTGLKYTGSGTIYQQSLGYIDNGYNTGLNANWKFDMWLENSPVSHPLSGLRCINWYAGCDMATSLILPQTTDASGFYGATVTSGGAKWMHGMMSDAFYQYLQQMPVGGSFTMTINACQTSVNYDASSGARCKDQASGNWYVRNVTHTKAANLRLINTHSLAEVFINSDGVPTLGEGNADCRTQTIGSRSGLSCKMVNYTLQTNGLSNTSIHIFPAIANSSLASAVGAYDMQFSLNGSSWKPVSNTAYYYTFNEMKSSDAIYVFFSSNFFKQMVNLGISDINTKDLFNFRFQNTTSPESGWYEFSTSNTLIIKPRDFSISIISDEYTSAPSREGYVGSGEPALDFGYIVTTSGKTAADEVLIKVTGPAQVIGGRSYCLFSSDDGTAKVPFPATLSFITRSGATQTYDAGCDDSWRDMTDALWLTTPWTDISGEVGQMDKTTVKFSIPMDNAISLRTVDDNGWFGEVSASGEIHVQATWRNIN

SEQ ID NO: 12722 - protein, 507 aa, Klebsiella pneumoniae
PATLFVSIYRTHNRGGVMSRMAEQQLYINGGYTSATSGRTFETINPATGEVLATVQAAGREDVDRAVESAQRGQKIWAAMTAMERSRILRRAVDLLRQRNDELARLETLDTGKPLSETAAVDIVTGTDVLEYYAGLIPALEGSQIPLRDSSFVYTRREPLGVVAGIGAWNYPIQIALWKSAPALAAGNAMIFKPSEVTPLTALKLAEIYSEAGLPDGVFNVLPGIGAETGQYLTEHPDIAKISFTGGVASGKKVMANSAASSLKEVTMELGGKSPLIIADDADLDLAADIAMMANFYSSGQVCTNGTRVFVPAKQKAEFEHKILERVARIRAGDLFADDTNFGPLVSFPHRDNVLRYIESGKREGARLLCGGEALKGDGFDNGAWVAPTVFTDCSDEMTIVREEIFGPVMSILSYADEAEVIRRANATEYGLAAGVVTPNLNRAHRIIHQLEAGICWINSWGESPAEMPVGGYKHSGIGRENGVMTLQSYTQVKSIQVEMGKFQSIF

SEQ ID NO: 12723 - protein, 403 aa, Klebsiella pneumoniae
IFFPQTGAVFYFCLYLVAAGRDLLAGGRRRLAAAGHRGIAKCGDQRGALLVAQLSGVLRLLSVLRRRVRAVLVCLLPAPLAVLVDSRHLAHHLRHLVSGRSRGGVNAWYAPFYDLIQSALATPHKVSINQFYQEIGVFLGIAIIAVIIGVMNNFFVSHYVFRWRTAMNEHYMAHWQHLRHIEGAAQRVQEDTMRFASTLEDMGVSFINAVMTLIAFLPVLVTLSEHVPDLPIVGHLPYGLVIAAIVWSLMGTGLLAVVGIKLPGLEFKNQRVEAAYRKELVYGEDDETRATPPTVRELFRAVRRNYFRLYFHYMYFNIARILYLQVDNVFGLFLLFPSIVAGTITLGLMTQITNVFGQVRGSFQYLISSWTTLVELMSIYKRLRSFERELDGKPLQEAIPTLR

SEQ ID NO: 12724 - protein, 391 aa, Klebsiella pneumoniae
FHLPAFQSQPMSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPAHVKFLLATTDPQKLPVTILSRCLQFHLKALDVEQIRHQLEHILGEEQIAFEPRALQLLSRAADGSLRDALSLTDQAIASGEGQLTAASVSTMLGTLDDDQALSLIEALVAADGERVMAGVNDAAARGVEWEALLVEMQSLLHRIAMVQLSPSALGADMAAVEVRMRELARTVPPGDVQLYYQTLLIGRKELPYAPDRRMGVEMTLLRALASHPRKPLPEPEVKLATGSGPRAG

SEQ ID NO: 12725 - protein, 357 aa, Klebsiella pneumoniae
NQLPLVDHSRAGGRRRHRPGADDQHQARPLRSGEHHPAADHSGSVGAGHAVRSSAPVGTGGEKMSVWHMQPDIAASRRQHKQLYQVQGRYLRYVGLVALACLLYYVWFFLQFGVSGEQLTTGLQQIGRYLARMFVWHDFWNWPFGYYFTQIGVTLAIVFAGTLTATVLALLLSFFAARNIMRGVVLGTLALLMRRLFDVLRGIDMAIWGLIFVRAVGLGPLAGVLAIIMQDTGLLGRLYAEGHEAVDRSPGRGLTAVGANGLQKHRFGIFTQSFPTFLALSLYQIESNTRSAAVLGFVGAGGIGLIYAENMRLWNWDVVMFITLLLVAVVMIMDTLSAWLRRRYIGGAAVPLYQGGR

SEQ ID NO: 12726 - protein, 467 aa, Klebsiella pneumoniae
GLSPSDRLSTPGPARRPRRGLTPARRSAATASAIRARTSGRSCFLPQLAIRQAQTAIAARRQQRIVSDEDQGGAVFAIKREQQIGNFVPGLAIEVAGGLIGEQNGRAPVKGPGQRHPLLFAAGELRRQVVQAFAKSQLLKQRAGIAPALAIAGAAQQRRQLDVLQGVERRDQHKRLKNKTNVLRPQRRPRLFIHPVQRFAQHRYFPAAAIVEAGEDRQQGRFTGTRLADQGDGLPRFDNQLNSGKDGELMLPLTDGLLKMMNFKYVFRWHVPFLLLFLFTCRAMAADTLLILGDSLSAGYRMAANAAWPALLNEQWQAKTPVVNASISGDTSQQGLARLPALLKQHQPRWVLVELGGNDGLRGFPPQQTEQTLRTIIKDIKAANAEPLLMQIHLPANYGRRYNEAFGAIYPALAKEFAIPLLPFFMEEVYLKPQWMQDDGIHPNRDAQPFIADWMAKRLAPLVNHDS

SEQ ID NO: 12727 - protein, 125 aa, Klebsiella pneumoniae
QEYPMNMKKLTTLLLTATLGLASGAALAADTGAQSNNGQANSSADAGQVAPDARENVAPNNVDNSQINSGSGGTTGSTMTQDNMSSDEVHKNSMCKDGRCPDTGKKLDNGGNTTQDNSKTDGTTQ

SEQ ID NO: 12728 - protein, 468 aa, Klebsiella pneumoniae
NLLFYTNLNETGRRGRKNLPSLRNAQPCRMVFSHKKITFPCAIVDFTGVMKINVYTTHDKLSAMTEATSELVIWRNGRLATLNPDHAQPYGLLERHALLVRDGRIAAIVAEDDVPSGRSIDLEGRLVTPGLIDCHTHLVFGGSRAQEWEQRLNGVSYQTISASGGGINSTVRATRDSSEAELLALAQPRLERLLREGVTTLEIKSGYGLDLPNERKMLRVARQLADHNGVELSATLLSAHATPPEYQGDANGYITLVCETILPTLWQEGLFESVDVFCENVGFSPQQTERVFQAAQALGIPVKGHVEQLSSLGGAQLVSRYHGLSADHIEYLTEEGVAAMRESGTVAALLPGAFYFLNETRKPPVELLRKYQVPMAVATDFNPGTSPFASLHLAMNMACVKFGLTPEEAWAGVTRHAARALGRQASHGQLAPGFVANFAIWDAEHPVEMVYEPGCSPLWHRVVQGELQ

SEQ ID NO: 12729 - protein, 564 aa, Klebsiella pneumoniae
SSLLLQTTGLIIERALAFEKVQIHFQNRLTRLHVRALFNQTFEALAFQRHGVDTHVNDDFRTVVGFEAERVVSVENFHHGTGGRGHHDVAGRFHRDPVADGFAGEGFVRHLLKGHHVTGNRRNQRLNGLRVRYRLRFSRGRCGGDVASRCGCRCRYRAAGNHFFHLIADRLCFRTDDNLNGLLIQFHHPGRAETFTGGVVHLRRIAHGQTQTGDTGVNGFQVVRSAHRGDIAGRQLGQPLFSVAVGFFRYHVSGFVFTTRRFQVEHADHRAEQQEVDEEEHHAHHQQHPDVFAGGRQAVHQHVVNCTCGEGEARMDPERRCDEQADTGQHRMQEVQQRSQEHEQEFQRLGYPGQERGDGHGQQHTAYHRTTRFRRRQIHRQRRTRQTKHHDWEEAGHEHPRGAVAGVEAVDVAVEHSASGVSELTNLEPGDGVQHLMQTGWDQQTVDETKDTGTQRACGDDPFAARVDSVLHRRPDVAEDRREDQTEEAGGDRHEAFAAEEAQEVRQLDAGPAVVYRPCHQTGNDTGQHAHIDFRVDGDHRFGHHEIPYRTGQRRRTGVILGPA

SEQ ID NO: 12730 - protein, 129 aa, Klebsiella pneumoniae
IWLFYLFNLALWSYFMTLDYVALAILIAVALILFYGVIVIHDIPYEIAKERRHPHQDAIHYAGWVSLFTLHALWPLLWIWATLWREDRGWGMRHIADDQQALHQRLETVVQQLEQVQREVDVLKAKEAK

SEQ ID NO: 12731 - protein, 232 aa, Klebsiella pneumoniae
GIMLDILPSGCKTQKFSEFYRHPGLTLSAVGICTYNPNDLYSEKISHWIKMKTIEVDDELYRYIASHTLHIGESASDILRRMLKFSAVSQPATPVSKAAPTLAPAPVAEVKPANPVKDKVRAMREMLLSDEYAEQKRAVNRFMLVLTTLYSLDSKAFAEATESLHGRTRVYFAEDARTLLKSGNQTKPKQVPGTPWWVITNTNTGRKCSMIEHIMQSMQFPAELIEKVCGTI

SEQ ID NO: 12732 - protein, 138 aa, Klebsiella pneumoniae
HYFPSTAATTCCAASVRLFAAIIFRPLSASFFAPSSALLPSRRTTTGTLTPTSATAPMMPSAIRSQRTMPPKILTSTALTLSSERMILNASVTRSLVAPPPTSRKLAGSPPCSLTMSMVPIARPAPLTMQPMLPSSAT

SEQ ID NO: 12733 - protein, 299 aa, Klebsiella pneumoniae
MDFPQQLQACVEQANEALRRFIAPQPFQNTPLVEAMHYGALLGGKRLRPFLVYATGEMFGVCRTTLDAPAAAVECIHAYSLMHDDLPAMDDDDLRRGLPTCHIKFGEANAILAGDALQTLAFSILSDAPMVDVPDRDRLAMVSELAQASGVAGMCGGQALDLQAEGQQVDLQALERIHRHKTGALIRAAVRMGALSAGERGRAALPALDRYAENIGLAFQVQDDILDVVGDTATLGKRQGADQQLGKSTYPALLGLEQARKKAHDLIADARRSLDELAAQSLDTSALEALANYIIQRDK

SEQ ID NO: 12734 - protein, 162 aa, Klebsiella pneumoniae; identical to SEQ ID NO: 10433

SEQ ID NO: 12735 - protein, 105 aa, Klebsiella pneumoniae
TRYPEWRAFSPESAPVRPRRRPPSSRNIADTAAAPRCAPPPAPVSHPPRWPATVNHSSCPAPPGYPAAWQPAPAAGDDYTPSAAIPLPSTRTDRASPRAGSESAV

SEQ ID NO: 12736 - protein, 406 aa, Klebsiella pneumoniae
NAHPPFGDVHLDSNPGRGGGGGPPLPHRHRSGAGFAADFGMAGPREPPAHGRIMMLELDFTQTLGSHCLQIRETLPASGITAVFGVSGAGKTSLINAISGLTRPQAGRIVLNGRVLNDTAQRICLAPEKRRIGYVFQDARLFPHYKVRGNLQYGMAKSMVSQFDKLVDLLGIAPLLDRLPGRLSGGEKQRVAIGRALLTAPELLLLDEPLASLDIPRKRELLPYLQRLAQEIHIPMLYVSHSLDEIQHLADRVLVLEAGKVKAFGPLEEVWSSSVMHPWLPAEQQSTILSATVAAQHPQYAMTALALGDQLLWVNRLERPAGDTARIRIQASDVSLTLAQPSGTSIRNILRAEVAQCLEVNGQIEVQLRVSGRLLWARISPWARDDLAIAPGQQVFAQIKSVSIAA

SEQ ID NO: 12737 - protein, 160 aa, Klebsiella pneumoniae
DLNPCPFRRGFSFTDRFLDNMEYAMTRPAIIINELDAERIDRLLEQPAFANSPVADALNEELDRAQMLAPEAMPHDVVTMNSRVKFRDLTSGEERVRTLVFPSQVTDSASQLSVLAPVGAALLGLKVGSTIHWELPGGASTHLEVLELLYQPEAAGEFHR

SEQ ID NO: 12738 - protein, 201 aa, Klebsiella pneumoniae
KADPFPASGQHRYYAEPVLYWRLIVFERSIQMSQASAEFIPTRIAILTVSSRRGEEDDTSGHWLREAAQEAGHQVVEKAIVKENRYAIRAQVSAWIASDNVQVVLITGGTGFTDGDQAPEALLPLFDREVEGFGEVFRMLSFEEIGTSTLQSRAVAGVANRTLIFAMPGSTKACRTAWDNIIAPQLDARTRPCNFIPHLKK

SEQ ID NO: 12739 - protein, 277 aa, Klebsiella pneumoniae
VFRPSAACPRTAFSAEGAGSAAPGEPRVTPMLDWHGVLSGQPLQWIISGFLTTVWVSVAGILLATLLAVLLLALRLGGGRAGRGLVAAWVSLFRNTPLLVQLLFWYFAAWNLLPLAVKEVVNDEHAWSILPGNVWWLTPEFLCSMWGLGVFTSAFLVEEIASGLRAVSHGQREAALSQGFTPWQELRFILLPQGLANAWQPIVGQYLNLMKLSSLASGIGFAELTYQVRQIESYNAHALEAFAVGTALYLALGVAMGVAFTRLGPGRKLQRSARHER

SEQ ID NO: 12740 - protein, 1061 aa, Klebsiella pneumoniae
AVRPYGAYAHRGGRKRMKILSLRLKNLNSLKGEWKIDFTAEPFASNGLFAITGATGAGKTTLLDAICLALYHETPRLNKVSQSQNDLMTRDTAECLAEVEFEVKGIAYRAFWSQNRARNQPDGNLQAPRVELARCADGKILADKVSDKLEQTATLTGLDYGRFTRSMLLSQGQFAAFLNAKPSDRAELLEELTGTEIYGQISAMVYEQHKAARHALEKFEAQAAGIVLLTEAQQQALQESLQVLTDEEKALLAQQQSQQHQLQWLTRRDELAQQQQQAATRQQQARQALADAAPALAKLELAQPAAQLRPLWERQQEQTAGLAQTRQRISEVNARLLASTALRARIRQGALRAQQQRQAELADLAQWLAAHERFRLWGQEIAGWRAQFSQLTRDKQQLTAQSTRLAALRQKLATLPASPLTLSADDVAAAIEQQTQSRPLRQRLISLHEQHQLLRKRLRQNADSVQQAQAEQVKLNATLTLRREQYKDKNQHYLDLKALCQREETIKDLESYRDRLEAGKPCPLCGACEHPAIEQYASLTLTDNQRRRDALEKEVAVLKEEGLLILGQVKALTQQLQRDTEAAGRLAEEEQALTKAWQETCASLHIARDIAQEINDWMQEQERYEQQLYQLSQRLMLQSQLNDQQALERQAEQQLAATRQGLESALQALALSLPAEGTEAAWLHARESEFAQWQAQQTQHDAIQQQIAALRPLLETLPTSDETEVEAESAIPDNWREIHEECLSLHSQLVAQQQQETQEKARLDQSQAQFTSALAASRFSDREAFLAALLDDETAQRLTQLKQTLEQQLQQAAALCEQATRQHEAHLALRPQGVDADVPTLQTQLHALAQRLRDNTTRQGEIRQQLRQDAESRQQQQALGQQIAEAAQLADDWGYLNSLIGSSTGDRFRKFAQGLTLDNLVWLANQQLNRLHGRYLLQRKASEALELEVVDTWQADAVRDTRTLSGGESFLVSLALALALSDLVSHKTRIDSLFLDEGFGTLDSETLDTALDALDALNASGKIIGVISHVEAMKDRIPVQIKVKKINGLGYSRLDKAFAVE

SEQ ID NO: 12741 - protein, 120 aa, Klebsiella pneumoniae
RLRPVAGAEHMPGGVFIKHRVVHICQAVDLLFGEHGSEAYRLLYRHRIGGQNLFCVIIIQIGAITTNCRCIESQCLIKRMDSDVMTSGDDDDLIACLSGAGQRLQRSGQNGFFAGKQGAV

SEQ ID NO: 12742 - protein, 803 aa, Klebsiella pneumoniae
LTSPIFISAICTESLFRGHNLHAERFVLQRKCQNFLDSFHRMDIQIGDNVIRNFFKVAFVLIRNQNSLNAAAMRRQQFFLQTADRQHLTTQSDFTGHRHISAYRVAGQAGDQRRAHGNTRARTILRRRPFRHVHVNVTLLVEVGVNAQLVSPRTYHRQRSLNRLLHHLAQRAGVGQLAFARHAGGFDGQQIAAHFRPRQTGHLTDAVLTIGAAIVEALYAEIIMQILTVNFDVFQRFIQQQLLNGLAAQLGDFTLQATYPRFPRVVTNNADNGAIVDGQLAFLQRVTFDLFRQQMTFGDVQFFIFGIAGETNHFHTVQQRRRNVHGVGSRHEHHVAEIVIHFQIVVVKGHVLFRIQHLKQRGSRVAAHVGRHFVDLVQQEQRVFDPHFRHFLDQFARHRANVGPTMTADFRFIAHAAKRHTNVFPSGRFGDGLTQRGFTYPRRSHQTKDWPLDFVHPALHREIFKDAILHALQAIVIGIEDLLGLTQVFFDLTARIPRHLHHPVDVATHDGRFRRHRRHHLQLLQFRFGFFFRLFRHFRRVDLTLQRFVFVRGVVHLAEFFLNRFHLLVQIVLALRFLHLLFDAVANALLNLQQIDFRFHHRHQIFQTFVNVGHLKHRLLVSQLQRHVRRDGIRQARRIVDAVQRRQHFRWDLLVQLDIAFKLADSGANQHFLLAFVNRRRVEILRFRREMLAIIRQRRNASTLQPFDQHLHGAVRQLQHLQNRRHGSNGEKIVYTRLIRRRFFLRNQHDFFIMVHGRFEATDRFFPPYEQGYDHVRINHHIAQWQYGDFNAFRTLRIHRALS

SEQ ID NO: 12743 - protein, 61 aa, Klebsiella pneumoniae
QESPMSLENASDEVKLAVDLIMLLESHQIPAQTVLSALEIVRRDYANKLKNAESGSQNPEK

SEQ ID NO: 12744 - protein, 315 aa, Klebsiella pneumoniae
LRSPNMSQTNPFTALLAAQPFVLLDGAMATELEARGCDLADSLWSAKVLLENPQLIRDVHLDYFRAGAQVAITASYQATPAGFAARGLDEAQSRALIGKSVELARKAREAYLAENPQAGTLLVAGSVGPYGAFLADGSEYRGDYQRSAAEFQAFHRPRVEALLDAGADLLACETLPSFAEIQALAALLQEYPRARAWYSFTLRDAEHLSDGTPLREVMAALADNPQVVAVGINCIALENTPAALAHLHSLTALPLVVYPNSGEHYDAVSKTWHHHGEACASLADYLPQWLAAGAKLIGGCCRTTPKDIAALNAKR

SEQ ID NO: 12745 - protein, 400 aa, Klebsiella pneumoniae
GDGPGRPHPGDGRWPHYRRFTAPCGDPRTVNRGFNTSRLIRLESIMNQKYMIYMYLLKARTFIALLLVIAFFSVMVPNFLTASNLLIMTQHVAITGLLAIGMTLVILTGGIDLSVGAVAGICGMVAGALLTNGLPLWNGDILFFNVPEVILCVAIFGVLVGLVNGAVITRFGVAPFICTLGMMYVARGSALLFNDGSTYPNLNGMEALGNTGFATLGSGTLLGVYLPIWLMIGFLVLGYWLTTKTPLGRYIYAIGGNESAARLAGVPIVKAKIFVYAFSGLCAAFVGLIVASQLQTAHPMTGNMFEMDAIGATVLGGTALAGGRGRVTGSIIGAFVIVFLADGMVMMGVSDFWQMVIKGVVIVTAVVVDQFQQKLQSKVILMRRHEEKLAAIPPNGATSS

SEQ ID NO: 12746 - protein, 84 aa, Klebsiella pneumoniae
LILPALLAGLTKGREMMALYKAYPAHIILLRRAFAVVAGVAALPVMLFWKDRARYYSWLHRVWSKTSEQPVWMAQAEKAAHDFY

SEQ ID NO: 12747 - protein, 257 aa, Klebsiella pneumoniae
QWLPFFFQESCMSIDWNWGIFLQQAPFGNTTYLGWLWSGFQITVALSISAWIIAFLVGSLFGILRTVPNRFLSGIGTCYVELFRNVPLIVQFFTWYLVVPEFLPENIGMWFKSELDPNIQFFVSSMLCLGLFTAARVCEQVRAAIQSLPRGQKNAGLAMGLTLPQTYRYVLLPNAYRVIVPPMTSEMMNLVKNSAIASTIGLADMAAQAGKLLDYSAHAWESFTAITLAYVFINAVIMLIMYVVERKVRLPGNMGGK

SEQ ID NO: 12748 - protein, 301 aa, Klebsiella pneumoniae
RLIPMFDVLEHAMHVRYSLLASQATTALFVLLWGSAAIFTRWGLDNASPMALLVFRFLVALVALAPLAIVRRRWLPAPGTRLQTAATGLMLIGGYSVCYFEAMANGVTPGLIATIMGIQPILTLCVVERRLQGRRLSGLLLALAGLVLLVWRSLAASPMATVGILFALAALLLMTFGALWQKRSRQAPADVLPLQYAVSLGLCLLIAPVSGFRFTVNAGLIIPVLFLGLLISVVAQLLLYRLLSAGNIVNVTSLFYLVPAITALLDYLLLGNRLPAAAMIGMMAIVGGIVLVFRTAKVRAG

SEQ ID NO: 12749 - protein, 156 aa, Klebsiella pneumoniae
APIPRRFIPKRICASRCASSSTARTASRLSIVLCSMRGKRCLPACAPMNGSGRKAPARCWFRSITAHLDLVLLMMLLGKQQINSVWVEAGATLAGALLQAGLVDELIVYIAPKLLGNAARGLCALPGLEELSQAPHFKFNEIRQVGPDVCLHLTTA

SEQ ID NO: 12750 - protein, 646 aa, Klebsiella pneumoniae
RHVPRLVLCRRYADHWHLSRIEQGRGRVSQTHETDTCEVLVVRNLNVAFRQQDAPEVQAVRQLSFSLRRGETLAIVGESGSGKSVTALALMRLLDAASSEVNSEGLWLRRRNRQVIALNEQTDAEMRRVRGADLAMIFQEPMTSLNPVFTIGEQIAESLRLHQGLGREEALRAAKKMLDQVRIPQAEEMLSRYPHQLSGGMRQRVMIAMALSCRPAVLIADEPTTALDVTIQAQILQLIAVLQKEMAMGVIFITHDMGVVADIADRVLVMYRGEAVETGSVEEIFRSPQHPYTQSLLAAVPRLGEMRGQDLPRRFPLPGQPLAESETPDTVVAGEPILQVRDLVARFPVRGGLLNRVTREVHAVEKVSFDLWPGETLSLVGESGCGKSTTGRALLRLVETQGGTITFDGQRIDTLAGGKLQALRRNIQFIFQDPYASLDPRQTVGDSIMEPLRVHGLLRGEAARERVAWLLKRVGLQPEHAWRYPHAFSGGQRQRICIARALALNPKVVIADESVSALDVSIRAQIINLMLDLQREMGIAFLFISHDMAVVERISHRVAVMYRGRIVEIGPRRAVFENPQHPYTRKLMAAVPVADPGHRHPQRVLLSDDVPGNIYKRGEEIASVPLQQVGPGHFVARESADVLGRT

SEQ ID NO: 12751 - protein, 573 aa, Klebsiella pneumoniae
CAPPLFHLCSKESNMSGPVKVDVLVVGSGAAGLSAAVTAAMHGASVMVAEKASVLGGTSAWSGGWLWIPRNPLARAEGIDEAADAPLTYLQHEMGGEAADIRLQTFLRYGPEMVEFFHQRTAVQFLSGSAMPDFHPSPGAANGGRSVTAQPYDGRLLGDWLHRLRPPLETISLGGMGIAGGADMAHFFNATRSPRSALYAARRLLRHGWQRLRAGRGQHLVNGNALVARLLRSALDAGVRFQLNAPVVRLLQGPPGVSGAVLRSDGGEIHVEAGAVVLACGGFPHDRQRLAQVVPHAAEGYGHFSAAPPDNQGEGIRLGESVGGQFDTSLRHPLAWAPVSRVTLASGQQLMFPHLVERAKPGVIAVLPNGKRFVNEADSYHDFIAALLAATPAGDTPQAWLLADRRTLRRYGLGHARPFPFTPTAWLRTGYLQRGNTLAELAKQCAIDANALAETVERFNHFASAGKDVDFHRGASAYNRAQGDHQVTLGPLREGPFYAVRILPGSLGTFSGLQTDEHARVLDEQQQPIPGLYAIGNDMSSVMRGYYPSGGITLGPAMTFGYLVGKGLTKKQI

SEQ ID NO: 12752 - protein, 139 aa, Klebsiella pneumoniae
  UNSURE (78): Identity of amino acid at the above locations are unknown.
TTPPGYRVINTGLIPITEKFSINHVLTWGSADDITDYTDKTRMLSLVARGQYQFTDYVRLIGEVGGFYQKDSYNNGTXYKQAGEKYTIALGLADGPDFMSRPELRIFASYLNDSEDGKPFEDQTANNTWNFGVQVEAWW

SEQ ID NO: 12753 - protein, 89 aa, Klebsiella pneumoniae
SWPPIAVFSIKCSRRCRRKRCWKRPTAGERATCRSCAHCPWMAMNGLKAIAEGLEQGGAEHEIHVDEALRTGALIPLNRMLDFAATLRG

SEQ ID NO: 12754 - protein, 138 aa, Klebsiella pneumoniae
CIKPPVSGKAGVNQENAMHAFKLKHPVPDLQPIGSVSLLGATPTAGDPQVAGAMIYGEPQDAFTCGLFSSTEGSFTMTYPFTEHATVLEGEVELTVAGGEPQRFAPGDSWFVKQGTEVEWKILTPRFVKHYLANVETR

SEQ ID NO: 12755 - protein, 883 aa, Klebsiella pneumoniae
ITKPAPAGFLCPEYAMAEKAGEIYYDIEANVSGLIQAQQQVNKRLDQMDAKFEQSSRSAGRFEGALNKVGVAIAAAFTIDAAKKLIAIGDEMVTLQARIARLSPSIDVAKETLASLSAIAAQTGNSLSETERLWESLTTALKETGATNSQILGLTSTLQKIGTIGGSSTEEMANALRQFGQSISGGIVRAEEFNSILEQMPELARQIAAGLGISIGDLRKRMLEGKLTAQDALNAIQRQSQSVNEEFDKMPVSIDRAKNSLDVAFKNAINDLNQAIGLTTTLAGLMQSVADNLNYYNNNVGDSSRMPKLIKLQQDLNNELKDGQRWYETDSVFQSRRAQAAVQLKQIEGEIAHIRAKAQKDAGSNQFNAPPTKGDDAATKKLVQNSERRLALAKLEGEARARLQAQYDAADAGVTDPKRIKALQDEYAETYRVTEARKESDKAGKQSASTAESIAQKLENLRQQSELAADSTQELSREQAILRAQQSLGKSATQAQIQEAGKYAAAAWDAAAAAKGVTEALNAIPEQAENKSYAESMQNLKAALNAGKIDLQEYNAATEQMEQQHQANLAKIRSQQVVNPTQQALAEVDPVQQLANQHAQELALIQQFEQQGVLAHENALALKNAADRQYEQQRIAAQWEILSQQSLGYNMLTSAVDAFSGNASNAITGLLTGTMSAQEAMRSLGNTILNSVINSIVQVGVEALKNYILGQTLGAASVATSVGLAATTASAWAPAAAMASLASFGANAGPAAAGISSTVGLASGLALAGARYNGGPVSAGGLYQVGEKGKPEIYQASTGKQYMIPGDNGKVISNKDMQSGGGISVQVNVINQSTGATVQSANGYMQDGSAVVDLLITDMERGGPVSSQMQQTFGLSRKAQGAY

SEQ ID NO: 12756 - protein, 646 aa, Klebsiella pneumoniae
IQKPNTFIGPVSWCPCSCAWAVCARVSVPIFQPCFVNLIEMLFFQFFDFCNRYVVIHVLVKALNNPGRYDADEAGDRHPPDMPDHGETKYRSEGGNHDAGAAVFRHMNFFIVSRLFVRFTFLFHFPEGITFVNLRNDSEVVERRWRRGCPLQRTATPRVTGQVTVLIAVANRHVELNQLAQNTAGDQRCTASCNNQHRVELRIDLLAQTTGHTHEAQHVQRHKRHEEADDPEPESAFAPGFVQGEAKGFRPPVGQTCEATEHYAADDNVMEVRNQEQAVVQNEVRARYRQQHAGHPTYGEGHDKADSPHHRRVEDDATLIHGEQPVEDLNPGRDRDNHGSNTEEGVYVRASTHGEEVVQPNDERQNGNTDGCPYQRGVTEQTLTREGRGDFGEDPEHRQNQDVHFRVTPGPNQVDVHHHVATHIVGKEMGAQVTIQGQQRDGDGQNWERGDNQDVSAQRCPGEYWHLEHGHARGAHLDNGHEEVNTGQGSTDTGELQRPNPVINPYARTVLNSRQRRIGQPTGLRELTNAQRQVNQNHAHNGEPEAQVVEEREGYVARAELKRNHQVHQTDNKRHRHEEDHDNAVGGKDLIVVMRRQEAGFPGRSQHLLATHHDGVSKATQQHDDCHDNVHDTETFVVDRSQPLVP

SEQ ID NO: 12757 - protein, 356 aa, Klebsiella pneumoniae
RPEPDGAQLSGERRAGRRDSGGGPRPILLAGAPAPNASLNGRTMATFDAVFVGLTILDIAGRPVVAIPPRGGVAFIEQIRLNPAGTAAGANINAAKLGIRTAAVACLGEDEKADFILASYARLGIDCSLIQRTALKETSATILPIRPNGERPALHCRGASDALFVSEAEFDAVLDCRFLHHGGTGLLAAMDQGQSARLLQAAKARGVTTSFDLIAPNEETLELLRPLLPSVDYFMPSLEEAAFLSGETQPEAIGRFFLALGVGTCILKDGENGSWLIGRDGGPQHIAPWPVEAVDTTGCGDSYCGGFIAALARGLSVKAACDVASAVAALVATGMGSDAGVVDWEQTQAFMAAHRP

SEQ ID NO: 12758 - protein, 335 aa, Klebsiella pneumoniae
RLEPDRIYLHRNHHCDRGCRLHLDYVEPELQHDDALRAASMFKQYLQVTKPGIIFGNLISVIGGFLLASKGHIDYPLFVWTLLGVSLVVASGCVFNNYIDRDIDRKMERTKNRVLVKGLISPEASLVYATLLGIAGFMLLWFGANPLACWLGVMGFVVYVGVYSLYMKRHSVYGTLIGSLSGAAPPVIGYCAVTGDFDSGAAILLAIFSLWQMPHSYAIAIFRFKDYQAANIPVLPVVKGISVAKNHITLYIVAFAVATLMLSLGGYAGYKYLVVAAAVSVWWLGMALRGYKVADDKVWARKLFVFSIVAITALSVMMSVDFMVPDSHSLLAYVR

SEQ ID NO: 12759 - protein, 266 aa, Klebsiella pneumoniae
SPRPSIPNDDAHHSRNEVIMQIDLTGKKALVTGASRGLGRAIALSLARAGADVVITYEKSVDKAQAVADEIKALGRYGEAVQADSASAQAIQEAVTHAARSLGGLDILVNNAGIARGGPLESMTLADIDALINVNIRGVVIATQEALVHMADGGRIINIGSCLANRVAMPGIAVYAMTKSALNALTRGLARDLGPRGITVNLVHPGPTNSDMNPEDGEQAEAQRQMIAVGHYGQPEDIAAAVTFLASPAAGQISGTGLDVDGGLNA

SEQ ID NO: 12760 - protein, 292 aa, Klebsiella pneumoniae
PDRPAGTVNRPEGALMPTYLFLRRLRRSPAAFSGLTLVILLVLTALFAPWLAPHDPNWQDAAARLQGPGAGHWLGTDSYGRDLLSRLLYGARPALGLVALVTAITLPVGLLVGILSGYYGGWLERILMRFTDVVMSMPRLILAFAFVAMLGPGLVNGALALALTTWPAYARQARSEIQRLRHSDYLAAAEMLGIRGGRLLVGHILPLCLPSAIVRLALDLAGIILAAAGLGFLGLGARPPMAEWGAMIADGMQVIFDQWWIAAIPGAAILLASLAFNLLGDGLRDILEPQHD

SEQ ID NO: 12761 - protein, 89 aa, Klebsiella pneumoniae
PALPIRCQRRIRRWTGSTWCCAPPARRACIWRASPKKRRSGKPSIRCCRGRSRSLTSLNSAARCVTRIALIRCAYIPISLPIWAAPRRS

SEQ ID NO: 12762 - protein, 457 aa, Klebsiella pneumoniae
MLTFIEILIGIVVIVGVARYIIKGYSATGVLFVGGLILLIVSALLGHKVLPGNTASTGYSATDIIEYIKILLMSRGGDLGMMIMMLCGFATYMTHIGANDMVVKLASKPLRYINSPYLLMIAAYFVACLMSLAVSSATGLGVLLMATLFPVMVNVGISRGAAAAICASPAAIILSPTSGDVVLAAKAAEMPLIDFAFKTTLPISIAAIICMAIAHFFWQRYLDKKEHISHEMLDVNDITTTAPALYAILPFTPIIGVLIFDGKWGPELHIITILVGCMLLAAILEFLRGFNTKNVFSGLEVAYRGMADAFAGVVMLLVAAGVFAQGLSTIGFINGLISIATSFGSASIILMLVLVILTMLAAMTTGSGNAPFYAFVEMIPKLAHSSGINPAYLSIPMLQASNLGRTISPVSGVVVAVAGMAKISPFEVVKRTSVPVLVGLLVVIVATEILVPGSALH

SEQ ID NO: 12763 - protein, 243 aa, Klebsiella pneumoniae
KGLPMLLRCLLPLALLPLAAVASAACTLTDPTLTLQSYRVDAQKERIAMYWQDRHGKAWGSLRSLLAGIDGDGRVQMAMNGGIYDKAYAPLGLYIEDGKRLTPVNRSAGGGNFFIRPGGVFLVENGRAKIVPLPAYKPSPAIRYAVQSGPMLIENGAINWRLKPSASSRKLRNGVGIDKQGRVVFMLSDRETNFYDFACYAQSKLGVRQMLYLDGTLSKMYRKGGSVPWQYHPFVTMITVERK

SEQ ID NO: 12764 - protein, 288 aa, Klebsiella pneumoniae
REMPMSEQNIVNISEANLQQTLQQSMNVPVLFYFWSARSQHCEQLTPVLERLAAQYNGQFTLAKVDCDAEQMLASQFGLRAIPTVYLFQNGQPVDGFEGPQPEEAIRALLDKVLPREEELKAQQALALMQEEKYADALPLLKEAWQLSNQESQIGLLLAETLIALHRSDEAESVLKTIPLQDQDTHYQGLVAQIELLKQAADTPEIQQLQQQVEQNPEDAQLASQLALQLHQVGRNEEALALLFSHLQKDLGAGDGQARKMLQEILAALGTGDALAAKYRRQLYSLLY

SEQ ID NO: 12765 - protein, 147 aa, Klebsiella pneumoniae
RASPPDWLKYARPRRRMPAVVGAAVRLMYDGALSAPARARQLVSPKSLRIMAKEQTDRTTLDLFANERRPGRPKTNPLSRDEQLRINKRNQLKRDKVRGLKRVELKLNADAVDALNELAEARNMSRSDLIEEMLMTQLTALRSQGKV

SEQ ID NO: 12766 - protein, 71 aa, Klebsiella pneumoniae
SIPPTILWAATSARWLMANNPAAVPPRKKGFTFSIISGPTNGTTAVTDYSTLPEGIWSGDVSVQFDATWTS

SEQ ID NO: 12767 - protein, 768 aa, Klebsiella pneumoniae
RAPPEITTLLPDIARFLPRLANDQIEQFTRNVNHFTHGFTVEIFRHQMFLAGALANLLFSCIYRNGNFTTNFAIDLDDDEGAVFHHRALIRYRPRRVVDIAFAVQLTPQGEAGVRSERVEHTHHRQQSFLHQRTILLIFLRRFRQLVHQLHDCRDGGVEGLTTADVIGHFGDGFVDIATQRFLIFAQSRHVQCRNLSFSGVLVDQFPDAFQEAVRPFNARFLPLEGHIRRGRKHHEQTHGIRAVALNHHLRVDAVVFRLGHLAHAGVHQLVARRVFGLHDAAFFVALNDGVNRGNPVTFAVFAHIVERVSQHHALAQQLFRRLIGVHHARVAHQLMEEAEVEQVHDGVFDTADVDIYRQPVVGRFRIQHSFLILRAGVARIVPGGFHKGVKGVGFAQRRLAVDGGLGPFRIGFDRAGDAVHDHVFRQDHRQLIFRGRQHGAIFQGHHRDRRAPVALTGYAPVAQTVVNFTLAHAHGSQFVGNGVEARFIIKTAELAGVKQDAFLGQRLLGEIRLGAVGSEDNRLNVQTVLAGELVVALVVTRNGHYRAGAVFHQHKVCRPDRNFFTGQRMNGFKAGIDAFFLHRRHVGFGHFGIAALVDKGGQRRIVRRSLLRQRVTRRDGQVGTTHKGVRTGGVDSQFVSVVVDVKGDFYPFRTADPVALHGLHGVRPVVQLIQIVQQFIGVGGDFNKPLRDLFTLDLGIAAPAAAVDNLFVGKHGLVIRAPVHCGGFFVHQAFFVQLGEELLLPAVVFRGAGRQLAAPVIAEAQHF

SEQ ID NO: 12768 - protein, 599 aa, Klebsiella pneumoniae
TRPPPPHLWRQRRERSPGPPRYSAPATICVKQVVSSCSPEKMRYVLLCSAQHIGGFAGDEVARPDLLQRHAGDLLAPLINIARDVIRQQDPLRMTVARVGHRYGGHELTGIGVLRVFKHRAARAYFDNATAIHHRHAVADALHHRHIMGNKQKRDAHLALQVEHQIDNLRPNGDIQGRHRLVGYHHLRIQRQRAGNADPLPLAAGKGMGIAPGMLRLQPHALQQPGDPLTRCFPTQQAMHPQRLHNRIADRLTRIKRGVRILKNKLNIAPQSLQLAAGEGIDPLTVEGNGASLGLYQPQQRPAGGRLAAAGLAHQRQGLSRPEIKTDLLHRMHFARHAIEQPAAHGKTGHQVTHLQDRLAGDYRIGRFALRQRLARQRKTARQILATHLPQPRDRRQQRLRIRVLRRTKDLLNAAGLYRLTAIHHQHPIGDIGHDAHIVGDKDHPHRHLLLQDSNELQNLRLDGDIQRRGWLIGYQHRRPTGERHGDHHPLAHAAGELVRIAREHLFRLGNTHLIEHLFRRAQRLFAPQPLVQAQGFGNLLADGKNRIQRGHRLLKNHGQIRAAHPAHLSVRLLIERDHLPVTPPQPQPLAVHLAAGRV

SEQ ID NO: 12769 - protein, 116 aa, Klebsiella pneumoniae
RAAPLPGGWRPGDHPGDGPARRRPTLPRGDQSAAGWPHGGVNAGENDAAARRGADGQRPARLQRASPAHSGVPRGAEPALSPPAAQRRAGGRGAAGADHPPGGASPVPQPKYCWDL

SEQ ID NO: 12770 - protein, 506 aa, Klebsiella pneumoniae
TSAPDKTVKGTIMVSRRSVLKMTIPAAAAIPVAVMAASDKPGNDRVFASISALSSFSGNDGDIGFLLSCHEGKMSGGGVLVHTISDAKPDMILSFPSKNGVWKRILENSGYVDCSHSGMLAEKGFDNSPYHNRLIKVADDAGLTIKYGSGSYEHNTNVLKEQSFSCPSFVGCGGRRGDKGTILKFLNGSTFKIKGGSGYVCNSKIEGITFAGDGETDGVLTIADQCGISVDRCYFDKCKTGVLMLNESKGGFTEFNVLTACYFTSSCVTGFAYRRLNGNESFHGTGMKECAFQQQKKDNDAPHIHIGEKCMVYNAPMTIHVFRDYTTSPIIRHDGFPRSNVYGVITVEKKPKNIVSLVDGNPLYILGSISCLSENLSTTNSILCSRFQANSDGSVNFIRNPASLSGGFDSEKEAVIHLNAGESAFMDVTVISNGVVSRGLIFIAVDTNGNGKITDTGMSPSESKLKHDNYFVFDRSTLYVNNNGDPSAKWIADISFVASRYQFTLK

SEQ ID NO: 12771 - protein, 61 aa, Klebsiella pneumoniae
RRAPARQSVRSKHVRTPIAKKPTEVSFFALKWLGYEDSNLGMPESESGALPLGDTPIVCCA

SEQ ID NO: 12772 - protein, 301 aa, Klebsiella pneumoniae
RFQPKKHVPFVRWVMTNRAERFCKWATIGHNTLFCQETIMQAEILLTLKLQQRLFADPRRIALLKQIDQTGSISQGAKHAGISYKSAWDAINEMNQLSEQPLVDRATGGKGGGGAVLTRYGQRLIQLYDLLAQIQQKAFDVLSDDDALPLDSLLAAISRFSLQTSARNQWFGTITGRDRQQVQQHVEVLLADGKTRLNVAITAQSAEKLGLDEGQEVLVLLKAPWVGITLDPAAARQADNQLSGRISHIECGSGQCEVLMTLADGQTLCATLPQAQAAGLAEGTEAIAYFNADRIILATLC

SEQ ID NO: 12773 - protein, 219 aa, Klebsiella pneumoniae
ILAFSSAGKPGQRLNKCFFGPFCTPVGNTVSIRHTLMTATAQQLEYLKNSIQSIEDYPKPGILFRDVTSLLEDPKAYALSIELLTERYKDAGITKVVGTEARGFLFGAPVALALGVGFVPVRKPRKLPRETIAETYELEYGTDQLEIHVDAIKPGDKVLVVDDLLATGGTIDATVKLIRRLGGEVHDAAFIINLFDLGGEQRLEKLGIHCYSLVLFPGH

SEQ ID NO: 12774 - protein, 419 aa, Klebsiella pneumoniae
GSQPLRHPVGDKRLRVAIWMNAVVLHPLRLEIDLLHKKGQERNSELFGQGRVNRAEGFIIAAAIVRRQVNLHQQRLGVGRFDIFNNGAQRLLGLLRRKTAQSVIAAELNQHPARLVLLKQRWQASQPLLRGIAADAGVHHRRFRLPLLIEQRRPGGVGRHPIASAQAVAEDQQRVRRHRAAGKQEQQQERHMPAENILEVHHLKKSVGQGEHQLSILTGVELVVKPRQTIALIGESGSGKSTLLAILAGLDDGSSGEVSMLGKPLHRMDEEARAALRAQHVGFVFQSFMLIPTLNALENVELPALLRGASDSQSRGDARALLEQLGLGKRLHHLPAQLSGGEQQRVALARAFNGRPAILFADEPTGNLDRQTGDKIADLLFSLNREHGTTLILVTHDPLLAARCDRRLRLADGQLREEA

SEQ ID NO: 12775 - protein, 556 aa, Klebsiella pneumoniae
FRQPTSKPATAWRCTASSRPGIFHKLSRKLPRRKSFMQGDNNMAPHDLVAPQPVESEVIIETRGLSRVYPGVTALDNVNYRVYRNKVNVLIGENGAGKSTMMKMLAGVETPSSGQIILDGEAVSLQSTHQAEKLGISIIFQELNLFPNMNVMDNIFMANEFFQKGRINEKYQYALAKSLLERLELDVDPYAPLGELGIGHQQLVEIARALSKDTRVLIMDEPTSALSQSEVKVLFKVIAQLKRRGVTIIYISHRLEELMEIGDNITIFRDGRFISERHVSDASVPWIIEQMVGDKKKHFDYQPAPKGDAVLDVKGLTALHPSGGYKLNDVTFTLSKGEVIGIYGLLGAGRTELFKGLVGLMPCQRGEVHLNGESIGKSRFQQRLKKGLALVPEDRQGEGVVQMMSIQANMTLSDFSLQGFRRAWRWLNPQKEETCVKEMIQQLAIKVSDATLPITSLSGGNQQKVVLGKALMTQPQVVFLDEPTRGIDVGAKTDVYHLIGKMAQQGLAVMFSSSELDEVMALADRILVMADGRITADLPRHAVTREQLIAASTPQD

SEQ ID NO: 12776 - protein, 120 aa, Klebsiella pneumoniae
WPRPASGFPAPPAPGSPPAARSPPARRRTHPRSPAGRSPPATAPAAGRSDTGRQSLRRRCRAPAGSGVYVHSGQPARPPPSDQQTSTPRSASPTTRPARSNGSSSGSAPGWPRPAGQATE

SEQ ID NO: 12777 - protein, 194 aa, Klebsiella pneumoniae
ISRPNGRIQTPCSTKKRCRAAMLTGRRVSTTPIAPSTRTSATSADPRAGASSACSWASIAATCSCHSPLSSRRRLSPATAQASGLPIKVGPCIKQPASPLLMVSATVRVVMAAERVMVPPVSALPRHRMSAVIPACSQANSLPVRPKPVAISSAISSIPSRSHILRTRFSHSGWYIRMPPTPWTIGSRITAAIS

SEQ ID NO: 12778 - protein, 414 aa, Klebsiella pneumoniae
NRAFCLPAAPRRQTGWCYRQTRGCGSRQCGSGRCVRQSPPAPASGRWPAPPSTATDPASSERVRSFSCGLPCKMLSTALKIGQCQRASQHQPFNNVHRVIRHREHHQPVGEHAEDHRPHQRPQGVRFTGARQRKADPGRRHRVHQIAAAGVDLRRADARGQQNAAQPGQQRGNHVCCDFVTRDPQAGEPRRLRVAADGVHPPSVGSERQRQLGDQRHHQHDNDDGRHLPQRAKGRRDSTLRHLAARQNHVFGNRPTVAVGHCHALNHKQAGQGGEHVRNAQHHDQKGVKQPHQGAEREGYQNRFGGPQAMPDKQGNHQRVSQRCRRSDGQIEAADGEGNRHPNGNHRHDGNRAQNVDDVERVKEVVRGEAKDRHQQHHGQQHAPLIEKIKKSLTARYRRVYCQGLAHAAAPPVE

SEQ ID NO: 12779 - protein, 142 aa, Klebsiella pneumoniae
LQQLAVDKLGDAGGLIVADDHVGAGFHLVHRVAHRHPGARRFQHAKIVVVIAEGHHILHRQPLVGHPLRQAFAFAVAGARDIHLIVPRPFALEAQRLANLLRKPLQAGNVVIGESEFPYRVNFANRLRQRIDLSENRTLIFR

SEQ ID NO: 12780 - protein, 156 aa, Klebsiella pneumoniae
CVKLQLVAVGTKMPDWVQTGFSEYLRRFPKDMPFELVEIPAGKRGKNADIKRILEKEGEMMLAAAGKNRIVTLDIPGKPWDTPQLARELERWKQDGRDVSLLVGGPEGLSPACKAAAEQSWSLSTLTLPHPLVRVLVAESLYRAWSITTNHPYHRE

SEQ ID NO: 12781 - protein, 466 aa, Klebsiella pneumoniae
NGITPLGSFNNCACCTPRAIPRARFFLAHLLLLPAITAHLPARGSRMSNSNDFPLVEAPAAGRKGVFSIAMVLFSFTFFTGTMFAGGKLGVSFSIVNLLWIAVIGNALLALYAASLGWIAARSGLNTVLMGRFCFGEIGSKLADFILGFAELGWYAWGTATVAISLVKILALPEALTQPLMVLFGILFCVTALVGYKGLDALSRLSVPLMFVLLMVSMYLALHHAGGWQAMTRIAPSDTMTWSAAITMVFGTFASGATQATNWTRLANSSRTAILASMGSFLIGNGLMIVAGAWCAIVYQQADIVEVLILQGLSVAAVIMLCLNLLTIQGPTIYNVSAAACHLLRSERRRTLTLAAAGVGIVLAIGGMYEMLIPFLVLLGSIIPPIGGVILADYWFARGGRYPLLQNARLPRFNWLGLGAYAAGAVVAYLSPWIAPLVGISVSALVYIALALLSKRQPAAVAEQEP

SEQ ID NO: 12782 - protein, 627 aa, Klebsiella pneumoniae
AASTAGAAGYARQHHSCGRRCHRPGDDAVAHFRRRTWLQSTDRAGNGAGADEADGPVYRRHPAGAGSGGMKSWDVIVIGSGAAGFAAAVTACCKGLSVLMLEKAGQFGGTSAISGGAVWLHDTDQARAEGKSGSAEAMKTYLRTIIGEGQYREDLAEAFVSAGREALAFLEREGAVKYSLRPLSPDYYPDESGAVDVGRALEVVEYDGRELGDAFRDLRSPPPGMLLFGGMMVNRVDIQHFLDMRRSLRSLAHCTRLLLRYARDRVKYPRGTRLAMGNALIARMATTALRKGMNLRLNVNVLTLCEAQGAVRGVEIEYQGQRETLHARRGVVLAAGGFAAGALAARYRPHTREHFTMSPPANDGAALRLAAALNAREGADRASNFFWAPVSVLTRADGSEERFPHLVTDRAKPGVIAVNQRAVRFVNESSSYHHFASAMQDAAENAPCFLLCDAQAMKRYGLGLARPAPVNNDALVAAGYLHKADTLAALAQQLGLDAQTLSETVARYNRDAAQGVDREFAKGGNSYNRAMGDPGHQPDACNAPLLSAPFYAIKLYTGDLGTSRGLVTTADAQVVNTQGNPIPGLYAVGNDMDSLMAGTYPGPGITLGPGLTFGYLAACHLAQHSTH

SEQ ID NO: 12783 - protein, 86 aa, Klebsiella pneumoniae
QESTFTMPKKNEAPASFETALGELEQIVNRLESGDLPLEEALSEFERGVQLARQGQSQLQKAEQRVQILLADSEDSPTTPFTPDAE

SEQ ID NO: 12784 - protein, 117 aa, Klebsiella pneumoniae
ISPTAARCNRRLTMSAKTMKGKQAILRYLETHRTFTAKDVATECGMTINCITKNALDLERARKIVRVSKVWRTVTYRLATPEEQDGTARSCTNGIFQECRNSAAMKRVLAVYGRAQA

SEQ ID NO: 12785 - protein, 608 aa, Klebsiella pneumoniae
KLEFHFPVSALVSTNLRRECRTQFRFHIDATTRHGFRLWQVQGMAQPVFIITIREVEAAVGATALGTEVSGYGGRVGGFHQVIQLQALNALGVELAGGIVETGVFQALADHFQLLQTFVHRIAFAEHREVMLHTFLQRFTNRHRIFTRAGVVPAVEAIQRAFDIGFASVAQRALLGNGFLQMQARRAAEDHQVEQRVAAQTVGAVDRYAGDFAYREQARDHHVFALLIHGQRLAGDFGRDTAHHVVTGWDNRDRLFHRIDVGKGTGKFKDTRQTRFQNLFTEVIQFQFRVRAPRTVAAAAFADFDHDGTRHHVTARKVFSVRGITLHKAFAVFVQQVTAFAAATFGNQNPSPGDTGRVELPHFHILHRHAGADGHPDAVTRIDVGVGGGLIDTACAAGRQHGGAGFKVDHFAGLDAQGGTTDYRAVLVFHQIEGVPFGEDSGVVFQVLLIQSVQQGVTGTVSRRRGTRRLFAAEVLRLAAKRALINTAIVKTRERQSHVLQLKNRFRAGLTHVFDGVLVADIVRPFYRVVHMPFPVIFMGVTERDGDATLRGYGMGTGREHFGEQCTGLSALGNLQRRAHTCAAGTDDNSIKLSDWQFHYTPHTTTNP

SEQ ID NO: 12786 - protein, 448 aa, Klebsiella pneumoniae
RTYTLASQPGYFTTLNFARSNMNTYSVSRLALALAFGVTLSACSSTPADQQPSTQTAPGTTARPILNAEEAKNFTPAAYFQSLAPNAAAWTPSAISLPAQPDFIVGPAGTQGVTHTTIQAAVDAAIARHSNRRLYIAIMPGEYPGTVYVPAAPGALTLYGTGDKPIDVKISEAIDSEMDRNTWRRLVNPGGKYMPGKPAWYMFDSCQSKSAATVGVMCSAVFWSQNNGLQLQNLTIANNLGDSVDAGTHQAVALRSDGDQVQINKVNILGRQNTFFVTNSGVQNRLQDNRQTRTLVTNSYIEGDVDIVSGRGAVVFDNTDFRVVNSRTQKEAYVFAPATLKSVTYGFLATNSRFTASGDNVAQLGRALDVDGNSNGQVVIRDSAINEGFNIAQPWAAAVGSGRPFSGNTGSADDKGNLQRNLNDNGFNRMWEYNNRGVGSTVVAEPKQ

SEQ ID NO: 12787 - protein, 338 aa, Klebsiella pneumoniae
QTHTNAARGRVPPITTHTITMGINSVADAADKELDMQLRKLATAMLVMGMTAGLAQAEDAAPAAGQNTLDKIAKNGVIVVGHRESSVPFSYYDNQQKVVGYSQDYSNAIVDAIKKKLNKPDLQVKLIPVTSQNRIPLLQNGTFDFECGSTTNNLERQKQAAFSDTIFVVGTRLLVKKGGPIKDFPDLKDKAVVVTSGTTSEILLHKLNDEKKMNMRIISAKDHGDSFRTLESGRAVAFMMDDALLAGERAKAKKPDNWEIVGTPQSKEAYGCMLRKDDPTFKALVDETVAQAQTSGEAEKWFDKWFKNPIPPKNLNLNFELSDDMKALFKSPNDKALN

SEQ ID NO: 12788 - protein, 402 aa, Klebsiella pneumoniae
FSDTQTHLRFGAHDFTAQRVGIYIDDFDIDKLTDEVRGTFEVDHPVILRTSGELHDVLTRGAFHQDALYRAEHATAPGHRLLVNAFLQDIQTLFFVRLRHVVDHIGRRGARASGEDKAVAHIEIDVGDELHGLFEIFRGFAGEADDKVGAYLNIRARFTQLANSRFILQRGMGASHQVQHTVGATLHRQVQEAHQLRRIAINVDDIVGKFDRVAGGEANAVDAVDGGDQAQQVGKAAGGAVVILTAPGVNVLPQQIDLTHALRRQLGDFKQDIVARTANFFSAGIRHHAVGAVFIATFHNRDKGGRPFGARLWQAIEFFNFREADINYRTAVAAHGVNHLRQAVQGLRPENNIDIVRALANMVAFLGSHAAADANNQVRVLLFQQLPAAKLMENFFLGLLTN

SEQ ID NO: 12789 - protein, 419 aa, Klebsiella pneumoniae
RGDTFVKCRWQEGNRITLLENGDQYYPALFAAIGRASRRVILESFIWFEDEVGRRLHAVLLEAARRGIQVEVLLDGYGSPDLSDEFVGELTAAGVIFRYYDPRPKLMGMRTNLFRRMHRKIVVIDDTTAFVGGINYSAEHMSDYGPEAKQDYAVKVEGPVVLDILQFELENLPNSETARRWWRRRRHQPEINQTPGEAQALFVWRDNQDHRDDIERHYLKMLTSARREVIIANAYFFPGYRLLHAMRNAARRGVRVKLIVQGEPDIPIVKFGAHLLYHYLVKGGVQIYEYRRRPLHGKVALADDHWATVGSSNLDPLSLSLNLEANLIIHDRVFNQTLRDNLNGLIARDCQRIDKTMLPKRNWWRLGVSVMAFHFLRHFPAWVGWLPAHTPRLARVSPPVQPEIETQDRVESPARDNPL

SEQ ID NO: 12790 - protein, 341 aa, Klebsiella pneumoniae
TCCTAASALKSCLSEECVVAQEYTVEQLNHGRKVWDFMRWDYWAFGISGFLLIVSIAIIGVRGFNWGLDFTGGTVIEITLEKPVDLDQMRDSLQKAGFEEPQVQNFGSSRDIMVRMPPVHDANGSQELGSKVVTVINESTSQNAAVKRIEFVGPSVGADLAQTGALALIAALVCILIYVGFRFEWRLAAGVVIALAHDVVITMGVLSLFHIEIDLTIVASLMSVIGYSLNDSIVVSDRIRENFRKIRRGTPYEIFNVSLTQTLHRTLITSGTTLMVILMLFLFGGPILEGFSLTMLIGVSIGTASSIYVASALALKLGMKREHLIQQKVEKEGADQPSILP

SEQ ID NO: 12791 - protein, 448 aa, Klebsiella pneumoniae
IHFTMKARYKAVVDRYAQAIRSGQLPAGSRLPTHRTLAAGERISLATATRVYRELEEMGLVSGETGRGTFVRDLSLPPGHGVDQQVVAADVVDLNFNYPSLPDQGDALREALRQLAMAGDIDSHLRYQPHAGRLAERDIIARHLTCQHFAPDAENVLIVNGAQHGLAVTVMGLLRPGDVVAVDALTYSGFKVLAALYHLELAAIPCRPEGPDLQALQTLCQQRRVRAVYTMPTLHNPLGWVLNTGQRQALADLARQHDLLIIEDAAYARLVSHPPPPVVSYAPERTVYVTGFSKNIATGLRVGVVISPPRYRPEIERAIRATTWNTPTLISSLICAWIEDGTVARFETQKRQDARQRQQVAREVLCGLPVVSHPDSYFVWLPLGEESRADRLANALMERRISVSTAEPFCVSTTIPQALRIALGSVPFDSLRPALLSVRDAVEYEQYR

SEQ ID NO: 12792 - protein, 448 aa, Klebsiella pneumoniae
KGITERRRRAAPCALCRVADVLHLTLQNHPAVANGGQHPCLTTDGLVVVFRIEDQQVRRAAFGEAVVIAQTERPGAVVGDKVETALQIVIAEHMADVQSGIQNAQDIAVSQRIPRILNRVLSKADIDAGAIQLRHPGDAAPFRPAVKPALQMNAFGRAGDEVDPRGFQQAKQLRAVGVIVRAHRAGVAGGDLRPHAAHPRLFRQHFEETRLRIVDFIAVDIHQAAVALGEVHQKHHRADPFVAGVLIVRNAAHHVGAHLDGARHQLPAVGIRFYSLLRKGDNLQIDEIGGLLFHRQQRLQGRQRRVGDIHMGADVLDAEIAQHADGFQRSLTGVLRGNTRFALAPAGDAFKQGAAAVPLRLARGEGGVKMDMRLDEGRDRQPALGVDIPCVGSLHRGLGGDAVNHPVMQVKGKQRLLAAQASVNNFHGGSCKWFCDKRQITSATEALR

SEQ ID NO: 12793 - protein, 499 aa, Klebsiella pneumoniae
RVITSPRVTDQLPQIKNCINIINDSRGTRKRWLTRTLSRPSVVVTMLLALRKVIDYKTAQNKSNRLQKEDRQANAPPAKRITIKRQAAPPDGGASRLRRAAQQFEGDKQEQDPHRQQDRRQTHAVDSAHQRQDQPKESNAEVVAGGRQQRFELRFAPFAALGGAELQVRHTDHDPVQQQRRHHQGHQQPQRFMRQQVVQHHHQRSDNPGEQQGVHRHAALADAGEKFRRITLHRQAEQHPAVGVHAAVIHRQRGHQNDEVQRGGHQVAVQIMENHHKRAAVGFDLHPRVERQQHHQRTDIEQQDTIDHLIDRFGNALFRVLRFGGGDADKLQPAEGEHDHRQRQNKSVPAGGEEAAVFPQIVEPGFAAAVAAEQHPQAEGNHADNRQHLDQREPELRFAIQAYVDQVDGVNNDEESRRPNPGGHVGKPVLHIDPGGGQLRHPYQHEHHPVVPAGEKAGERPPVLIGKVGKGTGYWLFHHHFAQLAHDQKSDNPGHGVAQ

SEQ ID NO: 12794 - protein, 227 aa, Klebsiella pneumoniae
RGWLMKILVIEDDALLLQGLILAMQSEGYVCDGVSTAHEAALSLASNHYSLIVLDLGLPDEDGLHFLSRMRREKMTQPVLILTARDTLEDRISGLDTGADDYLVKPFALEELNARIRALLRRHNNQGDNEISVGNLRLNVTRRLVWLGETALDLTPKEYALLSRLMMKAGSPVHREILYNDIYSWDNEPATNTLEVHIHNLREKIGKSRIRTVRGFGYMLANNIDTE

SEQ ID NO: 12795 - protein, 178 aa, Klebsiella pneumoniae
NTPTGVLRRMSSRNNSARIAIVMGSKSDWATMQFTAEILDALNVPYHVEVVSAHRTPDKLFSFAESAESHGYQVIIAGAGGAAHLPGMIAAKTLVPVLGVPVQSAALSGVDSLYSIVQMPRGIPVGTLAIGKAGAANAGLLAAQILAQHDAELHQRLSAWRQAQTDEVLDNPDPRGAA

SEQ ID NO: 12796 - protein, 155 aa, Klebsiella pneumoniae
WAWFPRQRSVAGERRLKQTDGPVMTNDVQHASGDHAGDDVVDHNPHSAVDIAIKPANWPRLPHIEDTENHEAGGHPLPVHGRQRHQGDPHPDELVPDDAAVVMGAHIFGRAMAQIDADTDAHHHHQRVKLPGEKGHQIPERDRRQRAHRPRHHRA

SEQ ID NO: 12797 - protein, 111 aa, Klebsiella pneumoniae
TPATPPPAGRDAGAAAARRGPESGLTPPGSTGPPRWKASRQTAGTARRRSPGAAPPAQTPPAAPGSWRSPARRSAAAPGRWPAGDPALPPFWFPHSPPPQWRHPPPSSGRE

SEQ ID NO: 12798 - protein, 496 aa, Klebsiella pneumoniae
HYRFPKTVRLYPRCAPTASDTRHRTPRGRTYLKRLNRFGHQADRFNPCTMQQVQRFNNFIVRDVFRTADQEYRFFIGFKTTLRFGNYLLRRQLGQRLLPHLHAVLPYPGDFHNHRRIVIAFHRLRFRGVRQIDFHALRNDWRRCHKDQQQHQQDIQQRNDVDLGLQFATSASTCSGHGLPLIAFAGGKGLTVHNIGELFHKVVVIQFKLVHALVQAVIRHDRRDRGEQTNRGGDQRFGDTWRHHLQGGLLHRAKGDKGVHNPPDGTEQTDIRADRAYGAEERNMGLQRFQFAVHRNTHRTRCPFDNRFRRMAVSPMQACKLFETAVEDLFRTGQVIATPLALLVQTRELDPGPEFVLERFSFTRGRVKDTRSLNNDSPGSDRKTNQNQHDKFYQKARLQEQIKDIHVSHCLNSATIDLGSARGFIKSGSTHTMRTSASFNTVFSALTIRCVKTKEVPRIEVISVWTSSMSSSLAGAKYSSVILRTTKATRSANSTC

SEQ ID NO: 12799 - protein, 350 aa, Klebsiella pneumoniae
TSNTLFLQSIVTHGNAVGRYTWPIIPNRTHRVPENTPPSESPDRQDERYDRQMFRILRNIDLNLLTIFEAVYVHKGIVNAAKILNITPSAISQSINKLRALFPDPLFIRKGQGVTPTAYATHLHQYISRGMEAFLSALDITGSPHQQRVITIATTPAMGALLMPGLASALKPTFPQILLHNIAIVDAARQLDQRQVDLLIDTHLHSGQAISHHVLYQDRVQMYCRAGHPALDGPQDETTLAEYEFALLLPEGQRYPTLHRRLQEEMGERRCGFSTFNLMTQAAMIAGSDMLGLTTERLFAMVSRLWPLQTLDFPSLGGEQIDVALHFNKLSGKEPLLKEIIETVIRSFKA

SEQ ID NO: 12800 - protein, 93 aa, Klebsiella pneumoniae
FYCTGSVAMTTVVLNVKIDAELKEKLRHYAEVNNENLGTATEKLLQLAFQLEESAGEAGVTEEDIDSQHTEEEATPLTPKEIKALRKLLKKKK

SEQ ID NO: 12801 - protein, 119 aa, Klebsiella pneumoniae
ACRTSGRTTMKKMLLIAMMAAGLVACTTSPAPKEDTKLKDAYSACINTAEGNPDKIEACQSVLNVLKKDKQHQQFANQESVRVLDYQQCIQATRTGNDQAVKARCDQIWKEIRSNNTTH

SEQ ID NO: 12802 - protein, 297 aa, Klebsiella pneumoniae
DKRTFGKDPDMNDFTSLLQQGNAWLFIPSAILLGALHGLEPGHSKTMMAAFIVAVRGTLKQAVLLGLAATVSHTAVVWLIAMAGLWFGRGWNAQTSEPWFQLVSGIAIVLIACWMLWRTWRETQPHTHHDHHHEHDHHHEHDHYHEHDHHHEHDHHHDHHHASSSAAPLVAEEWQDAHQRAHAQEINRRFDGRQVTTGQIVLFGLTGGLIPCPASITVLLICLQLKKFSLGATLVLGFSVGLALTLVASGAIAALSLKHATRRWPWLNDLSRKAPWFSGLLIIVVGIYMMLHGLSGL

SEQ ID NO: 12803 - protein, 328 aa, Klebsiella pneumoniae
QERTMHYIPLGDTALRVSRLCLGCMTFGEPDRGRHAWTLPEESSRPLIQHAIEGGINFFDTANSYSDGSSEEIVGRALRDFARRDEVVVATKVYHQVGDLAEGLSRAQILRSIDDSLRRLGMDYVDLLQIHRWDYTTPIEETLEALDEVVKAGKARYIGASSMHARQFAQALALQQQNGWARFVTMQDHYNLIYREEENEMLPLCQRNGVAVIPWSPLARGRLTRPWGETTARLVSDEFGKSLYSTSEENDAQIAGKLADVAEELDASRAQVALAWLLSKPGVAAPIIGPSRQEQLDDLLQAVDLTLSPEQIDKLEAPYQPHPVVGFK

SEQ ID NO: 12804 - protein, 62 aa, Klebsiella pneumoniae
VSGTRIRHRRMRTDSKRVLPDAWWFSMSRNGIRSLIYCLLICGVIWTALIIKILHVTGVFNG

SEQ ID NO: 12805 - protein, 71 aa, Klebsiella pneumoniae
RRGTFSRLWLKTSGGVTVRISSARSMRPRKSGTSVSILIDGFFSRMALMQSAKCCAPPSRRSSRSTEVTTT

SEQ ID NO: 12806 - protein, 63 aa, Klebsiella pneumoniae
SLRLTNIWTTLLRCSVTTALTLRICKSGKNPVTDYFVALSTPAGKTRPVYRVRIITIKRWNYV

SEQ ID NO: 12807 - protein, 78 aa, Klebsiella pneumoniae
YTRLSTGIVDNCPQPKTTAARRLPPFAVNRVAKNFYRTIFDNYPLKAARFLLLFAPPFSVGHRKSAAPALTRPDVIGV

SEQ ID NO: 12808 - protein, 72 aa, Klebsiella pneumoniae
RRRLAMGEISITKLLVVAALIILVFGTKKLRTLGGDLGSAIKGFKKAMNEDDDSAKKTTAEEAPAQKLSHKE

SEQ ID NO: 12809 - protein, 157 aa, Klebsiella pneumoniae
AELTAGWFASERHLEAWRQLHTGRNGSHLLFLGLFDTARGVVERGSHQIFEHLFVVFQQAWVDLHTAAVVRAVNGHFHQTRAGFAGYFQLSDLFLHLLHFFLHLLGLLHQVTQAAFSTKHRLLSQSSLKVLNASQTGIQMGRILSSSRSASKKRRRV

SEQ ID NO: 12810 - protein, 278 aa, Klebsiella pneumoniae
QMRFEMVSGTTQVVAVIGHPIAQVKSPDNFNRYFAEQHMDSVMIPVDIVPDAVAAYLNALRGWQNMTGVLVTVPHKQRAAALVDDLTPRARRLNAVNVIRKLADGRLQGDMLDGVGFQLAAEAQGFQPAGKQALLSGCGGVGSAIAWGLCEAGIRRLALHDQTPATRQRLHDLLAEAFPAVQLSALPDTLYGLDLLVNGSPAGMAGFDELPLPQALLDTLDSTTHVADVVTAPVMTPLLTFAAARGCKVQTGPEMALAQMRLMGQFIGAIPQAQGAAA

SEQ ID NO: 12811 - protein, 171 aa, Klebsiella pneumoniae
ILLTNYHKPVCSKASSPLHGFVKREYAMNLKPRNFDEVIENVLVEKGVCTSDTLNKYSKKEKFYYFNQFLIGATNRRKHPKDEHAFSLYSYERRKHIPRASRFDDMIKDIPLIKKSCNYRADNWPNGYRVTSAGYDIFSACCRAVPSRCGLYNEGKPYNPPRNGIRSQLKK

SEQ ID NO: 12812 - protein, 67 aa, Klebsiella pneumoniae
PAITDSSMTTFSTSSIEGRSYMVSSSAASTIERRPRAPVLRAIAFLAIASSASSRNSSSAPSRLNSA

SEQ ID NO: 12813 - protein, 118 aa, Klebsiella pneumoniae
PSSTPSQRLTSMQKSRSHWTHREPRLISGLLLRMMIALIALCLLAQLSGCSNMRTVYVKVPVVALPVSLTADTPQPEIPDNLTWGQSLDLNVSLLSALGQCNRDKADIRQSEKQRASL

SEQ ID NO: 12814 - protein, 75 aa, Klebsiella pneumoniae
RCSTAVKSCPDYNFRGFCAIQGRFISARMITQLAAYGSFINDQSVAYNKSASEHVFHVIRRFEKIYFSNWHTEFK

SEQ ID NO: 12815 - protein, 273 aa, Klebsiella pneumoniae
HMTTRVIALDLDGTLLTSKKTILPASLEALARAREAGYQVIVVTGRHHVAIHPFYQALALDTPAICCNGTYLYDYHAKKVLAADPMPVEQAVSLTAMLAKQQIHGLAYVDDAMLYEHPTGHVLRTRNWAQALPEDQRPVFAQVDSLAQAVREVNAVWKFALTDDDIPRLQRFAQQVGETLGLECEWSWHDQVDIARAGNSKGKRLAQWVADQGLSMQDVVAFGDNYNDLSMLEAAGTGVAMGNAVDEVKARANMVIGDNESTSIAEFIYRQLL

SEQ ID NO: 12816 - protein, 215 aa, Klebsiella pneumoniae
SIATAARSGRRASQASASLEALLVQRIQHLLQKTPCAGMLRMGEKLSRRGDFEDVAAVDKHHPVGNFAGKLHLVGHHQHGDPAVGEGFHHLQHFADHLRVERRGGLIEQDNLRRGGQGAGDGHPLLLAAGELRRHLLRFFFQSDLTQQRQRPRLSRAFPPAMNALQRQSDVLLRRQVGIKVELLEDKADAAAQLAQGAAAQPAGGFAVDQDLAAA

SEQ ID NO: 12817 - protein, 121 aa, Klebsiella pneumoniae
GQGLLRLLAHGSAFKIILDGLHEWLSITNKVKQEATMRTDDVLKFSSLFKVNVCHDTEENVWVAYCEDLGLSTEADSYEDLTERVWEIAPELYEMNGYKGNLKRLHLSFVQEQNFTDRMAL

SEQ ID NO: 12818 - protein, 172 aa, Klebsiella pneumoniae
KMGTDTLAHTAHAHEHGHHDTGPMKVFGFWIYLMSDCIIFATLFATYAVLVNGTAGGPTGKDIFELPFVLVETALLLFSSITYGMAAIAMYKNNKSQVVSWLALTWLFGAGFIGMEIYEFHHLIMEGFGPDRSGFLSAFFALVGTHGLHVTSGLIWMGGADVPGFTSWPDQH

SEQ ID NO: 12819 - protein, 167 aa, Klebsiella pneumoniae
LSLTISGRWKRRSSRSSPTSSTPTSASAQPLALADAAGVITAPKPPSSAAPMASPVTFCAVHRPLIRPSICSGVWVWIRVYCSSELIALSQPNSARHSAPNAQCGIRLNSAMATNDPTVVASISAPGRTVWASWPLVNAPSAAPSGIAAYSRPICPADICQLPASAG

SEQ ID NO: 12820 - protein, 302 aa, Klebsiella pneumoniae
QNLTGERMPGPSRKAAAWLPILVILVAMTSIQSGASLAKSLFPVVGAPGVTALRLALGTLILVVVFKPWRLRFSPAQRVPLLLYGLALGAMNYLFYLSLQRIPLGVAVALEFTGPLAVALFGSRRPLDFVWVALAILGLWYLLPLGQNVAQVDLTGALFALGAGACWAVYILTGQRAGEEHGPATVAMGSLIASLVFVPLGMAQATDTLWQWSLLPLGLGIAILSTALPYSLEMMALTRLPTRTFGTLMSLEPALAALSGMIFLGETLKLSQTLALGAIIIASMGATLTMQRQSKVEQVDIN

SEQ ID NO: 12821 - protein, 226 aa, Klebsiella pneumoniae
PCLTGEKKVQRARCYLLGETAVVLELEPPVTLESQKRIWGLTQRLTDREEVVEVIPGMNNITVVLRRPQEMAWEAIDKLQRWWEESDALEPQSREISIPVIYGGEAGPDLGDVARHSGLSEKQVVELHSSVEYMVWFLGFQPGFPYFGGLPEHLAMPRRAEPRVLVPAGSVCIGGSQTGIYPLATPGGWQLLGRTPLALFDPKREEPVLLRSGDRVRFVPQKEGVC

SEQ ID NO: 12822 - protein, 271 aa, Klebsiella pneumoniae
LIMTPERQGSLTGKVMQKTVLVTGCSSGIGLESALDLTRQGFRVLAACRKAEDVARMQELGLTGILLDLDDPQSVERAAAEVIALTDNRLYGLFNNAGYGVYGPLNTISRQQMEQQFSANFFGAHQLTMLLLPAMTPHGEGRIVMTSSVMGLIASPGRGAYAASKYALEAWSDALRMELRHSGIQVSLIEPGPIRTRFTDNVNQTQSDKPVENPGIAARFTLGPEAVVEKVRHAFTSDKPKLRYPVTLVTHAVALLKRLLPARAMDKIIHG

SEQ ID NO: 12823 - protein, 455 aa, Klebsiella pneumoniae
IYVTTQGVRPSLSPYKRLVECAMSQGLNNDIAVSKTRRVVKNLRWWVLVLFLLGVTVNYITRNSLGIIAPELKATLGITTEQYSWIVGAFQLAYTIFQPLCGWLIDVIGLKLGFMICATLWALACIAHAGAGSWLHLAMLRFFMGGAEAAATPANAKTIGEWFPKSERPIAAGWAGVGFSIGAMLAPPIIYFAHASFGWQGAFMFTGALALLWVVLWWAFYQTPEKHPNLSKSELEYIKQDNEAPPVKQPFFTALKTVSKNKRFYGIAIPAFMAEPAWAVLSFWVPLYLAKEHGMDLKQIAMFAWLPFLAADLGSVVSGYLTRLYVRWFGCTRVNSVIASSVTGAFLMLSLALVAITRDPYITIILISIGGFGHQIISCMLSALVVESFDKGQMATVNGMRGSAAWIASFLFSLLIGVTADKIGFNPLFIAMGFFDLIGAVFLVAFIAERRAKRA

SEQ ID NO: 12824 - protein, 117 aa, Klebsiella pneumoniae
FHVTGARSAPYIEPLTDDQKGLFMLQSNEYFDGKVKSIGFTSSSTGRASVGVMAEGEYTFGTAQPEEMTVVSGALNVLLPGETEWKVYAAGEVFNVPGNSEFHLQVAEPTSYLCRYL

SEQ ID NO: 12825 - protein, 95 aa, Klebsiella pneumoniae
SCVTYTIVVFSSWCRRAICRRISTRSSASRLESGSSNINTRGLRTIARPMATRCRWPPESCFGLRSSRCESCSVLATISTWRRISVFGTLFTFSP

SEQ ID NO: 12826 - protein, 80 aa, Klebsiella pneumoniae
RSTTVTDGLKGITFARLLTAFLLPFQLFQDGAHFHANHRVNRANEAIAGNIFVCLCLVKSVALRHNYSCEFVQLIRVESR

SEQ ID NO: 12827 - protein, 131 aa, Klebsiella pneumoniae
QETTVFQLLCAVFIGGGTGSVLRWWLGMKLNPVHHAIPIGTLTANLLGAFVIGAGLAWFNRLTGIDPMWKLLITTGFCGGLTTFSTFSAEVVFLLQQGRVSWALLNVAVNLLGSFAMTAVAFWLFSQAPSR

SEQ ID NO: 12828 - protein, 109 aa, Klebsiella pneumoniae
LMATWRRITAAGSGRLQRAPTPRPISAYLTPPTQGEKFDKQGVFIRLWLPELAKVPEKALHQPWAWADKQGITLDYSRPIVDHKQARQETLAAWEAARKGITPPPDGGS

SEQ ID NO: 12829 - protein, 241 aa, Klebsiella pneumoniae
FVATLFIADLHLQTEEPAITAGFLRFLQGEARQADALYILGDLFEAWIGDDDPNPLHQQIASAIKAVVDAGVPCYFIHGNRDFLVGQRFARQSGMILLAEEERLDLYGREVLIMHGDTLCTDDQGYLAFRAKVHTPWIQRLFLALPLFIRRRIAARMRADSKAANSSKSMEIMDVNPQAVVDAMERHHVQWLIHGHTHRPAVHELQANGQPAWRVVLGAWHIEGSMVKVTPDDVELIHFPF

SEQ ID NO: 12830 - protein, 367 aa, Klebsiella pneumoniae
AVQTSILLDSILTQCDTTTQQGFNDMQTLQTTSLRVSENQLFILDQQALPQEKRWLAADNVALLVDHIHTLRVRGAPLIGLSASLLLALLAQRGLNRDALQQALETLRAARPTAVNLMNNLDRMKQALAREDYPQALEAEALRLVEEDKQLCDRIAEAGSALVKPGSRLLTHCNTGGLATAGVGTALGVIALAHRQGKVTNVWVDETRPLLQGGRLTAWELGELGVPYQLIADSMAASLMAQGQVDAVWVGADRIAANGDVANKIGTYSLAVLAHYHQIPFYVAAPQTTLDRHCPNGAAIPIEQRAAAEVTGVAGSFGAVQWAPTGATVYNPAFDVTPAGLISGWVLDSGVVTPAQVAAGAFAPDNG

SEQ ID NO: 12831 - protein, 788 aa, Klebsiella pneumoniae
DMKTLKHWSLHQQLKHHVELTVDGQHTLCLYVLEENLFRVLLKRQGQLALDRTWSIAPQQDVPWEGRARDDLSGFSLPAWQLAQEGDTLTIATRQLRVTVNQPLWLEWSYRDEAGEWQPLANDRPTSAYLANAHGDGVAHYLSRRKDERFYGLGEKAGDLQRTGKRYEMRNLDAMGYNAVSTDPLYKHIPFTITQRSDISYGLFYDNLSSCWLDLGNEIDNYHTAYRRWQAEAGDIDYYLFTGKQVLDVTKAFVRLTGKTLFGPKWSLGYSGSTMHYTDAPDAQNQLMNFIRLCEQHAIPCDSFQLSSGYTSINGKRYVFNWNYDKVPQPKVMSQSFHDAGLKLAANIKPCLLQDHPRYGEVAERGLFIRDSQTDAPERSSFWDDEGSHLDFTNPQTVAWWQEGVTTQLLEMGIDSTWNDNNEYEVWDGEARCYGFGREIAIKHIRPVMPLLMMRASLEAQQRFAPQKRPYLISRSGCAGMQRYVQTWSGDNRTNWDTLRYNIRMGLGMSLSGLFNVGHDVGGFSGDKPEPELFVRWVQNGVMHPRFTIHSWNDDQTVNEAWMYPAITPAIRSAIELRYRLLPYLYTLLWQAHADDEPMLRPTFLDHQHDAQTFAECDDFLLGRDLLVASVVEPGARQREVWLPDNQAGWYDFYSHQWFAGGQWVTLDAPLEKLPLLVRAGAGLPLSERISHVDAQKDDRRELQLFPLKGTGSTRGLLFEDDGESWGYKQGDALWLEWEMTCSASSINLDINARGNYRPAWKALKLSLPVGEKRKLLVNGVEGTEWRL

SEQ ID NO: 12832 - protein, 89 aa, Klebsiella pneumoniae
DWKTIATPRRAGTTSFITSSPISTSPSLTSSSPAIMRSSVDFPQPEGPTKTANSPSSISRLTWCSVTVLPNLLVTFLSRILDIHIPRSE

SEQ ID NO: 12833 - protein, 191 aa, Klebsiella pneumoniae
LSETVSRETINNQGFSPAPLTRILLPFHILISAGGATDRLRPIFSFMIKDDIPMRLSTAVLALSCALATITGCTSSKSSPERHAYAFVAHRSDFVGGNFTVNRQENYRLNLPTFTAMYARGQQDKAAGMSESDARRTAEAIKQQAAQGTRTEHAFTGNASDKWDNAMENKDAVLFGNELSGAYLDGYLGVK

SEQ ID NO: 12834 - protein, 463 aa, Klebsiella pneumoniae
LAGTRRLRRRRGGGLSFAVDRAAGGDLRFRAGLYRPGSAKQTPACRRRGAGAMSLTVSELLALEGLSALRLRAGKQGLQRAVRWYYVAENEHIAEWIMGGELVFITGINHPRDEANLIQLLMEGKQRGIAGMVILTGEAYIHAIPATLIALADELGMPLIEQPYLLKMVIVTERIGTALVRSENVLQSQRDILMQLVTGDYPDLQMLHQRALHQQLDFTRPLRLAALRLEGLSRLFRQFPPEQAEAWLLQAHRSVRQQLQQQLNQQGNPFPLLERSNMFLFLLPDEEGEGFQQKKWLQQWLQTLADGEEGLSLLCGLSAPVRQLQGYPRALSQARQALDLCDTLRPTQRISDYQQLGFIKLLSAVSDPALLNDFMHDTLGCLIEPGRKAPWLLLETLETLLQENGNVVRAADRLGLHRNTLHQRIQRIEKLTGYPVSHPQFHLNASVALVIWRLSQNHLQDPP

SEQ ID NO: 12835 - protein, 143 aa, Klebsiella pneumoniae
PFFALPGCKVNTTLFRWPVRVYYEDTDAGGVVYHASYVAFYERARTEMLRHHHFSQQVLLAERVAFVVRKMTLEYFAPARLDDMLEVQTEITSMRGTSLVFTQRIVNAENTVLNEAEVLIVCVDPLLMKPRALPKSIVAEFKQ

SEQ ID NO: 12836 - protein, 512 aa, Klebsiella pneumoniae
MVFASLLERQRVRLLLALLFGASGTLAFSPYDFWPAAIVSLIGLQALTLNRRPLQSAGIGYFWGLGLFGTGINWVYVSIAQFGGMPGPVNVFLVVLLAAYLSLYTGLFAGLLARLWPKTNWIRMAIAAPVVWQITEFLRGWVLTGFPWLQFGYSQIDGPLKGLAPVMGVEAINFLLMVVSGLLALALVQRNWKPLAIAALLFALPFPLRYIQWYQLLPARATQVSLVQGDIPQAMKWDEKQLVNTLKTYLALTQPHIGHSQLIIWPESAIPDLEINQQQFLSMMDDLLRAKDSSLITGIVDARLNKQNRYDTYNTIITLGKDNPYRYDSTNRYNKNHLVPFGEFVPLESILRPLAPFFDLPMSSFSRGPYVQPQLMAHNLKLTAAICYEIILGEQVRDNFRPDTDFLLTISNDAWFGKSIGPWQHFQMARMRALELARPLLRSTNNGITAVIGPRGEIQKMIPQFTREVLTTTVTPASGLTPYARTGNWPLWALTALFGFAALLMSLRQRRR

SEQ ID NO: 12837 - protein, 591 aa, Klebsiella pneumoniae
HLFADMDHLNQLGGVGIQVDHVARFLRRLGTGVHGYRHVGLSQRGRVVGAVAGHRHQPTFRLILADQRQLGFRRRFGEEIIDAGLGGDRRGGQAVIAGDHHRFNAHFAQLGETFFDAAFDDIFERNNPQHLFAFGDHQRRGPLASDLFHLFIDIGREEAAVGLHVAANGVHRPFADHALIDIDAAHPRLRGKGDKGGVQRLQIAFAQVKALFRQHHDAAPLRGFIRQRGELGGVGEGSLFHAASRQEGGGLAVAEGNGPGFIQQQDIDVASGFHRAAAGGDHVGAEHTAHPGDADGRQQPADGGRDQAHQQGDQYGNADRIAAPRREGPDVAVASRNTSVRAISRIVRAISFGVLRRWAPSTMAIIRSRKVSPGFTLQRITSQSERMRVPPVTEAKSPPDSRITGADSPVMALSSTEAPPSMTSPSQGIISPASTSTTSPLRRSSAGTWSTGASCCGARSLRAKAVFFTPFRLLAWALLRPSAIASAKLANSTVNHSQILTAAVKVALPVRAPPAMAIASRVVNRLPTQTINITGLRHCTIGLSFFTASSSAWRTSVGSSRANCLRLITGCSASLKVRKSVQPAGQAPAQE

SEQ ID NO: 12838 - protein, 81 aa, Klebsiella pneumoniae
ARIARHAGNIGRISHFLFISRTNEYLTHGFFRHGAAARQSLHSTAAWSCYASRRLIFTHQGGGCCVWKACVEAVVVKRYMI

SEQ ID NO: 12839 - protein, 237 aa, Klebsiella pneumoniae
SGIAMKRAVVVFSGGQDSTTCLVQALQQYDEVHCVTFDYGQRHRAEIDVARELALKLGAVAHKVLDVTLLNELAVSSLTRDNIPVPDYQPDAEGIPNTFVPGRNILFLTLTAIYAYQVKAEAIITGVCETDFSGYPDCRDEFVKALHHAVSLGMAKDIRFETPLMWLNKAETWALADYWGQLDLVRRETLTCYNGIKGDGCGQCAACNLRANGLNQYLADKVGVMAVMQQKTGLAQA

SEQ ID NO: 12840 - protein, 562 aa, Klebsiella pneumoniae
IPVAPALTPGRRRPCRRPRWRHLLRELSWLLSLKQNPLSLPDFSPSCGDNARTGQGATKALQYAPWNAKFTLYISPRFGYLLLSMSKSMTKKLHIKTWGCQMNEYDSSKMADLLDATHGYQLTEVAEEADVLLLNTCSIREKAQEKVFHQLGRWKLLKEKNPDLIIGVGGCVASQEGDHIRQRAHYVDIIFGPQTLHRLPEMINSVRGNRSPVVDISFPEIEKFDRLPEPRAEGPTAFVSIMEGCNKYCTYCVVPYTRGEEVSRPCDDILFEIAQLAAQGVREVNLLGQNVNAWRGENYDGTTGSFADLLRLVAAIDGIDRIRFTTSHPIEFTDDIIDVYRDTPELVSFLHLPVQSGSDRVLNLMGRTHTALEYKATIRKLREARPDIQISSDFIVGFPGETTEDFEKTMKLIADVNFDMSYSFIFSARPGTPAADMVDDVPEADKKQRLYILQERINQQAMAWSRRMLGTVQRILVEGTSRKNIMELSGRTENNRVVNFEGTPDLVGKFVDVEIVDVYTNSLRGKIVRTEAEMGLRIAESPESVIARTRKENDLGVGIYQP

SEQ ID NO: 12841 - protein, 140 aa, Klebsiella pneumoniae
LASALSASRRAARRAGHYRPPFDLPALCAGRGKCPDRQRRTARAGGDRHGAVTSGGCGGGGCADLFGLQGSGGAVSSGAGGDPLSTGGTGPAGASDAVPAAAGAGGVYHADAAQSAGLGAQHRAATGAGRSRAPARSADY

SEQ ID NO: 12842 - protein, 183 aa, Klebsiella pneumoniae
PLPAGLFSPLPVALSSQPPLPLSSAPRPQLSPLQLPPVSSPRQRLSLQRLRPASSRQQPPWPPPVLPLSPGHPPSLSPRRPLWQRLPALLLPVRPLWLLPPRRPWQPLLQPASAAPSLLSPLPAPAAAPVRAVSAVPVPPPVSHVTLPPAAAPVFHAVQRRDVRWPAAVADGYSYLPPPPDRP

SEQ ID NO: 12843 - protein, 410 aa, Klebsiella pneumoniae
NNPAPRLRSAFDADPALLLMAFDDRLDDVHHIGAVVESGEAPGPGRRHLPGAHRLIKMPHHILKSVRPALNMAAGVMGAVSDFRPQQARVIAEQAIRLLAVADPQPLGHFLIPGQRTEAAVNLHRQTVFPPGAHLRDHKAALAAIVKTQQHRAKVLGIDRPRFICLRLVNGAEGRFAIDRRFTRWPDDRQIRHHLDNPPTGHKLHGIAPVGADVGHRPRRAALRRIDPPVVVGLQQHPVLQIAAVGREDSADLAMADHRRRLLDHSELAIDEADAMHHAGPGGKRHQLPRLLRRHTQRLFREDVQPGGEDLPVNLGMQMVRRTVMHHLQPRMGQQRLHAVVGMGNVQRLRLALRRLKAAVAQRHHLDISQPPQRLQMRRANKPCPDNRDLNHVIPSRRRQSHRRPVLQRE

SEQ ID NO: 12844 - protein, 235 aa, Klebsiella pneumoniae
GSPAWQYGRQIMYDFDWSSIVPSMPYLLAGLVITLKITVIAIVVGIVWGTLLAVMRLSSFLPLAWFAKSYVNVFRSIPLVMVLLWFYLIVPGFLQNVLGLSPKTDIRLISAMVAFSMFEAAYYSEIIRAGIQSISRGQSSAALALGMTHWQSMRLVILPQAFRAMVPLLLTQGIVLFQDTSLVYVLSLADFFRTASTIGERDGTQVEMILFAGGVYFVISLSASLLVSWLKKRTV

SEQ ID NO: 12845 - protein, 75 aa, Klebsiella pneumoniae
RHTAAAGHPPAPDGCAFATARQRSSAAAPPAQTGSPPSPSVRPPGCATPIAPAPPGQAAVLTAAAPAGGAPPRKA

SEQ ID NO: 12846 - protein, 298 aa, Klebsiella pneumoniae
RITAFNKYQEVNMLVSMKDMLQHALRDGYAVGQFNINNLEWVGAVLSTAQQCRSPVILGVSGGTVKHMLGLKCIHDIVVNAMEYLHIDVPVALHLDHGTTQEACEAAIAAGFSSIMFDGSHLPFRENLAITRHLVTLAHSKGISVEAELGTIAGSEDGIVNSEVIYADPQECYTLVTETQVDCLAAALGSTHGLYKGKARLGFTEMKAIAEQVKVPLVLHGGTGIADEDMRRAIACGTAKINVNTENMYAWCQQVKAIFAADTGHDVNDPRKVIAQGLQPVREMIARRMALFGSEQRY

SEQ ID NO: 12847 - protein, 160 aa, Klebsiella pneumoniae
FMAALKPEVKAAIVQMLACYDTLSIVVEVIQKDYGIKVTPQQVESHDPTKVSGKGLAKKWVDMFNATRDRFLNEISDIPIANKAYRLRVLQRMSTTAENMKNIGMTAQLLEQAAKEVGEAYTNRQKVEHTGANGGPIESTTLTKDEYKKARQEMLEDDDC

SEQ ID NO: 12848 - protein, 215 aa, Klebsiella pneumoniae
LAAAPATVKLSWSARARTVSTWKGLLITAVLHSVEPCRISIRRPPLKTTWRSACLKKPNSRPAGCWKHEGHMIGANHLPESLRLRMAQSPLAVVEDPFDVRLERLREEYFDRMYRDFIAAYGEEKGWQAYGEYLHHGLFAIRRRLGLQRFAQLTERLDEALVQQQRTASTEAHFAWLVPLLEEYYDPMYRYQLGKKAGKILFRGSWQEVAAWLAK

SEQ ID NO: 12849 - protein, 248 aa, Klebsiella pneumoniae
CEAAMAFYSIGEVAERCGINPVTLRAWQRRYGLLKPQRSEGGHRQFDEEDILRIEEIKRWIERGVSVGKVKALLEDNLPAARDESAHLQEEMMSILRYMQPARIRAKLMALSHQHPVDTLIDSLLVPVRQRLKLDQNTSLVISSMLDGLLIDCVALFLAEARKKNGKETLLVGWSNEDRTRLWLEAWRLSQRGWHVNVLAEPLESPRPELFPGQHIFVWTGRAATPLQEELLSHWQEQGFSIHFHGQN

SEQ ID NO: 12850 - protein, 80 aa, Klebsiella pneumoniae
SPHATGLGRGDRMSGGAWLRHYSPGESSMSAAEKWNDDEFIQLMSDAIGERDADDDEPVTLSAERQNPVISWDEFAGDFQ

SEQ ID NO: 12851 - protein, 388 aa, Klebsiella pneumoniae
QTHAQCRMLARRAFAIVRHFFNSITDAVVLTMKTSFTARLLITALSVAALSSAARADDLNIKTMIPGAPQIDAESWILIDYNSGKVLAENNADSRRDPASLTKMMTSYVIGQAMKAGKFKESDLVTVGNDAWATGNPVFKGSSLMFLKPGMQVPVSQLIRGINLQSGNDACVAMADYVAGSQDAFVSLMNNYVNALGLKNTHFQTVHGLDADGQYSSARDMALIGQALIRDVPNEYSIYREKEFTFNGIRQLNRNGLLWDNSLNVDGIKTGHTDKAGYNLVASATEGQMRLISAVMGGRTFKGRESESKKLLTWGFRFFETVNPIKAGKEFASEPAWFGDSDRASLGVDKDVYLTIPRGRMKDLKASYVLNNTELHAPLQKKPGCRHH

SEQ ID NO: 12852 - protein, 427 aa, Klebsiella pneumoniae
MSDAKAKITLGGDTAIELDVLKGTLGQDVIDIRSLGSKGVFTFDPGFTSTASCESKITFIDGDEGILLHRGFPIDQLATESNYLEVCYILLYGEKPTQAEYDEFKTTVTRHTMIHEQITRLFHAFRRDSHPMAVMCGITGALAAFYHDSLDVNNPRHREIAAYRLLSKMPTMAAMCYKYSIGQPFVYPRNDLSYAGNFLRMMFATPCEEYEVNPVLERAMDRILILHADHEQNASTSTVRTAGSSGANPFACIAAGIASLWGPAHGGANEAALKMLEEISSVEHIPEFVRRAKDKNDSFRLMGFGHRVYKNYDPRATVMRETCHEVLKELGTKDDLLQVAMELEHIALNDPYFIEKKLYPNVDFYSGIILKAMGIPSSMFTVIFAMARTVGWIAHWNEMHSDGMKIARPRQLYTGYAKRDFQSDIKR

SEQ ID NO: 12853 - protein, 405 aa, Klebsiella pneumoniae
TPDASPGRQPSASRHQPRRGYPLWSDPFPDRLHVHRGTGAYRALASAPLTPRHTVCPPLINPFRKPRRRQISGDFWTLQLDPWQHLPRQGFARLFLGETENLLIEIGLLKRQAVALFQLTMDLAVAHPQLARQATHRQLGAARLLAVVADKVAVERQFYPAGFHHRVLEGGVTAGVPAGVEVGKAVQWRTITGRIVQQMIGAKPQATAQTEDLLAHRAVHFPRVAGGVLLGKSNADLHRPPGVHRVKGTEQLLPHRHHPDKVIKNGAQLLFRLHIVQTVAIAFTVWRGDLQRGMDQKRRNVHFFRPAVNFLPGDFIQPRHHRIGLIVRLLLRDRQHRADVFFRRRQLLAVKRGGDGLRPGLPILDAGRHFLPHHRRHVNRLLALFQRRSLLAGTGAQRHGRQQRQ

SEQ ID NO: 12854 - protein, 65 aa, Klebsiella pneumoniae
RDDAVGIRSCRPHQRRYRTCPHPVNFTKHEITKDTESTTLRRRRKECFSICRSRGLPLQHQLGLQ

SEQ ID NO: 12855 - protein, 248 aa, Klebsiella pneumoniae
ALRAGDLIYPLPRHTLRRVQSPPCCKAHFCFDFRGYPMTNGTDYRAILASDTPLIDVRAPVEFSQSAMPAAINLPLMNDEERAAVGTCYKRQGPEAALALGHKLVQGDLRASRTQAWLEACARYPHGYLCCARGGQRSHIVQQWLKEAGVDYPLIVGGYKALRQAAIQATDELVQRPIVLIGGCTGNGKTQLVCSRPDGIDLEGLAHHRGSSFGRTLQDQHPQATFENHLAVSLLKKAEQQTRWVLEA

SEQ ID NO: 12856 - protein, 747 aa, Klebsiella pneumoniae
GGSAPFTGRQDMAEVPLPTPTQVPVPSTDIRNAVFAGAKLDEEVTGLGDFYTDRLGAKHLTNTGRNNQFQDAQNQRDSDFVASQADKEARFQQFLLNSGYQFLGDYENGPYTITARNQIIRYQNEFWRLNAATNPPYTTTGINSTSWATDITHLVSVGDANLRQELSFSYGLKLIGQCESIAALRAITLEYVGQQVFVKEHTSGMGQGGGIFYCHSLTNPGSLVDDNGFQIVTASGQVLRRKDRNIMSAEMFGAIGGQDITPVLNNMLLASKTFNIQEAYIPHPLNKTDYTATGGSVADVTDGIGFNLIGIKTVNKGPAINHISNNIFFRFRKNGPASSSFYEQCSITGLLIRGRNSTNTAAGNDGYAIEASDIIGFYCDVFCTGYTNTFAAAVSLYNDTSFTEQSRIKLHIRNCCNGVHFHRNASPGATSTNSFMGTDVDLAFQAAVSGKTNNGIVVGNLDGTSTSNTFDVNLYASKIKMKYWAEGGSATRAILVTAKGIVPESTTFDLISDGYGSGTSDTDTITDPSTQLIRVENGGIFRDKCTDQSMQTGLSHRLNQLQRLRNTIFSFQDDTYKVPYNDARPYINPVGMSCICSGTIDVATQQAGASWQISGLPMGMRIKVTINQYLEGESATSVQEVWEVLVRGDAQSVICTPLVTNDVLTTTTGLAVVNSSFATATFLKSVAAVFGKFWQGDSTRTRLTVRNNNDDNSLTTGSSDGRKFRIFLPVNASATSVLHYSVKLEVV

SEQ ID NO: 12857 - protein, 379 aa, Klebsiella pneumoniae
RVGAGWRAGTDLFSAPYLTFYRVNRMKKIALSLMTLGLLQSTAALATAPTPVPAAIAEHNGPIRIAVIRNLGSDDNTTQFVAGALQEGKKLGFKISTFLSNGDDAKFQDFVNQAISQKYDGIILSQGRDPYSTALVKKAVDAGIKVAVFDTAVSGEIPGVTVSQQDDASLTELSFGQLVKDFNGKANIVKLWVAGFPPMERRQAAYQTLLKQNPGIKELESIGAVSSDVQGDTANKVGAILAKYPKGKIDAIWGTWDAFSQGAYKALKENGRTEIKLYSIDISNQDLQLMREAGSPWKVSVAVDPKLIGATNVRLIANKIAGEPTPATYDFKAAAIPQALLAAQPGAVNVASLGKIIPGWGQTEDFIAPWFATLEAKNK

SEQ ID NO: 12858 - protein, 90 aa, Klebsiella pneumoniae
GTGAMKNLIAELLVKLAQKEEEAKELTVQVEALEIVVTALLRHMEHDAQQALIQDIEQAIDQVTPCPPVNDHDAMLLQQYLKKLLRHPRS

SEQ ID NO: 12859 - protein, 330 aa, Klebsiella pneumoniae
RAGAAAFRRSRALCAAEGGGMLKFIRAGMYTSVQDGGREGQRQWGISRCGALDKPAMTIANLLVGNAPEAAALEITLGQIDVQFTRHCWFALTGAACEATLDGAPVWLGWRMEAKAGQRLVLKNPQHGIRSYLAVAGGIDVPEVLGSRSTDLKVGIGGIEGRRLQDGDQVKIGKSSRRFSASRGVKQLPIGNIIRALPGPEYHEFDSVSQESFWRSPWKLSPQSNRMGYRLQGQPLKRTTDREMLSHGLLPGVVQVPHNGQPIVLMNDAQTTGGYPRIACIIEADMYQLAQIPLGQPIHFTPCSLEEALKARADQQRYLEQLAWRLSDEN

SEQ ID NO: 12860 - protein, 463 aa, Klebsiella pneumoniae
RGGARRAVYHPRRRLHRLCADPRLCPGQRLPRLADYRSRAGPGDGAAAGHRQPRLCLAGAPFIFPFIVRGVRIMSARLNIGLIGSGFMGQAHADAYRRAAMFYPDLPKRPHLYALADQDQAMAERHAAKLGAEKAYGDWRELVNDPQVDVVDITSPNHLHYTMAMAAIAAGKHVYCEKPLAVNEQQAQEMAQAARRAGVKTMVAFNNIKTPAALLAKQIIARGDIGEPVRFRGTFDQGFYNDPNLPWSWRCSKTLGGSGALGDLGAHTLSVAQFLLGGIREVTASAQTCLRQRPVPQTDAGYASRVAADAEWREVENDDQVQCLVNFDSGAAGVIEASRIAAGRIFGVFWEVSGTEGTLYMDGERFNELQVYRFNDDKHDRGFKTLYAGSQIPAYAGFFGFDFGGGGLGYFDVKVIEVHDLVQGICGDDDCYPNFEFGLQNQRVLSAIEASMVSRRWVNVVKD

SEQ ID NO: 12861 - protein, 306 aa, Klebsiella pneumoniae
VLFAVVQLAAIVAGHQEVANRLRIVILQHVADGKEITQRFRHLLAVNHHHAGVHPVVDVFAVVGAGGLGDFVFMVREHQIRTAAVNIEVVAKLLAVHRRALDMPARTARAPRRRPARLALFRHFPQDEVHRVTLDVNHVDARPRLQLIEILTRQQTVVRVRRHVEHHVTVICHVSMAFGDQLLGDLNDLRNMVRCARLAVGTQNIQRVKIFVHFGNHAIDQRDKAFAVFISALNDFVVDIGDIAHVLQLIAKKTQIARHDVKGDEGTSMTDMTEIVNGNTTHVHADFPGMDRFKFLFLARQCIKNF

SEQ ID NO: 12862 - protein, 452 aa, Klebsiella pneumoniae
PAIAMRGISFFSRRSISRSSLCSSTHTSDKASPVAAARPVSADAVDVIFRYVRQLVVHHVRQLFDIQTAGGDIGRHQHANAAGFKVGQRAGTRSLALVAMDRRAADAVFVELFREVVGAMLGTGKHQHLLPVAFADKLRQQFTLAVLVNKMDVLGDLLGRGVTTRHFHFQRVVQQFLGQALDLVGEGRREQQILSTRRQFSQYATDVMDKAHIQHTVRFVQHEDFNFIKTDGVLMFKIQQTARGGDEDVDAAAQLHHLRVDTHAAEDHQRANIQVFTVIADVLAHLRRQLTGRGQDQRAHRTTALCVRLILDQALQQRQGKARRFTGAGLGAGHQVTALQYRRDRLLLDRGRLNVALLSDSAQDIGIQAKGIKRHNNSEPPRPGKGRSFQGDYCDKRWQKPQCHEGAQSSRFCDRPHKICKRMPRLAGGHEKAAERAQRPVGHSSAVNADDT

SEQ ID NO: 12863 - protein, 97 aa, Klebsiella pneumoniae
GCVALGSARAGISSTCLPWYITSTRSQCAATSGRSWLISNMAICRCALCSTSSSRIWLRRRASRAEVGSSAISTFGLLSSARAIITRCPIPPESSPG

SEQ ID NO: 12864 - protein, 152 aa, Klebsiella pneumoniae
SGSAGCGMKQVCVLGNGQLGRMLRQAGEPLGIAVWPVGLEADPEAVPFQQSVITAEIERWPETALTRELARHPAFVNRDVFPIIADRLTQKQLFDKLGLATAPWQLLADKSEWPAVFARLGELAIVKRRVGGYDGRGQWRLPGKRDRSATGR

SEQ ID NO: 12865 - protein, 100 aa, Klebsiella pneumoniae
RHPADEKIFIFNKNRGMLKRDAFDGADNRSRTYDLRITNALLYQLSYIGPARGVHERESRGKRLELSGRCVNSQWNQLPIFASPVLIYARMVSSPKPIHL

SEQ ID NO: 12866 - protein, 172 aa, Klebsiella pneumoniae
TKPAPAGFSMPGGNVATVQYPPFLPLPQRADQNMTQDTAWQTTQTAVGPLIITPITTDLKATWTLQWIFTLAQAERFKSWLRSPTYCDRGRNWFQMPIDLGDTQGVQQQTLHFVDMPVQTSKNGNIVTWSATVISNGIEDITEDYDDWIVEAQPGYGYWLDYLITEVMPRAD

SEQ ID NO: 12867 - protein, 66 aa, Klebsiella pneumoniae
FSPAVHQNGLTIHLVIISRRDGGRVVLIALLICISEFCPFFRHIRTLKFGVVLFSYIFFGFRGNKC

SEQ ID NO: 12868 - protein, 194 aa, Klebsiella pneumoniae
LVAAESQLNKEDLMPLPERFKPAKINRQKLKELTDAAEEMLSQIDSGADEDDEELKAMIDDWNRQVVNPYEFSDFRDFSSWTDAKNFTRMAFNQEKYVADLTWDELVQIISFVCNAEGKESEQSYALGLLEINFDANPSDLIYWPNEWFQNEDMLHVDLTPEEIAGYLMARSGRLLSDAPQIDLRYPLPPSAAS

SEQ ID NO: 12869 - protein, 864 aa, Klebsiella pneumoniae
LPAAWRSLAQSSAIDAGPAAETTAPTLPGRWFLVSKSKAGTAQHAPEGLLVRDRNRRLTRNIMLMAVDATATAALVHLHHGADFSRRRRSGTVMARDLHHRRPLRQHRDRRRRQRREVTGGVHHFAVNHRQHRLNAFDLLFRDAEVVFRQHHQIGKLTGGQTAFLALLAGEPGAARRPQLQRDIARQAVGVVIHRHPANGAPGDQPVQRGPRVIAGDAGRIGAQPHRHVQRQHLCYRRGMFHRLFAVAIDKIFALEGHPMLHRNTAPQRLHPLNVTLGNGLGMIEEPVQAIKRDIAVHLLKHVQHPADGLIVGGMQAERPAMLHQMAYHPLQLILHALRQIRPRLQEIFKIRRRKYQHLAGAVGAIEVSPLPRLQHVGPAFKILQLLLRPLSKQVVGDAHGHLIFRVQLFDNFVIFRIVLEAAAGVDGAGQPQSVQLAHKLTGGVHLQIQRQLRPLGQRSVKDHGVRFGDQHPGRVAVAIADDLAARRIRRLFAISHGFQRRTVQQRAIVEMEHKHRRIRRRLVQLFQGRHPPLGELKFAPAADHPHPLRGRRAIRLILQHSQGIRQRGDALPAELKVVVQPTADQVQMRIVEARDHRMPFEIDDLRPLGGKAHDPIVTSGGNNFSVGDGYSFRQGIRTIEGMNLTVGQNQCGSLRHNALLEEADSVFLQPASKQAGHDGHPEPDHQRNHAGIIDEVQQQAPLKRRQQHAGHRRHQVGAGENHQQGDQKLFPAPRLAYVHRRRGKPEGRFSPHLSPIAFRQQWGNLSHQLPTGFRLRPGVEVLQGIEADYDAPQILPCGGPDHIRPKMAGKFCRNGHNFTEPLFVALAVLRIEQMADNQGHRFLLRHDEFLASGKWPVFSCHSP

SEQ ID NO: 12870 - protein, 80 aa, Klebsiella pneumoniae
ARAARCLKTRSTPIPVSSWPPYRWPTRATVIRSGSCCLMTSRAIFISGARRSPACRCSRSGRATSSPANPPMCWAEHNNT

SEQ ID NO: 12871 - protein, 133 aa, Klebsiella pneumoniae
PSAAPWRALSASSIKPPPISSRPKENFSQTRSTERTLPSGRISHASTTPAAITAIALTDWNSAVGTSQFSRRRLTKWSINRLIELPPCCASTQNSVPASISRTICHSARRCSGALIMIRATIWAANRQTIASR

SEQ ID NO: 12872 - protein, 143 aa, Klebsiella pneumoniae
RTAAGQAPRRISGDAEKPTGRAVPRRNTVACRHRAARRSRPVSGPQGAGSGVIHCASSGSSSAIISPSATLRPRCKTQKRSATRRIKGRCCSASSTVRPISRFNRNSRSASFCRQRGPLPREGSSRISSRGWTISAMASASWY

SEQ ID NO: 12873 - protein, 214 aa, Klebsiella pneumoniae
GKAATSLSQAGVTMKLIGMMDSPYVRRVAVSLALYGVEFESLPLSVFSGFDEFSRINPVVKAPTVVLDNGTQLMDSTLILHYFETTNPAGRRLLPAHPEALARDLHLLGVILAACEKAVQHVYEHRLRPEEKQHQPWVARVTGQLLAACREWDARLADRAAAAQPDQVLVTSTVVWSFIQLMIPAVVSTAEFPHIRALAEKGEALPAFQQYPLG

SEQ ID NO: 12874 - protein, 388 aa, Klebsiella pneumoniae
QHYAAKRKPGGNRRGGSIMTDNPNKKSLWDKIHLDPTMLLILLALLTYSALVIWSASGQDVGMMERKIGQIAMGVVIMIVMAQIPPRVYEGWAPYLYIFCIILLVAVDAFGAISKGAQRWLDLGIVRFQPSEIAKIAVPLMVARFINRDVCPPSLKNTGIALVLIFLPTLLVAAQPDLGTSILIALSGLFVLFLSGLSWRLIGIAVVLVAAFIPILWFFLMHDYQRQRVMMLLDPETDPLGAGYHIIQSKIAIGSGGLRGKGWLHGTQSQLEFLPERHTDFIFAVLAEELGLIGVLILLALYILLIMRGLWIAAQAQTTFGRVMAGGLMLILFVYVFVNIGMVSGILPVVGVPLPLVSYGGSALIVLMAGFGIVMSIHTHRKMLSKSV

SEQ ID NO: 12875 - protein, 413 aa, Klebsiella pneumoniae
KSHAIHRVNDRMLRTGSEEWWQTLRGPQCRAVDDAIEVTFWWRDPAGDETCSPHRRVWLYITGVTDHHQNARPQSLQRLPGTDAWFWRTTLSPTWRGSYCFIPSDRDDDFSPEVFSADAPDRALLREGWRKLLPRAIADPLNPHSWRGGRGHGVSALEMPQAPAQPGWDRLNEAHPPARCLEWRSARLGNHRRVWIYTPGEAVDPQTRPLAILLDGQFWAESMPVWSPLAALTREGRLPPAVYLLIDAIDNQRRGVELPCHRDFWLAVQEELLPLVHGYAPFSDRPDRTVVAGQSFGGLAAMFAALNWPQRFGCVLSQSGSYWWPHRDGRGTGFIGEQLRQGEVSAAGLRVWLEAGQREPIIFRANQALLAQLTTTQQTIFWRQVDGGHDALCWRGGLTAGLIQLWQPLLSHP

SEQ ID NO: 12876 - protein, 327 aa, Klebsiella pneumoniae
GYDASTMNSTGLSIIKTLGCMTAVTFFTIYNTWDRFDYDYHWILGLLTFISTIATPLFFVVAGYLDAQTRHDANWQIGKIKSVVIVFLFWVTVYYVWEPYQRGYLIQPWFIFALIVIYTFHPLIAWLSQRRGLFFAVLLTLLCCSYGYDLLSVIYPDRHLFSLPPQYRLWTWLLFYLTGQLFNDPKVAEWIRNPQVIKGSIIALPFVYLFTWFYERHFFFALFKADRNAFILTGSQIYILIVLLVIAANAVQFKKNREWKEAVLATVSKAMTGVYILHYSVFHLLVMLIPVHSLATKLGVIALTFVLSVLISLAALSSTLLRKVITL

SEQ ID NO: 12877 - protein, 513 aa, Klebsiella pneumoniae
RHCASGGPSPDASAACRTALITVVLCTRVGGSHSPDRPTPHICRHIKKSGHLYMQQQHKPHLLRGLNARHIRFIALGSAIGTGLFYGSASAIKAAGPAVLLAYLIGGAAVFIVMRALGEMAVRNPVSGSFGSYARQYLGPLAGFITGWTYTFEMVIVALADVTAFGIYMGLWYPDVPRWIWILSIIFFIGAMNLCNVRVFGEMEFWLSLVKVVAIIAMMLAGAGIIFFGFGHSFPATGLENLWSHGGFAPNGWQGVIASLGIVMFAFGGVEIIGVTAAEAKDPKKVIPQAINTIPLRIILFYVCTLAVLMAIFPWNSFGEQGSPFVLIFDGLGIPAAATILNIIVISASISAINSDIFGAGRMMYGMSKEGLAPKSFQRIASNGVPWMTVVVMGGALLAAVVLNYLIPEQVFVLIASLAAFATVWVWLMILLSHFAMRRGLSAEERSQIAFPIPFWPVAPLLTLLFMGLVIAVLGMFAETRMALIAGLVWLGLLTVVWYARVRKTALQVVTEQ

SEQ ID NO: 12878 - protein, 236 aa, Klebsiella pneumoniae
PPCAAREKSNFPRKTRIHVAECAVGRDCCFRALACSAMIAVIYGHCVPTTSFKFQEVILLMAIIGIFFGSDTGNTENIAKMIQKQLGKDVADVHDIAKSSKEDLEAHDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTNERVEKWVKQVAEELHLEEIKNA

SEQ ID NO: 12879 - protein, 99 aa, Klebsiella pneumoniae
RRCAMSKKIIDWDTLKTELLGQPEVQAAFDAQERQQRLRTMLAQWREQAGLTRAQVAQRMGVSAPTVSRMEANITRASLDTLTRYALACGIKHPQVLLY

SEQ ID NO: 12880 - protein, 292 aa, Klebsiella pneumoniae
SQCAHNDVTRCHIPARRLALCLVVRRFYSEGTTAQENEMATSNVVFITGATSGFGEAAAQVFADAGWSLVLSGRRYPRLKALQDRLAARVPVHIIELDVRDSEAVAAAVASLPADFADITTLINNAGLALSPLPAQEVALEDWKTMIDTNVTGLVTMTHALLPTLIRHGAGASIINIGSIAGQWPYPGSHVYGASKAFVKQFSYNLRCDLLGTGVRVTDLAPGIAETEFTLVRTKGDQAASDKLYRGTTPLSAHDIAEQMFYIATLPAHMNINRVEVMPVRQAWQPFAIDRD

SEQ ID NO: 12881 - protein, 65 aa, Klebsiella pneumoniae
SASAKHGGCGRIQLLSGAFLKNIKAWVIYEYSFVILKEQEPDFTCQILNLKDLRQCFVMSLLMTC

SEQ ID NO: 12882 - protein, 401 aa, Klebsiella pneumoniae
RRGAGRNASAGADPLSAAPSGACPLRGAVSRLPPAARADAAGMAGQTGRPSTSFSGPTTMKIVFTAEHAGDLSAFHQLGELLVEGWALGKPKLSAGQLIELAHDAEVLVTSYDEVTDVVMAACPHLQVIACTRANPVNIDTQAAQARGIRVLYTPGRNADAAAELTLGLMLSLARHIPQSHAALKRGEFTQADNAAAATQQGLRRDVVWDVSPESPYEVFKGTELRNKTLGLVGYGNIGRRVARIARAFGMAVLVVDPFVAAEDINEPGLQKTTLEALFREADIVSLHLSSGPHSDGLVNAALLNSMKPGALLINTSRAAVVDEAALIDALRHGPLGGAALDVYHREPLWRDHPFVIEFDNVIITPHIAGATRESIAKHTAMIAADLQRYVAGEPLLYQWR

SEQ ID NO: 12883 - protein, 418 aa, Klebsiella pneumoniae
RQGAVMNRQSWLLNLSLLKTHPAFRAVFIARFISILSLGLLGVAIPVQIQMMTHSTWQVGLSVTLTGASMFVGLMVGGVLADRYERKRLILLARGTCGVGFVGLCLNALLPEPSLAAIYLLGIWDGFFASLGVTALLAATPALVGRENLMQAGAITMLTVRLGSVISPMIGGLLLATGGVAWNFGLAAAGTFITTLTLLRLPQLPPPPQPREHPLRSLLAGLTFLCRSPLIGGIALLGGLLTMASAVRVLYPALAGSWQMSAGQIGLLYAAIPLGAALGALTSGQLAQTVRPGALMLATTVGSFVAIALFSLMPHWALGALCLALFGWLSAISSLLQYTLIQTQTPEHMLGRINGLWTAQNVTGDAIGAALLGGLGAVMTPAASASASGWALALVGVLLVGLLRELRRFQRPEIVNES

SEQ ID NO: 12884 - protein, 95 aa, Klebsiella pneumoniae
AGLAQQVERLPCKQDVGGSIPSISTRPSQGIFGPKSRHCSTLITSSRLERVFYYQVPQESSSTRFVVKSSLTGLTLLLTTDSTPNIIGGGDYENA

SEQ ID NO: 12885 - protein, 523 aa, Klebsiella pneumoniae
TGLANISTLTDLPLDVTNMYKKRKLAILIALLTGTAAAHGQTDLNSIEARLAALEKRLQDAETRASTAESRAASAEQKVQQLTQQQQQTQATTQQVARRTTQLEEKAERPGGFEFHGYARSGVIMNDSAASTKSGAYMTPAGETGGAIGRLGNQADTYVEMNLEHKQTLDNGATTRFKVMVADGQTTYNDWTASSSDLNVRQAFVELGNLPTFEGPFKGSTLWAGKRFDRDNFDIHWIDSDVVFLAGTGGGIYDVKWNDSLRSNFSLYGRNFGDIADSSNSVQNYIVSMNNFAGPVQMMVSGMRAKDNDDRQDANGNLVKGDAANTGVHALLGLHNESFYGLRDGTSKTALLYGHGLGAEVKGIGSDGALRPGANTWRFASYGTTPLSDRWFIAPAVLAQSSKDRYVDGDSYQWATLNLRLIQEVTQNFALAWEGSYQYMDLQPEGYNDRHAVNGSFYKLTFAPTFKVGSIGDFFSRPEIRFYTSWMDWSKKLDNYANDDALGSNGFKSGGEWSFGMQMETWF

SEQ ID NO: 12886 - protein, 95 aa, Klebsiella pneumoniae
LQIAPRTLSEVETMKMPDKIFSAASYCTSGGLICTGLAQTYDWFHGLDWNFIALASGVVIGVATYLTNLYYKRRWTKMYQQSLDRGYGGQPPQDN

SEQ ID NO: 12887 - protein, 68 aa, Klebsiella pneumoniae
SHPARDSLCSFLRSVFACIWLSGLNIVVGSNDDLRIRVTLMHGLGDGLQVACVYGTYRQCFRAYQMDR

SEQ ID NO: 12888 - protein, 835 aa, Klebsiella pneumoniae
RFTAKWSTWCMVRYELQRLPGAPLQRGTVGACTTLVSLLDSLQLHRDVIVKLNGRALPDDYDISRPLRSGDVVAVFDQPEGGVGKLITTILRPVTKILSGALKVFGLSNKPSASVSVATGESPNNDLTGQTNRARLYKGRPNIYGQCRVFPDLIQEALFEFVDNNKQLTEWFEVGYGRYTISSIRYSESNLGSLAGASSAIYNPGDVIGTIEVGYQFDDVDNETVPGLNESQDFPAQTATTTAPTSVAIESNQLKAIVLSNDDNFAYFAALAVPHPVSFVINATWNEGGTSVTRNVTGAGNIISSESFIGDDTLSYTTFYIGELSGEITSLPGNAVINPTLFTLNDQTPLVIGPSVSPIVSTQVWVHVLVQLGATAGTTRYRIKFWQVDDENNQVPGTSEQHDYFFDNDFQVTTRYFRTTHKFVPAAGAGRYAVTIERLDNSNDANVVTMMAIHAVNVRENVVYPEDTIARITIKGSNDSNSTREQKYNMLAQRHTISYDRTTGAVDYTLRPSRSFADAILHEWVVVGKQDVASIDVAALYAIADSLPDAQLGYFDYTFSDEKQPLGERIATIANVARVDGNNIGDVLTFWRDEKVANPDAVFARSNMFWDEYKVAWQMSLPGGYDGVALDYVDPLTNKKAYIYLQIDSSGITEVEDATVNAMQISLDGCRNATQATDRAWLEARKILYSRLTMTVKVLESTQVVRGTVVQCPDMYDNAQQTGYITGRSGDVFSTSERIDFSLGDMWVVMTDSIGNYRGRWRAYPVSGKPKAFQAAADTFDLNIYDRENVQNPSRYFIATDSELNSTIWRVDSAKPNGDDTQTLSLTEYSDSIYP

SEQ ID NO: 12889 - protein, 267 aa, Klebsiella pneumoniae
PITALCRKGSGAATSAYSSTPPGPADPSDAPAGGSPPAFFTDGIVMKKHLLALGLLLAGVSPAQALDVGDISSFMNSGSSTLSKTIKNSTDSGRLINIHLERLSSPLDGGQVIPMDKPDEVLLTPASLLLPAQASDVIRFFYKGPADDKERYYRIVWFDQALSDAQRDNANRSAVATASARIGTILVVAPRQVNYRFQYANGSLTNTGNATLRILAYGPCLKAADGKECKENYYLMPGKSRRFTRVDTADKKGRVALWQGEQFVPVK

SEQ ID NO: 12890 - protein, 476 aa, Klebsiella pneumoniae
PITARLPAAAYRSKERHSSGRYSTPARRAVMRVLSQARPQGNAMNIKIDALNYYGATKKYHLHFPALREDIEADVVIIGGGFSGINTALELAEQGITNVVVLEARHLGYGGTGRNGGQVMAGIGHDIEAVKKHVGKEGLETLFKIANLGAGIIRERIRKYNIDADFVPGYGYLAYNQRQLKTLRQWEKEFKAATPDEEIELYTGKEVQQVVGSEVYCGALKHMGGGQIHSLNMLLGSAQAAHSLGVKIFESSPVVEVNYGKQVRVRTAMGSVKAAKLLWACDSFLNNMEPEIYNKTLVTYSYQVSTEPLSDELIERISPLRGAFSDIRPVINYYRVTRENRLLFGSATRFVEYTPNDFAAWNRTLLAEVFPYLRDVKIDFAWGGPMACSANLFPQIGTLRDHNNVFYVQGYSGFGVTPSHIVCKILAEGINGGSDRYRLLSSIPHATIHGRDSLRLLLVTAGKLMHQTAGFWKGRS

SEQ ID NO: 12891 - protein, 137 aa, Klebsiella pneumoniae
AHQAGFHLAVARIRRKPSPSRRAAGGAGRAPAPPPAPLPRCGRPACRCTSRTPGAGQPPPAAGPGLMPDGEISVLTQCPDSPPPAPRAGRYPGEYHRLNPRVHRWSSTGGSRPTAVALSPSCSPFHPVVLSGVTISR

SEQ ID NO: 12892 - protein, 158 aa, Klebsiella pneumoniae
AGQAPRRPARCSGRVPVLMPGGGCALPGLRSGLGDAGIVGRASAAPPGKVCRPSARPDGAARVSRTGWRDAGAPAERCSSQGGRSRCPAGRRVCLRPPGDAPAAGWRRWHPHLSGRRRTGTGSGRSDRPRGSPRPAARYRGVYPGYGWRAGRPAASPG

SEQ ID NO: 12893 - protein, 516 aa, Klebsiella pneumoniae
KSKAAAPGCAPTACSLPHFCAAPAGAPRTDALSRQTTFWHSLCSLSFSTFLSGEAIRMTEHTTTLKRTLGSFRLWGIAVGLVISGEYFGWSYGWSQAGTMGFMVVALAVAAMYCAFIFSFTELTTAIPHAGGPFAYAYRAFGPTGGFIAGFATLIEFVFAPPAIAMAIGAYLNVQFPALDPKWVACGAYVIFMTLNILGVGIAATFELIVTLLAIFELLVFMGVVAPGFSWSHFTTNGWAGADSFSGLALPGMFAAIPFAIWFFLAIEGASMAAEEAKDPQRTIPRALGGGILTLTVLAIGVMVFAGGVGDWRALSNINDPLPQAMKTVVGNGSGWLHMLVWLGLFGLVASFHGIIMGYSRQIYSLARAGYLPAGLASLNRRTRTPHLAILAGGVVGIAAIFSDSLITISGMPLTACIVTMSVFGAIVMYITSMAALFKLRRSEPKLIRPFRAPLYPLAPAFALGMAVLCLVAMVWYNLLLALIFAAMMLGGYLWFRKTAAARERAPVDPQLRTVS

SEQ ID NO: 12894 - protein, 375 aa, Klebsiella pneumoniae
IRRAGRFMRPHLRTVGRTDRSGDPRRGSPGRDTALLFNRRSGSVSKALAVNATVSGRQRFFDFLYKWGMLLTVVLLVAVFGLASDNFLDPFNIINILRSIAIVTVIAIGVSISLTIGGFDLSVGSTASLANALVISLFVWHGLGTTEAILITLALCTLVGLFNAFLIVVLRIPDMLATLASLFVIQGVAMTYSYGGSITENMVLPSGEMAEGTIPAAFGALGQVPTIVIIMLVVTLIAQLALSFTTHGRRMYAIGGNPEAARLSGLRITRYKVAAYVIASLLAGLGGILLASRIGSSQVNAGGGYLMDAVAAAWIGFSLAGSGKPNALGTLVGAVILGVLSNGLVMLSVPYYAMDIIKGLVLAGALALTYFQRRT

SEQ ID NO: 12895 - protein, 313 aa, Klebsiella pneumoniae
LRGACRMNGKIWVLGDAVVDLLPDGEGRLLQCPGGAPANVAVGVARLGGDSGFIGRVGDDPFGRFMRHTLAQEQVDVNYMRLDAAQRTSTVVVDLDSHGERTFTFMVRPSADLFLQPEDLPPFAAGQWLHVCSIALSAEPSRSTTFAAMEAIKRAGGYVSFDPNIRSDLWQDPQDLRDCLDRALALADAIKLSEEELAFISGSDDIVSGIARLNARFQPTLLLVTQGKAGVQAALRGQVSHFPARPVVAVDTTGAGDAFVAGLLAGLAAHGIPDNLAALAPDLALAQTCGALATTAKGAMTALPYRDDLQRSL

SEQ ID NO: 12896 - protein, 198 aa, Klebsiella pneumoniae
TITAGLAKSALQERFMSRRRGATLTKALLTLSCLLAAPLALAISVGNLTFSLPAEADFASKRVVNNNKSARLYRITVSAIDRPGGSEVRSRPVDGELLFAPRQLALQAGESEYFKFYYHGPRDNRERYYRVSFREIPTRNLTRRSPTGGEVSMEPVVVMDTILVVRPRQVQCKWSFVKAAGTVSNTGNTWFKLLIKPG

SEQ ID NO: 12897 - protein, 768 aa, Klebsiella pneumoniae
PATALSPTMRAAFPESSSLPFRQRLLYLPVYVATEVPMPWILLLLAALFTAPLSAATLPGVPTANTDKNSASEPDVEQKRAAYAALADVLANDSARQELIDQLRKAAATPPPDSTPTLTPPAVKEETTVLENVTQISREYGEQLSSRFSQLWRNITGSPHKPFNPQTFTSAAWHFLLLAGLVFAFWWLVRLAALPLYRKMGEWGRHKNRDRGNWLQLPLTIAGAFIIDLLLLALTLFVGQLLSDRLNGNNPTIAFQQSLFLNAFALIEFFKAILRLIFCPRIPALRPFNLSDEAASYWSLRLSALSSLIGYGLIVAVPIISNQVNVQVGALANVVIMLCITLWALYLIFHNKTVITQGLIHLADHSLAFFSLFIRAFALVWHWLACAYFVVLFFFSLFDPGNSLKFMMGATLQSLAIIGGAALVSGILSRWIAKTITLSPATQRNYPELQKRLNGWISASLKAARILTVCVAIMLLLSAWGLFDFREWLHNDAGQKTVDVLIRIALILFFSAIGWTVLASLIENRLASDIHGRPLPSARARTLLTLFRNALAVVISTITVMILLSEIGVNIAPLLAGAGALGLAISFGAQTLVKDIITGIFIQFENGMNTGDLVTIGPLTGTVERMSIRSVGVRQDTGAYHIIPWSSITTFANFVRGIGSVVANYDVDRHEDLDKASQALKAAVDDLLAQEEIRGLIIGEPSFAGLVGLSNTAFTLRVSFTTLPLKQWTVRFALDTQVKKHFDRAGVRAPVQTWQQLPMPGADSPAAE

SEQ ID NO: 12898 - protein, 434 aa, Klebsiella pneumoniae
TIAAKLRLLVHQFVEGSGFFRHFGFRQHGFNSLLFQRHVAHVVHQLFVLAVELNDFRRIFVRRSHLFDQGFYALFVSFQLVGADHFAQQQTNNDATFSLLFEQLARQFQSLFLVAAETLSSLTTQHVDFAVDQGSRNVDLVGFNQTFDSLRLHAVTHSAFQLAFHIFTHFSAQASDGTIFHAETFDELFGQLRQFTLFDFLQVDNELSRFTFQVFCVVLFREGHVDGELFTRFVAFDTVFEARDHATLAHRQYEVRGFAAFELFAVNRTGEVDGYAIFSVNRAFFFFPGRLLLAQSFQHGINVSVGDFNNRFFNFDRVQTLQFNFRIHFELYRVGEVFAQFVFARNVVRRAGRIDFFFDDRVNEMTAHQVAQHVLANGSAIALSNNIHRHFAFTEAVNANFFRYVDQLAFDSILDAVSGDSNRYTAPKALSGFN

SEQ ID NO: 12899 - protein, 425 aa, Klebsiella pneumoniae
GKQAHSAVLAYPRQQLVDAVDTLGQHDQRSAQGNGVAQALMTHGVVLDSVDIRDVRQSDAAADQFAAAEADRVGPHLFQKGGGVAGVSQRRVAGFLRRQRLEALGKGGPQLVDVVQPLLARGGGIANAELARQAAVVQQQVADGGADIEADGAEVAELGVDGLQAAFGNEDRPAVDIAVQQRFRMGKETVLQRRHRQLKLSVVAQGGDIGLQLRRVVIALVDLIRVVKEQILGDLAHRRVNKLRHLRLFLVGMEVEIAGVEQHLRQIVAKLAGRLGIVDVSDKLSAPDAVVGKIFHHHHRQLGIKVMDFYRVLRAVLIVGDKSLRLQTGAVEGQRPGFADAAHVGQSLFDDRPADALAIEHFKHQIEVAIAHFLRADQLRWVVDAGELLRVSHGIVGGEGMVLRHCLDPRILIKPFRRLYFWIPS

SEQ ID NO: 12900 - protein, 392 aa, Klebsiella pneumoniae
PDEAYIPGVVMYALTQGRVYTGHEILDDHAVVIANGFIERLCPLADLPSDIEQRSVNGAIIAPGFIDVQLNGCGGVQFNDSPEAVTVETLEIMQKANERSGCTSFLPTLITSSDDLMKQGVRVMREYLQKHPNQALGLHLEGPWLNIVKKGTHNPDYVRKPNAALVDFLCDNADVITKVTLAPERVEPEVIRKLVAAGIVVSAGHSNATLKEAKVGFRAGITFATHLYNAMPYITGREPGLAGAIFDEPDVYCGIIVDGMHVDYANVRNAKRLKGDKLCLVTDATAPAGANIDQFIFAGKTIYYRNGLCVDENGTLSGSSLTMIEGVRNLVEHCGVALDEVLRMATLYPARAIGVDKQLGSIAPGMVANLTAFTRDYKITKTIVNGNEVVTE

SEQ ID NO: 12901 - protein, 66 aa, Klebsiella pneumoniae
PYWASESALTIVSAAGKKIKLFVIRLRLFGGEWYNWVYSETGRKRPPAQRSRLTDMVCEATFHLEK

SEQ ID NO: 12902 - protein, 309 aa, Klebsiella pneumoniae
RRWAKSIKNNYVSGWPKASWAEGEQRMAIPKLQAYALPEASDIPANKVNWAFEPSRAALLIHDMQEYFLNFWGENSAMMEKVVANIAALRDFCKQNGIPVYYTAQPKEQSDEDRALLNDMWGPGLTRSPEQQQVIAALAPDEDDTVLVKWRYSAFHRSPLEEMLKETGRDQLIITGVYAHIGCMTTATDAFMRDIKPFFVADALADFSREEHLMALKYVAGRSGRVVMTEELLPLPASKAALRALILPLLDESDEPLDDENLIDYGLDSVRMMALAARWRKVHGDIDFVMLAKNPTIDAWWALLSREVH

SEQ ID NO: 12903 - protein, 493 aa, Klebsiella pneumoniae
PRRACQRTIVAMKFIIKLFPEITIKSQSVRLRFIKILTGNIRNVLKNYDETLAVVRHWDHIEVRAKDENQRPAIRDALTRIPGIHHILEVEDVPFTSLHDIFEQTLPLWREALEGKTFCVRVKRRGKHEFTSIEVERYVGGGLNQHIETARVKLTDPDVTVNLEIENDRLLLVKGRYEGIGGFPIGTQEDVLSLISGGFDSGVSSYMLMRRGCRVHYCFFNLGGAAHEIGVRQVAHYLWNRFGSSHRVRFVAINFEPVVGEILEKVDDGQMGVVLKRMMVRAASKVAERYGVQALVTGEALGQVSSQTLTNLRLIDNVSDTLILRPLISHDKEHIIDLAREIGTEDFARTMPEYCGVISKSPTVKAVKAKIEAEEEHFDFSILDKVVEEASNIDIREIAQQTEETVVEVETVTGFGANDAILDIRSIDEQEDKPLKVEGVEVVSLPFYKLSTKFGDLDQSKTWLLWCERGVMSRLQALYLREQGFSNVKVYRP

SEQ ID NO: 12904 - protein, 199 aa, Klebsiella pneumoniae
DRRAVAGDPRQQGPVRRSRAPSPHGATDRAAGAVRRRSDAALRRSRDALRRRAGPAGGGQRYRCAVACHHPQRAGGRPGAEDPGCAGAGGRPLAVQLSRDASAGGGARAAAASARREAWGQRGGGPAALGVPDPGAARHCRSGGRLAAAGHRLPGRPPADDAGRRPAVAADRHGGSTGPLQRYSGAGKSLLPAAAGRRG

SEQ ID NO: 12905 - protein, 77 aa, Klebsiella pneumoniae
PLRAPLRGNTTPILISAACALLAPTSAATSVAIKDAFPENDFIGISPSVDYLSLTINDCITLRNNAPAYPANYWLLC

SEQ ID NO: 12906 - protein, 247 aa, Klebsiella pneumoniae
LPHFKEICPHLSDPGRDSMNTQYLQYVREQLIVATADLSGATKGQLVAFAENAMFEATPRSRGRKKVYDPQKKRMVNPDSPPIDGSQSRAKGSAIALVLPVEYSTASWRRALLSLEEHQKAWLLWNYSDNIRWEHQETITRWAWEQFSQQLAGVRIAKKTVERLRQLIWLAAQEVKAELSGRDAYEYQVLAELVGVAKSTWTETYLPHWLKMRSSFVRLDSDALISVTRSRSQQKATNLDVSLAKPN

SEQ ID NO: 12907 - protein, 443 aa, Klebsiella pneumoniae
EWHLRRRVRHKELKKRFGLMTDKRKDGSGKLLYCSFCGKSQHEVRKLIAGPSVYICDECVDLCNDIIREEIKEVAPHRERSALPTPHEIRHHLDDYVIGQEQAKKVLAVAVYNHYKRLRNGDTSNGVELGKSNILLIGPTGSGKTLLAETLARLLDVPFTMADATTLTEAGYVGEDVENIIQKLLQKCDYDVQKAQRGIVYIDEIDKISRKSDNPSITRDVSGEGVQQALLKLIEGTVAAVPPQGGRKHPQQEFLQVDTSKILFICGGAFAGLDKVISHRVETGSGIGFGATVKAKSDKASEGELLAQVEPEDLIKFGLIPEFIGRLPVVATLNELSEEALIQILKEPKNALTKQYQALFSLEGAELEFRDEALDAIAKKAMARKTGARGLRSIVEAALLDTMYDLPSMEDVEKVVIDESVIAGQSKPLLIYGKPEAQQASGE

SEQ ID NO: 12908 - protein, 338 aa, Klebsiella pneumoniae
RCFFAFPYAVHPGCATLFAIFFYSRAAQDAAMSQPLPNKNLPMPSLRNIQAFIEVAATGSLNLAAENLNITASAVSHQIASLEHFLGKKLFSRSSKGVTLTAVGEKYLKEVSGALNMIGQATSQVINDIHQDYLRIHSAPSFGLLWLMPRLDKFRQAWPALKISLTCSYESIQFSRDNIDIDIRHGLSQWPTLLVRTIKNERVLPYSAASYLASHPVQAVEDLLACDLIHSDSTLINWSNWLSWHKVRGWHKNFIFNFDRSYMSIEAARMGMGVILESNLLAGGHVRQGQLTPVFADERSMPVGAHHFVLPHANEQKEKVQRFFAWVAGELKEEGFHI

SEQ ID NO: 12909 - protein, 585 aa, Klebsiella pneumoniae
YLFYVTNSCHYALLVRSCAVIRCLRFEEPVMSEAEARPTNFIRQIIDEDLATGKHTTVHTRFPPEPNGYLHIGHAKSICLNFGIAQDYQGQCNLRFDDTNPVKEDIEYVESIKNDVQWLGFHWSGDVCYSSDYFDQLHQYAVELINKGLAYVDELSPDEIREYRGTLKAPGKNSPYRDRSVEENLALFEKMRSGGFEEGKACLRAKIDMASPFIVMRDPVLYRIKFAEHHQTGNKWCIYPMYDFTHCISDALEGITHSLCTLEFQDNRRLYDWVLDNISIPVHPRQYEFSRLNLEYTVMSKRKLNQLVTEKHVEGWDDPRMPTISGLRRRGYTAESIREFCKRIGVTKQDNTIEMASLESCIREDLNENAPRAMAVIDPVKLVIENYPQGESEMVMMPNHPNKPEMGSREVPFSAEIWIDRADFREEANKQYKRLVLGKEVRLRNAYVIKAERVEKDAEGNITTIFCTYDADTLSKDPADGRKVKGVIHWVSAAHALPVEIRLYDRLFSVPNPGAAEDFLAVINPESLVIKQGYAEPSLAQAEAGKAYQFEREGYFCLDSRYATATSLVFNRTVGLRDTWAKAGE

SEQ ID NO: 12910 - protein, 240 aa, Klebsiella pneumoniae
RIVYCEEVGVPEINEYGQQVNDLVPGWQGAQVLRRTALNGRFCRLEPLDVDRHAADLFAAYALGDNRDWTWLASTRPESVAATAHWIAGKVNDDALVPYAVVDLRSEQAVGIVSYMAIEREMGTVEIGHVTWSRRMKNTPLGTEAVWLLLKNGFDHGYRRLEWKCDSMNVASRRAAERLGFSWEGRLRQRLVRKGRTRDSDMLSIIDGEWPARDAALRAWLAAENFTADGQQIKRLEAFR

SEQ ID NO: 12911 - protein, 86 aa, Klebsiella pneumoniae
VVFLVKIRSFPVHLNFAERLKVPAHSCLYFGMLPVGMDSAVFVDGEFTGVFCENPLEALFGTFDFEHHSSSTLMPAAASATFTSWL

SEQ ID NO: 12912 - protein, 818 aa, Klebsiella pneumoniae
RRYYEDNPMTTLKLNTLSARIQAHKMALVHIVKPPVCTERARHYTEMYQRHLDKPIPVRRALALAHHLAERTIWIKHDELIVGNQASEVRAAPIFPEYTVSWIEKEIDDLADRPGAGFSVSEENKRVLHEVCPWWRGQTVQDRCYGMFTDEQKALLATGIIKAEGNMTSGDAHLAVNYPLLLEKGLDGMRAKVAERRSRINLTVLEDLHGEQFLKAIDIVLEAVSDHSKRFAALAREMATAESRESRRHELLTIAENCDVIAHEPPKTFWQALQLCYFIQLILQIESNGHSVSFGRMDQYLYPYYRRDVELQQSLDREQAIELLHSCWLKLLEVNKIRSGSHSKASAGSPLYQNVTIGGQNLVDGKPQDAVNPLSYAILESCGRLRSTQPNLSVRYHAGMSNDFLDACVQVIRCGFGMPAFNNDEIVIPEFIKLGIEPQDAYDYAAIGCIETAVGGKWGYRCTGMSFINFARVMLATLEGGRDATSGQVFLPQEHALSKGNFANFDQVLTDWDNQIRYYTRKSIEIEYVVDTMLEENVHDILCSALVDDCIERAKSIKQGGAKYDWVSGLQVGIANLGNSLAAVKKLVFDQGAIGQQELAKALAEDFDGLTHEQLRQRLINGAPKYGNDDDSVDQLLARAYQTYIDELKQYHNPRYGRGPIGGNYYAGTSSISANVPFGAQTMATPDGRKAHTPLAEGASPASGTDHLGPTAVISSVGKLPTGAILGGVLLNQKLNPSTLENESDKQKLMVLLRTFFEVHKGWHIQYNIVSRDTLLEAKKHPDQYRDLVVRVAGYSAFFTALSPDTQDDIIARTEHTL

SEQ ID NO: 12913 - protein, 551 aa, Klebsiella pneumoniae
SMHYFKHSVALALFAALSLGSLSAQAYEQDKTYKITILHTNDHHGHFWRNDYGEYGLAAQKTLVDGIRKEVAAEGGSVLLLSGGDINTGVPESDLQDAEPDFRGMNLIGYDAMAVGNHEFDNPLSVLRQQEKWAKFPFLSANIYQKSTGERLFKPWALFKRGGLKIAVIGLTTDDTAKIGNPEYFTDIEFRKPAEEAKLVIQELQQNEKPDVILATTHMGHYDNGNHGSNAPGDVEMARSLPAGSLAMIVGGHSQDPVCMAAENKKQVDYVPGTPCAPDRQNGIWIVQAHEWGKYVGRADFEFRNGEMKLVHYQLIPVNLKKKVTYDNGQSERVLYTPQIAENPQMMSLLTPFQNKGKAQLQVKIGSVNGHLEGDRSKVRFVQTNMGHLLLAAQMARSNADFAVMSGGGIRDSIEAGDITYKDVMKVQPFGNVLTYVDMNGKEVVDYLTAVAQMKPDSGAYPQFANVSFVAKDGKLNDLKIKGEPVDPAKTYRMATLSFNATGGDGYPNIADKPGYVNTGFIDAEVLKEYIEKNSPLDAAAYEPKGEVSWQ

SEQ ID NO: 12914 - protein, 487 aa, Klebsiella pneumoniae
PLCYAGLLSDLLCGFRADQVVESAQRRFCPFPCRDNNLFVRHGGAIARGEHAFDVGFALRIDDDLTHAVALNGAFQPGGVRQQANLDEDPRQRDMMLIAAHPVTILQTGDFAAIAFHFRGLRIKNDVDILQAADFILQHLVGFHLWGKLQQGYVLYDARQVNGGFHAGVPAADYRYAFALKQRTIAVKAVGHALGAILIFAPARSYCAISPPVAMMTLRALSTAPRSGFDLMQAALCRRRRQFGRTLGVDHVDVIVIDVRFQRACQLLAFGFRHRNIVFDIHGIQHLTAEAFAHQAGKNPFTCRVDRPRRAGRAGANDQYIVSVTLIQLFRCAFFRTGIHFGDDFSQRHPSLTKLLTVHEHRWHAHDVTLGDLILEGPAVNRRVFDARVEHRHQVQGLDHVRAVMTGERIVGFEFEIAINIADLLQQRLGLFRRMTAGPQQRQHQRGKLVAQRRARKTRPLVGTWVSNQERGLTYRERVVFFKGDFV

SEQ ID NO: 12915 - protein, 285 aa, Klebsiella pneumoniae
LECYWSKLSQEHSLMTVKVIVTDMDGTFLNDAKQYDRPRFLAQFAQLRQQGIEFVVASGNQYYQLISFFPEIREQISFVAENGALVYEHGKQLFHGELTRHESQVVIGELLKDPQLNFVACGLQSAYVSDKAPDAFVELMSKHYHRLQRVSDYHAIDDTLFKFSLNLPDSEIPQLIDKLHVSLDGIMKPVTSGFGFVDLIIPGLHKANGISRLLKRWDLSPQQCVAIGDSGNDAEMLKLVKYAFAMGNAADSIKAIAGYATDDNNHDGALNVIQAVLDNTPPFNA

SEQ ID NO: 12916 - protein, 259 aa, Klebsiella pneumoniae
RSILYILRGTVGNLGLDMDNIEIATLLPGATLFSDSNINQTWKAHVRTATNTVVVFAKIIDPREICVEAFCAILGRELGIPIPKPFLVLADNTTLDVIPPGQHALMYGSEDADYPSFRRYADCSQAYEKLQNFKASLDVGVFDEWIANHDRNVGNILYDGCDDFLFIDHGLALPEGLPASEPAIDNNILRALFSFKSELEKFRDLRTASQMITPMYRALNLEDVMSSAQATMYVPRCGDRSNFSFSNREIVINRDSDKI

SEQ ID NO: 12917 - protein, 361 aa, Klebsiella pneumoniae
RDILCLQTVTGGRAMLTQTTALAPDGQPWQQVTLRNKSGMTVTVADWGATLLSAEVPLADGSLRRPLLGCAKLEDYARQAAFLGASVGRYANRIGHSRFSLDGQVVNVTPSNDAGHQLHGGPEGFDKRRWRIVRADEQEVLFALTSPDGDQGFPGTLQATAHYRLSDDNRIAITYRATVDQPCPVNMTNHVYFNLDGEQGDVRQHQLQILAQRYLPVESDGIPGGELKDVANTSFDFRQPKTIAADFLADADQQKVKGYDHAFLLDAKGDASQPAAQVWSQDGKLQMTVYTSAPALQFYSGNYLGGTPSQTTEPYADWQGLALESEFLPDSPNHPQWPQPDCVLRPGQEYVSLTEYQFIAR

SEQ ID NO: 12918 - protein, 454 aa, Klebsiella pneumoniae
PQRYRPQQQHHGHLDQQKINQRLRIVSAAATGQRQEQRTKDSRSETEGRLLQGAEDCAPGPGVAGADIAHTNPIKAVDDQRLAIADQRRGGNQRQGVGGDAEAGEGGAQQQETGDLHRQTGQQDPPHAVAGDKPRGIQRRNKIGHAEGDKAIAGLPRRHPQPLLHGQRHAEHKAGPGAEKQQGDGHPEADAGQLQQTRRQQRMVATLLLAQGALTHGEQQRQDRHQHQLQPQRPVQLRTEGHREQQAAEDQREVQRTLPVNPRRRLATGFRHIAAAQSQHQQADRHIDKKGVAPAQPGDVRRHQPAAAHLTDDKGDPADPAIQADGPGVGGAFEGDVQGREDLRHNQRRPGALQGAGRQQGADAVRHPAQQGSDAKEGDAPHKQAPAAIVIAKLTAHRQADGKGDAVQSDDKLQLRGAGRQGVGDGVQRHIGDRGINKRQHLAAQQQQQTGAAG

SEQ ID NO: 12919 - protein, 455 aa, Klebsiella pneumoniae
RCGYAIISTDNRRRWPRNTGGGNLHNSYPAVIIPAGYSGDVMQELISQIAALGIEITPTRSLMIIFGIILFTAVVVHLILHKVVLRAFEKRALASSHLWLQIITQNKLFHRLAFTLQGIIVNVQAVLWLQKGSEAAEILTTVAQLWVMIYAMLSFFSLLDVILKLAQKFPAASQLPLKGIFQGIKLVTAIIIGILIISLLIGQSPAILISGLGAMAAVLMLVFKDPILGLVAGIQLSANDMLKLGDWLEMPKYGADGAVIDIGLTTVKVRNWDNTITTIPTWSLVSDSFKNWSGMSASGGRRIKRSLNIDTTSIHFLDEQEQQRLIRAKLLKPYMDSRHEEISAWNQQYAGEQSILNERRMTNVGTFRAYLQEYLRHHPRIRQDMTLMVRQLAPDANGLPIEIYCFTNTVVWAEYEGIQADIFDHVFAVVDEFGLRIHQTPTGNDIRALTGAFSR

SEQ ID NO: 12920 - protein, 250 aa, Klebsiella pneumoniae
HNLYSKSFRMPPCGNRMPYRWQRCRARPDSMPFGHRGAVQRNISVSTCPLVFKGCRFMNFLAHLHLAHLADSSLPGNLMADFVRGNPQGDYPAEIIDGIFMHRRIDVMTDNLAEVKEAREWFRPQTRRVAPITLDVMWDHFLSQHWAQLSPDLPLDEFVRYAERQIVPILPDSPPRFVNLNQYLWSERWLERYREMDFIQRVLNGMASRRPRLEALRDSWQDLDTHYDRLETQFWRFYPQMMRLAENKQL

SEQ ID NO: 12921 - protein, 92 aa, Klebsiella pneumoniae
  UNSURE (85): Identity of amino acid at the above locations are unknown.
CPVYVRTRGAFRWAFSLATAIFGDLTPAISTALVELSGDKSAPGWWLMCAALCGFIATALLFVRLSRGYQPAESQRKKQTGGDMXRPFAAVV

SEQ ID NO: 12922 - protein, 335 aa, Klebsiella pneumoniae
CRKYCTYNNSGEADIMAFTSRITLLAALAVAAFQAQAVNVTVAYQTSAEPAKVAQADNTFAKTSGATVDWRKFDSGASVVRALASGDVQIGNIGSSPLAVAASQQVPIEVFLLASKLGNSEALVVKKSITKPEDLIGKRIAVPFISTTHYSLLSALKHWGIKPGQVQIINLQPPAIIAAWQRGDIDGAYVWAPAVNELEKEGKVLTDSSQVGEWGAPTLDVWVVRKDFAEQHPEIVKAFAKSAIDAQQPYIANPEAWLKQPDNISKLARLSGVPEADVPGLVKGNTYLTAAEQAQALNGPVNQAIVDTARFLKEQGKVPAAGTDYRQYVTDRFVK

SEQ ID NO: 12923 - protein, 130 aa, Klebsiella pneumoniae
MRKYMMEKCIRAATVQFCHRADDKQYNLSVIENFIIQAHRENVQLLVFPEMCITGYWHVPNLTTETLNDLAERVEDSPSLSRIVTNAVNYHMAIGVGFIEKGSDDILYNSYAVCMPDGKSLLHRARSGVI

SEQ ID NO: 12924 - protein, 147 aa, Klebsiella pneumoniae
KCPLCVAPPGPAPGRAPPSRLDRAVATAGRSARPAAPGFCWRRTALCTARFCPRRPARRYQEFPPSAGAAKYPAAAPHHADRQPAAAPLRRAAGAAAGRYRSARGPASFRRSVRRSAAPSGRSQSAARRAAPSGCRRSPSAHGYDAK

SEQ ID NO: 12925 - protein, 88 aa, Klebsiella pneumoniae
HDGYKARAMPEMKKGRKAALCWQKTGDRSGNILRNGAWRAKMHHNSAFDVTFLHHGRPPSVPCLLVVHQALSDSSLALAASSSPASCS

SEQ ID NO: 12926 - protein, 251 aa, Klebsiella pneumoniae
THMYFSKETLATNSRLGGHWNELWANRNMWNANHDAMIAANRAHMTPDWLAANAAGGFTRDFWAEIDRQVLQLRDQEVGMEIINDLVGVQTVLSVGKTAKLYSVVGDIADDVSVSIDGQAPFSFDHTEYASDGDPIPVFTAGYGVNWRHAAGLSTVGIDLVLDSQMAKMRKFNKERVNYYLNGNPNIQVQSYPAQGIKNHRNTKKLNLGSGAGGANIDLTTADMTALFAFFGKGAFGSLARTNKVAQYHVM

SEQ ID NO: 12927 - protein, 141 aa, Klebsiella pneumoniae
PHAYPVPEPVLALPGRRVDLRVLGCLSDGGDVMSHSTDHSGASHGSVKSYMTGFILSIILTVIPFAMVMSGSASHAVILGTILVTAVVQIVVHLVYFLHMNSKSDEGWNLTAFIFTVIIIAIVVVGSIWIMWNLNYNMMMH

SEQ ID NO: 12928 - protein, 419 aa, Klebsiella pneumoniae
TMAYVNHLLTFIESNPALAVGFNLILLLLSGIFAHLLCKFLLIKVVRKVFFSSHKQDVPLEKDRRIAEKLSNFIPVIIVYYVLQFMPAMPASLVTAINTICGILFFIFMSVFFNEMLDIVNSSYLRKTKRKNHSIKGYIQIGKILVHILAAIMILAVMSNKSPIIIISSLGAVAAVLMIVFQHTLLSLVANVQLSSNDVLQLGDWIEMPDKNLSGEVTDIALHTITIRNWDNTISRIPTKNFLTETYTNWQAMFSSGARRIMRSIAIDQHSVRFLDQEMLSSMLTIRGVSEPLATLLDGRDPGGVADRWFVDNGLTNLTLFRHYLMHYLAERPDIIKEMYIVARTLKPSPSGIPLEIYCFTTSTLWKDYENTQSAIFEYITAVAGQFSLRLYQYPAGHDFWRLSQEHAARTGLPPSAEG

SEQ ID NO: 12929 - protein, 366 aa, Klebsiella pneumoniae
TMALFATETWTMRHRLLLTIGAILVVCQLISVFWLWHESKEQIQLLVASAIEGHNNQKHVEHEVREAVASLLVPSLLIVGLALYISMLAVRKITRPLSRLQSELENRTPDNLTPIVLSESVPEVTAVTTALNQLVSRLNLTLDRERLFTADVAHELRTPLAGLRLHLELLAKVHGVGVDPLIQRLDQMTTSISQLLQLARVGQSFSAGSYQQVLLLDDVVKPLQDELEAMLAQRQQRLLLTDIENETVVSGDATLIRVILRNLVENAHRYSPEGSTIRVSVKAGLMPVMAVEDEGPGIDEAKSGELSKAFVRMDSRYGGIGLGLSIVTRIAQLHDAQFFLHNRQPGPGVRAWVLFPQRGGQNVSTH

SEQ ID NO: 12930 - protein, 138 aa, Klebsiella pneumoniae
TGKYRSRWRKGREEDSGKAALIVGERAVAGQATCCRNSRRRGLGGFFTSSWGLPSSAIRPLSIKISREATFSAKPISWVTITIVMPSSARSCITLSTSWRSSGSSAEVGSSNSIIFGFTASARAMATRCCWPPESSDG

SEQ ID NO: 12931 - protein, 216 aa, Klebsiella pneumoniae
LRRYLMSIRELLDPTNSALIFIDHQPQMSFGVANIDRQTLKNNTVALAKAGKIFNVPVIYTSVETKSFSGYIWPELLAVHPDVKPIERTSMNSWEDDAFVAAVKATGRKKLVISALWTEVCLTFPALMALEAGYEVYVVTDTSGGTSVDAHERSIDRMVQAGAVPVTWQQVLLEYQRDWSRKATYDAVMDLVREHSGAYGMGVDYAYTMVHGAPEA

SEQ ID NO: 12932 - protein, 147 aa, Klebsiella pneumoniae
KDYLMYKNIVVPVDVFDAGLADKALSHAKFLAQHSAGQIHLIHVIPAFSPVLTRGFISDARKMEDHLLNTAKEKLSELVKKNGLAEDASHLYVRSGNVRDQVIALADELKADVVIVGSRNPGIQTHLLGSEAANIVRYAHVPVFVVR

SEQ ID NO: 12933 - protein, 412 aa, Klebsiella pneumoniae
PMDFTAGLMPLDTALAQMLDRITPLNATETVPLLQAFSRVTAHDIVSPLDVPGFDNAAMDGYAVRLNDLRDGAALPVAGKAFAGQPFNDAWPSGTCIRIMTGAPVPEGCDAVVMQEETEQTEAGVRFIAPVKAGQHIRRRGEDIAHGAVVFPAGTPLTVAELPVLASLGIAEVEVVRKVRVAVFSTGDELQLPGQPLGDGQIYDTNRLAVHLMLQQLGYEVINLGIIPDDPAKLRDAFIDADQQADVVISSGGVSVGEADYTKTILEELGEIGFWKLAIKPGKPFAFGKLSSSWFCGLPGNPVSATVTFCQLVQPLLAKLSGKHGPLQAPRLRVRAATRLKKSPGRLDFQRGILQRNPDGELVVNTTGHQGSHIFSSFSLGNCFIVLERERGHVEAGEWVEVEPFSHLFGGL

SEQ ID NO: 12934 - protein, 300 aa, Klebsiella pneumoniae
AMHLSNGHVSMTFDISLFPAKPTYAGKWWSVSFEPIIGSGERINAIIVARGVDGKHEIIQSIRDEVLDSIYGTKSESIKSMVSWVRSSLHSHLESHINLEHWAPPISGFAISKNSDALDDSLSGILRQAVRLTASLGTLTLEAERLEDDDRSSQKQSEQWSTRISDEARKLNPKLSDYFGTRVQLSSAQLHTRFGFYNDIYASNFGLMVPSRLSASINSIKAKVYDLESLSRSSMVLKPKTLDVIVGIPSFDDPTIPPKTVASMRGYVNELTELALKEDINFIPVNSAFEAAQRIIKIAA

SEQ ID NO: 12935 - protein, 607 aa, Klebsiella pneumoniae
KSNLSHFFVLYIAQNWEIIHMPQLYSYIRWSSERQQKGTTRQRQVIGAKEFAIANGLELVEIEDPGVSAFRGKNTTHGKLGDFIDAVRQGAIPPDSWLYVENLDRLTRQEVTTAQKLFIELLDLGLTLVTGMDKRVYTLESVNKNPTDLMISLLLFSRANEESKTKQARTIGNVESLIERHRQGLPVNIKSCGKHPFWIDDSGSQYESVKRHTIYWEIAREAIELFLSGYGIYKVKRFLDEKYPNGLNGKEWGYQVLKKMRESRALIGERQINIGSHTYTLRDYYPCLCKNEVEFLHLQELKGQNSYKSKKNPLKEQIKLLSGLAILRCSKCGGTMSSFMNKGKPRYICLNGRHLQKGCVGWSLTAPLVDHCVIIALLMGYMDANRKERQDTSDISALIEAKNTSVGELNVSITNLVAVIEAGVNVSELASRLKVLSTERETFLKEIERLKERKALIDSKGSFEVSMMDFINLIHWNVLSDYAHESRDKIRSTINKIIEHVIIDKTDGCITIKIKCRGSDEQLIFCGIGRKPHWKFDIALYVEQDTDGDTTFEEKSILPMANQLMEEATKQFALIREGYISYFDKICKILAAIGYPDIDGSAFWPNR

SEQ ID NO: 12936 - protein, 118 aa, Klebsiella pneumoniae
SAFQTPPEEVSQMENAIARKLEPPILNPIEIEGILLNRLLSIGQKVFAEMRGVSESTISRRKSEGYYAEMAKEISALGLQVVPPEAVVVSRHYLQSVETLADIGLRAERCRPGPLGWD

SEQ ID NO: 12937 - protein, 161 aa, Klebsiella pneumoniae
TTLQFNYLSGRAMHCPFCFAVDTKVIDSRLVGEGSSVRRRRQCLVCNERFTTFEVAELVMPRVVKSNDVREPFNEDKLRSGMLKALEKRPVSADDVEMAVNHIKTHLRGTGEREVASKMIGNLVMEQLKKLDKVAYIRFASVYRSFEDIKEFGEEIARLQD

SEQ ID NO: 12938 - protein, 181 aa, Klebsiella pneumoniae
NSLQAEPAAPGPPGAAGSLQNSRTKMTEIQRLLIHTIDELNVQEKRDNRPRFSISFIRNHPGLFVAMYAAFLATLVVMLRSETLVDSVWLLVVLFILFNAFFFFDVYPRYRYEDIDVLDFRVCYNGEWYNTRFVPQQLIDRILQSPDVDSEQKAQLKKMVATKGELSFYDVFTLTRAGAAQ

SEQ ID NO: 12939 - protein, 428 aa, Klebsiella pneumoniae
RFIHRHGQRSRRQVPDELLCFDDISHAVFSAAAGETNDRRPIVKAVKKAVWRQITLALGVLRGDPAYRARPDYRVQRVMRQAVALRRLIKVHAAPVTDNGDIQTPLFTAPPSTGILRGCSKEIVMKAQKPGLHPRNRHHQRYDLPALCQAHPDLQGYITLNPLGEQTIDFANPQAVKALNKALLAHFYAVKHWDIPDGFLCPPVPGRADYIHHLADLLAGDSGEVPKDATILDIGTGANLIYPLIGAHEYGWRFTGSEINPQAFASAQAIINGNPGLTRQIRLRRQKESQAIFHGVIHKNETYDATLCNPPFHDSAESARAGGERKRRNLGLGAESGLNFGGQQQELWCEGGEVAFISQMIRESQAFARQVKWFTSLVSRGDNLPPLYRLLTEVGAVKVVKKEMAQGQKQSRFIAWSFMDDAKRRRPF

SEQ ID NO: 12940 - protein, 74 aa, Klebsiella pneumoniae
KFSHRRDGVSPPNAIAAAEVGLSFFDWMKCGFPAMIVLLLVAIAILYLLFRPELKGTFEMNSEQVDWDKGKDDA

SEQ ID NO: 12941 - protein, 365 aa, Klebsiella pneumoniae
PTPHPGPVGIAPPGTMLIYQEFPFSMPSFSTHLTRLLQGLFTLLLTLFGLLLVTFSLSALSPVDRVLQIVGDHASQSTYDQVRHQLGLDQPLPVQFWHYLVNLAHGDLGIASATGQPVLHDLLAVFPATLELATLALIVGAVLGIVAGVLCARYAGSPWDLAVRTFTLLGNSVPIFWLGLLMLALFYARLQWAPGPGRLDDIYQYTVEPRSGFALIDTWLSGDTAAFKNAIGHLALPVLVLAYYSLASITRLTRSACLSEMNKEYILLARAKGAGEMTILLRHVLPNIRGTLLTVTALAWTSMLEGAVLTETVFSWPGIGRYLTTALFAGDTTAIMGGTLLIGVSFVLINNLTDLLVRLTDPRVR

SEQ ID NO: 12942 - protein, 219 aa, Klebsiella pneumoniae
TSHHSANSNPVTGFFFILLRPSTVRYKEDPCMSEEKRKMIAGELYLSGDPTLRADRLRARQLLHRYNHSAPDDQEQRQHILAELFARAGDAYIEPSFRCDYGYNIFLGAGFYANFDCVMLDVCPIHIGDNCMLAPGVHIYTATHPLDADARNSGQEYGKPVTIGHNVWIGGRAVINPGVTIGDNAVIASGAVVTKDVPACTVVGGNPAQIIKRLPPTNP

SEQ ID NO: 12943 - protein, 130 aa, Klebsiella pneumoniae
IINHSKNSMKTVNFLRFYLPQKSVILITSTEHRPLNRTTCERLTMKNIKYAAAAIALTALSFGAFAAEPVTPAQAESMNKIGVVSAQGATTLDGLEAKLAAKAEAAGATGYSITSANTNNKLSGTAVIYK

SEQ ID NO: 12944 - protein, 396 aa, Klebsiella pneumoniae
LRNHSVASMKTSDCFSDAGASMKFELDTTDGRARRGRLVFERGVVETPAFMPVGTYGTVKGMTPEEVEATGAQIILGNTFHLWLRPGQEIMKLHGDLHDFMQWKGPILTDSGGFQVFSLGDIRKITEQGVHFRNPINGDPIFLDPEKSMEIQYDLGSDIVMIFDECTPYPADWDYAKRSMEMSLRWAKRSRDRFDSLGNKNALFGIIQGSVYEDLRDISVKGLVEIGFDGYAVGGLAVGEPKEDMHRILEHVCPQIPADKPRYLMGVGKPEDLVEGVRRGIDMFDCVMPTRNARNGHLFVTDGVVKIRNAKHKSDTAPLDAECDCYTCRNYSRAYLHHLDRCNEILGARLNTIHNLRYYQRLMAGLRKAIEEGKLESFVTDFYQRQGRTVPPLNVD

SEQ ID NO: 12945 - protein, 324 aa, Klebsiella pneumoniae
RRDHVHLHASSLPEWEGAMLNYVIKRLLGLIPTLLIVAVLVFLFVHMLPGDPARLIAGPEADAQVVAMVRQQLGLDQPLHVQFWHYITNVLRGDFGISMASRRPVASEIASRFMPTLWLTLASMSWAVLFGMAAGIAAAVWRNRWPDRLGMALAVSGISFPAFALGMLLMQVFSVELGWLPTVGADSWRHYILPSLTLGAAVAAVMARFTRASFVDVLHEDYMRTARAKGVSETRVVLKHGLRNAMIPVVTMMGLQFGFLLGGSIVVEKVFNWPGLGRLLVDSVEMRDYPVIQAEVLLFSLEFILINLVVDVLYAAINPAIRYK

SEQ ID NO: 12946 - protein, 80 aa, Klebsiella pneumoniae
LSDQRATGGQWSAPQRPGLVRLRQRLAAGLVDVRELVMEGVWRYHIAFIHLVRNCHETRRSCLQRRTRFNHLSGAGSATV

SEQ ID NO: 12947 - protein, 62 aa, Klebsiella pneumoniae
LQRQADSVKPFTQVIEGTIYLFLDRFSDVPETVTHKDQTTGFDHTGYCQAFIDFVPYNSNHY

SEQ ID NO: 12948 - protein, 164 aa, Klebsiella pneumoniae
HWRHLLQVTGAGMAIWVDADACPNVIKEILFRAAERTQTPLTLVANQPLRVPPSRFIRTLRVEQGFDVADNEIVRQCAAGDLVITADIPLAAEVLAKGGAALNPRGERYSEATIRERLTMRDFMETLRASGVQTGGPDSLSQRDRQQFAAELEKWLLAVKRRQG

SEQ ID NO: 12949 - protein, 467 aa, Klebsiella pneumoniae
MTSHIPRRSMKNRLPADFLWGNSVSSMQTEGAWNEGGKGMSVYDIRQPAEFASDWKVATDSYHRYREDFDLMQDLGMNCYRFQIAWSRVCPDGDGEFNEQGIAFYHQFIDELIARGIEPMICLYHFDMPLSLAERYNGFTDRRVMDAFIRYGQKMIACYGDKVKYWLTFNEQNLYHSPEAFLISGYLQGEKTLRELYLIQHHVMMAHVHLTHYLHQTKPQCLMGGMLAHALVYPATCKPRDILCAQQLDEFLNQNLLRAYAGEGYSPEVMHFVAAEGFDDIYRPEDLALMATVKVDYLAFSYYASRTLNSDAIPPGTAVNNYMLFGNQDNPFLKATEWNWQIDPLGFRTIITRYYNDWRLPVFPIENGIGVIESWDGEHPIADDYRIAYHRDHINAMKAAIFEDGAQVIGYLGWGLIDILSSQGDMRKRYGVVYVNRENHDLKDLRRVPKKSYAWLKQVFRSNGEAM

SEQ ID NO: 12950 - protein, 118 aa, Klebsiella pneumoniae
PNCLTASSMAGVPGFEPGNAGIKNRCLTAWRYPNTVAVNRKYRRNMAGVPGFEPGNAGIKNRCLTAWRYPIRTTLTGEWCGRRDLNSHTLRRQNLNLVRLPISPLPQKRWWLRRDSNL

SEQ ID NO: 12951 - protein, 352 aa, Klebsiella pneumoniae
PRLHHAGSMMIRLYPEQLRAQLTEGLRAAYLLLGNDPLLLQESQDAIREAAAAQGFTEHHTFSIDNSTDWQAIFALSQAMSLFASRQTLLLILPENGPNAAINEQLATLVGLLHDDLLLIVRGNKLTKAQENAAWLTALAQRAVQVSCQTPEYAQLPRWLAARAKQHQLQLDDAASQLLCYCYEGNLLALAQALERLALLWPDGKLTLPRVEQAVNDAAHFTPYHWVDALLAGKSKRVLHVLQQLRLEGCEPAILLRTLQRELLLLVTLKRQATHTPLRSLFDKHRVWQNRRQLLSDALTRLSGEQLRQAVTLLTRAELTFKQDYGHDVWPELESLSLLLCHKALADVFIDG

SEQ ID NO: 12952 - protein, 96 aa, Klebsiella pneumoniae
TDVQINRPHVGLHAKVPLIAFLGLMHLRIALLLFVLGRAGCLNDGGIHQSALGHHDACFGQPAIDGLEQLTGQLMLLEQVAEIHDGGAIRQGAIQG

SEQ ID NO: 12953 - protein, 86 aa, Klebsiella pneumoniae
PPVHSSASTSEVNSWPSGEPAKRGPWSEPGLVIRNEGLRTASVLSSLKVTLSDSSAISANSSLISADLALSSSVAISSTGLVSFSR

SEQ ID NO: 12954 - protein, 97 aa, Klebsiella pneumoniae
AMSHAVYEDMLMKFVSLLFAAALTAHATAASPLPPPPVLPYNGPLRPVGTVSAFGASTLDDLAAALADKAHRHGAIAWRINAASSGNRLYGSAIIYQ

SEQ ID NO: 12955 - protein, 138 aa, Klebsiella pneumoniae
QSPHLPTAGGTPERCAAERARGASRRAGPVGRAVRQPAAVAGGDGPAGHPGAEAGAATRLRHRLSVADGRPREQHSGDGAGRRRQPNRAAARSARRGDGAAGGYADPLAHQRPFTAGHDRLVAGATAVARRGIAADDL

SEQ ID NO: 12956 - protein, 229 aa, Klebsiella pneumoniae
YTPQPEFSLPGGDVVLQHNKILIRQLGLQPYEPVSQAMHEFTDARDEDTLDEIWLVEHHPVFTQGQAGKAEHVLVPGDIPVIQSDRGGQVTYHGPGQQVMYVLLDLKRRKLGVRELVTLLEQTVVNTLAEYSIESHPRADAPGVYVGERKICSLGLRIRKGCSFHGLALNIAMDLTPFLRINPCGYAGMEMTQMRQWQPAASPETVAPRLVANLLALLNHPPHEYLPRD

SEQ ID NO: 12957 - protein, 446 aa, Klebsiella pneumoniae
HRPQQHAGAGLCRRPAAHRQSRRPTSVAPRPADGRDASPLLARRGATPADLYRPLQRGDFHQRWRGGDEQPLLSGLSGAAHLQRCDAGGILPLAAAAMHGRISVLLSGSRVLMKTKRVTIKDIAELAGVSKATASLVLNGRGKELRVAQETRERVLAIAREQHYQPSIHARSLRDNRSHTIGLVVPEITNYGFAVFSHELETLCREAGVQLLISCTDENPGQESVVVNNMIARQVDGLIVASCMHSDADYQKLSEQLPVVLFDRSPSDSALPLVMTDSVTPTAELISRIAPQHADEFWFLGGQPRLSPSRDRLAGFTQGLAQAGITLRPEWVINGNYHPSSGYEMFAALCARLGRPPKALFTAACGLLEGVLRYMSQHHLLDSNIHLASFDDHYLYDSLSLRIDTVQQDNRQLAWHCYDLLSQLIDGQAPEPLQRYLPATLQIRHP

SEQ ID NO: 12958 - protein, 510 aa, Klebsiella pneumoniae
GAAQRIPEQVIRAVRLLRQQRAQMMLAHLVEAGGAGHRPLRARRLNTGNRPARAEIARQHAELPGEAGGRMEAEQRRAVALAQRQKRIQPQALSLLIAEIGGQQRAQFAHRRGHHHLPRGHLPRQLAAELCRQAHRQQRMTAKGEEIGVDIVHLAAQQLAEGRGDKGFHPGLRRPAAALPAEGRQRQRFAVQFAVGAQRQLSELHQHHRHHMRRQLFRQLRFQRRGIQRQAGVRDQIAHQLSGIAAGRRRLVEDAGVTHRLPHVRQGRHHPINLAKLDALPADLQLIVAAAKVLHRAVRQPARHVAGAIHPLAGGKRVGDKAAGGEIRAPQIALRQLDAGEIKIPRHPRRYRAHRGIENAQPGVPHRPANRHAAAGHRRQLRAAGRIPADVHRRLRRAVQVMQRRAGQALPLAAQFRRQRFAAAEYPPQRAAGSDAVGIQRGDKRRQHRRHKVGGGHAVAGEELLHRLRVAVRLRLGHHQLRAGDKRPPEFPHRHVETARRFLRHHVVGR

SEQ ID NO: 12959 - protein, 554 aa, Klebsiella pneumoniae
HLHQKDQAMAIDKRAGQPAQQSDLINVAQLTAQYYVLKPEVGNAEHAVKFGTSGHRGSAARHNFNEPHILAIAQAIAEDRAKNGITGPCYVGKDTHALSEPAFISVLEVLTANGVDVIVQENNGFTPTPAVSNAILVHNKKGGPLADGIVITPSHNPPEDGGIKYNPPNGGPADTNVTKVVENRANELLAAGLQGVKRISLDAALASGHVKEQDLVQPFIEGLADIVDMAAIQKAGLTLGVDPLGGSGIEYWKRIGEHYKLNLTIVNDQVDQTFRFMHLDKDGAIRMDCSSECAMAGLLALRDKFDLAFANDPDYDRHGIVTPAGLMNPNHYLAVAINYLFQHRPQWGKEVAVGKTLVSSAMIDRVVNDLGRKLVEVPVGFKWFVDGLFDGSFGFGGEESAGASFLRFDGTPWSTDKDGIIMCLLAAEITAVTGKNPQEHYNELAERFGAPSYNRLQASATSAQKAALSKLSPEMVSADTLAGDPITARLTAAPGNGAAIGGLKVMTDNGWFAARPSGTEDAYKIYCESFLGEEHRKLIEKEAVEIVSEVLKNA

SEQ ID NO: 12960 - protein, 439 aa, Klebsiella pneumoniae
FPDHTVMGNETMKMATMKSGLGALALLPGLAMAAPAVADKADNAFMMICTALVLFMTIPGIALFYGGLIRGKNVLSMLTQVIVTFGLVCVLWVIYGYTLAFGTGGSFFGSFDWVMLKNIELKALMGTFYQYIHVAFQGSFACITVGLIVGALAERIRFSAVLIFVVVWMTLSYVPIAHMVWGGGLLATHGALDFAGGTVVHINAAVAGLVGAYMMGKRVGFGKEAFKPHNLPMVFTGTAILYVGWFGFNAGSASAANEIAALAFVNTVVATAAAILAWTFGEWALRGKPSLLGACSGAIAGLVGVTPACGYIGVGGALIVGIASGLAGIWGVTALKRWLRVDDPCDVFGVHGVCGIVGCILTGIFAATSLGGVGYAEGVTMGHQLLVQLESIAITVVWSGVVAFIGYKVADMTVGLRVPEEQEREGLDVNSHGENAYNA

SEQ ID NO: 12961 - protein, 126 aa, Klebsiella pneumoniae
LNCQRASASAGASGVFRAWSATSALRVVAGNGTAVSLTAASRASSSAESISASPQRSVGSAANCASSAVSRAMWRRSSASSYRALLARISSDSPPVSSGNSASSRSLTGPVARVWVTACTPSISSW

SEQ ID NO: 12962 - protein, 403 aa, Klebsiella pneumoniae
KHRHEDWPKRCVGIQNFKPHEKGRHEKRCAMTYQLHVGRCEEVLKTLPDNSVDAIVTDPPYGLSFMNQKWDYDVPTVDQWRECLRVLKPGGHLLAFGGSRTYHRLVVNAEDAGFEIRDQILWIYGSGFPKSHNLDGDFDGWGTALKPAHEPIVMARKPFKQTVSANMNEHGTGAINIDACRIPTDEALNGGTGGLLSHQRDGTQPVADYEQAPEGRWPANIIHDGSEEVIACFPANAGAAAPVTGNEPSAASTGQVLGMRKRVATVHHGDKGSAARFFYCAKVKPKERDEGLERFIATSASDMTGGRKEGSVGINDPRAGAGRTNGAKNNHPTVKPIALMSYLCRLITPPGGTVLDPWMGSGSTGRAAIEEGFNFIGIDLNPDYVTIASARIAYSFKKSTEAA

SEQ ID NO: 12963 - protein, 563 aa, Klebsiella pneumoniae
RHRHRAALQLQAPFLQRRTAVAGACGKGEGFLIEGDHHQIEVRRMASQTIGEAAAIPPAALALAANDDFAEVMFAGVMEDRFLFRRVGEGGGFGPQLLGQTQRGENSPPPAFRQPVQGRGLDIHRMPDAAQAGGEPGGGAHQLFAAGVVPDTEQDRIAGVPDFLLALAVAPGAHLLIDAVGGAAQGQLAQRNQIALAEKVFDSALGLAADVDFALIEPLAQIVRGEVHQHHVVRGVKEGIGNRLPHLHAGDPADDVIQAFQMLDVNGSENIYPGLQQFIHILPALWMAGAWRIAVRQLIHQNQRRTAGEGGVEIELIDVPPAMGKPPRRQSAQALQHRGGLFTAVGLRHANQNIQPLGAQPLRFRQHRPGFPHPGAGAKEHFQFAAMRGGGVLQQAVRVRAQRLVTHLLILQGIQRHIELQYIDHRLAKEAQQRGLCGLIHQLGYLLNAQLARLSHPGHLPQRGGRSQVVIETARRGGDQFDRHPRVGVRVGGAQGLHALAHRFIQRRVAGGEVAAARGHGIIRRLRGGRRAALEIACGGEVLANQRRAAHFTVQADQRAVGL

SEQ ID NO: 12964 - protein, 570 aa, Klebsiella pneumoniae
WMRHQTNETNGYCFMLIRSRTLTGLLFITLAGTSAAGAAPLTSSTHQTEQDKARQEALAPQQQDFQSSQQRVAPQGIPFPEETHCKLINRVDIDSDNQALTRKLLAKTARQAQGRCLGSEGIRLLAYTLQNELIAQGYITSLIDVPSQSLEHGILRFTLHYGKVGAIDYADGSDTTRLWNSLPTSSGTILRLSDLEQGMANLQRLPGATAHMKLLPGQHEGESDIQIARSLAKKWQLGAWLDDAGSKASGRYQAGGALYLYDLTTLNDILYLSGGGDIEFNQHNDGNHNGSLYYSIPFGYWTLSAYGAYSQYRQQFNGNWSTMDYKSKNRYYSATLSRLLSHTRQQKTTADLRIAKSTSHYYFGGSELLVMRKQNPSWEFTLNHQHYFNKKIVDASIGIQRSLPWLSSTATPEEQAGLYSPLSRIVHGNLQAMMKFDATGDKFTWAPRLSAQFSPDKLASDNKFNIGSRWSVRGFDGENSLSGNQGWYWRNDFIWDLATHERQFYLGADIGRLIGADLYQKGKVLSGAVSGLRGQLWSTQYDLFISTPLSKPDKFHSDALNMGFSLQWRY

SEQ ID NO: 12965 - protein, 129 aa, Klebsiella pneumoniae
AQRHRAMLSGTEPLYCRVAAGALAGLQEPLTGSHLVGPVSAAPPGDAIRHGAALLPGGGWRLTRPTGASHRITPRRPGKRSATGRCHQAQSRFIAGWRLAPYPVYDSRNLSLIYSPVLLKLPVLRPQHR

SEQ ID NO: 12966 - protein, 75 aa, Klebsiella pneumoniae
FISQCLYLLKQLFVSDIHFIVTFINPKTLNICMNNKQLVILLCINKLEPLAQMLLQGFVHQPPCDFMDSWRNTDT

SEQ ID NO: 12967 - protein, 226 aa, Klebsiella pneumoniae
KNGQYCYWPVKEEFHHYYYPGICIPDRLIVAQSDHHCQHYCARWYYFLDNLRAYSDVTQNRLVRRIAMTPAVKLLEKNKISFQIHSYDHDPNETNFGDEVVRKLGLNADQVYKTLLVAVNGDMKHLAVAVTPVAGQLDLKKVAKALGAKKVDMADPMVAQRITGYLVGGISPLGQKKRLPTVIDAPAQEFATIYISGGKRGLDIELAASDLAQLLDAKFADIARRD

SEQ ID NO: 12968 - protein, 364 aa, Klebsiella pneumoniae
LAGHAPRPATCVKRNSLNIDTREITLEPADNARLLALCGPFDDNIKQLERRLGIEINRRDNHFKLTGRALCVHAAADILRSLYVDTAPMRGQIQDIEPEQIHLAIKEARVLEQSAESVPEYGKAVNIKTKRGVIKPRTPNQAQYIANILDHDITFGVGPAGTGKTYLAVAAAVDALERQEIRRILLTRPAVEAGEKLGFLPGDLSQKVDPYLRPLYDALFEMLGFEKVEKLIERNVIEVAPLAYMRGRTLNDAFIILDESQNTTIEQMKMFLTRIGFNSKAVITGDITQIDLPRSTKSGLRHAIEVLAEVDEISFNFFHSEDVVRHPVVARIVNAYEAWEAADQKRKAELAAERKREAQEQEQK

SEQ ID NO: 12969 - protein, 186 aa, Klebsiella pneumoniae
TAGQRPTRMACGTWRLAHRRFDGQGDAGRRRTNPLSVLIPARAQFRKRLLPGRRCALPPALHASLPQRHSQGTSMSMKKWSQPLMWGMIIAILNPLGVSYIALIGVVIGNTLTFVWCAMLAWAIYFYAIYLLCTRPHDSRLVQIYLLLMGTLMLPWGVVLLITCIMREIKVNQAPTPSPPGETKDG

SEQ ID NO: 12970 - protein, 393 aa, Klebsiella pneumoniae
GILQRGGAMSWQQRIDRALDERRAAEAFRRRLPVTHGAGRWLEREGERWLNFSSNDYLGLSQHPAIIAAWQQGATRYGVGAGGSGHVSGYSEAHRALEEALADWLGYPRALLFISGFAANQALIAALVEKDDRIVADRLSHASLLEAASLSPAQLRRFTHNDPQQLAQLLAKPLAGEQLAVTEGIFSMDGDSAPLAAIHAATQAAGAVLLVDDAHGVGVVGDEGRGSCAAQAVRPELLVVTFGKAFGVSGAAVLCDEAMADYLLQFARHLIYSTAMPPAQAVALSAALRIIRSDEGQQRRDILAARIRQFREGMGEVSLGLTDSVSAIQPLIVGDNARALNLACRLRDAGCWATAIRPPTVPVGSARLRLTLTAAHHAEDINRLLEVLHGHSE

SEQ ID NO: 12971 - protein, 163 aa, Klebsiella pneumoniae
SMLQLTHINAAGEAHMVDVSGKAETVREARAEAYVELQATTLAMIIDGSHHKGDVFATARIAGIQAAKRTWELIPLCHPLMLSKVEVNLQAQPEHNRVRIESLCRLTGKTGVEMEALTAASVAALTIYDMCKAVQKDMVIGPVRLLAKSGGKSGDFKVGECHD

SEQ ID NO: 12972 - protein, 269 aa, Klebsiella pneumoniae
RLLHYFIQESDIYWRIMAEPTAGFSLNVLTINTHKGFTAFNRRFILPELRDAVRSVSADIVCLQEVMGAHEVHPLHIENWPDTTHYEFLADTMWSDYAYGRNAVYPEGHHGNAVLSRFPIEYYENRDISVGNGEKRGLLYCRIVPPRSGITIHVICVHLGLRADQRQAQLTMLAEWVNTLPAGEPVVVAGDFNDWRQQANQPLKAQAGLEEIFTRARGRPARTFPVSFPLLRLDRIYVKNAHASRPKALALKQWRHLSDHAPLSVEIHL

SEQ ID NO: 12973 - protein, 334 aa, Klebsiella pneumoniae
TSSHRFVTRNTNHTQHSDKPTANNSYSLRGMWMSNIRLRNVTKRFGSTVTLHQVNLDIEDGEFAVFVGPSGCGKSTLLRMIAGLEEVSEGEVLIGDEVMNDVVPARRGVAMVFQSYALYPHMTVAENMGYGLKVNKVPKTEIRRQVEMVAKTLQLSHLLDRKPKQLSGGQRQRVAIGRAIVRNPRVFMFDEPLSNLDAELRVDMRLHIARLHQELKTTMVYVTHDQVEAMTLADKIVVMNYGKVEQMGSPMALYYNPVNKFVAGFIGSPKDELSAGYRQRLAAGTLNGHPRAGPSAGPEYRHPAAEARRCGDARDPAGAPHPGSRHRYRGGVSM

SEQ ID NO: 12974 - protein, 186 aa, Klebsiella pneumoniae
ITPQPLANYLSGLVGLFYSDANGRIHQRVSLSLARHAAIAMRNNKMNKTWLFTTLTLALVAAAPAHAISAKYREQLERSGCTQMTDGITCDIHKTKAENAAAAQQADSGFGPWVGTWYVYTEYGDKIDEITVTAKTVKTRGHLVEAAKASQGKLTFRVKSSAFTLNDAFNGVWANGSQRGTLQKVL

SEQ ID NO: 12975 - protein, 62 aa, Klebsiella pneumoniae
TATHSRAPPRRRPRWHARTRAEPAARRGASTAGLSPAPSRSPASRRAPASALPLPHSRGRRR

SEQ ID NO: 12976 - protein, 264 aa, Klebsiella pneumoniae
RRAQLPPCGDRPKPAGRRQRDARRSGGCRVQRRRAPYRRAPEREDGFRFCRYATAARLQDAVLMQTSPLLTQLMEALRCLPGVGPKSAQRMAFTLLQRDRSGGMRLAQALTRAMSEIGHCADCRTFTEQEVCNICSNPRRQENGQICVVESPADIYAIEQTGQYSGRYFVLMGHLSPLDGIGPDDIGLDRLEQRLEAESITEVILATNPTVEGEATANYIAELCAQYGVDASRIAHGVPVGGELEMVDGTTLSHSLAGRHKITF

SEQ ID NO: 12977 - protein, 265 aa, Klebsiella pneumoniae
SWQQAAGPGQVKRFAPAERPPQWRQILPPTTRQVLAAGSHLQRSQGATTPKKSEPAAASRARPVNNAALERLSSITERVQARPAAAALEQAPAKKEAYRWKATTVVEESKVEVATPKALKKALEHEKTPELAAKLAEEAVERDSWAAEVSQLAVPKLVEQVALNAWKEQEGSRVCLHLRPSQRHLNSASAQQKLAEALGVLYGTPVELTIVEDDNPAMRTPLEWRQAIYEEKLAQAREAIIADNNIQTLRRFFDADLDEESIRPI

SEQ ID NO: 12978 - protein, 115 aa, Klebsiella pneumoniae; identical to SEQ ID NO: 9318

SEQ ID NO: 12979 - protein, 296 aa, Klebsiella pneumoniae
HIKHHDRVKPPTGHTDGCRVKPVKRDCMMSVMFDPETAIYPFPAKPQPLTVDEKQFYREKIKRLLRERDAVMVAHYYTDPEIQQLAEETGGCIADSLEMARFGARHSASTLLVAGVRFMGETAKILSPEKTILMPTLNAECSLDLGCPIEEFNAFCDAHPDRTVVVYANTSAAVKARADWVVTSSIAVELIDHLDSLGQKILWAPDRHLGRYVQRQTDADVLCWQGACIVHDEFKTHALMRMKALHPEAAVLVHPESPQAIVEMADAVGSTSQLIAAAKSLPQPPADRGHRSRYFL

SEQ ID NO: 12980 - protein, 487 aa, Klebsiella pneumoniae
YQKQFFPTPLREHISLSLPAMAAVSSLRGERGIFPFFYNTTSTGSNEFMTHQLKSRDIIALGFMTFALFVGAGNIIFPPMVGLQAGEHVWTAAIGFLITAVGLPVLTVVALAKVGGGVESLSTPIGKVAGILLAVVCYLAVGPLFATPRTATVSFEVGIAPLTGDGPLPLLIYSVIYFALVILVSLYPGKLLDTVGNFLAPLKIIALIVLAVAAIIWPAGPISDALEAYRTAPFSNGFVNGYLTMDTLGAMVFGIVIVNAARSRGVSEARLLTRYTVWAGLMAGVGLTLLYLALFRLGSDSATLVDQSANGAAILHAYVQHTFGGAGSFLLAALIFIACLVTAVGLTCACAEFFAQYLPFSYRTLVFVLGLFSMAVSNLGLSHLIQVSIPVLTAIYPPCIALVVLSFTRSWWHNSSRVIAPAMFISLMFGIIDGIKSSAFAAILPDWTARLPLAEQGLAWLMPTAVMTILAVIWDRAAGRQVTSSAH

SEQ ID NO: 12981 - protein, 685 aa, Klebsiella pneumoniae
LQKQWGYWMTDLSQSREKDKINPVVFYTSAGLILLFSLMTIFFRDFSAEWIGRTLDWVSKTFGWYYLLAATLYIVFVVCIACSRFGSVKLGPEQSKPEFSLLSWAAMLFAAGIGIDLMFFSVAEPVTQYMQPPEGAGQTIEAARQAMVWTLFHYGLTGWSMYALMGMALGYFSYRYNLPLTIRSALYPIFGKRINGPIGHSVDIAAVIGTIFGIATTLGIGVVQLNYGLSVLFDIPDSLAAKAALIALSVIIATISVTSGVDKGIRVLSELNVALALGLILFVLFMGDTSFLLNALVLNVGDYVNRFMGMTLNSFAFDRPVEWMNNWTLFFWAWWVAWSPFVGLFLARISRGRTIRQFVMGTLIIPFTFTLLWLSVFGNSALYEIIHGDAAFAQEAMAHPERGFYSLLAQYPAFTFSASVATITGLLFYVTSADSGALVLGNFTSKLKDINSDAPNWLRIFWSVAIGLLTLGMLMTNGISALQNTTVIMGLPFSFVIFFVMAGLYKSLKVEDYRRVSASRDTAPRPMGLQDRLSWKKRLSRLMNYPGTRYTKLMMETVCYPAMEEVAQELRLRGAAVELKSLPPEEGENLGHLDLLVHMGDEQNFIYKIWPQQYSVPGFTYRARSGKSTYYRLETFLLEGSQGNDLMDYSKEQVITDILDQYERHLNFIHLHREAPGNSVMFPDG

SEQ ID NO: 12982 - protein, 590 aa, Klebsiella pneumoniae
SERHLHLLLSGQDGGGATMFSLDNVLDDLWPQARPAPWQKKLLKKLFYEEEFQQFADRHRHLKGLDTVEQVLEYLNIRCAIPAHDLEQIPEYGPLVIIANHPTGTLDGLALLYAVSRVRRDVKVVTNRMLTHLEPLSSLFIPVDNIHGRTAKAALQQMDQQLQAGGVLIFFPAGEVSRLTRHGIRDKKWHSGFIKLAAKYRAPLLPAWINARNSALFYASTLVSDDLPLLLLMQQMFRRRNSSLPVRIGQQIPWSNWFDAQSSARELTGRCYQHLEQLRKGLPGRFKTESAIARPEDRALLKRELHKAECLGRTADGKVIYLWQRNGQEDAPLLRELGRLREIAFRAVGEGSGKRRDIDGYDDDYLHLILWDEEDLEIVGAYRFMPTAIQLAKRGLEGIYSYSLFHYDGRMDDVLQHGIELGRSFIQPRYWGRRGLDYLWSGIGAYLARYPHYRYLFGPVSISGGLPPAARDLLVAFYRMWFPATHPLAESRRPYPASLPDVLAQFGGEDYNDDLARLKSLLGNLGCAIPPLYKQYSEVCEPGGVQFIDFGSDPDFNNCVDGLVLVDLTYLKANRYQRYIGAHLGAQKSA

SEQ ID NO: 12983 - protein, 766 aa, Klebsiella pneumoniae
RPGQRRTYRPERAIKITGPATGPLIHLSSSMGQIMHTTHYSSFPLRKTLLALAIGAASQTAMAADAAAAKQPGEETLIVEANETSDFKSGGDLVVPAFLDGQIAHGGRLGMLGEQKAMDVPFNVIGYTSKLIQDQQAKTIADVVSNDAGVQAVQGYGNFAETYRIRGFKLDGDDMTMGGLAGVVPRQVMDTQMLERVEIFKGANSLLNGAASSGVGGMINLEPKRAEDLPTARVGVDYTSDSQVGGTLDLGRRFGDNNQFGARVNLVHREGEGAIDNDKRRTTLASLGLDYRGDRFRSSLDFGYQKKTFHGGTMGVNISGVDFVPALPDNSKNYSQKWGYSDIESEFGMAKAEYDLTDSWTVYSALGGQHSHEIGTYSAPKLLNKNGDATVGRLDTNRIIDAISGMGGVRGDFNTGAISHKVNLGYAAQVHTDATAWRMSARNPTTNIYDNHDVAMPDNAYFGGNYHDPLVTSRSRTQGWLLSDTLGFFNDKVLFTAAARHQKVVVRNYSNATGLEDTSSRYTQSRWMPTFGLVYKPWEQLSLYANHTEALQPGSVAPTTAANAGQSTGIAHSKQDEVGVKIDYGTIGGSLALFEIKKPNAISDTAGNYGLDGEQRNRGVEMNVFGEPMLGLRLNASTVWLDAKQTKTAEGATDGKDAIGVANFYAVLGAEYDIKPVEGLTATARVNHSGSQYADAANTKKLDSYTTLDLGLRYRMRLNADQNEMIWRVGVTNVTNEKYWSGIDDTGTYLFEGDPRTVRVSMSYEF

SEQ ID NO: 12984 - protein, 454 aa, Klebsiella pneumoniae
PNGQTMTDKLTLAVNHALNDARMARARMGLLNPTMGLDNKRGSAWCEYGFPEQITYDNLYSLYRRGGIAHGAVEKLVGKCWQTNPEIIEGDDADESKDETPWEKSAKKVFTKRLWRAFAEADRRRLVGRYAGILLHINDSRKWDQPVVRGKSLKKVTIAWAGSLTVSQWVTDENSADYGQPKQWKYVESLPNGGTNQRFVHPDRVFILGDYSNDAIGFLEPPYNAFVSLEKVEGGSGESFLKNAARQQNINFDKEINFSELASMYGVTVDELQERYNDAARELNRGNDTLLITQGASITSLVSPVSDPSPTYNVNLQTAAAGVDIPTRILVGNQQAERSSTEDQKYMNARCQSRRGDLSFEIEDFSDKLIDLKIIDAVSEKTVIWDDLNEQTGTEKLTNAKTMGEINQTMMGSGEEPAFSREEIRTAAGYENDGEIPLGEEDGSEEDEATDSTA

SEQ ID NO: 12985 - protein, 141 aa, Klebsiella pneumoniae
CSLHLVRRLLQSRRSRKSRMRGCSMTDITELAQRLKLEVHRAVSNFNPQMNIKTRDLKELVEALEKAQAQSSKWLEAYHKAVSIGARYEERIAELESRTVKLPDLRQIVSGDRYVWSDGVYNYSQDVKVALAAAGIKVEDE

SEQ ID NO: 12986 - protein, 62 aa, Klebsiella pneumoniae
NLLQRIELVVDRFSLKHDMLPKMYNGLPSTRLTIFLGFFSTVITPYTFDLGNPSCLIIGDVV

SEQ ID NO: 12987 - protein, 254 aa, Klebsiella pneumoniae
ANMQNTIHPRDLIVGLQKGLALIQLFSKTCPKLTVAQTAKMSGLTQSAARRFLLTLLHERYLQTDGRYYWLTPKTLRLGQAYVDSAQFPRMVRPIVEYIASRTEEHASVGVVDEDELVYIARSRHTPFNSTSVRLGERVPIFCTAGGRLWLASLPEAECETVLQRITREQRTPYTVTDIASLMEKIAQVRRQGYATIEQEFEIGMLVLAVPLTDREGTWWGALSLTSHQSRTSLEALCRDHLDLLYSAQAMLVG

SEQ ID NO: 12988 - protein, 123 aa, Klebsiella pneumoniae
APVQYQRREHMTISAQVIDTIVEWIDDNLHQPLRIDDIARHAGYSKWHLQRLFLQYKGESLGRYIRERKLLLAARDLRDTDQRVYDICLKYGFDSQQTFTRVFTRTFNQPPGAYRKENHSRAH

SEQ ID NO: 12989 - protein, 334 aa, Klebsiella pneumoniae
AGVQSALASRCSRRIAMMLWQATPASLWQGRDDSAEAPNALRLFQTIARAERFAPQEMPGDIALLGFACDEGVRRNKGRTGAADGPATLRRALANMASHQGHDRCVDMGTISVDGEQLEAAHQALREAVADCQRAGKRTLVLGGGHETAFGHGAGVLDAFPGEKVGIINLDAHLDLRFADCASSGTPFRQLALECDAQQRGFHYTCIGVSRAANTQALWDEAALRQVAIVEDLEVLTAFETRVLPELERNIAQFDRLYLTIDLDVLPAREMPAVSAPAALGVPLGTLLRIVEPLCRSGKLQAVDLVEFNPLFDIDGQGARAAARVAWQIAHWWR

SEQ ID NO: 12990 - protein, 316 aa, Klebsiella pneumoniae
GVPHWRYHSGTAPRWRYAYRGYVTPPKGSPDKARRTTIREARLPTFDTILKRIIIMIGKDFAQHLFSLRDRVAFVTGAGSGIGQTIACSLASAGARVVCFDLRDDGGLAETVSHIESIGGQACSYNGDVRQIADLRAAVALAKSRYGRLDIAVNAAGIANANPALEMESEQWQRVIDINLTGVWNSCKAEAELMLESGGGSIINIASMSGIIVNRGLDQAHYNCSKAGVIHLSKSLAMEWVGKGIRVNSISPGYTATPMNTRPEMVHQTREFESQTPMQRMAKVEEIAGPALFLASDAASFCTGVDLVVDGGFVCW

SEQ ID NO: 12991 - protein, 104 aa, Klebsiella pneumoniae
NKPQVVAAMKVTAESILSILRKDARNNITVFHRWQTAAGALGYNAGITLNFHEPYYAGWAPALEMKEVFISAPELEMVKPFLTVERWGNGTLGGEIYRLPREAQ

SEQ ID NO: 12992 - protein, 147 aa, Klebsiella pneumoniae
TFQQGEGQGEKMNISDVAKKTGLTSKAIRFYEEKGLVTPPLRSENGYRTYSQQHLDELTLLRQARQVGFNLEECRELVALFNDPSRHSADVKKRTLEKVADIENHIRELQNMRAHLLALAESCPGDDSAECPIIDNLSGCCHRKAQA

SEQ ID NO: 12993 - protein, 407 aa, Klebsiella pneumoniae
YQQHRSLTEDKPMLNIAALRQQQIPLAAEPRSPVPFHILMKPIGPACNLACRYCYYPQDETPVNKMDDARLEQFIRRYIAAQPAGAREINFVWQGGEPLLAGLSFYKKALALQARYAPDGVTISNSLQTNGTLINDAWCRLFREHGFIIGLSLEGNEALQDYHRPDKRGRSTWSAALRGIDLLHQHQVDFNLLVVVHNEMAAHAAAIYDRLVSLGARYLQFQPLMSEGAALREGYQLSADNWGRFMVGIWRQWRKRCDRGRVFVINIEQAWAQYFTHTSGSCVHSARCGSNLVMEPDGQLYACDHLINAEHRLGRLDEQTLAAAVDASVQLPFGQQKSLRRECQTCSVKMVCQGGCPAHLNAAGNNRLCGGYYRFFSDILAPLRPFSRDLNGLKAWRAAFVGTAHTA

SEQ ID NO: 12994 - protein, 277 aa, Klebsiella pneumoniae
RKKQRGMVMDKKIGFIGCGNMGKAILGGLIASGQVQPGQIWVYTPSPDKVAALRDQYGINAASSAQEVAQIADIVFGAVKPGIMTKVLGDIASSLNKESLVVSIAAGVTLEQLARALGHDRKIIRAMPNTPSLVNAGMTSVTPNALVSSEDVAEVLTIFRCFGQAEQIAEPMIHPVVGVSGSAPAYVFMFIEAMADAAVLGGMPRAQAYKFAAQAVMGSAKMVLESGEHPGALKDMVCSPGGTTIEAVRVLEEKGFRSAVIEAITQCMEKSEKLSRS

SEQ ID NO: 12995 - protein, 389 aa, Klebsiella pneumoniae
ILWQPGSGFTWYVMPFDVIWMEVEMAKMRVGIVFGGKSAEHEVSLQSAKNIVEAIDKSRFDVVLLGIDKQGLWHINDAGNYLLNAQDPARIALRPSTVTLAQIPGREAQQLINAESGQPLAAIDVIFPIVHGTLGEDGSLQGMLRMANLPFVGSDVLGSAACMDKDVTKRLLRDAGLAVAPFITLTRANRAQFSFADVEAKLGLPLFVKPANQGSSVGVSKVKNEEQYHQAVALAFEFDHKVVVEQGIKGREIECAVLGNDHPQASTCGEIVLNSEFYAYDTKYIDDQGAQVVVPAAIAPEINDKIRAIAVQAYQTLGCSGMARVDVFLTADNEVVINEINTLPGFTNISMYPKLWQASGLDYTSLITRLIELALERHAADRALKTSMN

SEQ ID NO: 12996 - protein, 107 aa, Klebsiella pneumoniae
  UNSURE (31): Identity of amino acid at the above locations are unknown.
LLRQKADGFRCGLSLIIQLQHSGDNFSLTYXSDHGLAFKERVKELQYLAHDDKFQQNFQVPFMVLSSDDKAHIVIKAQRSANDFLSVFLPVDRDPGGGNHPTLSVYL

SEQ ID NO: 12997 - protein, 387 aa, Klebsiella pneumoniae
LWRHPPPGRLSPREDRVKRKTGFFFDERCFWHSTGLHAVTLPVGGWVQPPAGGGHAESPETKRRMKNLMDVSGLTPQLALRSAAPASLEDLRRIHPDSYLERFKAISDNGGGMLGKEAPLGPGSYEIACLSAGLACAAVEAVLKGELDNAYSLSRPPGHHCLPDQSMGFCFLANIPIAVERAKAQLGLGKVAIIDWDVHHGNGTQHIYLQRDDVLTISLHQDGCFPPGYAGEDDRGVGAGEGYNINIPLLAGAGDDSWRYALETIVIPALARFEPELIIIACGYDANAMDPLARMQLHSDSFRAMTEQVQQAADRLCGGKLVMVHEGGYAESYVPFCGLAVMEALSGIRTEVQDPLLEFIQQQQPRATFAQFQRQAIDRLAQQFGLQ

SEQ ID NO: 12998 - protein, 342 aa, Klebsiella pneumoniae
AIRQPLRCRAFHNQISGETMSEIMDLTVIEIKPEQAPALYRAGGLDAYLEQIRQAVNEVPDLTTKKGRDRVASLAAQVSRSKTAIEKPGREYLKRLKEAVRPAEAEIKRFVDACDELRDATRKPLTEWEAEQERIKAEEAINALHVEALAMNEEFDRQLAARIESDHEMALLMNDAFDREQADKAAEAERQRIAHEEEIKRMAAAAAAREVEQRAQREREEAAHREAVLKAQAEQAERDRIAAEKKAEADKQAAIEAERRKAQEEADRIRREAEQREQARLAEEKRKADEQARREADVKHRKAVGTEIVKALLANTSLTRDQAIEVLTAVKDGRIPHTGISY

SEQ ID NO: 12999 - protein, 70 aa, Klebsiella pneumoniae
TGRQLQRLFLLAIVALAGCSAPIAAASSGAASDTASLLSKVNVYHLTEKGLAAQATINGYKYWPDAALDP

SEQ ID NO: 13000 - protein, 274 aa, Klebsiella pneumoniae
TLFLTLSDAEHPVMSRKQLALLEPTLVRQALLDAVKKLSPMVQWRNPVMFIVWVGSLLTTLLAIAMAGGALTGSATFTAAVSIWLWFTVLFANFAEAMAEGRSKAQANSLKGVKKTAFARKLRAPQHDAPVDHVPAEDLRKGDVVLVEAGDIIPCDGEVIEGGASVDESAITGESAPVIRESGGDFASVTGGTRILSDWLVIRCSVNPGETFLDRMIAMVEGAQRRKTPNEIALTILLIALTLVFLLATATSGPSRRGAAMRSALPYWSPCWCA

SEQ ID NO: 13001 - protein, 740 aa, Klebsiella pneumoniae
PVFLRLLPSPVITRREGLSTSGDLTMNVIAIMNHMGVYFKEEPIRELHRALERLDFRIVYPNDRDDLLKLIENNSRLCGVIFDWDKYNLELCEEISKMNEYMPLYAFANTYSTLDVSLNDLRMQVRFFEYALGAAEDIANKIKQNTDEYIDTILPPLTKALFKYVREGKYTFCTPGHMGGTAFQKSPVGSIFYDFFGSNTMKSDISISVSELGSLLDHSGPHKEAEEYIARVFNAERSYMVTNGTSTANKIVGMYSAPAGSTVLIDRNCHKSLTHLMMMSDITPIYFRPTRNAYGILGGIPQSEFQHATIAKRVKETPNATWPVHAVITNSTYDGLLYNTDFIKKTLDVKSIHFDSAWVPYTNFSPIYEGKCGMSGGRVEGKVIYETQSTHKLLAAFSQASMIHVKGDVNEETFNEAYMMHTTTSPHYGIVASTETAAAMMKGNAGKRLIDGSIERSIKFRKEIKRLKGESDGWFFDVWQPEHIDGPECWPLRSDSAWHGFKNIDNEHMYLDPIKVTLLTPGMKKDGTMDDFGIPASIVAKYLDEHGIVVEKTGPYNLLFLFSIGIDKTKALSLLRALTDFKRAFDLNLRVKNMLPSLYREDPEFYENMRIQDLAQNIHKLIEHHNLPDLMFRAFEVLPSMVMTPYAAFQKELHGQTEEVYLEEMVGRVNANMILPYPPGVPLVMPGEMITEESRPVLEFLQMLCEIGAHYPGFETDIHGAYRQADGRYTVKVLKEENNK

SEQ ID NO: 13002 - protein, 605 aa, Klebsiella pneumoniae
SLFKGIKKMFKFKASYVALAAVLTSSVVYADPTSYTHSSGATVIDIEKPNAAGVSHNLYRDFNVGTNGTILNNSGDDVSHSTFGNIARNNNLTAGSASVILNEVTSKNASSLKGFIEVNGQKADVVIANPNGITCSGCSFVNTNKAILTTGKVNMTDDGAIGSYTVTGGTLTIGENGMNAANGYAVLLADAIKINGKVQANNALVSAGNFTMDNSSGSVTSAGKKATLIQMTVNPQYSIDVSSLGGIEANSISMVGNNIGFGVRNKGSIVANSSLQLTSNGNLLNKGTIKSNGLLSQVATASGITNDGSIAGAYYLMLSSGDYIVNTGSLSGGQLIATANGNITNGDSGTMTGTSGLSLTSGGKIRNEEKASLLSNNQIAATAIGDFLNEGKISAKNTSLTFVGDSFKNTGNINSTGQTTIQSLKQDGSANTGEIYNLGNITGENINLQTNGTLAQSSSGRIEATNAITAHSYWLNQNGYMKAADITTDHGVVNNYGNITAKNISITTYSDITNEGQISSTGDLTLNTKNKGAIYNYSTLSAGGNMTLTATKVVNGGKSCGILGLAKCGVGTLTADKLVLNSSQKYVSDMGGKQYFKSTEVNTVK

SEQ ID NO: 13003 - protein, 135 aa, Klebsiella pneumoniae
SSFKPLKRGCVMDEYSPKRHDIAQLRFLCETLYHDCLANLEESNHGWVNDPTSAVNLQLNELIEHIATFALNYKIKYAEDNKLIAQVDEYLDDTFTLFSNYGINSTDLQKWKKSGNRLFRCFVNASRENPASLSC

SEQ ID NO: 13004 - protein, 565 aa, Klebsiella pneumoniae
GCLKIGLALYPHLFLWVCIMSLLPLRRPVVSRTTYLILFACYIGICLNLAFYRQVFPLLPVNSLHNWLVFLSMPIVAISVMNILTTLASFLKLDRLVISLFILLSASAQYFIWNFGVVIDRSMITNILDTTPAESFALLSGEMIAVLGLSGVLAVFIAWWVKIRKPATRWRGAAMRLLNIAVSALLIILVAALFYKDYASVFRNNKELVKSLSPSNSIVAVNSWYAHHRMDNLPLVKIGEDATQKAVMHNAPRKNLTIVVLGETSRADNFSLGGYLRDTNPLMRQDGVIYFPHTTSCGTATAVSVPCMFSNMPRAHYDEELAHHQEGVLDILQRAGIQVLWNDNDGGCKGACDRVPHQNVTNLKLTGQCIDGECYDDVLFHNLDSYIDNLQQDGIIVLHTIGSHGPTYYNRYPAAFRKFTPTCDTNEIQGCTREQLTNTYDNTILYVDYVVDKAIKLLQSKQDKFTTSLVYLSDHGESLGEDGVYLHGLPYSIAPDTQKHVPMALWLSADYQQRYGISAHCLQQRAQKENYSQDNLFSTLLGLLGVSTREYQAADDILTPCREAG

SEQ ID NO: 13005 - protein, 182 aa, Klebsiella pneumoniae
LIIKGIKEMQLNKVLKGLMIALPVMAIAACSSNKNASNDQSGEGMLGAGTGMDANGNGGNMSSEEQARLQMQQLQQNNIVYFDLDKYDIRSDFAAMLDAHANFLRSNPSYKVTVEGHADERGTPEYNIALGERRANAVKMYLQGKGVSADQISIVSYGKEKPAVLGHDEAAYAKNRRAVLVY

SEQ ID NO: 13006 - protein, 295 aa, Klebsiella pneumoniae
  UNSURE (284): Identity of amino acid at the above locations are unknown.
RPINSGQLMTNLDTLMNSSLAAVAETDFQPFTDLAAGRQRKVLSVRNLSKAYQAQHKVLDGISFDLHAGEMVGVIGRSGAGKSTLLHVLNGTHSASGGEILSYPEVGTPHDVSQLKGRALNAWRSHCGMIFQDFCLVPRLDVLTNVLLGRLSQTSTLKSLFKIFPAADRARAIALLEWMNMLPHALQRAENLSGGQMQRVAICRALMQNPGILLADEPVASLDPKNTQRIMDVLREISEQGISVMVNLHSVELVRAYCTRVIGVASGQLIFDDHPSRLTQDVLXRLYGDEVSQLH

SEQ ID NO: 13007 - protein, 121 aa, Klebsiella pneumoniae
TLINFNNEGISMSFFISDAVAATGAPAQGSPMSLILMLVVFGLIFYFMILRPQQKRTKEHKNLMNSIAKGDEVLTNGGLVGRVTKVAETGYIAIALNDTTEVVIKRDFVAAVLPKGTMKAL

SEQ ID NO: 13008 - protein, 242 aa, Klebsiella pneumoniae
YFVNQERVMDRYPRSDSIVQGRTGLQTYMAQVYGWMTVGLLLTAFIAWFAANTPAVMMFVFSSKITFFGLIIAQLALVFVLSGMVQRLSAGMATTLFMLYSALTGLTLSSIFIAYTYSSIASTFVVTGGMFGAMSLYGYTTKRDLSGFGSMLFMGLIGIVLASLVNLWLKSEALMWAVTYIGVVLFVGLTAYDTQKLKNIGEQIDTRDSATLRKYSILGALTLYLDFINLFLMLLRIMGNRR

SEQ ID NO: 13009 - protein, 352 aa, Klebsiella pneumoniae
SSVKELKMLEQMGIAAKAASWQLALLSSREKNQVLEKIADYLEAQTDDILRANAEDLAEARANGLSEAMLDRLALTPARLSGIASDVRQVCNLADPVGQVIDGGLLDSGLRIERRRVPLGVIGVIYEARPNVTVDVASLCLKTGNAAILRGGKETWRTNAATVKVIQQALQECGLPAAAVQAIESPDRALVGEMLKMDKYIDMLIPRGGAGLHKLCREQSTIPVITGGIGVCHIFVDETAEIAPALKIIVNAKTQRPSTCNTVETLLVHRNIADTFLPALSKQMAESGVTLHAAPSALPALQNGPAKVEPVKAEQYDDEYLSLDLNVKVVADMDEGYRPISANMAPSNPTPS

SEQ ID NO: 13010 - protein, 170 aa, Klebsiella pneumoniae
EDVNPTGGEMMNKVAQYYRELVSSLSERLRHGERDIDALVTQAREKIVRAGDLTQSEIESVIAAVKRDLEEFARSYEESHEDESDSVFMRVIKESLWQELADITDKTQLEWREVFQDLNHHGVYHSGEVVGLGNLVCEKCHYHLAVYTPDVLPRCRKCGHDQFQRRPFEP

SEQ ID NO: 13011 - protein, 631 aa, Klebsiella pneumoniae
PSVNLCLCHFYTFFTPHPRIFAKSLRRNFYPPGKSKTHPEVDCDCRRTHWRWAGVPVTGLSGLCLDTCGGILMAAQGFLLLASYLLVLLVLARPMGMCLARMVNDIPLPGLAGVERVLWRVAGIRAEEMGWLQYLLALLLFNALGGLALFALLMLQGVLPFNPQHLPGLSWDLALNTAISFVSNTNWQAYAGESTMSYLSQMVGLTVQNFLSAATGIAVVFALTRAFARQKMSTLGNAWVDLTRITLWLLLPLSLLVALFFIQQGVPQNLQAYQPLTTLEGVHQLLPMGPVASQEAIKLLGTNGGGFFNANSAHPFENPTALTNLVQMLAIFLIPAALCFAFGEVVSDRRQGRAILWAMTLIFILCVAVVMWAETRGNPHLLTLGADSSLNMEGKESRFGILASSLFAVITTAASCGAVNAMHDSFTALGGMVPMWLMQIGEVVFGGVGSGLYGMLLFVMLAVFIAGLMVGRTPEYLGKKIDVREMKMIALAILVTPTLVLLGTALAMMTDAGRAGMFNPGPHGFSEVLYAVTSAANNNGSAFAGLGAATPFWNLLLAFCMLVGRFAVIIPVMAIAGSLVAKKIQPASPGTLATHDALFIGLLIGTVLLVGALTFIPALALGPLAEHFSLL

SEQ ID NO: 13012 - protein, 400 aa, Klebsiella pneumoniae
FAVNIQLENIRWLINQGKTMAHTIKALAISIGAALALTSLPSHAEITLLKQDPQAGDPLSRLNFTVGGSIRPQFNMMTGDGDKGSYKRNGFDGGTRFRFAADYYLFDDISWISYYELGVNIPALFDWDNHYAEGANNTTRRMLYTGLKSDTWGTLTYGQQNSIYYDVVGVKTDIWDYDMIGQAPGNGINGDYDGSYRSRNMLKYKKTVGDVDLYGSYLFEDSEYLPGNGLRYKRKGGGSVGADYHIMKDLTWGTAWNYTRAEMRDPSSADSKTYDQNIVGTALSWTPDNWTFSFGSGWYQNFLTTKKTDVHNYFAGDAWGIEYFAGYKFPINQYAVKSIQPYFMGDRLEYVNGRNYQRIDNGLGISFQLDYGFRVDYEHVFTSSTDNLGDMNLVRLRYDF

SEQ ID NO: 13013 - protein, 311 aa, Klebsiella pneumoniae
REVNVVDSTLDKSAPGPWSGWLHGLLGVIIFSGSLPATRLAVQDMDPLLLTFLRASIAGLLAIALLVGFRQKRPRLAQLVSLIIVSSGVVLGFPLLTALALQRITSAHSIVFIGLLPLMTALFGVLRGGERPRRAFWIFSLLGSLLVVGFALTQSAAASLSGDLLMLAAVIACGLGYAEGAKLTRELGGWQVICWALVIALPLMLPASLLVQPASWHAISASSWAALGYVSLFSMLIGFIFWYKGLAAGGIAAVGQLQLLQPFFGLGLSAALLHETVSPLMLAVTLGVVLCVVGSRKFGRQRVGEENGGNN

SEQ ID NO: 13014 - protein, 1049 aa, Klebsiella pneumoniae
DMPNFFIDRPIFAWVIAIIIMLAGGLSILKLPVAQYPTIAPPAISITAMYPGADAETVQNTVTQVIEQNMNGIDHLMYMSSNGDSTGTATITLTFESGTDPDIAQVQVQNKLALATPLLPQEVQQQGISVEKASSSFLMVVGVINTNGTMNQDDISDYVAANMKDPISRTSGVGDVQLFGSQYAMRIWMDPNKLNNFQLTPVDVISALKAQNAQVAAGQLGGTPPVKGQQLNASIIAQTRLTNTEEFGNILLKVNQDGSQVRLRDVAKIELGGESYDVVAKFNGQPASGLGIKLATGANALDTANAIRAELAKMEPFFPSGMKIVYPYDTTPFVKISIHEVVKTLVEAIILVFLVMYLFLQNFRATLIPTIAVPVVLLGTFAVLAAFGFSINTLTMFGMVLAIGLLVDDAIVVVENVERVMAEEGLPPKEATRKSMGQIQGALVGIAMVLSAVFIPMAFFGGSTGAIYRQFSITIVSAMALSVLVALILTPALCATMLKPIQKGSHGATTGFFGWFNRMFDKSTHHYTDSVGNILRSTGRYLVLYLIIVVGMAWLFVRLPSSFLPDEDQGVFLSMAQLPAGATQERTQKVLDEMTNYYLTKEKDNVESVFAVNGFGFAGRGQNTGIAFVSLKDWSQRPGEENKVEAITARAMGYFSQIKDAMVFAFNLPAIVELGTATGFDFELIDQGGLGHEKLTQARNQLFGMVAQHPDVLTGVRPNGLEDTPQFKIDIDQEKAQALGVSISDINTTLGAAWGGSYVNDFIDRGRVKKVYIMSEAKYRMLPEDIGKWYVRGSDGQMVPFSAFSTSRWEYGSPRLERYNGLPSLEILGQAAPGKSTGEAMALMEELAGKLPSGIGYDWTGMSYQERLSGNQAPALYAISLIVVFLCLAALYESWSIPFSVMLVVPLGVVGALLAATFRGLTNDVYFQVGLLTTIGLSAKNAILIVEFAKDLMEKEGKGLIEATLEAVRMRLRPILMTSLAFILGVMPLVISSGAGSGAQNAVGTGVMGGMVTATILAIFFVPVFFVVVRRRFSKKSEDIEHSHQVEHH

SEQ ID NO: 13015 - protein, 75 aa, Klebsiella pneumoniae
INTNHQLICAFVIFILFLHRTRGFLRNLCAVISILQVNRKHTRRWIVTAGVLTGVGLVFLLLAYLVYALIHAEAF

SEQ ID NO: 13016 - protein, 446 aa, Klebsiella pneumoniae
HSAKLSWAFRPDKGDMMKQALRVAFGFLMLWAAVLHAEVRIEITQGVDSARPIGVVPFQWAGQGAAPEDVGGIVAADLRNSGTFNPVDRSRLPQQPTSAQEVQPAACSALGIDAVVVGQVTQNPDGSYQVAYQLVDTGGAPGTTLAQGSFKVTKQYLRYAAHAASDAVFEKLTGIKGAFRTRIAYVVQKNGGQYPYELRVSDYDGYNQFLVHRSSQPLMSPAWSPDGSKLAYVTFESGRSALVVQTLANASVRQIASFPQHNGAPAFSPDGSKLAFALSKTGSLNLYVMDLGSGQIRQVTNGRSNNTEPSWFPDSQNLAFTSDQAGRPQVYKVNINGGTPQRITWEGSQNQDADVSADGKTMVMVSSAGGQQHIAKQDLETGGVQVLSSTFLDETPSLAPNGTMVIYSSSQGMGSVLNLVSTDGRFKARLPATDGQVKSPAWSPYL

SEQ ID NO: 13017 - protein, 329 aa, Klebsiella pneumoniae
HDHNRKTVVGLWLFEPLNILKLDTRGLHMNKNRGLTPLAVVLMLSGSLALTGCDDKPAQQGAQHMPEVGIVTLKSAPLQITTELPGRTSAYRIAEVRPQVSGIILKRNFVEGSDIQAGVSLYQIDPATYQASYDSAKGDLAKAQAAANMDQLTVKRYQKLLGTKYISQQDYDTAVATAQQSNAAVVAAKAAVETARINLAYTKVTSPISGRIGKSAVTEGALVQNGQTTALATVQQLDPIYVDVTQSSNDFLRLKQELADGRLKQENGKAKVELVTNDGLKYPQSGTLEFSDVTVDQTTGSITPTRYFPEPGSHPASGDVRPCPSGRRD

SEQ ID NO: 13018 - protein, 483 aa, Klebsiella pneumoniae
ITHKYKVRGACHGWRRPRHIIMHLEGTMDFEQISRSLLPLLGGKENIASAAHCATRLRLVLVDDALADQQAIGKIDGVKGCFRNAGQMQIIFGTGVVNKVYAAFIQAAGISESSKSEAADLAGKKLNPFQRIARLLSNIFVPIIPAIVASGLLMGLLGMVKTYGWVDPSNALYIMLDMCSSAAFIILPILIGFTAAREFGGNPYLGATLGGILTHPALTNAWGVAAGFHTMNFFGIEVAMIGYQGTVFPVLLAVWFMSMVEKRLRRVIPDALDLILTPFLTVIISGFIALLLIGPAGRALGDGISFILSTLISHAGWLAGLLFGGLYSVIVITGIHHSFHAIEAGLLGNPSIGVNFLLPIWAMANVAQGGACFAVWFKTKDAKIKAITLPSAFSAMLGITEAAIFGINLRFVKPFIAALVGGAAGGAWVVSMHVYMTAVGLTAIPGMAIVQASSLLNYIIGMAIAFAVAFALSLTLKYKTDAE

SEQ ID NO: 13019 - protein, 239 aa, Klebsiella pneumoniae
IPNKETAMCEYNQFGQALGVALPDWQPRPWPTRQVLQGSRCRLEPLTLAHASDLFAAHQLAPDARSWTWLLREPESNLAEFSAWVEQVATLADPIHFAVVDQQRGKAVGSLALMRIDIAHGVVEVGHVHFSPLLSRTAMATEAHWLLMQYVFDTLGYRRYEWKCNSLNIPSARAARRLGFQYEGRFRQALVSKGHNRDTDWFSVIDGEWPELDNAMRQWLAADNFTADGQQRRSLESFR

SEQ ID NO: 13020 - protein, 139 aa, Klebsiella pneumoniae
VSNKSLPVAKLRHRLVFFLSASRLTTFHSQKDGAMKITLLMTLLFGLIFISAVGAAEKTPTPQQQRMTDCNQQASAKMLKGEERKTFMSQCLKKETTTSQGKALTPQQQKMSDCSKAATAKSLKGDERSTFMSSCLKKA

SEQ ID NO: 13021 - protein, 276 aa, Klebsiella pneumoniae
KRNNMFSGLLSHSAAPAADFSRLQRASITFRDVAKRYGDHQVLNAINLQVESGEVVAILGPSGSGKSTLIRLINQLESLSGGEILIDGKPTSRLSGSALRQLRSRVGFVFQQFNLYAHLTAQENITLALERVHGWGKSAAQARALALLRQVGLEEKAQQMPAQLSGGQQQRVAIARALASSPQIILFDEPTSALDPEMIGEVLQVMKTLAHSGITMLVVTHEMQFAREIADRVVFIDGGDILEVAPPAEFFAHPQHARARRFLQKVLDPLHQESLE

SEQ ID NO: 13022 - protein, 542 aa, Klebsiella pneumoniae
KDDNEMSQHGLHRRRRRWEIFLVFAVPGHRVTEESTMQATAKEFIIALDEGTTNAKAVVLDSRGKVIVKFSQPLAIQTPRDGWVEQSGEALVTASLTVIASAVAHVGAENVAALAISNQRETAIGWYRDSGEPINAAITWQCTRSAAFCDTLRHDRQEQHIKRATGLPIAPLFSASKMRWLLDATVDGHLRAERGEICLGTIDSWLLWNLTAGEAFCCDYSNASRTQLLNLHRGEWDDEMLALFGIPRAALPDIKPSSGLFGHTKGLAAIPDGIPIMSMIGDSHAALFGHALGEAGCVKATYGTGSSVMAPVKSAQCDIDALATTVAWHDGDQLVWGLEGNIPHTGDAVAWMADSTGLSELSAAELAHELNTLPASVDSTLGVYFVPALTGLGAPWWDDSARGVICGLSRGVKRAHMIRAALESITYQIADVVVAMRQHEEFTLTALMVDGGPTNNDWLMQYQADLLGCPVMRSDVPELSAIGAALLARKALHPGSTADLQAFLTEHSTFQPDMVRHQRLQTRWQEWRHAVDRTLWKPDSPA

SEQ ID NO: 13023 - protein, 630 aa, Klebsiella pneumoniae
VSLLKECVMSQTATLILTHGQIHTLDRANPLAEAVAIADGKIVATGSHDRIMSFAAEGTQIVDLKGHTVIPGLNDSHLHLIRGGLNYNLELRWEGVPSLADALRMLKDQADRTPSPQWVRVVGGWSEFQFAERRMPTLEELNEAAPDTPVFVLHLYDRALLNRAALKAVGYSKETPDPAGGEIVRDSHGNPTGMLIAKPNAMILYATLAKGPKLPLDLQVNSTRQFMRELNRLGLTSAIDAGGGFQNYPEDYEIIEQLHAKDQMTVRIAYNLFTQRPKQELEDFERWTDMLKPGQGTDFYRANGAGEMLVFSAADFEDFLQPRPDLPQGMEDELERVVRHLVEHRWPFRLHATYDESISRMLDVFEKVNRDIPFNGLHWFFDHAETITERNIERVKALGGGIAVQHRMAFQGEYFVDRYGKEAVKHTPPVAKMLALDVPVGLGTDATRVASYNPWTALYWLVSGRTVGGMAMYDDANRLPRDVALELWTAGSAWFSSEQGKKGRLAAGQLADLVVLSKDYFSVAEEEIKGIESVLTVVDGKVVYAAGHFSPLAPPPIPVLPEWSPVVKVPGHYRSAPPATAKIGAMVQMHQCCGSCGVHGHQHDIARKSSIPVSDEQAFWGVLGCSCFAF

SEQ ID NO: 13024 - protein, 248 aa, Klebsiella pneumoniae
  UNSURE (158): Identity of amino acid at the above locations are unknown.
RQDKENPSMLNLQAVNHFYGNQHSLWNVDLVLRPGECIGVLGREGMGKTTLVNCIAGHLPVASGRMTWHDIGAPPQDLTPLSAQSRSAIGIGYVPQDKRIFSQLSVEENLHIALAAGKPGANASGGEIYEHFPELYALRQRKGASLSDDDQYQLALAXALIVQPRLLILDEPSRGRGPRCLQKLADLLLRLNRDIGLTVLLAEQHLPFIRRVADRFCVLHRGRNVAEGDIMALDEPLLAQWITPDPAP

SEQ ID NO: 13025 - protein, 108 aa, Klebsiella pneumoniae
SSLLNKGPLPRPFFITGWQGTYCHCLFFVLHLIYIDMAQAIFSSLFNNSGSANTHLPGIILLSLSTGRRFLNATAACLKPMIHKISLFLRLWASACEINSSIFKIISR

SEQ ID NO: 13026 - protein, 911 aa, Klebsiella pneumoniae
GKCKLTKMNNPKFTTPSGDTAPRQVWQQTVDAVLAQTKSQAAGLSSADAAERLNTCGPNALPEKKGKPGWLRFLAHFNDVLIYVLLAAAALTAIMGHWVDTLVILGVTVINALIGHIQESNAEKSLQGIRNMLSSDARVQRNGKHETIPTRDLVPGDIVILRAGDRVPADMRLIETHNLRVEEAILTGESTVVDKITDALEGDLPLGDRVNMVFSGTTVSAGGGVGVVTATGAQTELGHINQMMAGIEKHRTPLLVQMDKLGKAIFAIILAMMVALFIFSLALRDIPMGELLLSLISLAVAAVPEGLPAIISIILSLGVQTMARKRAIIRKLPTVETLGAMTVVCSDKTGTLTMNEMTVKAIITADCCYRVEGDSYEPQGRIFLEGSDEPVQVQPGTVLETWLRTIDLCNDSQLTQDERGLWGITGGPTEGALKVLAAKAQLPAVEARLVAKIPFDSQYKYMSTLQHIDGNARVLITGAPDVIFAMCREQMSRHGAVPFEAQYWEEEMARFARQGLRMVAAACKPASLDATTLNHEDLQEGLIFLGIAGMMDPPRPEAIDAIHACQTAGIRVKMITGDHPQTAMSIGQMLGITNSSQAMTGYQLEHMDDAALAKAAVEYDIFARTSPEHKLRLVKALQDNGEVVGMTGDGVNDAPALRQADVGIAMGIKGTEVTKEAADMVLTDDNFATIASSVKEGRRVYDNLKKTILFIMPTNLAQGLLIIIALLAGNIIPLTPVLILWMNMATSATLSFGLAFEAAERNVMNRPPRKTGQHVMDGFAVWRVAFVGSMIAIAAFILEAWLAPRGHSPEFIRTVLLQMLVTAQWVYMINCRSSDSFSLSMGLLRNKGIWLVTGVLLLMQLVIIYVPLMQSMFGTEALPLRYWFVTLVIGVAMFLVVEIEKRLTRRFRKTA

SEQ ID NO: 13027 - protein, 97 aa, Klebsiella pneumoniae
SVRKVTISAAGILKLLQETEMSYSGERDNFAPHMALVPMVIEQTSRGERSFDIYSRLLKERVIFLTGQVEDHMANLIVAQMLFLEAENPAKRHLPVH

SEQ ID NO: 13028 - protein, 674 aa, Klebsiella pneumoniae
LMSKSFVLHSAFRPSGDQPEAIRRLEEGLEDGLAHQTLLGVTGSGKTFTIANVIADLQRPTMVLAPNKTLAAQLYGEMKEFFPENAVEYFVSYYDYYQPEAYVPSSDTFIEKDASVNEHIEQMRLSATKALLERRDVVVVASVSAIYGLGDPDLYLKMMLHLTVGMLIDQRAILRRLAELQYTRNDQAFQRGTFRVRGEVIDVFPAESDDIALRIELFDEEVERLSLFDPLTGHVEGTVPRYTIYPKTHYVTPRERIVQAMEEIKLELAERRKVLLANNKLLEEQRLTQRTQFDLEMMNELGYCSGIENYSRFLSGRGPGEPPPTLFDYLPADGLLVIDESHVTVPQIGGMYRGDRARKETLVEYGFRLPSALDNRPMKFEEFEALAPQTIYVSATPGAYELDKSGGEVVDQVVRPTGLLDPIIEVRPVATQVDDLLSEIRLRTAINERVLVTTLTKRMAEDLTEYLEEHGERVRYLHSDIDTVERMEIIRDLRLGEFDVLVGINLLREGLDMPEVSLVAILDADKEGFLRSERSLIQTIGRAARNVNGKAILYGDKITPSMAKAIGETERRREKQQRYNEEHGIVPQGLNKKVVDILQLGQGLAKTKAKGRGKAKAVEPAGLSAVDMTPKALQQKIHELEGQMMQHAQNLEFEEAAQIRDQLHQLRELFIAAS

SEQ ID NO: 13029 - protein, 312 aa, Klebsiella pneumoniae
KMSNAEHLANVMVEAFIAAVERGVDLVPVVADSTSTAKIAPFIKQFPGRLVNVGIAEQSMVGTAAGLALGGKVAVTCNAAPFLISRANEQIKVDVCYNNTNVKLFGLNAGASYGPLASTHHSIDDLAVMRGFGNIQIFAPSTPRECRQIIDYALAYQGPVYIRLDGKALPELLDESYRFVPGAVLTLREGEDVALVATGSTVHEVVEAAQQLADLGIQAKVVSVPSIRPCDTAALLAALQPCGSVITVEEHNVNGGLGSLVAEVLAEAGVGIALQRLGIPDGEYAAAADRGWMRQYHGFDAAAIVALVQKRD

SEQ ID NO: 13030 - protein, 68 aa, Klebsiella pneumoniae
SVSKRGIGREAEANVLAILSTIGRAVEVRFIYLCIKQEILRVASNNRVVPSVRAEFILESAYNNALCD

SEQ ID NO: 13031 - protein, 80 aa, Klebsiella pneumoniae
RVSKVELLEKISALATECHALACELDIGDERTEMFEIYGVLHNLGRRGYASQVGRRMNPLLSSCDDDEDEEDDDWDEDED

SEQ ID NO: 13032 - protein, 88 aa, Klebsiella pneumoniae
PQSNKQSVLLHLDKGCNRKVPCLQHRESSLCRMGTPCHSRRAQNSSSQNFLGEDNGGGRGTATRPGRAMLTGAMSITEPAPGGAHGGS

SEQ ID NO: 13033 - protein, 261 aa, Klebsiella pneumoniae
QESKMAGSWLRGVVGVSLTLCVAGQALAAEGKVTVFAAASLTNAMQDIAQAYKKEKNVEVVSSFASSSTLARQIEAGAPADLFISADQKWMDYAADKKAIDPATRATLLGNSLVVVAPKASAQGAITIDEKTDWTSLLKGGRLAVGDPQHVPAGIYAKEALQKLGAWETLSPKLAPAEDVRGALALVERNEAPLGIVYGSDAVASKGVKVVGTFPEASHQKVEYPLAIVDGHRNAAVSAFYDYLKGPEASAIFKRYGFTTR

SEQ ID NO: 13034 - protein, 69 aa, Klebsiella pneumoniae
QVFNLTNHISMIAALLESLQVSPERKLIKGNFFRDLGFYITFIAIFLIGSGCHSEVGCMVFLRYRDRIG

SEQ ID NO: 13035 - protein, 80 aa, Klebsiella pneumoniae
RMFKLIQRGQIYADCHGWPVIIASSDDKTVCYWRQGRINTASIDRFNNDFEPLSHEEAQQIKAELEQSEHIKKLRAQRAA

SEQ ID NO: 13036 - protein, 312 aa, Klebsiella pneumoniae
SCLNAACLPQGKRRRYVEDPRRMKTTHTEFERYYQQVRSRQKRDAVCWSLLLLALYFAAGSAAEFNLLTIWHSLPHFFDYMAETIPPLSAGNLFADVQTKGSLAWWGYRLPIQLPLIWETLQLALASTLVAVAIATVFAFLAANNAWSPAPVRFAIRVLVAFLRTMPELAWAVIFVMAFGIGAIPGFLALMLHTVGSLTKLFYEAVESAQNKPVRGLAACGASPLQKIRFALWPQVKPLFLSYGFMRLEINFRSSTILGLVGAGGIGQELMTNIKLDRYDQVSITLLLIILVVSALDMLSGRLRLWVLEGKK

SEQ ID NO: 13037 - protein, 314 aa, Klebsiella pneumoniae
FSTNGGSPPSPARRSCSPAWRLTCWAMACAIFWSRNMTDIRLTVQGLAVDYPTARVVDNVSFTLGNERLALVGESGSGKSMTARALMGLVRKPGVVSAERLEVLGRDVLTLSARGWRALRGNDIAMVLQDPRYALNPVQTIQTQLEEALTLHQRLSRRARAEAVKDAIAAVGLDLPVLSRYPGELSGGMGQRVMIALALLNNPKVLIADEPTSALDARLRNQILELLVEQSAQRQMAMLLISHDLPLVAAHCDRVLVMYQGRQVDEMPARALPSATHPYTRTLWTCRPNAHTYGQMLPTLDRTQDFTETAHGDR

SEQ ID NO: 13038 - protein, 397 aa, Klebsiella pneumoniae
IAVLTRKNKMKWFVFMFAAIAATLMVTPEANSGSFDPVTGAYTTDPITVTLTPKTVAASTSVIANGEKVYWATSTYAQLSGPFYWGPHTYTMDSAAIATTAATRMNAGGLCTATASGTSLTISGCFSFTDIYTIYVGKSASCKSFFNFFNDINSSLTSFGDFVGLTFSSGTGTVVNRQLNKTSIPDVHTTSITYPSQTLLPPNSWPTYNTNLQATLSAKTPPYIHLYCNVSQGGQISRENGAYMSRSLDIVPAANKPAYPPTISYSLALPITNNITVNIRNITAIDILPRTVFNTGTISAWRTTYMEQPLTVTGQGNITRNFGAYQNFNVLESWTCATTGQIDFRIMRDNTNANVCTGATYTHPVQTPQSLTAQWKAQSSTASGAWSARATVTFTLP

SEQ ID NO: 13039 - protein, 303 aa, Klebsiella pneumoniae
RGYKMDGAIFLQQVVNGMSLGGMYALIAIGYTMVYGVLRLINFAHADVMMVGAFSTLFLFSSVGLPFGVAVFLTLGLCGLFGMLIDRVAYRPLRQASKISMLITAIGVSFFLENLFNVLFGGSSRFFSAPDFFNQTRAFGSVIITNVAWIVPLITVLLLLAILWLLYRTRYGMAIRAVAFDVNTVRLMGIDANRIISLVFALGSSLAALGGVFYSISYPTIDPLMGVLIGLKAFAAAVLGGIGSVTGAVLGGFILGFTEVVAVAIFPELGGYKDAFAFLFLILVLLFRPVGIMGDERLERSRF

SEQ ID NO: 13040 - protein, 312 aa, Klebsiella pneumoniae
FNDKAVEIIMLWFKNLMVYRLSRDIELRAEEMEKQLAELTFTPCGSQDMAKTGWVSPMGSHSDALTHTANGQIIICARKEEKILPSPVIKQALEAKIQKLEADQGRKLKKTEKDSLKDEVLHSLLPRAFSRFSQTMMWIDTVNGLIMVDCASAKKAEDTLALLRKTLGSLPVVPLTLENPIELTLTEWVRSGTVAQGFQLLDEAELKAMLEDGGVIRAKKQDLVSDEIAVHIEAGKVVTKLALDWQQRIQFVICDDASIKRLKFCDELRDQNEDIDREDFAQRFDADFILMTGELAALIQSLVEGLGGEAQR

SEQ ID NO: 13041 - protein, 274 aa, Klebsiella pneumoniae
LRCNLPAEICRRYSMNGHNITNESLALSMVLVLIAILVSYREKLALEKDIIWSICRAIVQLIIVGYVLKYIFNVNHAVLTLLMVLFICFNAAWNAKKRSKYIDKAFISSFIAITTGAGLTLAVLVFSGSIAFVPMQVIPIAGMVAGNAMVAVGLCYNNMGQRFSSEQQQIQEKLSLGATPKMASARLIRESIRASLIPTVDSAKTVGLVSLPGMMSGLIFAGIDPVKAIKYQIMVTFMLLSTASLSTIIAGYLTYRKFFNARHQLVVTQLKKRP

SEQ ID NO: 13042 - protein, 324 aa, Klebsiella pneumoniae
KNSNKCNVEAKVPKEIPLNEFSLRRYLKRLQQSGNHRNMISQIEYLLTLAKASKSGLLPITYVQSNGGRLYAEGAVNLQNCKREIRKTALAGMFDVDIENCHYNLLEQMCARIGIKTPRISHYVRNKKQVRKEVATTLQCTEEQAKVVLIALIYGANLGPRGVLKKLDIDTSDEALKDTWISKLTEEITNVRRYVIEDYTARTRGYCKIKNDAGMIVKTITENGESVKKSKLLAHLLHGAESLILQYMISFLGDNVVLLQHDGVTCPNPVDTDELSDYIAEKTGYRVQFDIEQLKPDFYVDATDRFQQQDLEDIFEIFKYEMAA

SEQ ID NO: 13043 - protein, 285 aa, Klebsiella pneumoniae
TLLNRFSSLKHSPPVSGTIGSRNREARVKNVSQAEYFATPDLDFSFPTRLGIVQQVAVSPAAVAKGKGVRSAMNPSFGDIYDRYQKLTLTTHLPAVIACSETLSLGKDQGFIPQPGYLYFLLQGQMTLAFGDEQNLVGIVIAHMPLGLLEHYCPSVALYYQCLGECQLAKITASDFERIFFHSSPGYMQELTTILAYMGIFALDAHYERGSQTSFQTIKSMLSRYLYRGEIDGGQHESLSAFIIKRTNLSRSYVYQVLAALREGGYITVKKGKLISIDRHIPEKF

SEQ ID NO: 13044 - protein, 68 aa, Klebsiella pneumoniae
VKLKLLYKYQEVVMSKQSVKPVLLSEAQIQAIRKIQEKQRQQSGIGVAPTIHEIARGLVDKALQQHLG

SEQ ID NO: 13045 - protein, 480 aa, Klebsiella pneumoniae
YLLNKHLFTLLTPRRYTRRSFYIEVVMNDNKMTPGELRATWGLGTVFSLRMLGMFMVLPVLTTYGMALQGASEALIGLAIGIYGLAQAVFQIPFGLLSDRIGRKPLIVGGLLIFVLGSVIAALTDSIWGIILGRALQGSGAIAAAVMALLSDLTREQNRTKAMAFIGVSFGVTFAIAMVLGPIVTHQLGLHALFWMIAILATVGILLTLWVVPNSHNHVLNRESGMVKGCFSKVLAEPRLLKLNFGIMCLHIMLMSTFVALPGQLEAAGFPAAEHWKIYLVTMVISFISVVPFIIYAEVKRKMKRVFLLCVAILLIAEIVLWGAGGYFWELVAGVQLFFLAFNLLEALLPSLISKESPAGYKGTAMGVYSTSQFLGVAIGGALGGWVDGFFDSQTVFLLGALLAMLWLLVASTMSEPPYVSSLRVEVPDGVVVDSALQARLLSASGVHQALVVPEERSVYIKIDSKVTNRFEIEQLIKGV

SEQ ID NO: 13046 - protein, 269 aa, Klebsiella pneumoniae
SGIKMFRKDFAAIALVLTATQAGAEPLTAMRYADFDRYVLALSWQTGFCQSMYDRNRNEPEECRLQQDTANKADFLTVHGLWPGLPKSIAARGVDERRWMRYGCATRPVPNMPEVKANRKCQAAETGLSLEMANKLNNVMPGSGGTSCLERYEYAKHGVCFGFDPDSYFGAMVRLNGEIKRSPVGDFLAKHYGQTVSRADFDAAVARAWGPQSVKAFKLTCNGNPAYLTEMQISLNAATINAPLATSAFLPQPHPGNCGAQFILDKVGH

SEQ ID NO: 13047 - protein, 209 aa, Klebsiella pneumoniae
RCVKKTFLRFRIPAFFAGAYDDRLAEGSWERTMTAQRVVMVVDMQNGVFATPRLARERCVAQINRLVRAADKVIFIQHDEAGGLEAGSEGFALLPELEQPAGALYVTKTACDAFYHTSLAQVLDEHDIQQFVICGCATDYCLDTTIKNGASRGYGIVIAEDAHTTADRPAAQAATLIAHYNEVWRTLTIPGNPLQVKPTETILHAWQQN

SEQ ID NO: 13048 - protein, 117 aa, Klebsiella pneumoniae
PAVNGRWCASGSAYPPAAPSPRRADRAAARFGCRRLPAPSPLCCSRGRPSATDNRCRNLVAAPASAPGWPAGPSPPATAAGCRTARPTGPARRLAPLARSAAHRSGVPPAVGKWGDC

SEQ ID NO: 13049 - protein, 622 aa, Klebsiella pneumoniae
LFPKGTAVLNRYPLWKYVMLVVVIVVGLIYALPNLYGEDPAVQITGARGVAASEQTLIQVQKTLQEEKITAKSVALEEGAILARFDTTDTQLRAREALLNVLGDKYVVALNLAPATPRWLAALYAEPMKLGLDLRGGVHFLMEVDMDTALGKLQEQNIDSLRSELRDKGIPYATVRKEDNYGLSIVFRDSAARDQAISYLSPRHRDLVISSQGDNSLKAVMTDERLKEAREYAVQQNINILRNRVNQLGVAEPLVQRQGADRIVVELPGIQDTARAKEILGATATLEFRLVNTNVDQSAAASGRVPGDSEVKQTREGQPVVLYKRVILTGDHITDSTSSMDEYNQPQVNISLDSAGGNIMSNFTKDNIGKPMATLFVEYKDSGKKDANGRAILAKEEEVINIANIQSRLGNSFRITGISNPNEARQLSLLLRAGALIAPIQIVEERTIGPTLGMQNIKQGLEACLAGLVVSILFMILFYKKFGLIATSALIANLILIVGIMSLIPGATLTMPGIAGIVLTLAVAVDANVLINERIKEELSNGRTVQQAIDEGYRGAFSSIFDANVTTLIKVIILYAVGTGAIKGFAITTGIGIATSMFTAIVGTRAIVNLLYGGKRVKKLSI

SEQ ID NO: 13050 - protein, 599 aa, Klebsiella pneumoniae
PITKSGFYCLRLFAQLSWYFRREWRRYLGAIALLVIIAVLQLIPPKVVGIVVDGVTQQHYTAEKVWMWIGALVLIAVMVYLLRYVWRVLLFGASYQLAVELREDFYRQLSRQHPAFYLRHRTGDLIARATNDVDRVVFAAGEGVLTLVDSLVMGCAVLIVMSTQISWQLTLLALLPMPLMALAIKRNGDALHERFRVAQAAFSSLNDRTQESLTSIRMIKAFGLEDRQSAQFAADAADTGAKNMRVARIDARFDPTIYIAIGAANLLAIGGGSWMVIHGSLTLGQLTSFVMYLGLMIWPMLALAWMFNIVERGSAAYGRIRTMLEEAPAVDDGTEAVPAGRGVLQVAIRDFIYPQASKPSLEQVNFTLQPGQMLGICGPTGAGKSTILALLQRHFDVTHGEIRFHDLPLPILQLDSWRARLAVVNQTPFLFSDTVANNIALGKPDATQAQIERVAQLASVHDDILRLPQGYETEVGERGVMLSGGQKQRISIARALLLEAEILILDDALSAVDGRTEHQILHNLRQWGEGRTVIISAHRLSALTEASEILVLQHGHIAQRGRHEALAVQPGWYRDMYRYQQLEAALDEVPQTQEEALDA

SEQ ID NO: 13051 - protein, 66 aa, Klebsiella pneumoniae
STANGIMDSILQAHPDVKGVICGNGPVALAANAALKAANRSDVIVVGIDGSNDERDAGKAAPCRQP

SEQ ID NO: 13052 - protein, 114 aa, Klebsiella pneumoniae
KTAKAMKTMKAAGLSFGAPQTLSRTGQDPLSQLAFTLPLPQQGKPVYGVGSNMQGDVVLVALDEVKAGSMPEEQKKAMVQGITQNNAQIAFEALMSNLRKAAKIKLGDSIDQQQ

SEQ ID NO: 13053 - protein, 313 aa, Klebsiella pneumoniae
RSQKRPPDGGQPCRNRTDFCLRTSREGLLDNSFQRFADVGQAANSFHTRRFQRCEFLIRCTFTAGDDSARVAHTLAFRRGNTRDVADNRLSDMIFNISSRFFFRAAANLTDHDDRFGLRIFLEHLQDIDEVGARDRVAADTDAGRLAEAVVGGLLNRFIGQGAGTGNDAHFTRLVNVTRHDADFALARSDNARAVRADHTHARFVQLHLHGQHIQRWDTFGDGDDKLNARVDRFQDGIFAERRRNVDHGRGRAGRFNGFAHGVEHRQAQVSGAAFAWRHAANHLRTVSDRLFRVEGPLATGEALADNLGIFIN

SEQ ID NO: 13054 - protein, 195 aa, Klebsiella pneumoniae
RCKNDYFKDYEVKNYMEYKSCSDKYIWSADDSYFYKGLSELIVDIDELIYLSLEKIRKDFVFINLNTASLNEFIRRDSEWLSAVKGKQVVLIAARKSEALANYWYYNSDIRGVVYVGLSRDIRKELAYVINGRFLRKDIKKDKITDREMKIIRMTAQGMQPKSIARIENCSVKTVYTHRRNAEAKLYSKIYKLVQ

SEQ ID NO: 13055 - protein, 360 aa, Klebsiella pneumoniae
RAKNGTDFRSHYLSYRFHPAWVIAKEFGLMKKPVVVILLIVILLAALGGGWWWYQSSRQQPLTLYGNVDIRTVNMSFRVGGRLASLTVDEGDNIRAGQTLGELDRAPYENALLQAQANVSTAQAQYDLMMAGYRAEEIAQAAAAVKQAQAAYDYAQNFYQRQLGLRASSAISANDLENARSSRDQAQATLKSAQDKLRQYRAGNRPQEIAQAKASLEQAQAALAQAKLDLHDTVLTAPSDGTLMTRAVEPGTMLNAGGTVLTLSLTHPVWVRAYVDEKNLGQAQPGQEVLLYTDSRPDKPYHGKIGFVSPSAEFTPKTVETPDLRTDLVYRLRIVVTDADGALRQGMPVTISFSHGNGHE

SEQ ID NO: 13056 - protein, 483 aa, Klebsiella pneumoniae
NKKKRRWERRFDRKEMLFARFRPGITQPDGAVEHQTGCGCIAAVEAEIAFTLKLVSFTGFGLRQARLRVPLFDHQRFRVDHCEEIFRRARVWHAEQTIVETDLYRQRMRRAYPMDHAFDLAAVGRVFAQGVGIVGAEDGGNIAFGIFLHAFRFDDVGVAQTHFFTQHQTLVLFVGFFAEVRAIDPDFGAERHFTTAHFRLVRMVRHHHHFAFALRIVLDNQFHRIDHRHRARGVFVQIFTNAGLQRRHLDGVVLLGHADALAELADGFGGVAATTQTGDGRHTRVVPAFHVLLSHQLVQLTLGHHGVFEIQAREFVLTRMHRDADVVQHPIVQAAVVLELQGTQRVGNAFQRIADAVGEVVHRVDAPLVASLMMLSELNAVQHRIAHHDKRRRHIDLRAQAGFTLFEAAAAHFFKQRQVLFHAAVAIRAVFTRRFQGAAVFANFIRREFINIGQTFVDQLNRILMQLIEIIRRVAYVPGPVET

SEQ ID NO: 13057 - protein, 173 aa, Klebsiella pneumoniae
CMKKLSAAAFAFGLLSVSVSQALAADATVNFSGTILQEACSVHTSDNTVNVQLGTYGAAQFPTVGTTTLPVPFAINLTGCPASGGPTAALVTFSGAADAAGDLALTAGGASGVSINIKKADGTNIDINSTDSGIALTSATTQQLRFTANYISTAASVTAGAANAVAQVNISYM

SEQ ID NO: 13058 - protein, 83 aa, Klebsiella pneumoniae
LMKKAFGRKELLLVVPLSMSTIDRLEHKGQFPKRFYITDGRCAWDGDEVEQWLDERKAANTGNFGGKKPPVDKRVSRPVSKAT

SEQ ID NO: 13059 - protein, 351 aa, Klebsiella pneumoniae
IMKKSTLALMMMGFVASTATQAAEVYNKNANKLDVYGKIKAMHYFSDYDSKDGDQTYVRFGIKGETQINDDLTGYGRWESEFSGNKTESDSSQKTRLAFAGVKLKNYGSFDYGRNLGALYDVEAWTDMFPEFGGDSSAQTDNFMTKRASGLATYRNTDFFGLVDGLDLTLQYQGKNEGREAKKQNGDGVGTSLSYDFGGSDFAVSAAYTSSDRTNDQNLLARGQGSKAEAWATGLKYDANNIYLATMYSETRKMTPISGGFANKAQNFEAVAQYQFDFGLRPSLGYVLSKGKDIEGVGSEDLVNYIDVGLTYYFNKNMNAFVDYKINQLKSDNKLGINDDDIVALGMTYQF

SEQ ID NO: 13060 - protein, 103 aa, Klebsiella pneumoniae
  UNSURE (48): Identity of amino acid at the above locations are unknown.
SWKKGLRIATALSRRWWWIPRKRPAIITSSGRLAPPPPTIWKPGCGQXDLIGVSSWSSTIRAMVDEVHAQNLKASGVIQLLGGVGPNGNVPGDDSYPDPRPAA

SEQ ID NO: 13061 - protein, 470 aa, Klebsiella pneumoniae
KVPLRKNTQGNDVKDASTSSDAVEESGPTLHRGLQNRHIQLIALGGAIGTGLFLGIGPAIQMAGPAVLLGYAVAGIVAFLIMRQLGEMVVEEPVSGSFAHFAYKYWGPFAGFLSGWNYWVMFVLVGMAELTAAGIYMQYWLPDVPTWVWAAAFFIIINAVNLVNVRLYGEAEFWFALIKVLAIIGMIAFGLWMLFGGHGGSKAGFDNLWKHGGFLATGWHGLILSLAVIMFSFGGLELIGITAAEAQNPEKSIPKAVNQVVYRILLFYIGSLVVLLALYPWVEIKSDSSPFVMIFHNLDSNLVASALNFVILVASLSVYNSGVYSNSRMLFGLSVQGNAPKFLARVSKRGVPVNSLLLSGIITSLVVVLNYLLPHEALGLLMALVVATLLLNWIMICMAHLKFRAAQRRKGRESKFKALLAPASNYFCIAFLGLILALMCTIDGMRLSAILLPVWILFLFIAFKLLRRPA

SEQ ID NO: 13062 - protein, 96 aa, Klebsiella pneumoniae
YRRNAHLPDQSRGLVRSVWSGSHHSKRLRISATAAKAGGLMNSLLAKVMERGIFRVPTRRKRKVEVKPSDIPTLKEYTARLVDKKWLRLRARRPHA

SEQ ID NO: 13063 - protein, 220 aa, Klebsiella pneumoniae
THGKTSPTMGDIMQQQLTQALEAYLQKLDDEARIEAINAFRQVLHHYSPFRSQPVDCVLWVKQELVAPNDYNPNNVAPPEKRLLQTSLEADGFTQPVVVIQQRPQAYTIVDGFHRHELACSKAALKKTLKGYLPVTCLTSEAASRDGLMAATIRHNRARGRHQIHAMSEIVRELTQLGWTPQKIGKELGMDADEVLRLKQISGLTEMFAGRQFSQAWTIK

SEQ ID NO: 13064 - protein, 115 aa, Klebsiella pneumoniae
SGGNMASDKPITAQQAADLLIVSARVIYRLIESGELAGRKVGNKYRTTEAACIAYLKTPRDPVIANAGEHKGEVLCQSPSGAACGTVISLRRQEKELGDLLARGTKSRLRSSTTN

SEQ ID NO: 13065 - protein, 162 aa, Klebsiella pneumoniae
TTGKSNKWVRRWRCTTIRSTNSSPALSARRKMNFLPAIVSDWQPERLTVTLAQDHQLALNIATQPLKPGAAVTLGIRPEHLTPEVATGTVVEFQCEVVERLGNNTYLFGQCYGHDNVKILLPGDVHFRPWQKIKLAFDERFCMVFDENDLRISADIPAPDAH

SEQ ID NO: 13066 - protein, 60 aa, Klebsiella pneumoniae
PRTLRNANRFINEVDSSAVYVNASTRFTDGGQFGLRRGSGGQHPEAARPRPDGAGSVNHL

SEQ ID NO: 13067 - protein, 388 aa, Klebsiella pneumoniae
SPLKRSLLIFAALCAASWTSVQAAQPTVDPVFASDVVDRYANHIYYGSGATGMALVVIDGNQRVFRSFGETRPGNNQHPQLDSVIRIASLSKLMTSEMLVKLLDQGVVKLNDPLSKYAPPGARVPDWQGKPITLVNLATHTSALPREQPGGAAHRPVFVWPTRQQRWNWLSTATLKTAPGSQAAYSNLAFDLLADALATAAGKPYPQLFEEQITRPLGMKDTTFTPSPDQCQRLMIPEKGASPCNNTLAAIGSGGVYSTPGDMMRWMQQFLSSDFYTRSQQADRMQTLIYQRNQLTRVIGMDVPGRADALGLGWVYMKPKNGHPGIIQKTGGGGGFITYMAMNPQANVGAFVVVTRSPLTRFNNMSDGINDLVSELSGAQPNMQTASQ

SEQ ID NO: 13068 - protein, 558 aa, Klebsiella pneumoniae
RTLKVTAVASFKRSSALRSLSFSLGQPARSRCTAFINGVSNQGTEDIWRHLPAGLFFIIVDGALHHLFHYQRLERIDALHAHRPEQGVSGGQAEHYAERHQHLAAVHPGRRDIDDSDDDPDAGDNLRQREPRRAVGARQVRAANAQHHHRQSNQQIGDAPGADRGEDQRHDAVQIAVQIPGVQAGDRHPDGNGDHRRLKARMQPGQEMGQRAVQRHAVDNTRHGGHQRIDGGAAGQQQPDPQPVLAGVAHHPFGEGRDRHRCIQQMDVVGRVEHGILHLAVDRRAVDKHAAGDPQQAQRHRPRYGAVGLFDLRRHRRHQFATDEHKHRHADIAEQAVDIANVQRCAEPAGQMGDRRHKNAAQAENGQRGPHAEGQHHFDLAEDFHADGVEQAENHHHADAHHPGILVSGHLGVNRLEVHQRHNARQDRLRRPGEDMDDQIGAQRAGDSEEAAHAAGDIVVHRTGGGNERRRLGKGGDLRLHHNKGQQHRQREGIAAHAEAAGDRQDHRAGHDQPDGAGEGGREADDAALKMAGESVTKHSQPLHNNGVGQGIASATPG

SEQ ID NO: 13069 - protein, 84 aa, Klebsiella pneumoniae
HDMKHPLETLLSAAGILLLALLSCLLLPAPSLGLTLAQKLVETFHMMDLNQLYTVLFCLWFLALGAIEYLVLRWVWRRWFSLER

SEQ ID NO: 13070 - protein, 403 aa, Klebsiella pneumoniae
LLMKNIDLIREVTLAAADRWPTVLAGLHIDVPDSPRRHAPCPACGGSDRFRFDDGGRGSFICNQCGAGDGLDLIKRVNNCDTTEAAQLAADVLGIDYRTVKQDEATASQKREQMKAESQQREQERQRRKLAEIEQRRGLFVSHWQGLAETAFEGESEYLMNKGLVGFTFPVLPDGSLLLGLVDESGTVTAARTITQQGEKRLLAGSAKRGAYHAVNAADAPQSVLIAEGLATALSVHLIRPEALTVCAIDAGNLQPVAQAMHQRYPNAQIIIAADNDIKPGEPNTGKDAAEKAAKAVSGWVALPPTVKKADWNDYHQQYGLEAATTAFKNSMYQPQEPEVSAKLQVINGGKKGASKPESLRPHVESRADGIYWVEPKSDKDAGEIICRESWLCSALKVIGIGH

SEQ ID NO: 13071 - protein, 853 aa, Klebsiella pneumoniae
YSMKEWVWSIVDRKIIQELFMSNTIDLTLDGLSCGHCVKRVKESLEQRPDVEQAEVTLTEAHVTGSASAQALIDTVKQAGYGAELSHPKAKPLAESSIPSEALTAATPELPAAHDEDDSQQLLINGMSCASCVSRVQNALAAVPGVSQARVNLAERTALVMGSASAAELVQAVEKAGYGAEAIEDDLQRRERQQETALATMKRFRWQAIVALLVGVPVMVWGMIGDNMMVSDDNRSLWLVIGLVTLAVMVFAGGHFYRSAWKSLKNGTATMDTLVALGTGVAWLYSMSVNLWPQWFPMEARHLYYEASAMIIGLINLGHMLEARARQRSSKALEKLLDLTPPSARVVTPEGEKDLPLAEVQAGMTLRLTTGDRVPVDGMISQGEAWFDEAMLTGEPVPQQKGDGDAIHAGTVVQDGSVLFTASAVGSQTTLARIIRMVRQAQSSKPEIGQLADKISAVFVPAVVVIALISAAIWYFFGPAPQIVYTLVIATTVLIIACPCALGLATPMSIISGVGRAAEYGVLVRDADALQRASELDTLVFDKTGTLTEGKPQVVAVKTFAGVDEHTALRLAAALEQGSSHPLARAILDKAADGPLPEVSGFRTLRGLGVSGEAEGHRLLLGNQALLNEQHINTAEVESEMTAQASRGATPVLLAVDGQAAALFAIRDPLREDSVDALARLHRQGYRLVMLTGDNPTTAKAIAKEAGIDEVIAGVLPDGKADAIKRLQSQGHKVAMVGDGINDAPALAQADVGIAMGGGSDVAIETAAITLMRHSLHGVADALAISKATLRNMKQNLLGAFVYNSLGIPIAAGILWPLTGTLLNPVVAGAAMALSSITVVSNANRLLRFKPKE

SEQ ID NO: 13072 - protein, 235 aa, Klebsiella pneumoniae
PAMKNINALIGQGLTHPVDSQREFITLHKQEVRIDSRVFAHRIGIKSTNLHALIRKHKTELLELGTLPTFETAAVKKGGARGIKHERCFLLNEAQFDYMCRVVRGRDPLRMNQFKLDVTKAFSKRRTVEPLRREYLPGYHESRDGLKALGAQRHHYINLARAENRVAGLSDGERGSADEQQLGLLVVIQKIEQAAFNEAVHNGMSPGDAVREVARRMDTFASLLSTKSLLGGENV

SEQ ID NO: 13073 - protein, 506 aa, Klebsiella pneumoniae
RRMNTRKLDRRCWRMTTVEQRNFARKIECEEDGLYYSRYFFKQRTGGKMIIAPHHLAIQRALDRVINGEITRLVINVPPGYTKTELATINMMGRGLALNKRARFMHLSYSHNLALLNSSTARGMIKSKLYQAMWPMELRDDADSKAMWWNEHGGGVYASSAAGQVTGFRAGHMEPGWQGALIIDDPVKPDDAYSDIVRNGVNNRFNETIKSRLAIETTPMIVIMQRIHYHDLSGYLLRGGSGEKWHHLNLPVIIDNSQPYAAQYPENSHAIPIDHGLPDGWLWPFKHNESHRVSLFSHRRTAEAQYMQKPRRFNAEGALWTEVMISAARELQIHHDKVRTVVAIDPQATNSDESDETGIVAASSYGAGDKKQFSVDGDYSGKYSPAGWAKKAISAYEQHEADAIVIETNQGGDMAEETLRNAGFKGRIIRVHASKGKYARAEPISALYEQGRVANHGNLYVLENQLMEYIPATAKKSPDRLDAMVYALTELNGSQPVGMMIPKRLR

SEQ ID NO: 13074 - protein, 212 aa, Klebsiella pneumoniae
NSSNRSGCRRRKRRKKRRSSRSRLKKRLPRPPRRQKPKRTHRQKKRRKPLPKRPPRRKRRRMPRRKRQNRRRPRRLLTRRSRPKPLQRKPLPRRRNRRKLKRRKLRPRRRRKRKRRLRRKRNRKRRKKPSRKRLSRRQLKKRLPKKPLRKPPRKKRPLRRPPPRKPQPLKKRLQQRRLQLIKRPRRQQQKPRRRRKRRLRKKRTALTTCSAI

SEQ ID NO: 13075 - protein, 201 aa, Klebsiella pneumoniae
SASNAPTIPATAPGSSLLPAAPRAFLPLFDHWASLVWYDAPARIRQLQSMTMAQLQQEIASHFPARLGRVTPQAAGAFPLTRRHALQYVQPGLALVGDAAHTIHPLAGQGVNLGYRDVDALLEILAEARGRGEDWASLPVLKRYQARRRADNFIMQSGMDLFYAGFSNDLAPVRMLRNIGLMAAERAGMLKRQALKYALGL

SEQ ID NO: 13076 - protein, 141 aa, Klebsiella pneumoniae
PATNACRQTFHPTFSSVQVYCQALYDYQSSRTQGEHLQGKALQDFVIDKIDDLKGQDIVAIDVHGKSSITDCMIICTGTSTRHVMSIADHVVQESRAAGMLPLGVEGEAAADWIVVDLGDVMVHVMQEESRRLYELEKLWS

SEQ ID NO: 13077 - protein, 528 aa, Klebsiella pneumoniae
HPANDKDTGMRTRHLMALFTGVLILAIILPISLSIWQAARQAKMQFYRELDDYSNRIVVRTLQVADQAREALREADAHTAASCSPEHLLTLRRIAYTHRYIQEVLWLRDSVPQCSSLEDHSVAVTFPPPDHIAPDGYRTWLTSINDLGLDHQMTAMGSRQHMVMIDPVSFIDVVPASEEKIHTMLFGLDHQKMVISSQPLPAKVWQRIKDPHVDMLTLDNTVYRIQRIPELGSGIVTWSSTLPLQQRIRQQLFFWLPAGIFTSLLATGLLLRLLRHLRSPRNSMLDALNSEAIQVHYQPIISLQEGKIAGAEALARWQQPDGTFLSPDIFIPLAEQTGLITQLTEDIVRKIFADLGPWLRQRPEVHISINLSVDDLRSPTLPTLLHNQLQHWGIAAEQIILEITERGFVDPETTMPVIAHYRQAGHRISIDDFGTGYSSLSYLQKLDVDTLKIDKSFVDTLEYRPLTPHIIEMAKALNLATVAEGVETESQRDWLRQHGVQYAQGWLYSKALPKEQFILWAEHNLHAH

SEQ ID NO: 13078 - protein, 83 aa, Klebsiella pneumoniae
LSQNTDKTVGGNMETISQRLKKKREEMNLSQAQLAKKVGMRQQSLQAIEAGTTKRPRYLFELATALHCDPKWLLYGEMPSQSQ

SEQ ID NO: 13079 - protein, 197 aa, Klebsiella pneumoniae
KTQKTGGDRRFFCLQVQICNKKCRHELLADGDAFDDHIIFRHILVHAAAAGGNRFDFVNHVHAFNHFREDAVAPTLQAFAGEVQEVVVNHVDKELRGGRVRRLSTGHRQRAAGVFQTVVRFVLNRRFGRFLFHARFKTAALNHEAVDNTVENGVVVETFAAVVQEVFNCFRRFVVKRFDYDIAMIGVESNHFCILFR

SEQ ID NO: 13080 - protein, 216 aa, Klebsiella pneumoniae
TQKKLFKRKKEKIPLNPPRGENSLAQEVMDYFNELTGSRCAALAPFEKALSTVKSKDQCYTAEELKLVIRWAHVNWGHSFKPENLCRMTRFDGYLSDALIWADGHGSNPKACPHEEIIKLWNEKFPSKAVSLHEWNRRRPAYRDLEAVWNGKTTQGNWRELKHMGMAFELISKSSLFGTRGDQPWLTLDWILNPKNWGSVYEQAINEHRERKGVKA

SEQ ID NO: 13081 - protein, 776 aa, Klebsiella pneumoniae
AEKNAGAMKKQHNYTVMHWGTWQVESSEGEIVAVKPVPWDKNPSRIGQSLPDAVTSQTRIRRPAVRAGYLQHGPVSREGRGKEPFVEVSWEVALDLLARELRSVKARCGNEAIYGGSYGWASAGRFHHAQSQLHRFLKGFGGYTASTNTYSSAAGERILPHILGPLSPLHRQHTHFSELARECQLFVAIGGLPLRNAQVNGGGANDHMLQYWLDKMQANGTRFINISPVRNDLSAVPDAEWLAIRPGTDTALLLALSYVLIAESLYDQAFVASHTVGFAPYRAYLLGEHDGVAKTPAWAAAITGLDAQRIADLAREMARHRTMVNISWSIQRARQGEQAYWATVALTALLGQLGTPGGGLGFGYACTNLAGAVRKAFSGPRLPAGENAVDSVIPVARLSDMLLHPGETYEFDGQQRRYPDIRLVYWAGGNAFHHHQDINRLCEAWRRPETVVVHEQYWTAQAKFSDIVLPATTSLEREDIGSGGHDGFMIAMSAQIPPVGEARDDYAIFCDLAGRLGFGEAFSEGRDAGQWLRHLYEESRPRAQEEGIALPSFDDFWQQGVLEYCAPERPQIFLADFRADPQRYPLSTPSGKIELFSATVAGFGYRECPGHPWWDEQEAARQRQEAARWPLHLLSSQPRARLHSQYDHGSVSRATKIQGREPLWMHPSDAQARDIREGSVVKVYNDRGAILAGVHLSEQILPGVVQMSTGAWYDPLDPNEKGTLDKHGNPNVLTEDRGSSRLGQGCSAQSCWVEIAPWREELPPITAFDPPRFIEV

SEQ ID NO: 13082 - protein, 266 aa, Klebsiella pneumoniae
REKNMRVAAGQFAVTPVWRTNAQTCVAMMQQAEREGAALLVLPEALLARDDNDPDLSVKSAQPLDGAFLQPLLAESRRNSLTTVLTLHVPSGEGRATNTLVVLREGAVIAHYHKLHLYDAFAMQESRRVDPGQQIPPVIEVAGLRVGLMTCYDLRFPELALSLALNGAQLLVLPAAWVKGPQKEHHWATLLAARALDTTCYIVAAGECGTRNIGLSRIVDPLGTTLAGAGSEPQLIFADLSADDLARVRERLPVLRNRRFAPPQLL

SEQ ID NO: 13083 - protein, 115 aa, Klebsiella pneumoniae
LREKPMFGGKGGLGNLMKQAQQMQEKMQKMQEEIAQLEVTGESGAGLVKVTINGAHNCRRVEIDPSLLEDDKEMLEDLVAAAFNDAARRIEEPQKEKMASVSAGMQLPPGFKMPF

SEQ ID NO: 13084 - protein, 205 aa, Klebsiella pneumoniae
LQENQMVLVTRQAPDFTAAAVLGNGEIVEKFNFKQHTNGKPTVLFFWPMDFTFVCPSELIAFDKRYEEFQKRGVEVVGVSFDSEFVHNAWRNTPVDQGGIGPVKYAMVADIKREIQKAYGIEHPDEGVALRGSFLIDANGIVRHQVVNDLPLGRNIDEMLRMVDALQFHEEHGEVCPAQWEKGKEGMAASPEGVAKYLTENVSSL

SEQ ID NO: 13085 - protein, 137 aa, Klebsiella pneumoniae
PWEKPNTTSPRACWRSPPGCAATSAMRKSSSAPSSRRSSARRCAIICRSAAGVPTPFMPGSASKSAITRAMSKPSSILAIWRSRRRSLASMCTSAARAATTPSICCMACRALYRTSSPLTPPHRGLTAPTAASPVRA

SEQ ID NO: 13086 - protein, 137 aa, Klebsiella pneumoniae
MAWKRELTLAALNASSENTMVAHLGIIYTRLEEGLLEAEMPVDARTHQPFGLLHGGASAALAETLGSMAGWLMTEEGQCVVGTELNASHHRAVSSGKVRGECRPLHLGRQSQSWEIVVYDEKGRRCCTCRLGTAVLG

SEQ ID NO: 13087 - protein, 269 aa, Klebsiella pneumoniae
GNRKPHYRRVRMARVVVITGGGTGIGAACARLMRAVGDRVFITGRREAPLQAVANETGATALVGDAADGEVWRQRLLPAILDQTGGIDVLICSAGGMGNSPAAETSDRQWREALDGNLTSAFASVRACLPSLIARRGNVLFVASIASLAAGPQACGYVTAKHALIGLMRSVARDYGPQGVRANAICPGWVTTPMADEEMRPLMQAEGLSLAEAYQRVCRDVPLRRPASPEEIAEACQFLCSPQAAIISGATLVADGGASIVDVPTLAFA

SEQ ID NO: 13088 - protein, 677 aa, Klebsiella pneumoniae
ATRKPLTKGPRKKTMFGKLTLDAVPYHEPIIVVTVAAIIIGGLALLAAITYFGKWSYLWNEWLTSVDHKRLGIMYVIVAIVMLLRGFADAIMMRSQQVLASAGEAGFLPPHHYDQIFTAHGVIMIFFVAMPFVIGLMNLVVPLQLGARDVAFPFLNNLSFWFTVVGVILVNLSLGVGEFAQTGWLAYPPLSGIEYSPGVGVDYWIWALQLSGIGTTLTGINFFVTIIKMRAPGMTMFKMPVFSWASLCANILIIASFPILTVTIALLTLDRYLGTHFFTNDMGGNMMMYINLIWAWGHPEVYILVLPVFGVFSEIAATFSRKRLFGYTSLVWATVCITVLSFIVWLHHFFTMGAGANVNAFFGITTMIIAIPTGVKIFNWLFTMYQGRIVFNSAMMWTIGFIVTFSVGGMTGVLLAVPGADFVLHNSLFLIAHFHNVIIGGVVFGCFAGLTYWWPKAFGFTLNETWGKRAFWFWIIGFFVAFMPLYVLGFMGMTRRLSQQIDPQFHPMLVIAACGAALIACGILCQLIQFYVSIRDRDQNRDLTGDPWGGRTLEWATSSPPPFYNFAIVPQVHERDAFWEMKEKGEAYKQPAHYEEIHMPKNSGAGIVIAAFATVFGFAMIWHIWWMAIASFIGIVATWIIKSFDEDVDYYVPVAEVEKLEKQHFDEINKAGLKNGN

SEQ ID NO: 13089 - protein, 338 aa, Klebsiella pneumoniae
KTRKAGRKTQRSRMLSPAVCWQSGPLRMTPLETILMEKVSQTPHDAVFRQMLMHQAVAKDFLQLYLPAPFLAICELDSLQLVSGSFVEEDLRASYSDILYSLRTRHGPGYVYALIEHQSTPDKLMAFRLLRYALAAMQRHLDAGHDTLPLVVPILFYHGKVSPWPWARNWQQLFADPALAKALYSNDFPLVDLTVMPDNQIARHRRMAMLELLQKHIRHRDLAELQVPLIALMTQGYLTEAQLNTLLRYMLQAGTTEHPGALIRTLAAQSPRHKELMMTIAEWLEEKGRKQGQQEGEQEGREAATRSIAARMLARGLERQTVQELTGLSDEELAALAP

SEQ ID NO: 13090 - protein, 238 aa, Klebsiella pneumoniae
KYRNRVMKLRITLLTAATLTAFSFAAHAAEKGTIMIMVNSLDNPYYASEAKGASEKAQALGYKTTVLSHGEDVKKQNELIDTAIGKKVQGIILDNADSTASVAAIEKAKKAGIPVVLINREIPVDDVALEQITHNNFQAGSEVANVFVEKMAEKGKYAELTCNLADNNCVTRSKSFHQVIDQYPDMVSVAKQDAKGTLIDGKRHHGQHPAGAPRRERRHLWQRAGSPCRECGAESGQP

SEQ ID NO: 13091 - protein, 161 aa, Klebsiella pneumoniae
TRRKSMNIIEANVATPDARVAITIARFNNFINDSLLEGAIDALKRIGQVKDENITVVWVPGAYELPLAAGALAKTGKYDAVIALGTVIRGGTAHFEYVAGGASNGLAHVAQDSEIPVAFGVLTTESIEQAIERAGTKAGNKGAEAALTALEMINVLKAIKA

SEQ ID NO: 13092 - protein, 131 aa, Klebsiella pneumoniae
KANLPVGFFMGASGALPAHAPGVTFLIPALSGELIWNFTSGAISDRIGRRPVLIGITVLALLTTWPVMHWLTVAPDLTRMTLALVWVLGLSLACINGAKVAALSRSNARYTSAPGGLFAGLLVSLLPFSAT

SEQ ID NO: 13093 - protein, 66 aa, Klebsiella pneumoniae
LMFDTLSKAGKYLGQAAKMMIGVPDYDNYVEHMRITHPDQTPMTYEEFFRERQDARYGGKGGAKCC

SEQ ID NO: 13094 - protein, 379 aa, Klebsiella pneumoniae
ASVDQKLRRASTERVTCFSHRAAGRSGGYSKTESKTDSKTDGPQTSLTPARDAPGGAMEYSKIIKEVGRGKNHARDLDEETARALYARMLNGEVPELELGGILIALRIKGEGEAEMKGFYAAMQQHTLRLTPPAGKPMPIVIPSYNGARKQANLTPLLAMLLHKLGFPVVVHGVSHDPTRVLTETIFTLLDIPATLHAGQAQAQLEGHEPVYIPVGAFCPPLEKQLAMRWRMGVRNSAHTLAKLATPFGEGEALRLSSVSHPEYVPRVANFFRETGGRALLMHGTEGEVYANPQRCPQISLIDEQGVRVLYERQTEMAAEAVVLPTSKDPEVTARWIERCVAGVEPVPNSLKIQLACCLLACGEVTSLEQGLSRVNDCW

SEQ ID NO: 13095 - protein, 337 aa, Klebsiella pneumoniae
HKVENETHLSPFKSGCDDVNFFSFCRRGALTGMLLLLGITSAQAADWPRQVTDSYGTHTLPSQPLRIVSTSVTLTGSLLAIDAPVVASGATTPNNRVADSQGFLRQWSEVAKARKLARLYIGEPSAEAVAAQMPDLILVSATGGDSALPLYDQLKTIAPTLVINYDDKSWQTLLTQLGQITGHEQQASARIADFNKQLVSLKEKMKLPPQPVTALVYTAAAHSANIWTPESAQGQMLEQLGFSLATLPGGLPASHSQGKRHDIVQLGGENLAAGLNGQSLFLFAGDQKDADAIYANPLLAHLPAVAGKRVYPLGTETFRLDYYSALLVLQRLSSLFG

SEQ ID NO: 13096 - protein, 207 aa, Klebsiella pneumoniae
CESETGRWISSFRSWLPMSTRTGSHHRKVNTMKYPTVSVNGVSVRVDGDGRYNFNDLHAAAVAKGEATESQRPSKFLRSAQIKRFIKALQSKAQKSALEQIQPLKVVKGGDEPGVWGVELLAIRYAAWIKPEFEIEVYEVFRTVVRMGIGAMSRLNKIEHIINTETKVISQCASQMAKWGVGGRKQLLHAARDRAADEVQLYLPGIA

SEQ ID NO: 13097 - protein, 126 aa, Klebsiella pneumoniae
AIPDRRALGKRNAWRRNLPVTTGGTMNKQSITPEQFRAVAGTMPACRAADALGISQANFYRLAQSYSISTAFVYKPWKPEEKQIAAEMRDAGESHKSIAMKIGRSVASVSRTLSRMRKADTKRGAQ

SEQ ID NO: 13098 - protein, 397 aa, Klebsiella pneumoniae
LHPEGWTEHMNLHEYQAKQLFARYGLPAPVGYACTTPREAEEAASKIGAGPWVVKCQVHAGGRGKAGGVKVVKSKEEIRAFAEHWLGKRLVTYQTDANGQPVNQILVEAATDIDKELYLGAVVDRSSRRVVFMASTEGGVEIEKVAEETPHLIHKIAIDPLAGPMPYQGRELAFKLGLEGKQVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDNVKAVLVNIFGGIVRCDLIADGIIGAVAEVGVNVPVVVRLEGNNAELGAKKLADSGLNIIAAKSLTDAAQQVVAAVEGK

SEQ ID NO: 13099 - protein, 237 aa, Klebsiella pneumoniae
YLPDQLTGVGVRGKTLLVLAGLLGAGLLGYRNLPPHLNPLAPLALDDPPGWLTSFKLRRLTADQCASLLAEANRRRLIASRPVADSEGSCPLRNVVRVANFGSVQLSSSFLASCPLALSSALYIEQQAKPLTRQLMASDLRQIDHLGSFACRNIYHRQQARRSEHATADALDVSGFRLADGRRVSVLQGWWSETSHPWLAALLSSSCHYFGNALGPKYNAAHANHFHFGMRGQGFCF

SEQ ID NO: 13100 - protein, 109 aa, Klebsiella pneumoniae
PAPDPAARRRRGLPAGRPTPDRRPAAGRSPGLPTADAASLPAADGAHKHAGPLFHRRRGSPPAGADRGPAPRDAREAAGARPDWSFRNSGGSAWSPSAASRYRAPPSAP

SEQ ID NO: 13101 - protein, 171 aa, Klebsiella pneumoniae
SQPDPVADGGQTARHRRDGDPHRRGLYPRHSRHADRPCRRAGHAADRAALPAEDGDCHRAHRHRAGPQRKRPAVAARHSDAAGHRRLSGPADAPSARPPPAARFYPSAAAGGAASGGAVPPVSPVPARAGRSLAAAGPPQRTSAAAAAAQPAGQSLPAAGAQQYVSFPAAG

SEQ ID NO: 13102 - protein, 254 aa, Klebsiella pneumoniae
AMPESIAVSVKNVSKQFDNVEVLRDINLTVEKGTVVSILGSSGSGKSTLLRCMNWLEQPDRGEIHIGGQRLGIDEQRGRAMSHRQLAKIRERVGMVFQSFNLWPHLTVQQNVSEALLRVKGMKRDEAKAMAMQQLEKVGMAHKADVYPITLSGGQKQRVAIARSLAMSPEVILFDEPTSALDPELVNEVLGVMKALAAEGYTMVVVTHEMDFARQVSNEVVFLEKGLLIEKAPPEKFFTQPDSERVRQFLQSSR

SEQ ID NO: 13103 - protein, 315 aa, Klebsiella pneumoniae
QRPEYYCSEKSDGRSTAGCCRSGGEIMSVLINKDTKVICQGFTGSQGTFHSEQAIAYGTQMVGGVTPGKGGTTHLGLPVFNTVREAVEATGATATVIYVPAPFCKDSILEAIDAGIKLIITITEGIPTLDMLTVKVKLDEAGVRMIGPNCPGVITPGECKIGIMPGHIHKPGKVGIVSRSGTLTYEAVKQTTDYGFGQSTCVGIGGDPIPGSNFIDILKMFEEDPQTEAIVMIGEIGGSAEEEAAAYIKDHVTKPVVGYIAGVTAPKGKRMGHAGAIIAGGKGTADEKFAALEAAGVKTVRSLADIGEALKAIIK

SEQ ID NO: 13104 - protein, 354 aa, Klebsiella pneumoniae
RRPDPGGAGGLGGQTQRRRGMSQITLKTSASAEQTASSPLAWLSRAGFGVIILLAIALFGWANPVFLTVDNWANLLQGSAILLIVAMAMTLIVSAGAIDLSVGVALDFGAAFALVALKTWHLPWQAAVGCALLGGVLIGLLNAFLILICRIRPFLATLGTWFIASSAERIYTDGGGAIAYRRMAPEYHDLAVGNLGGIPTPVAIVLALWLAAWLVTERTLWGKYVRAIGQNSESARIAGIRDRLTMLGVLVAASALCAVGGVILSANLRQFTPLAGQSYLMDAIAAVFIGTAFTRLGRVSILGTLGGVLFLAIIDNGLNLMGLNYLVNDALVGVILVVALALSFWQARLRQTHR

SEQ ID NO: 13105 - protein, 192 aa, Klebsiella pneumoniae
LVTDALNFTRNKPMPLPERLQPAKVNRQKLKQLADMAEEILAQIDNGAKEEDTGLKMLINDWNSLVINPYAFSDFRDFSSWTSAKDFTRMAFNQEKYVADLSWDELIQIIQFVCQAEGKESEQSYALGLLEKNFDANPSDLIYWPNEWFQDKDMLHVDLTPEEIAGYLMAKSGRRLSDAPHIELKYPIPSNI

SEQ ID NO: 13106 - protein, 231 aa, Klebsiella pneumoniae
AVTDMNILDLFLKASLLVKLIMLILIGFSIASWAIIIQRTRILNSAAREAEAFEDKFWSGIELSRLYQESQGRRDNLTGSEQIFYSGFKEFARLHRANSHAPEAIVEGASRAMRISMNRELETLETHIPFLGTVGSISPYIGLFGTVWGIMHAFIALGAVKQATLQMVAPGIAEALIATAIGLFPAIPAVMAYNRLNQRVNKLELNYDNFMEEFTDIMHRQAFTTSESNKG

SEQ ID NO: 13107 - protein, 212 aa, Klebsiella pneumoniae
KMAEPTEGRPFPPVNFTGENWLPYTRLIPATEIGEWVNQHILSEEGRIHNPDHIHLLDADVAFMWASGAFEKKGRYVLGQCEQVMLRAGGWQKARMEQQMHEWFGRIPKFIITLAADYCGQCSDLEFCALLEHELYHIAQATDDYGAPKFNKESGMPVLTLRGHDVEEFVGVVRRYGASKDVQEMVDAANRPAEVAHIDVARACGTCMLKLA

SEQ ID NO: 13108 - protein, 154 aa, Klebsiella pneumoniae
RGADMTQTRIVVSPARFSVSEEYPWLAERDEDGAVVTFTGKVRNHNLGDSVKALTLEHYPGMTEKSLAEIVELARERWPLGRVTVIHRIGEMWPGEEIVFVGVTSAHRGSAFAAGEFIMDYLKTRAPFWKREATPDGERWVDARDSDRQAAERW

SEQ ID NO: 13109 - protein, 311 aa, Klebsiella pneumoniae
AFYDTSYVNVIQNNKRIEMNTTLRALSIALAAALIAPSAFAATAAIPTIDFHGYMRAGVGVSGDGSEAEWQKNKLGRLGNESDTYGELELGSEVYKKDDVSFYLDSMVSMVSDGSNDNETTLNDDAQFGLRQLNLQIKGLIPGDPNAVIWGGKRYYQRHDLHIIDTKYWNISGSGAGVENYTLGPGAVSLAWIRGDANDVDYRVDGDSNVNINYIDLRYAGWKPWAGSWTEFGIDYAMPNTTKKQDSYGGLYDADNGVMLTGEISQDMLGGYNKTVLQYANKGLAQNMVSQGGGWYDMWNYVNDATGLSRD

SEQ ID NO: 13110 - protein, 397 aa, Klebsiella pneumoniae
PGHDGTPPWRQDQFFHICRECLYALCAAVRRKFGGRCEYHGRMSYNFQGAVILKMKIPRAVREGVVMKQTVYTASPESQQIHVWSLEADGKLTLVQVVDAPGQVQPMVVSPNKEFLYVGVRPEFRVLAYRITPDNGALTFAGEAALPGSPTHISTDHHGRFVFSASYNQGCVSVTPLHDGLPGETITVVEGLEGCHSANISPDNRTLWVPALKQDRICLFTLSDDGFLSAQEPAEVTTVEGAGPRHMVFHPNQQYGYCVNELNSSIDVWELKDPKGNIECVQTLDMMPPDFSGVRWAADIHITPDGRHLYACDRTASIITVFSVSEDGSVLAVEGYQPTETQPRGFNLDHSGKYLIAAGQKSHHIAVYDIVGEQGLLQEKGRYAVGQGPMWVVVNAH

SEQ ID NO: 13111 - protein, 163 aa, Klebsiella pneumoniae
YAHDRYRYRPSSPSAADAGGSGHRAYCSADGYPPAQENAQRSRHRAGLRRGGSHSRHRPPARRRGPAAAASAGPARQRPHPEAADYAAATDKKRAMPAPRKRSRAPAAPGGRRLPPPGALSPPPSAGAPADRHAAPPGQRRRTPRHTLDAPPPAVLQGEWTAR

SEQ ID NO: 13112 - protein, 359 aa, Klebsiella pneumoniae
AQNDKQEITMNSAWVKHAISEINADYQRSADTHLIRLPLPAFPGIHLYLKDESTHPTGSLKHRLARSLFLYGLCNGWIKEGTPIIESSSGSTAVSEAYFARLLGLPFIAVMPSCTARRKIEQIEFYGGRCHFVQSAGEIYAASETLARELNGHYMDQFTFAERATDWRGNNNIADSIFRQMSHEPHPQPSWIVMSAGTGGTSATIGRYIRSQGYETQLMVVDPQNSVFLDYWQTRDASLRSPVGSKIEGIGRPRVEPSFIPDVVDEMLRVPDAASVATALWLETQLGRKVGASTGTNMWGVLQLAARMRKEGRTGSIVTLLCDSGERYLESYYNPQWVADNIGDIAPWQAEIAGLVERR

SEQ ID NO: 13113 - protein, 626 aa, Klebsiella pneumoniae
TKNESLMSFDIAKYPTLALVDSTQELRLLPKESLPKLCDELRRYLLDSVSRSSGHFASGLGTVELTVALHYVYNTPFDRLIWDVGHQAYPHKILTGRRDKIGTIRQKGGLHPFPWRGESEYDVLSVGHSSTSISAGIGVAIAAAKEDKQRRAVCVIGDGAITAGMAFEAMNHAGDIKPDLLVVLNDNEMSISENVGALNNHLAQLLSGKLYSTLREGGKKVFSGVPPIKELLKRTEEHIKGMVVPGTLFEELGFNYIGPVDGHDVLGLVSTLKNMRDLKGPQFLHIMTKKGRGYEPAEKDPITFHAVPKFDHTSGVLPKSSGGLPSYSKIFGDWLCETAAKDNKLMAITPAMREGSGMVEFSKKFPDRYFDVAIAEQHAVTFAAGLAIGDYKPVVAIYSTFLQRAYDQVIHDVAIQKLPVLFAIDRAGIVGADGQTHQGAFDLSFLRCIPDMVVMTPSDENECRQMLYTGYHYSDGPCAVRYPRGSGTGATLEPLASLPIGKGVVKRQGEKIAILNFGTLLPEAAAVADKLNATLVDMRFVKPLDTALILQLAGEHDSLVTLEENAIMGGAGSGVNEVLMAHRRAVPVLNIGLPDYFIPQGTQEEIRADLGLDAAGIEAKIRDWLA

SEQ ID NO: 13114 - protein, 90 aa, Klebsiella pneumoniae
QMNEMKGAHMQQNGYIPDTANAIAQYFNKASLPSQQETLGQIVMDILNEGRHLNRKALCTKLLSRLDRARAPEEESHYQTLIGLLFAGQE

SEQ ID NO: 13115 - protein, 268 aa, Klebsiella pneumoniae
QKDDSMPEGPEIRRAADKLEAAIKGEPLTNVWFAFPQLQPYQTQLIGQRVTHIATRGKALLTHFSGGLTLYSHNQLYGVWRVVDAGVEPQSNRVLRVRLQTASKAILLYSASDIDILTAEQVANHPFLLRVGPDVLDMTLTAEQVKARLLSAKFRNRQFSGLLLDQAFLAGLGNYLRVEILWQVGLSGKRKAAELSDSQLDALAHALLDIPRLSYRTRGLVDDNKHHGALFRFKVFHRDGERCERCGGIIEKTTLSSRPFYWCPGCQH

SEQ ID NO: 13116 - protein, 246 aa, Klebsiella pneumoniae
KKDENPVIEFKNVSKHFGPTQVLHDISLKINQGEVVVIIGPSGSGKSTMLRCINKLEEITSGDLIVDGLKVNDPKVDERLIRQEAGMVFQQFYLFPHLTALENVMFGPLRVRGASKQAAEKQAKELLAKVGLAERAHHYPSELSGGQQQRVAIARALAVKPKMMLFDEPTSALDPELRHEVLKVMQDLAEEGMTMVIVTHEIGFAEKVASRLIFIDKGRIAEDGNPQELVKNPPSPRLREFLQHVA

SEQ ID NO: 13117 - protein, 176 aa, Klebsiella pneumoniae
LLCEVHHVGHSHRAGLSRRCRYSPSDDGLWLPGRNPRSRETFRQNFFCYYCRAFTSRRSPRMVSNASALGRNGVHDFILVRATAIVLTLYIIYMVGFFATTGEISWEVWTGFFASGFTKVFTLLALVSILIHAWIGMWQVLTDYVKPLALRLVLQLAIVVALVAYVLYGFVVVWGV

SEQ ID NO: 13118 - protein, 264 aa, Klebsiella pneumoniae
PLCEVKEAAMLQISHLSADYGGKPALADINLTLESGELLVVLGPSGCGKTTLLNLIAGFVPYQHGSITLEGQRVTGPGAERGVVFQNEGLLPWRNVQDNVALGLQLAGVDKAQRRQAAAQMLKKVGLEGAEKRFIWQLSGGQRQRVGIARALAANPQLLLLDEPFGALDAFTREQMQTLLLKLWHETGKQVLLITHDIEEAIFMATELVLLSPGPGRVVERLRLDFSRRFVAGESCRSIKSDPRFIEQREYILSRVFDQREAFS

SEQ ID NO: 13119 - protein, 136 aa, Klebsiella pneumoniae
RYRDLAVYTQGDISMKYGIKALMAAGVLVFAVRVQGALAAPASGKAAVNKENVQASSSAKAEAVPGESDNGATKVSINRASAEQLAQALNGVGLKKAQAIVSYREEYGPFKTLDDLKQVPGMGSALVERNLAHLTL

SEQ ID NO: 13120 - protein, 136 aa, Klebsiella pneumoniae
RGGEEGAFSMTPSMYMRLKDLFVAEGLTAGFKVQWRQWRDTGKDTDQFIVFRPSGGTDITFDLGGDWYVMVDVISSKANPDAADAVVNAIVEYISAQSGADDCVGALRLVGNVPAPIATEEGRLVTRLLVSCTYGE

SEQ ID NO: 13121 - protein, 247 aa, Klebsiella pneumoniae
CIFDSVTEECNMQSEEQRLIDGLFSRLKEAEAHSASRDASAEERIAQHVSAQPAAPYYMAQTILIQEAAIKQLNDRIQALESQVSQLQAAKPSSGGFLSGLFGGGGSSRGSDPIPGAEQYGRPQTSAQPQYTPPPQQNYAPQAAARGGGFMAGALQTAAGVAGGVVLGNMLTNMFSGSHPQEIVNIIEEKPQPDAASAQDSIAQDTTAGDDPFRQGDDQFLADNTWNDDFDAGFGDDDFGSDDDSWV

SEQ ID NO: 13122 - protein, 393 aa, Klebsiella pneumoniae
RLLENNSQNHYIYKLANGTHFMARKSVRSLLLTALLATPLLSYATQYPLTVTDLDGRQVTLAKEPQRIILQDGRDIMTLALLDRDNPFKRLVAWNNLAKKQDVATWQMLKTTWPQSATILDMGFSDKGNVDLESVIARQPDLMIAQLRARPALMESGVIDKLSALHVPVLFVDYEIAPAKDTAPSIDLLGKVLNRESQAKAFTDYYRQQLQTIRQKTAAITPKANVFVEALAGNSDACCFTHGHSGWGGLVEAVGANNIGSQLLPGASGFVSLEKIISMKPDAWIMTGSKRGNSQVLPLGYAVKPEAVKAQAQTLLARPGVSQIPAVQEKRAYGVYHHFYNHPWNIVGMEYLAKDIYPQAFGDLNPDETYHYIVRHFTDLPDQPFVFSWQQSE

SEQ ID NO: 13123 - protein, 268 aa, Klebsiella pneumoniae
NLIDDAYSFVFVNDSGPTMTIQNIICDIDGVLMHDNVAVPGAAEFIKRILDKGMPLVMLTNYPSQTGQDLANRFATAGIDVPDSAFYTSAMATADFLRRQEGKKAYVVGEGALIHELYKAGFTITDVNPDFVIVGETRSFNWEMMHKAAFFVANGARFIATNPDTHGRGFYPACGALCAGIEKISGRKPFYVGKPSPWIIRSALNKMQAHSEQTVIVGDNLRTDILAGFQAGLETILVLSGVSTLDDIDSMPFRPSWIYPSVAEIDIF

SEQ ID NO: 13124 - protein, 249 aa, Klebsiella pneumoniae
QPADRGDHQPGTVSQTRRTVIFRGGRPPPVVEKEGLMDAISWQLLIEGAWTTLWISAIAIAFGVVAGLLIALVRMLRLPVIDQLLVVYISLARATPLVTLVLFLFLSLPTMGINLDKNVAAIVALTLNTSAFNAEIWRNAFRTFPREQREAAESVGMRRWTYFRYIMLPQMWIESLPALVNEMSFLIKGSPAIAVIGVVDLTRVTNRISSVTYEPLSPILAAGLLYVAIIGCLLKLQGIAERKARRLAR

SEQ ID NO: 13125 - protein, 355 aa, Klebsiella pneumoniae
EVYDLLERKMAHQPRWTMSQVTELFNKPLIDLLFEAQQIHRQHFDPRQVQVSTLLSIKTGACPEDCKYCPQSARYKTGLEAERLMEVEQVLESARQAKNAGSTRFCMGAAWKNPNDRDMPYLEQMVRGVKDLGLESCMTLGTLTDSQAQRLAEAGLDYYNHNLDTSPEFYGNIITTRTYQERLDTLDKVRDAGIKVCSGGIVGLGESVKDRAGLLLQLANLPTPPESVPINMLVKVKGTPLADNDDVDAFDFIRTIAIARIMMPTSYVRLSAGREQMNEQTQAMCFMAGANSIFYGCKLLTTPNPEEDKDLQLFRKLGINPQQTAVLEGDNEQQQRLEQALLTPDTEEYYNAAAL

SEQ ID NO: 13126 - protein, 272 aa, Klebsiella pneumoniae
KWHDFFIRLVVLAGDRPVDIKGNAMKSVFKVSLAALTLAFAVSSHAANKTLVVATDTAFVPFEFKQGDKYVGFDVDLWAAIAKELKLDYTLKPMDFSGIIPALQTKNIDLALAGITITDERKKAIDFSDGYYKSGLLVMVNANNNDIKDVKDLNGKVVAVKSGTGSVDYAKANIKTKDLRQFPNIDNAYMELGTGRADAVLHDTPNILYFIKTAGNGKFKAVGESLEAQNYGIAFPKGSDELREKVNGALKTLRDNGTYNEIYKKWFGTEPK

SEQ ID NO: 13127 - protein, 895 aa, Klebsiella pneumoniae
MSDEPLRPDPDRLLQHTAAPHRGKLKVFFGACAGVGKTWAMLAEAQRLRAQGLDILIGVAETHGRKETAAMLQGLSTLPPRRLAHRGRYVYEFDLDAALARRPALILVDELAHSNAPGSRHPKRWQDVDELLEAGIDVFTTVNVQHLESLNDVVSGITGVQVRETVPDPFFDAADDVVLVDLPPDDLRQRLNEGKVYIGGQAERAIENFFRKGNLIALRELALRRTADRVDEQMRAWRDRQGQEKVWHTRDAILLCIGHNTGSEKLVRAAARLAARLGSVWHAVYVETPSLHRLPEGRRRAILAALRLAQELGAETATLSDPSEEKAVLHYAREHNLGKIVIGRQSKRRWWDRSGFADRLARHAPDLDLVVIALDEKPFPLAARASDSRPALEKWRLQLQGCAVAVALCAIITLVAMQWLMAFEAANLVMLYLLGVVLIALVYGRWPSVLATVINVISFDLFFVAPRGTLAVSDVQYLLTFGVMLTVGLLIGNLTAGVRYQARVARYRERRTRHLYEMSKALAVGRSQQDIATTSERFIASTFQARSQLLLPDAQGKLLPLTHQPGLTPWDDAIARWSFDKGQPAGAGTDTLPGVPYQILPLKSAARTWGLLVVEPENLRQLMIPEQQRLLETFTLLVASALERLTLTASEEQARLTSERESLRNSLLAALSHDLRTPLTVLFGQAEILTLDLASEGSKHAPQANEIRQHVLNTTRLVNNLLDMARIQSGGFNLHKEWLTLEEVVGSALRMLEPSLGGQHIQLDLPDPLQLVHVDGPLFERVLINLLENAHKYAGARASIGIRAEADARQLSLEVWDNGPGIPAGQEQTIFDKFARGNKESAIPGVGLGLAICQAIVDVHGGTISASNRPEGGASFRVTLPGETPPELEELPEEL

SEQ ID NO: 13128 - protein, 116 aa, Klebsiella pneumoniae
RSRDVDPAEPRVSHRQSAGYRRHPASGRPGALPGQPGAGGDGRPGDGLRRAAVAGAGAGRYASTPSGAGGLAHAGGRKIAAARYAVGGVCPAGAGFRPGGGDRRGSGAGDAADESL

SEQ ID NO: 13129 - protein, 257 aa, Klebsiella pneumoniae
PQRLAVGQLVEEKDCVMITLKNVSKWYGHFQVLTDCSTEVKKGEVVVVCGPSGSGKSTLIKTVNGLEPVQQGQIIVDGTVVNDKKTNLAKLRSHVGMVFQHFELFPHLSIIDNLTLAQVKVLNRDKASARKKGLKLLERVGLAAHAEKYPAQLSGGQQQRVAIARALCMDPIAMLFDEPTSALDPEMINEVLDVMVELANEGMTMMVVTHEMGFARKVANRVIFMDEGKIVEDADKEAFFANPQSERAKDFLAKILH

SEQ ID NO: 13130 - protein, 90 aa, Klebsiella pneumoniae
QCGDEAGTGCLREGAGMKFIKLSQRGTVERQGKYGWEPETVYEPVFVAAGHIVSMFFAGVTILKMTSGERIDVKETPEEIIAMLTEGASK

SEQ ID NO: 13131 - protein, 367 aa, Klebsiella pneumoniae
HSSLFACVKRYGDLAATPPVVARAWKEMTASPVFGKVYMASQLTDAFARKFYYLRLSITDVCNFRCTYCLPNGYKPGAVNNNGFLSVDEVRRVTRAFSALGTEKVRLTGGEPSLRRDFTEIIAAVRENPAIRQIAVTTNGYRLARDVERWRDAGLTAINVSVDSLDARQFHAITGQDKFHQVMDGIDAAFAAGFDKVKVNTVLMRDVNHHQLDTFLAWIQPRRIQLRFIELMETGEGSDLFRRHHLSGMVLRDELLRRGWIHQIRQRSDGPAQVFCHPDYAGEIGLIMPYEKDFCATCNRLRVSSVGKLHLCLFGEGGVDLRDLMAEDQQQAALEARIAEALTHKKQTHFLHQGNTGITQNLSYIGG

SEQ ID NO: 13132 - protein, 513 aa, Klebsiella pneumoniae
QVIDAHQGSGLPLPFFTLQGEHMKTPSQPRAIYYIVAIQIWEYFSFYGMRALLILYLTHQLGFDDSHAISLFSAYASLVYVTPILGGWLADRLLGNRTAVIAGALLMTLGHVVLGVESTSAWSLYVALAIIICGYGLFKSNISCLLGELYAHDDPRRDGGFSLLYAAGNVGSIAAPIACGLAAQWYGWHIGFALAGIGMFIGLMIFLSGSRHFRHTRGVDKPALRAVKFVLPTWGWLLVMLCLAPVFFTLLLQNNWSGYLLAIVCLFAAQMVARIMIKAPEHRRALWQIVLLMLAGTLFWVLAQQGGSSISLFIDHFVNRRLLNWDVPTALFQSVNAIAVMAAGVVLAWLMRPEGSVRSVLRVWLKFSFGLLLMGGGFMLLALNARHGAADGQASMGMMVAGLAMMGFAELFIDPVAMAQITRLNMPGVTGVLTGIYMLATGAVANWLAGVVAQQTTESQISDTAIAAYQHFFAQMGEWTLGCVAVMVIIAFAAACSVGKRRAAAGEITGGGA

SEQ ID NO: 13133 - protein, 544 aa, Klebsiella pneumoniae
  UNSURE (519): Identity of amino acid at the above locations are unknown.
RPSELPHLIKTAYKYEFLNKAVQKILFFHCSTITVAFFLFPAAKPLRLLPLYGIFLSTHSGFATRRSQHNIKHDRVMEKAMCSIFGVLDIKTDAGELRKKALELSRLMRHRGPDWSGVYASDKAILAHERLSIVDVNAGAQPLYNAEKTHALAVNGEIYNHQALRAEYGDRYQFQTGSDCEVILALYQEKGPEFLDDLQGMFAFALYDSEKDAYLIGRDHIGIIPLYMGHDEHGNFYVASEMKALVPVCRTIKEFPAGSYLWSKDGEIRQYYQRDWFDYDAVKDNVTDKNELRQALEESVKSHLMSDVPYGVLLSGGLDSSVISAITKKFAARRVEDQERSEAWWPQLHSFAVGLEGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLQALHMFDCARANKAMSAWGVEARVPFLDKNSSTSRCALTRRIRCAATAKWKNTFCANALNXTCRPASPGARRSSSLTASATAGSIP

SEQ ID NO: 13134 - protein, 70 aa, Klebsiella pneumoniae
NNGLIVQVTLGLENTVDGERHDGGLINQFITGVTEIVGERGVLQSCVNIWLLMHSLSHHILTLFNSPWLG

SEQ ID NO: 13135 - protein, 252 aa, Klebsiella pneumoniae
AVPDTRFFIRNNLISASRHGARLTVAGELLLQRASEVLASYDNFRTDVSSIQQGLVGKLTVGFGISSFRVAPEKVAIFRALYPDVQVSLNDMSSAVQFQKLAEGQLQTGFVRLPAPERLESKILAEEKLVLAVAHEHDTELSSAAELLGSRKLLQLSRDRGEGLSEQILRFLSLRQLTPQTVFPADDIQTLLALVATKNGVALLPAGVFHILPCGVRLIPLEGEHTTWQTGIAWNPQIKDPVRDNFINIVTP

SEQ ID NO: 13136 - protein, 171 aa, Klebsiella pneumoniae
VITESSTPLGIRRAIPATSWRLNAEPPPPTFMRKIPNMTIQYIKDEEGKDQYVVIPYSDYFRMRLALLEYDDEDESDWEDIPYESDIYDDVMLPGEVCDVMHKENVSLQAAWRILRGMSQQEVAEKLGISQSAVSQLEALDSRPQKRTREKLAAIYGCTQEQISLYLPKEG

SEQ ID NO: 13137 - protein, 180 aa, Klebsiella pneumoniae
SFTENMSEFALIILYAHYKEACYEDGISPGGNMFKALTAIVALAASASVMAQSDVTLNSLAHDAATRASFNQMVKGHQLPAWVTTGGTGSPAQTVKLGSESWQVLSACKPHDCGHERIAVIWSEKSKQMSGVYSVVDEKTDQEKLTWLNVSDALSIDGKTVLFAALSGSLDNHPDAFNYQ

SEQ ID NO: 13138 - protein, 322 aa, Klebsiella pneumoniae
TPTERRNILKRFGTSFNAFRLNLNSGITMKKTLLAAGAVVALSTTFAAGAAENDKPQYLSDWWHQSVNVVGSYHTRFGPQIRNDTYLEYEAFAKKDWFDFYGYIDAPVFFGGNSTAKGIWNKGSPLFMEIEPRFSIDKLTNTDLSFGPFKEWYFANNYIYDMGRNDSQEQSTWYMGLGTDIDTGLPMSLSLNVYAKYQWQNYGASNENEWDGYRFKVKYFVPLTDLWGGSLSYIGFTNFDWGSDLGDDNFYDLNGKHARTSNSIASSHILALNYAHWHYSIVARYFHNGGQWADDAKLNFGDGPFSVRSTGWGGYFVVGYNF

SEQ ID NO: 13139 - protein, 70 aa, Klebsiella pneumoniae
YGQEHHHLTFFLHGRTTKTLYRRHCLKTTTTLKCSQKPYHFQAYLTQPLLLPGWLRQLVLSSSEHFYEIP

SEQ ID NO: 13140 - protein, 474 aa, Klebsiella pneumoniae
NVKEDMHMRTFSGKRSTLALAIAAVTAMSGWVVAPQASAAGFIDDSTLTGGIYYWQRERDRKDVTDGDKYKTNLSHSTWNANLDFQSGYAADMFGLDIAAFTAIEMAENGDSGHPNEIAFSSRNKAYDEDYSGDKSGISLYKAAAKFKYGPAWARAGYIQPTGQTLLAPHWSFMPGTYQGAEAGANFDYGTAGALSFSYMWTNEYKAPWHIEMDDFYQNDKKTKVDYLHSVGAKYDFKNDLVLEAAFGQAQGYIDQYFAKASYKFDVAGAPLSTSYQFYGTRDKVSNGGVNDIYDGTAWLQALTFGYKVADVLDLRLEGTWVKADGQQGYFLQRMTPTYASSNGRLDIWWDNRSDFNANGEKAVFFGAMYDMKNWDMPGWAFGASYVYAWDAKPGRMSSPDAYYDPDYRLKESAYSLDAMYTVQEGRAKGTLFKLHFTQYDNHSDIPSWSGGYGNIFQDERDVKFMVIAPFTIF

SEQ ID NO: 13141 - protein, 93 aa, Klebsiella pneumoniae
RNEEVSMKAHIHPPYRTVVFHDTSANEYFKVGSTIRTDRVIELDGETFPYVTIDVSSKSHPYYTGKQKTFANEGSAARFRQRFGGFIDAKRKA

SEQ ID NO: 13142 - protein, 416 aa, Klebsiella pneumoniae
NLEDPADLPGDFRAGSHVGAGRGKKRAAGADSRRPFAGRQPGAGAVAGDPARRAAGDPHRAAHWSRGGLVNAGGRRADRRHPRIRIYGAVCRRVSRHRCGAGGDRGDCHYRLFTGTGSARAAAAPDALAWRSTMSERLSITPLGPYIGAQVSGADLTRPLSDNQFEQLYHAVLRHQVVFLREQNITPAQQRDLALRFGDLHIHPVYPHAPGVEEIIVLDTHNDNPPDNDNWHTDVTFIDTPPAGAILAAKELPTTGGDTLWTSGIAAWEALSEPFRQLLSGLHAEHDFRKSFQEYKYNKTEAEHRRWQEAVAKHPPLLHPVVRTHPVTGKQALFVNEGFTTRIVEVSEKESAALLNFLFAHVTKPEFQVRWRWQPNDVAIWDNRVTQHYANADYLPQRRIMHRATILGDKPYYRAG

SEQ ID NO: 13143 - protein, 151 aa, Klebsiella pneumoniae
GRRDTANRPVRRYVRATGGRFRTDYGSLIMGAKVRGIRQAKANLDRIIKDVQGRKVVRAVQSAMLIGSAQAALYTPIDTSTLINSQFREIMANGTRVTGRVGYSVNYAVYVHDPAVKQNFTRATARKEFLTKGFEDTRSQIDAVVKKELSL

SEQ ID NO: 13144 - protein, 161 aa, Klebsiella pneumoniae
RERDPGRNHRHAYRRSLQMTITLQAVNELIQSLESAGELSIREQKFLKLAKAYQQLAAENVALKDINAWCKTDAFKNMYREFKTAEALGCSDADCMHDAMLVAIMHAPATPATDRIVAEAEARGVEKFAAHLRANDNGASVCKMIALGADDFAKQLRKGAK

SEQ ID NO: 13145 - protein, 96 aa, Klebsiella pneumoniae
FQGDCRMKKVIVALALSAVAFGASAAQLITKEEVKHFKLTKVGPISVGPSGGEFSSPSDLHDQLSKLADEKGGKYYVITAAREHGPNFEATAEVYK

SEQ ID NO: 13146 - protein, 75 aa, Klebsiella pneumoniae
GSLDISIIRDRCSMYFYQPSQGHGLPHDPLNAIIGPRPIGWIASQDAEGQRNLAPYSFFNCFNYRPPIIGFASSG

SEQ ID NO: 13147 - protein, 432 aa, Klebsiella pneumoniae
PVLERLSWKRLALELFLACIPALILGAFVGHLPWFLLAAVTGLLIWHFWNLMRLSWWLWVDRSMTPPPGRGSWEPLLYGLHQMQMRNKKRRRELGSLIKRFRSGAESLPDAVVLTTEEGAIFWCNGLAQQILNLRWPDDSGQNILNLLRYPEFANYLKQRDFSKPLNLVLNNARHLEIRVMPYSDKQWLMVARDVTQMHQLEGARRNFFANVSHELRTPLTVLQGYLEMMQEQVLEGATREKALHTMREQTQRMEGLVKQLLTLSRIEAAPALAMNDRIDVPMMLRVVEREAQTLSQEKQTLIFTVDEQLKVLGNEEQLRSAISNLVYNAVNHTPPGTEIRVSWQRTPQGALFSVEDNGPGIAPEHIPRLTERFYRVDKARSRQTGGSGLGLAIVKHAVNHHDSRLEIDSTVGKGTRFSFLLPERLIAKNDA

SEQ ID NO: 13148 - protein, 186 aa, Klebsiella pneumoniae
GGPEMSEFSRETLLNIIETDHVQCGEASALARIALAAMDSETVEMPLDYLQGHKDGLEWAARLAEANHPDTGDWLYDDPIELAKAIRKGPDMPPVQPVADSEPDRNPVLAYADSYRDMAKQGVESVPIWCVITDLERNIAPLYRHAQPVTVVPDKMTAIVKDEAEYVEGWNACRAAMLAAAQQEGK

SEQ ID NO: 13149 - protein, 69 aa, Klebsiella pneumoniae
AVAETAGIMQWQNRSSVHSKKSASGSGYIKPGTWPGRDIFDYIEVFYNRNRRHSHLGGVSPEAFEKASP

SEQ ID NO: 13150 - protein, 119 aa, Klebsiella pneumoniae
ACQDANSKKAHRSELFCIEMAGVRGFEPRNAGIRIRCLTAWRYPNCLLRLTVTTPVEGNSAFTAERLLNLAGVRGFEPRNAGIRIRCLTAWRYPNKLFADLSMRIDTSRIWWLRRDSNL

SEQ ID NO: 13151 - protein, 299 aa, Klebsiella pneumoniae
AMQDEMYMARALKLAARGRFTTHPNPNVGCVIVKDGEIVGEGFHYRAGEPHAEVHALRMAGEKARGATAYVTLEPCSHHGRTPPCCDALIAAGVSRVVAAMQDPNPQVAGRGLYRLQQAGIEVSHGLMMNEAEALNKGFLKRMRTGFPWVQLKLGASLDGRTAMASGESQWITSPQARRDVQRLRAQSHAILTSSATVLADDPALTVRWQELSADTQALYPEENLRQPLRVVIDSQNRVTPEHRIVQHAGETLFARLRADERQWPESARTLLVPEHNGPSRSGAADDAAWQTADQQRLG

SEQ ID NO: 13152 - protein, 144 aa, Klebsiella pneumoniae
ATQDARSLLERGVLCVARDCLRLRHRGRRRRSPGSFDHAYPPRYIRLISGLVSISRAAPDKVIRPFSRTYARSAIASAAVAFCSTSSTVIFSSRSCLMMPNSSPTIFGASPRLGSSSINNTGSLISARAMASICCSPPLMVPAI

SEQ ID NO: 13153 - protein, 244 aa, Klebsiella pneumoniae
MDKDREMTAKYLQIAREIKKRIISQQYPASAPLPDQFALAAEFSTSRMTIQQAMRQLIVEGLIYTRKGQGTFVRKNFLQLSQWELPGSDYFGATKTWEHLGEVQSEVVRFAVRFPSDKEQSSLLIDADAPVYDFVRLRLLNGEPVSLDLTVMPVGLVPGLTKSHLEGSVFRYVQETLGLKLMGSYRVVRAMKPGELDKQHLHCEPTDPVLEVEQVIYLEDGTPLEYAHCHYRYDHGGIILVNNG

SEQ ID NO: 13154 - protein, 112 aa, Klebsiella pneumoniae
HPEEGSLMFRLVVHVDVKKELQALPPIVQAKMIRQLDKLRQNPTALREPDSKPLGQGLFEIRALGSVQGRGIYVFQQGKTLFLLRVFVKKTQKTPSSEIRLALKRLEEMRNE

SEQ ID NO: 13155 - protein, 418 aa, Klebsiella pneumoniae
LVWEMLDQFRLGQKNRLAKRYLCKFFHEMSEIAYLTAEFACNVCFGDYENSFIFQSELDHKMDKKLRVAEIAARTGLSPSTVSRVLAGKANTSDKARRAVLECARELGVMQGLAAGRLLLNHLLVFAPQRAFDERSDIFYYRVIQSINNALAAHEVRLRYCALDENDSDANLFLARMNEPETQAAVLLGIDDPHIHGLAADLGKPCVLINCRDEGMRLPSIAPDHRLIGQCAARYLFDMGHRAVMNVMCLRRYTMELRLGGIQEAWRARNLRFTASRDLISVANFSARETEEQVGAWLDGLQGRPLPTAFLVGGDFMAAGTVSALQKRGLRVPQDVSVMSIDGFNLAAIQEVPLTAVHVPRDELGSEAVHLLQQRLLRPEAPHGSLLLHGTLVVRDSVRRIRPGKGHTAVEPQGLYDD

SEQ ID NO: 13156 - protein, 202 aa, Klebsiella pneumoniae
SGRDGHRRRRGYGAFFQCHPLAALRAVCCPPPAAPRLAAATRRTGAASGQWQCAGRPSAAIRPRRRRAFSAQCPGGPAAAGSAGRVRRGAAQRRRGDSRRSWRRGAGLRRFSPRSPAAGAGGAPRGGGLRPFLRRTAGQSGRGDQAWRIRRRPVRHFPAPPAGLGAGVPRHSGQRPAANVSSSGGARQTRGDRRPAQRQTFC

SEQ ID NO: 13157 - protein, 320 aa, Klebsiella pneumoniae
LLRDDTMAHSHSHSSVQAPDNSNARRLLWAFIVTAGFMLIEAVGGAISGSLALLADAGHMLTDSAALLFALLAVRFASRPPNARHTFGWLRLTTLAAFLNAIALVVITMLIVWEAIQRFQHPQPVAGVTMMVIAVAGLLANVLAFWILHRGSEERNLNVRAAALHVLGDLLGSVGAIVAAVVILTTGWTPVDPILSVLVSCLVLRSAWRLLKESLNELLEGAPRSLDVAALQRDIRRSIPEVRDVHHVHVWLVGEKPVMTLHVQVVPPHDHDALLNRILHFLEHKYEIAHATVQMEYQPCSGPECHLNTMHAGHDHHHHH

SEQ ID NO: 13158 - protein, 227 aa, Klebsiella pneumoniae
PVRESIMGNTLTIFDLDNTLIQGDSSTVWSQFMVREGLATQKGYLAREARLMADYDRGEMNIADYVALIQAPLAGIPKSDVDALVARCVREAILPRVYPQAWELIRRLRAEGEQMLIISASVSLLVQAVAAALEIDQALGIDVAMVDGGYSGEITGIPSYQQGKVARLAQWREAHPQYDGEVTFYTDSINDLPLCLHADRVRLVNPCPQLQAAGAGYGWPVLSWRLE

SEQ ID NO: 13159 - protein, 398 aa, Klebsiella pneumoniae
CGRDGTSRERRDAGDVPEIYPNTGISGSMTLPFVQSLLRDRFLHLLLIIACVLSAIVPFVPASWPAAIDWHTIVTLSGLMLLTKGIELSGYFDVLGRKMARRFVTERQLAIFMVLAAALLSTFLTNDVALFIVVPLTLTLKKWCAIPVNRLIIFEALAVNAGSLLTPIGNPQNILLWGRSGLSFFGFIGQMLPLAAAMMLTLLALCWFCFPAKRLSYQSSDRTPSWQPKLVWSCLGLYVVFLTALEMNQALWGLALVLLGFLVLARAVIVHVDWSLLLVFMVMFIDVHLLTQLPALHQVLSGVGTLSGGGLWLTAIGLSQVISNVPSTILLLNYVPPSILLAWAVNVGGFGLLPGSLANIIALRMASDRRIWWRFHLYSIPMLLWAALSGYWLFKLCA

SEQ ID NO: 13160 - protein, 64 aa, Klebsiella pneumoniae
YRREIAQRPVKPGAGKSVILLAAIFVAYAGEEVEHFAKTVNQSQDDRHHHRYHDDRKNQTFQKL

SEQ ID NO: 13161 - protein, 391 aa, Klebsiella pneumoniae
RRSFMSITLRGGVWHCHFFTPSGKRVRRSLGTGDKKQAQELHDKLKAEAWRVDQIGDLPVRTFEECCIRWLREKDHKRSLDDDKTKIEFWLQHFSGRDVSKITAEEVHEAVNGMINRKHLQVWESKRDAAVRKGKPVPEYKPRQVSQATKAQHLSFIRSLLRAAANDWGWIKTAPVIKTRKPISKRIRWLTREEAERLIECMPESIKPVVIFALATGLRRSNIIGLEWQQVDMQRKVAWVNPENAKAGKAIGVALNDTACRVLRDQIGKHSRWVFVHTTAKHRPDGTLTPAVRKMRVDDNNAWRAGLKKAGIEDFRFHDLRHTWASWLIQSGVPLSVLQEMGGWESIEMVRRYAHLAPNHLTEHARKIDAIFGASDTNTTQGGNQAGLKLA

SEQ ID NO: 13162 - protein, 434 aa, Klebsiella pneumoniae
DFILSNERYSEVIMAALPTHETLPADHKAAIRQMKQALRAQIGDVQAVFDKLSARISERLQEIETLKAAGQEVWPTVPFRDIAEGTVSDEQRAAIKRRGCAVIKGHFPREQALAWDTAMLEYLDRNHFDDVYKGPGDSFFGSLEASRPEIYPIYWSPSQMQARQSDEMAAVQSFLNRLWRFEQNGKRWFDPDVSMIYPDRIRRRPPGTTSKGLGAHTDSGALERWLLPAYQQVFANVFNGNIDAYDPWDAAHRTEVEEYTVDNTTKCSVFRTFQGWTALSDMIPGQGLLHVVPIPEAMAYVLLRPLLDDVPEDELCGVAPGRVLPISEQWHPLLIKALSSIPALNAGDSVWWHCDIIHSVAPVENQQGWGNVMYIPAAPMCEKNLAYAQKVKIALEKGASPGDFPREDYEASWQGRFTVEDLNIHGKRALGMPV

SEQ ID NO: 13163 - protein, 495 aa, Klebsiella pneumoniae
TIGLVMDHRMTVEEGAAAGVFAGQTNRNTFVNQRGVGQVFSAAPVKQLLACRHRLAVGVNFRHAGLHFDTFRYRADAFGQLLQTFRLNFIRIALVPLVVEVRRPGKGMHIHRTPFLHHAFAGIQRIAVEVNLLGRIFQSRHLLLLQLVSIDFARSRMLFDLLIHQRLGCARLIGFVVAVTAVAHQINEDIAFKGIAEIKRQTGDEGDRFRIVRVHVENRRLHHFTDVGAVRRRARIQRVRGREAHLVVDNDAHGTAHFVTAGFGHVQSFLNHALAGDGGVAVDGNRQNFVAAWLVQTIQTGAYGTDNHRADDLEVRRVKRQRQVHQTAFGFHIGREAHVVLHVAGAEVFFMFARELVEQVLRFFTQHVDQHVETAAVRHAQHHFAGAAFACMADHLFEHRDQGVATLQREALRPREFGAEVALQTFRGGQFAEEAFFLFRGKARFASYRFNALLDPAFFFGRGDMHVFRADGAAVGLLEGGNQLAQLHRVFTDGK

SEQ ID NO: 13164 - protein, 488 aa, Klebsiella pneumoniae
RAGFFQPRANHAQQILQHKARRAGAGVNRRQDKQRLKQNGEVVPERDIHQPAQRAVQDVGHPHRQRWRAAGAGDNRLFADLAGDLMQRIRRNAKAPAAHHLRCRGDDIGGTRRRQHRHRAVHREVDARIDNTGRHQRHNSDEGFHQHAAVADKAGLAFVGQHFRRGAGGDQRMEAGDRAAGDGDKQEREQVAGPYRAGTIDELGQRRHRQGRAHNQDANRQPHDGADFQEGGEIIARGQQQPDRQYRSHKSVAHQDPGQLYAGVIKPRRPGRAFRHPAAGDDGEHQHHQAYHRHLADASRTQIADVDAHKDRQRNGKGDGVCPPRTVGQRFHHNHRQDREDDHHDHKAGHQRQDASGRSHLLFNQFAKRTAIAAGRNKQHHKVLYRPSQHHAGEDPDHPRQVAHLRGEHRAHQRPRAGNGGKMVTEQHFFVGWNVVEAIVMPHRGRHPRRVNAEHGFSDIQAVETIRDQINADRGDDNPQRVYLLTPV

SEQ ID NO: 13165 - protein, 456 aa, Klebsiella pneumoniae
SQPLRHERGQGMKLAIHNEVAVSNDEVRQLDRAYVFHSWSMQGNLNPLVIAGAQGCELWDYEGNTWLDFSSQLVNVNIGYQHPRVLAAMKSQLETLVTIAPATANLARGEAAKRIVDLAPAGFSKVFFTNAGADANENAIRMARLYTGRDKVLSAYRSYHGNTGSAIAATGDWRRVPNEFSRGHVHFFNPYLYRSEFNAATEEEECQRALAHLRRIIECEGPTAIAAILLESIPGTAGILVPPAGYMQGVRALADEFGIVLILDEVMAGFGRTGSWFAFEQDGVVPDLVTFAKGVNAGYVPAGGVLISEPIARYFDDHFFAGGLTYSGHPLAMAAIVATIDAMKEENVVENAASIGNEVLRPGLEALAEKHAIIGEVRGRGLFQALELVSSREQKTPLTAADMAAIKGALTEAGLLAFVVENRIHVVPPCTITAEQVAQGLAIFDAVFARFASLAK

SEQ ID NO: 13166 - protein, 255 aa, Klebsiella pneumoniae
LTTLTILTTEQDVIMQEAISLWPLIGIAVIVVGFVLRFNPVLVVIISGIVTGVAAHMPIATILEKLGEGFLNTRNLPFILLLPLAVIGLLERHGLKERAQAWIAKIHSATAGRLLIVYLFVREATAALGLTSLGGHPQMVRPLLAPMAEGAAEKRFGPLPGNVRYRLRAMSAATDNVGLFFGEDIFVAFGAIIFMHNFMLESGGIQTEPLHIALWGIPTAICAFLIHAARLWRLDRHLQRELDRINAGQAKGGAA

SEQ ID NO: 13167 - protein, 137 aa, Klebsiella pneumoniae
SPGLAGRWATCPPPRSAPPAWCCWCCSCTIRRRAAASRPSTSSAMNRRRRSKPAARCLKTSCWRCATRRCGPSPSPPPLCTSTATPSTHGGSSFWSRIKLIPRWRRPGLSASTLSPASPGPSSPACSPTAFSRATAA

SEQ ID NO: 13168 - protein, 349 aa, Klebsiella pneumoniae
RSFWRNIPLPFQLHYRLSFHKIRQTMTDLITRPRRLRQSAALRALFEETTLSLNDLVLPIFVEEEIDDYKAIEAMPGVMRIPEKYLAREIERIANAGIRSVMTFGISHHTDATGSDTWNENGLVARMSRICKSTVPEMIVMSDTCFCEYTSHGHCGVLCDHGVDNDATLENLGKQAVVAAAAGADFIAPSAAMDGQVQAIRRSLDAAGFTNTAIMSYSTKFASSFYGPFREAAGTALKGDRKTYQMSPMNRREAIRESLLDEAQGADCLMVKPAGAYLDILRDIRERSDLPLGAYQVSGEYAMIKFAAQAGAIDEEKVVLESLGAIKRAGADLIFSYFALDLAEKKILR

SEQ ID NO: 13169 - protein, 208 aa, Klebsiella pneumoniae
DYLCYFRWLLNQSGNRKVLMLRRFSLFSLGFLGWLLVSGNASASFSSTLSEGYHTLSNNVAQTWNEPEHYDLYVPAITWHARFAYDKEKTDKYNERPWGAGFGVSRWDEKGNWHGLYLMAFKDSFNKWEPIGGYGWEKTWRPLTDQNFHLGLGYTLGVTARDNWNYIPIPVILPLASIGYGPATFQMTYIPGTYNNGNVYFAWARIQF

SEQ ID NO: 13170 - protein, 159 aa, Klebsiella pneumoniae
SMKLISHDLQDGGKLPNRHVFNGMGYDGDNISPHLMWDDVPAGTKSFVVTCYDPDAPTGSGWWHWVVANLPADTRVLPQGAGSGQAELPEEAVQTRTDFGKAGYGGAAPPKGETHRYIFTVHALDVEKIEVDAEASGAMVGFNVHFHSLASASITALFS

SEQ ID NO: 13171 - protein, 330 aa, Klebsiella pneumoniae
GGIWLLFSLFAAALKAANPVVTLTYRLTDRETTMADFPPVASLRSFEAVARLGSVTQAAHELSVTHSAVSQHIKQLEALVGVTLFIRHGRGVRITEEGRLYALQIREALQHIADATRMVQIKPRTLEVSLATLPSFGCHWLLPRLARFQARHPQIAVRLLTSLAVVNLQQEGIDLAIRMGQGDWEGMESRHLFADEQLVVAAPGYRGGNLPTTPQAIAASDIIFSMESWNAWCSQAGLEKPLVPSGLRLNDSNLVLEAVRLGAGVALERRSLVAGAIARGELVQLTAVTVPYPWHYWLTVSPQAENRPEVARFIAWLEEEIALWRQQISA

SEQ ID NO: 13172 - protein, 275 aa, Klebsiella pneumoniae
HMYWIINKNIEFWPENKRLISLKNPAQSVTLTAPASHCLVLLLEATPELVSQQVFFKKVWEDEGILVPANTLYQNISIVRRGLRDVGETDNSIVVTVPRKGFHINPNVNVERMDEKPLNSETYNNITIISQDDVAEKNPTTESGDIVQTATRKNIGAKATTFLIMLLSLLAGCLSFHYIWHFHDEKPFFSSYTLVENDRGCHFYTKDDNHAKVDKFNYYKSLIFKSGLDCKKYPFVYFSMSQMSPGFIVFICRKSYSEKVSAGCVTLSFRGIVYE

SEQ ID NO: 13173 - protein, 66 aa, Klebsiella pneumoniae
RNHCFFHNILSHVSCYESHSGWHNESGMTLGISLKNVFDLQPWQKMLPPRAPCRRWHNFQHVCYIL

SEQ ID NO: 13174 - protein, 878 aa, Klebsiella pneumoniae
HIHWLHFVAVLKTGPLAAMQEQYRPEEIESKVQLHWDENRTFEVTEDESKEKYYCLSMLPYPSGRLHMGHVRNYTIGDVIARYQRMLGKNVLQPIGWDAFGLPAEGAAVKNNTAPAPWTYDNIAYMKNQLKMLGFGYDWSRELATCTPEYYRWEQKFFTELYKKGLVYKKTSAVNWCPNDQTVLANEQVIDGCCWRCDTKVERKEIPQWFIKITAYADELLNDLDKLDHWPDTVKTMQRNWIGRSEGVEISFDVNDYADKLTVYTTRPDTFMGCTYLAVAAGHPLAQQAAANNPALATFIDECRNTKVAEADMATMEKKGVDTGFKAIHPLTGEEIPVWAANFVLMEYGTGAVMAVPGHDQRDYEFASKYGLNIKPVILAADGSEPDLSEQALTEKGVLFNSGEFSGLDYEAGFNAIADKLAAMGVGERKVNYRLRDWGVSRQRYWGAPIPMVTLEDGTVLPTPEDQLPVILPEDVVMDGITSPIKADPEWAKTTVNGQPALRETDTFDTFMESSWYYARYTCPQYQEGMLDSKAANYWLPVDIYIGGIEHAIMHLLYFRFFHKLMRDAGMVNSDEPAKQLLCQGMVLADAFYYVGENGERNWVSPVDAIVERDEKGRIVKAKDAAGHELVYTGMSKMSKSKNNGIDPQVMVERYGADTVRLFMMFASPADMTLEWQESGVEGANRFLKRVWKLVYEHTTKGEVAALNVAALSEDQKALRRDIHKTIAKVTDDIGRRQTFNTAIAAIMELMNKLAKAPQEDEQDRALMQEALLAVVRMLNPFTPHASFTLWRELNGEGDIDNAPWPVADESAMVEDSTLVVVQVNGKVRGKITVAVDATEEQVRERAGQEHLVAKYLDGKTVRKVIYVPGKLLNLVVG

SEQ ID NO: 13175 - protein, 208 aa, Klebsiella pneumoniae
NCHWLRRSSRQRLAARHPVAAGVSAGTPHRLYLRRPRRRAGPDWRTDPASALYSADYARTVDRRPGANHLWPGHGRWFNVDFIRLCLRKYWYGEWYFTGGGRTVAAGELRGLRPDRTDGRVWYRNVDPYPQKNVVEKRLKGLAMRKQWLGICIAAGLLAACSSDDVQQKTVSTPQPAVCNGPTVEISGADPQYETPNATANQDYERDV

SEQ ID NO: 13176 - protein, 186 aa, Klebsiella pneumoniae
SKELIMAQQKSVTLVISHLLDPQHSQRYEEWLGKIMPIAAEFPGHLGANVIRPAAGQNLWSVIIRFDTLEHLYAWTQSETRRQLVAEIAPLLTEGDRTEVRTEPAFWFTPPTVNVRQPRRWKQFLITLLVIFPSTNLVPAVTGMLLPSLKGSLLLHLINDACVVALVVWFWMPIVTRLFAGWLKKN

SEQ ID NO: 13177 - protein, 242 aa, Klebsiella pneumoniae
AEELRRQPPDVARQNGPGVFVVHHLLHRQRQQVPGGKVPEQQLDQQRSVAKQRDPRGHQSAPRASAAEAQGQQQDRQQGGEQDPGDADPDGGEKTRDNPLQRLPAQDAVPVKHRRHSRLSWCSGSSTFCRKRRARACCGWAKNSAGGATSRMSPPSINTTRSAISRANCISWVTTSMVIPLWARVFITCSTSPIISGSSAEVGSSNRIICGEEARARAMATRCCWPPESCAGICCAFSSSPT

SEQ ID NO: 13178 - protein, 235 aa, Klebsiella pneumoniae
SSGCEKVHDMSSATMAILTIGVVPLAGVLPLLTEHIREEQIAHISLLGEMTPDEVMAEYAVGDGEKGLLTLLSNNQLVMVSRQKIERDVRSAIAMLDRQHYDVILLLSSEQLTGFTTHHAILLEPQRIIPPLVASIVDGHQVGVIVPVEEIMPMQRQKWLSLEKSPYYALANPFTGSDSELLTAGKTLLEQGADVLVLDCLGYYQHHRDVLQKALDVPVLLSNVLVSRLAAELLV

SEQ ID NO: 13179 - protein, 63 aa, Klebsiella pneumoniae
IAFCSASQDIVFDAWKNDVLQAEERGARRRDQRAGLSPGDAGLRWNWPCGLPTAISAGRGCTG

SEQ ID NO: 13180 - protein, 149 aa, Klebsiella pneumoniae
TPLCRRDAPPGTARQLPPVDRRTTAPPDCSTPDRRRRPAAAAPQYPPTDNAARRRYAAPGRASRRRDPARSPRCPPHANSDSYCRGRSRHPAPAQNRGAPAGAAVDRRSAAAVHHVAYSRWPPGQTPRPPPAYSLWPCSTSSKRLMSSA

SEQ ID NO: 13181 - protein, 543 aa, Klebsiella pneumoniae
CYVWTSRWLILFRCILCFLRSCQPAAAMKNSLNQKINCRTGAVMSANRLEMHNISLAFSGFQALNKVDFTLHGGSVHALTGANGAGKSTLMAVLCGTHAHYEGEVTINNQPVIIRSPRDAKQLGIHLVQQEVDVALVPGLSIAENIMLDRLAESGMTFRWSRVRQLAREALAQLDVALDVRRSIDSCTLAEKQQILLARALSHHCRFLILDEPTAPLDQHESERLFAVVRRLQHQGIGVVFISHRIHELKAICDTLTVLRDGRLIESGPMAPLSGEQIVEKMLGHELSDIFPPPRPPHGEEVLLQVDGLHDEALLQDISLRLRKGEILGIAGLAGAGKTELCKALFGASKSRVQRGELNGQPWRPRDPADSVGRGLALVPEERRKEGIFIEEPIAMNLAVSADNSFSRWSLFGHRQAWRWAEEVIARLGVRATGPGQTLRRLSGGNQQKVAIGKWLRGDANVLIFDEPTKGVDVKAKTDLFMLIDGLAREGKGVIYASGEFAELVGLCDRICVLWDGRIVAEIPGAEAREETLLYYSTGGAAA

SEQ ID NO: 13182 - protein, 587 aa, Klebsiella pneumoniae
QSPCFLVKIRPHARRPSRAMLRELKSSTAERCYTMMDNLRTAANSVVLKIIFGIIIVSFILTGVSGYLIGGGKNYAAKVNGQEIGRGQFENAVASERNRMQQQLGDQFSELAANENYMKTMRQQVLNRLIDESLLDQYARELGLSISDEQVKQAIFQTQAFQTNGKFDNQRFSGIVAQMGMTTEQYAQALRNQLTTQQLINAIAGTDFMLPGESDQLAALVSQQRVVRAATINVNALAAKQTASDEEINAFWQQNQARFMAPEQFRVSYIKMDAASMQESASDEEIQSWYDQHKDQFTQPQRNRYSVIQTKTEADAKAVLAELQKGADFATLAKEKSTDIISARNGGDMGWMEDASTVPELKDAGLKEKGQLSGVIKSSVGFLVARLDDVQPAQVKPLADVRNDIAAKVKQEKALDAYYALQQKVSDAASNDNESLASAAQVAGLKVVETGWFGRDNLPEELNFKPVADAIFNGGLVGENGAPGSNSDIITVDGDRAFVLRISEHKAEAVKPLAEVKAQVSDIVKHNKAEQQAKLEADKLLAALKDGKGDEDDEGGWPELWRAADAFSYRPGSAEPAGIYPAAAAAG

SEQ ID NO: 13183 - protein, 311 aa, Klebsiella pneumoniae
SAPWCSPGLHRLEKPDPRGHYSGGDRHFPGRGPVLFEHHFTSSGAGMSDQTLSGLSLSHFSAGYPRRKVIENLTVPHLPRGKITALLGPNGSGKSTLMRAMAGLGPCRGELLLEGENLLTQPFSRRAEQVVYLPQTLPAGVHLHVLESIIVAQRAAGGRHSPKRQEEVMALLRQLGIAHLAMSYLDQLSGGQKQLVGLAQSLIRQPRLLLLDEPLSALDLNYQFHVMDLVRRETRRRNIVTLVVVHDINIALRHADHVLMLKAGQLLGDGTPAAVITPETLAAVYGVRGRIEPCSQGVRQVIIDGLVDSEA

SEQ ID NO: 13184 - protein, 451 aa, Klebsiella pneumoniae
PAPCRPSTIATASPPRRLSKKLSIVCVNRAAMTHWPLSALSGLLMPASQARHSFADFMRPVTKSARLRPFMALWFLPSLIAIISLKTTPFTGPGRFGVVMSFDSLGLNPDILRAVAEQGYVEPTPIQQQAIPAVLQGRDLMASAQTGTGKTAGFTLPLLQRLIQNEPHAKGRRPVRALILTPTRELAAQVGENVRDYSKYLNIRSLVVFGGVSINPQMMKLRGGVDILVATPGRLLDLEHQNAVSLDKVEILVLDEADRMLDMGFIHDIRRVLAKLPARRQNLLFSATFSDEIKGLAEKLLHNPLEVEVARRNTASEQITQHVHFVDKNRKRELLSQLIGEGNWQQVLVFTRTKHGANHLAEQLNKDGIRSAAIHGNKSQGARTRALADFKSGGIRVLVATDIAARGLDIEELPHVVNYELPNVPEDYVHRIGRYRSRGGHRRSLIAGVRG

SEQ ID NO: 13185 - protein, 502 aa, Klebsiella pneumoniae
CRPCRRRCRSLSKCRLTASKAPCRLFSGRSYCSMPRSPTCAPAHKEYAMTQTQRLDVRELINRNPLSRFQKLIIFLGFCVIALDGFDIAIMGFIAPTLKLEWGVSNHQLGLVISAALIGLALGAIFSGPLADWLGRKKIIINSVFFFGFWTIATAFSHNVEQMMFFRFMTGLGLGAAMPNIGTLVSEYAPERQRSFIITVIFCGFTFGAAAGGFSASWLIPQFGWHSLMALGGILPLLFAPLLIWLLPESVRFLVIKQAPAARIRAILNRLYPGQISDNVRFILPAQPAAGNAMRIVLSRQYGFGSLMLWLVYFMGLFLVYILGSWLPTLVKAVGMTVSQAAIMTAIYQAGGTLGSLFAGWLMDRINPHRALGIIYAVGGLFTMAMGYAAGSFALLCMLAFISGACLNGANTGMNALSARYYPTQARATGSSWMHGVGRIGAILSAFAGAEMMALNLPFESVFLILGIPAALTVAGLAAKGIFAAGHPAVASTSPASVRGAS

SEQ ID NO: 13186 - protein, 72 aa, Klebsiella pneumoniae
INACWASCSIWRNNAVTTISSASTCTVSSFASSSFCASLTSNSAMRFFIAPVPYARPVLIGMSYAMTDLRIT

SEQ ID NO: 13187 - protein, 75 aa, Klebsiella pneumoniae
LSYCFFDGWGTWIRTRECRYQKPVPYRLAIPQYRRGEPQISKKYGWGTWIRTRECRYQKPVPYRLAIPHPYNANW

SEQ ID NO: 13188 - protein, 419 aa, Klebsiella pneumoniae
PDNCYCECLSLPSGITMLTTIIYRSHICDNVSFKSIEAMVARANERNGQADVTGILLFNGTHFFQLIEGPEEKVQDIYQHICQDPRHYNLVELLCDYAPSRRFGKVGMELFDLREHDREEVLQAVMDRGTSKYQLTYDDRALQFFRTFVEATEKANYFEIPSADSWVFIPDKETFYPDTPIIDNTEGCSFAFQPIVDPFACEIISWEALLRTPDGQSPGAYFAGLIGDDIYLADLHSKRVALSLAGKLGLRNKALSINLLPMTMVKAPNAVSFLLDEISRNDLIPEQIIVEFTEREVISRMDDFTDAVRKLKGAGINLAIDHFGAGFAGLSLLAQYQPDRIKIDHELIRNIHQDGPRQSIVQAIIKCCTSLEIAVSAVGVERAEEWMWLESAGISQFQGNLFASARLGGLPAVAWPEKK

SEQ ID NO: 13189 - protein, 188 aa, Klebsiella pneumoniae
PRCWRALPELTLRSIPSTSALPEVGTSRPHIILKVVDFPAPLGPSRPKISPRLTWKSTWSVAAKSPNFFVNDWASMTVSSLLPSTRWIIAPNGDSAVPAPPSRSINASSKRGAVSATCRGGMSPCCWTSSMRASFFRIRRTDLPWITPSLTCGSFSARCSRRRLFSCWLETRKLRPAMVCVSAVGSPW

SEQ ID NO: 13190 - protein, 132 aa, Klebsiella pneumoniae
PGSCSSSPVEKTATRTLRTTSTSAMPSEASTGSSATVRGVPAGKTTAPWAISSPRRRICCPAFTGAIKRTPASVCSVSSCITTASQPSGTGAPVMMRIQVPDGQASLNGWPAKALPATGSAAPSRRSFSRTA

SEQ ID NO: 13191 - protein, 234 aa, Klebsiella pneumoniae
HRSCSPAKRSAGRGITGCAVILPGGGWRLTRPTGASHRITPRRPGKRSATGRCHQARSRFIAGWRLRLTRPTGASHRLTPRRPGKRSATGRCHQARSRFIAGWRLRLTRPTGASHRLTPRRPGKRSATGRCHQARSRFYAGWRLRLTRPTVRVMFSLPPLPAGKRDCLRRWRRPAAPLAPRSGSAPPRGQNSPPEPRWWRWRSARSPLRGRSATPGQPQPASRPARPRPPPGYR

SEQ ID NO: 13192 - protein, 133 aa, Klebsiella pneumoniae
TTSCRTYRKITSTASADTGRAAATGEALSLVCVDEHKLLRDIERLLKKEIPRIAIAGYEPDPSIIAESIQNGRQQRGGGRGQGQGRGGQGQGRSGQPRSQNNAPRRQDGEAPKARTQDGKPPRRRRPRKPAGE

SEQ ID NO: 13193 - protein, 372 aa, Klebsiella pneumoniae
QRGCWRHVRVMTCNKKRSVLHSRPSVMARRLRSAAPIRNMKRRTPRRIRIMSATCKSYKIVQDPANFTQAGFAAIYDAEPNSNLTASGEAFDPTQLTAAHPTLPIPSYARITNLANGRMIVVRINDRGPYGNDRVISLSRASADRLNTSNNTKVRIDPIIVAPDGSLSGPGMACTTVAKQTYALPARPNLDGGDAAGMSQPAPTDVRPISNSTLTPADSVGAPVNSGGFLGAPTPLNNGVLESSEPAAAAATAPAAGATPTAPVTAPGSIQGNVAPAAATAAAAGAVAASSSATSSASGNFVVQVGAVSDQTRAQQYQQRLSQQFSVPGRVMQNGAVWRIQLGPFADKAQASAVQQRLQSEAQLQSFITRAN

SEQ ID NO: 13194 - protein, 267 aa, Klebsiella pneumoniae
RMRLIPLVTAEQVGKWAARHIVNRINAFKPTADRPFVLGLPTGGTPLTAYKALVEMHKAGQVSFKHVVTFNMDEYVGLPKEHPESYHSFMHRNFFDHVDIPAENINLLNGNAPDIDAECRRYEEKIRSYGKIHLFMGGVGNDGHIAFNEPASSLASRTRIKTLTHETRVANSRFFDGDVDLVPKYALTVGVGTLLDAEEVMILVLGHQKALALQAAVEGNVNHMWTITCLQLHPKAVIVCDEPSTMELKVKTLKYFNELEAENIKGL

SEQ ID NO: 13195 - protein, 363 aa, Klebsiella pneumoniae
LVLCHTFHFFDMLSSSQTISRMERIMKVLVTGGSGYIGSHTCVQLLQQGHEVVILDNLCNSKRSVLPVIERLGGKEATFIEGDIRNEALMTEILHDHAIEAVIHFAGLKAVGESVAKPLEYYDNNVTGTLKLVSAMRAAGVKNFIFSSSATVYGDQPKIPYVESFPTGTPQSPYGKSKLMVEQILTDLQKAQPEWSIALLRYFNPVGAHPSGDMGEDPQGIPNNLMPYIAQVAVGRRESLAIFGNDYPTEDGTGVRDYIHVMDLADGHVAAMEKLADKAGVHIYNLGAGVGSSVLDVVNAFSKACGKPINYHFAPRRDGDLPAYWADAAKADRELNWRVTRNLDEMAQDTWHWQSRHPQGYPD

SEQ ID NO: 13196 - protein, 229 aa, Klebsiella pneumoniae
SGRLMKENNALLRLDGVGFKTDDAVILHNINFQLRAGEFKLITGPSGCGKSTLLKIIASLLSPTSGRLFFDDADVATLSPERYRQQVSYCAQTPALFGDSVYDNLIFPWQIRNKQPDPQALLADLQRFGLDENMLEKSINELSGGEKQRVSLIRNLQFLPRVLLLDEITSALDESNKQNVNEIIHGYATEKQVAVLWVTHDRNEISHADEVITLQPAGGNMQEVQHERA

SEQ ID NO: 13197 - protein, 182 aa, Klebsiella pneumoniae
GLGLIRNTFEVVMNKIARLSALAVVLAASVGTTAFAATSTVTGGYAQSDMQGKANKAGGFNLKYRYEQDNNPLGVIGSFTYTEKDNNSNGTYNKGQYYGITAGPAYRLNDWASIYGVVGVGYGKFQNNNYPHKSDMSDYGFSYGAGLQFNPIENVALDFSYEQSRIRNVDVGTWIAGVGYRF

SEQ ID NO: 13198 - protein, 67 aa, Klebsiella pneumoniae
VRQWCESAGVVFLSSWSSNSAMSLPRPADQARQAQPEGYFMLQYSAEKVTDQLQKSITVTDLSAEGA

SEQ ID NO: 13199 - protein, 75 aa, Klebsiella pneumoniae
ITEWYISAKSLMRHRELPAGNRVKLKEHTRSSSIMGKLGLDRFSGWIIAVKSLAHDLFHYWDIPHVPKQSINFNN

SEQ ID NO: 13200 - protein, 145 aa, Klebsiella pneumoniae
IYRCADRPGAQRRQSADPRSPQLWSGPCQSAGCHSSAVRQPTIGGAAGGARPRCPDGAQRRAGPSYLSAAPGSRAAARRRESRRPRRQRRPPRRPAAGDRRRPLFLGGRAPGGAVDPRPAALSADAGYRPGAGGAGASVAGGAGR

SEQ ID NO: 13201 - protein, 124 aa, Klebsiella pneumoniae
SSRWCRTRGPPGRFYRHWPGCGRRYCWSAPGSAYSTAYSRTAGQSAGRRSAPPAPAGQTTGSPPRPGASPPSPSARRKSDPPASPAQRETRWRRSARRRTHRRSAMTSHSGSSPAPGSPTSCPR

SEQ ID NO: 13202 - protein, 242 aa, Klebsiella pneumoniae
SSMCHVPSSRRGGPIMSALLKASRNDAIIARCLQTISQLIPLTSAVFYRVNNRLKPENYILHNISDNTHQQYLENFQPLDPLLPSHFSHQNTTVAAMTPRLCDRNRHYYHEFMLPNNVRDMTEIFIRRERRIVAGISLMRDVPFSSEERQRAQAVLPLVELAIRDCLQEEDDLPAILTAKEREIVGMVREGASNKLIARQLDISLSTVKTHLRNIFAKTEVVNRTELVSRTWMPAAQRTLHL

SEQ ID NO: 13203 - protein, 337 aa, Klebsiella pneumoniae
  UNSURE (6),(102): Identity of amino acid at the above locations are unknown.
RRMCCXGCTAMKLANCINFTHTGNIMKKYMTGAVRLSAMVAGMMMAWQAAAAQPKELNLGILGGQNATQQIGDNQCVKAFLDKELNVDTKLRNSSDYSGVIXGLLGGKVDVVLSMSPSSYASVYLNNPKAVDIVGIAVDDKDQSRGYHSVVIVKADSPYKTLDDLKGKAFGFADPDSTSGYLIPNHAFKEKFGGNADNKYNNTFSSVTFSGGHEQDILGVLNGQFAGAVTWASMVGDYNTGYTTGAFNRLIRMDHPDLMKQIRIIWQSPLIPNGPILVSNALPADFKAKVVAAVKKLDTEDHACFIKAMGGTQHIGPGSVADFQQIIDMKRELVSAR

SEQ ID NO: 13204 - protein, 608 aa, Klebsiella pneumoniae
PNSCRRRLSTRRASRRITPWKVSAKTCSTLSRTASRRDDKMPIYTDDPGQGINQPLSNAPSGLGESLLSSLKEGFKEGPVVSGYRFSQADQLANDPNSTIVSKSDAETRLKEYGVKSINVPDSGVTQTFLDHVISERRETLAKQQIAMSAPSGWVATPLNFAANLAGSMADPGNVALALVPFGGEAKAATMLGRFGERLATGARLGAGQAIATVPLTAQAAAAEGDDFTYGNALESTFFNTIAGGLMHAGGGLIADVVRSRRVGAAENPATYPDAQPVADAQPTPVVTPDNIPAGVNIPESDTNADLSAAIARDAESYAYSRAYDDVVPEYLARQQELQTGRIDNVADLRTELAANNRQSEALDATLAQRTTEYQAQRMNFKAAQAKAQRDIQGEKDTITARNQEINQTLERNAIAEQARGRESQLSRKEIPEDLAPLIDQRAQQIRESMQMSPVAGAVRTASAAVREADWSVNQQAYRGALAHMMEGRSPDIEPFYDLHKPALRERAIQRIQNPVRQADEGSRAVSETADRVWQDTQKADHEITAATADLENEFNISDALLNDIATDNPDLAASMRENIASIRAEASDDSIGKAYRAFAACMINRGL

SEQ ID NO: 13205 - protein, 291 aa, Klebsiella pneumoniae
ALPCAKSRQYNENSYQSITHTPSHSAHRSRREGWRVERSERMAVTKLVLVRHGESQWNNENRFTGWYDVDLSEKGVSEAKAAGKLLKAEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLTDAELPTTESLALTIDRVVPYWNETILPRLKSGERVIIAAHGNSLRALVKYLDNMGEDEILELNIPTGVPLVYEFDENFKPIKHYYLGNAEEIAAKAAAVANQGKAK

SEQ ID NO: 13206 - protein, 99 aa, Klebsiella pneumoniae
CAPWATGCLLPDGAKRRCRLSPMRPAPRRWWAMPPTARCGASGCYRRSSTRPAGLMSSSAAPAGWATAPPPRPATANGARRWTAISPAPSPAFAPACLR

SEQ ID NO: 13207 - protein, 104 aa, Klebsiella pneumoniae
LAQCACWRKAAASPAILRWVNAMIKVLFFAQVRELVGTDSLTLDASELATVEAVRQQLAARGDRWALALEEGKLLAAVNQTLTSFEHPVASGDEVAFFPPVTGG

SEQ ID NO: 13208 - protein, 199 aa, Klebsiella pneumoniae
AVWCEEQTMSLIRPALVLFILLTLLTGGVYPLLTTSLGQWWFNSQANGSLIRLNGEVRGSALIGQNFTAAGYFQGRPSATAETADNPMASGGSNLAASNPALDKAVSERVQALRAANPDADPRVPVELVTTSASGLDNNLTPAAALWQVPRVAQARQLSVEQVTQLVNQATQTPLLSFLGQPVINILQLNMALDALKDK

SEQ ID NO: 13209 - protein, 322 aa, Klebsiella pneumoniae
FKRCKSRMGAVVHRAAVNPEQLIISIHYYFRISQVILQHKRSPSHIGEYTMAKLAAFDMDGTLLMPDHRLGEKTLSALKRLRERDITLTFATGRHVLEMHHVIGEFSLDAFLITGNGTRIHSLEGEELYRQDLAPEAAEAVLHGKWDTQASMHVFNDGGWFTGQARPELLQAHVFSGFHYQLCDLKRMSAQHVTKICFCGDHDDLRRLRIQLNETLGDRAFLCFSAMDCLEVLPVGCNKGAALAVLSQHLGFTLQECMAFGDAMNDREMLGSVGRGFIMGNAMPQLKAELPHLPVIGDCRNQAVSHFLTHWLDNPDLPYSPE

SEQ ID NO: 13210 - protein, 279 aa, Klebsiella pneumoniae
PIRCGRLRAITRTPWRRLPSAPRCTWRWGWRWAWRSRVSAREENCNGAPDMNANLAVIADNLDYLLWGRLAEGQPGGVALTLLMAIGATLLALPGGIALAGLAWRYGGLVRRLLFLWAEIIRGIPLIFVIFWLWYLLPMLTGGDLPGAVTVTLALAWFTAASVMHSVLAGLQSLPKGQYEAALTQGFAPGQTLRLVLLPQALRNVQPSLVGIFIGLLKDTSLAFIVNVPELTTVAGQVNNRVQIYPLAIFVFTGAVYYLLCCGLSLLASRRFTRRATTR

SEQ ID NO: 13211 - protein, 203 aa, Klebsiella pneumoniae
NNRWHNANRYQTDEATVAQLADGKWRGLVKTAQLLQTLNDQLSELAALVAPLAEHATLSPRFDRQLFHTRSTLMQAYLAEAQHNFNQLRQAVERQQLPQVVWIAERLAAQIAALRRETATWSLRSWDHASPTLSRWQRRRLQHQEYERRLLAMRDQRQRQLAQATSLDEQQRLGKEVEAYSGRLARCRQALDKIENVLARLTR

SEQ ID NO: 13212 - protein, 281 aa, Klebsiella pneumoniae
IQRCEMNPYRYDIQTLERKARAVRRHIVRLNANSPAGGHTGADLSQVELLTALYFRVLNVAPDRLDDPQRDIYIQSKGHAVGCYYCVLAEAGFFPVEWLETYQHANSHLPGHPVRQKTPGIELNTGALGHGLPVAVGLALAAKKSNSTRRIFLITGDGELAEGSNWEAALAAAHYGLDNLVIINDKNNLQLAGPTREIMNTDPLADKWRAFGMEVSECQGNDMASVVSVIEGLKQEGKPNVIIANTTKGAGISFIQGRPEWHHRVPKGEEIALALEELKDE

SEQ ID NO: 13213 - protein, 156 aa, Klebsiella pneumoniae
IRRCTMKKMISLAVILSCVLSVPAFADGPNDGHRPGQPTVWQNGPDHDGHAPQGGPDAHHQGDHDQRGPDRDGHDKRDLARHEQDHFAWRGNDFRKGHPAPAPFRGDEYRVRDWSDRGLPPPPEGHHWSYIDGNYVLIAAATGIITSILVSGALGH

SEQ ID NO: 13214 - protein, 429 aa, Klebsiella pneumoniae
SDFRIPRAPWQHGVFLMPVGITPWRILRGEAFLTGARPTMSSTPLTDNALSRPAGLMVSLRLLAAIVIFAAIAPGILMTAPAVAAQLASEWQLKPGQIGWLFSAELGAMSLATLPAWWWMSRLDWRRVALTAGVVFLAANLVSAVVTQYETLLAARFIASLAGGTLMILCISCAAGTPNPSRVYAFWVLGQLLLGMLGLLALPGLFATFGLKVVYLILAAIMLCCLPLVSAFPPRFQPLSVSRQQPSTALWRQALAVLAVLTFYISLSAVWTFIGTIGSAAGLSPTQVGLVLAAATVCGIIGAGGAALRGTRRADRLPVWLGYGLLIVSVGLLIGQPLLVRYAIAALLFKFTWTFVLPFILARVAGLDNSGRLMNSINLVIGGGMAAGPALAGALLQHFASADPLLAAAGVCALLSLILIVAASAAGKA

SEQ ID NO: 13215 - protein, 380 aa, Klebsiella pneumoniae
RRFRLPVLDSGPLVPPGRHYGRRTSGKEPFLMLNATTTAGAQLRNLVIIVICIALLAGINVVFNDYIVRVISTIFIFMILAVSYNLINGVTGQLSLEPNGFVAVGAYVTALLILSSDSKVDMFEMAAPSPWILSLHAGFLPALLISGLCAAALAVCLAVPVFRVRGDYLAIVTLGFGFIIKILAINNPQITNGAIGLNDIPQQPHLLFWCGLFALLATGMILQLVWSKYGRMMKAIRDDEDAAIAMGVNTFRIKTCAFATSAFFEGIGGGLLASLLTTISPGLFDFMLTFQLLIIIVLGGLGSTTGALLGTVLVVGSGEWLRFLDQPLQFFGHDLGAYPGLRMVVFSLLLLIIMLFAREGLLGKKEIWQMGRRNSSYGGK

SEQ ID NO: 13216 - protein, 328 aa, Klebsiella pneumoniae
RCLRRSTPSRRPSRSCCRSLSSAWRCGSSAPPNPSKMTTWRKGSNMAQSPSIKREKWIRLSLTWLVVILVSVVIIYPLVWTVGASLNAGNSLLSTSIIPENVSFQHYADLFNGNVNYLTWYWNSMKISFLTMVLTLISVSFTAYAFSRFRFKGRQNGLMLFLLLQMIPQFSALIAIFVLSQLLGLINSHLALVLIYVGGMIPMNTWLMKGYLDAIPKDLDESARMDGASSFRIFIEIIMPLSRPILAVVALFSFTGPLGDFILSSTILRTPDKYTLPIGLYNLVAQKMGASYTTYAAGAVLIAVPVAILYLALQKYFVSGLTSGSTKG

SEQ ID NO: 13217 - protein, 117 aa, Klebsiella pneumoniae
MPVRLFRKRVACIETVMNNSETEEITDEIIGEAVLALLKTNRPITTPTLLVRLRLMQATEPDRQRRKIIAAVIEEICAKLIRQRKYAPLQVKKINGRWETRGSLAPDSMPSEAKKIH

SEQ ID NO: 13218 - protein, 488 aa, Klebsiella pneumoniae
SLPRFVFLSIFYMEMTKVKLSALFIALIPLLGSPVIHAETTAAPVLENRAAQGDITTPGGARRLTGDQTEALRASLINKPAKNVILLIGDGMGDSEITAARNYAEGAGGFFKGIDALPLTGQYTHYSLDKKTGKPDYVTDSAASATAWTTGVKTYNGALGVDIHENAHQTILELAKAAGLATGNVSTAELQDATPAALVAHVTSRKCYGPTVTSEKCPSNALEKGGKGSITEQLLNARPDVTLGGGAKTFAETATAGEWQGKTLREQAQARGYQIVTDAASLAAATEASQDKPLLGLFADGNMPVRWEGPKASYHGNIDKPPVTCTPNPKRDASVPTLAQMTEKAIDLLSRNEKGFFLQVEGASIDKQDHAANPCGQIGETVDLDEAVQKALEFARKDGNTLVIVTADHAHASQIIPADSKAPGLTQALNTHDGAVMVMSYGNSEEESMEHTGTQLRIAAYGPHAANVVGLTDQTDLFTTMKAALSLK

SEQ ID NO: 13219 - protein, 215 aa, Klebsiella pneumoniae
RRPRLIQPWFLIGYKTKQSACYFENNDMKPKLTHALFLIPFLLLAGCSSSPKQAKNTKSHADMTIDSGSDDLIPVVAALHDQMHTWQGTPYEWGGTEQSGVDCSGFVWRTLKDRFNLPMERITTRELLHMGVRVNKRDLRPGDLVFFRTRAGMHVGFYDTDHNFLHASSSQGVMRSSLDNPYWESAFYQARRLPKEYNAQITMNSDTLHLAKNRR

SEQ ID NO: 13220 - protein, 88 aa, Klebsiella pneumoniae
NSARRPCAPADRGGQGSRPLPAAGSSVPPPRRAAAAPGPPPPSPGSTPSPSSVWYSACPGNSSAATGASSSSDDPGGPSGAGRCRGWR

SEQ ID NO: 13221 - protein, 613 aa, Klebsiella pneumoniae
LHYRAGRAPAAHSGRSAGRRRPRPRRRADADAHPQPAGRPRPAGGQLRRQLRHRPRRGAVWDHFPAGAAAAGILRRALRLAAGSLYRQPGRRSAEPGAPHSRRGRPCGGTRGAVQRHRPAQPGRLRSATLLAGRFAGYPHPANAENCPAAGSGGGDRRSAAEPGAEQPEPGQRYRHRPRQPRRPHPADRPDRHHRPVRQRHRRRRPHRLYRPDDAAYGALAGGGRSSLVAAGHPARHPGPAAVCRRDWPPAGARRTAGIGGERLSRRAGADLAGAPPAAGRWPVIAPSRRLIASCLLLTAASLLISLLGLAQGPVPLTIDQVFSALFGDAPRNVAMVVNEWRLPRVLMALLIGAALGVSGAIFQSLTRNPLGSPDVMGFNTGAWSGVLVAMVLFGQNLTAIALAAMAGGVLTSLVVWLLAWRNGIETFRLIIIGIGVRAMLVAFNTWLLLRASLETALSAGLWNAGSLNGLTWGKTWPSAPLILLMLVGSALLVRRMRLLEMGDDTACALGVQVERSRLLLMLVAVVLTAASTALAGPISFIALVAPHIARRLSGTARWGLTQSALCGALLLALADYGAQRLFMPWQLPVGVLTVSLGGIYLIALLIQESRKK

SEQ ID NO: 13222 - protein, 79 aa, Klebsiella pneumoniae
CGHRPSPGCGRPGPSPHPVPKMRTSPPAPAEPFCRSGDRRRFSRRRRCRASVRRGTPPAAGSSALYPAPLFVDCRRSAR

SEQ ID NO: 13223 - protein, 301 aa, Klebsiella pneumoniae
KPNRLRSGFGADDGPGRPLAQSARRYRLRDAGEKPDHRRLVGAALPRGALMAALDFRGQTVWVTGAGKGIGYATALAFVEAGANVTGFDLAFDGESYPFATETLDVADADQVREACSRLLANTERLDVLVNAAGILRMGATDQLSAEDWQQTFAVNVGGAFNLFQQTMAQFRRQRGGAIVTVASDAAHTPRIGMSAYGASKAALKSLALTVGLELAGSGVRCNLVSPGSTDTDMQRTLWVSDDAEQQRIRGFGEQFKLGIPLGKIARPQEIANTILFLASSHASHITLQDIVVDGGSTLGA

SEQ ID NO: 13224 - protein, 513 aa, Klebsiella pneumoniae
LINRYSCRTIDFRFTPGNTLHMQTTSSQPRAIYYVVALQIWEYFSFYGMRALLILYLTNQLKYDDNHAYALFSAYCSLVYVTPILGGYLADKLLGNRMAVMLGALLMAIGHLVLGASETAPVFLYLSLAIIVCGYGLFKSNVSCLLGELYEPADPRRDGGFSLMYAAGNIGSIIAPIACGYVQEEYSWAMGFALAAIGMVAGLVIFLCGNRHFQHTAGVNRQALCARRFLLPNWGWLLVLLVTAPLLIAVLFWQEWSVYALIVATAIGLAVLARIYLRAETDKQRKDLRLIVVLTAFSLLFWAFAQQGGSSISLYIDRFVNRHIMSYEVPTAMFQSINAFAVMLCGMVLAWLVKESVNGNRTVRIWGKFALGLGLMSAGFCILTLSARWSAAYGQSSMPLMVLGLAVMGFAELFIDPVAMSQITRIEIPGVTGVLTGIYMLLSGAIANYLAGVIADQTSQASFDAAGAVNYSIDAYITVFSQITWGALACVGVVLVIWLYHSLKVKTRRLAVE

SEQ ID NO: 13225 - protein, 112 aa, Klebsiella pneumoniae
AIDRRRPAYLRARQRHRRAHRLHLGHHSWPRPAGLRRHRRRGYGPAVRSHPRTEPHQSDGLYRRQLRRHLRHRHGAGADCHPPAGSARAVLDDRHPGDRRHPAHPVGGAQQP

SEQ ID NO: 13226 - protein, 490 aa, Klebsiella pneumoniae
SEDRRGYYRRADENCCDSLLISIEGTTMQAILSFLTEIFSQPAFLMGLIAFVGLVALRSPGNKLLTGTLKPILGYLMLSAGAGVIVANLNPLGGIIEAGFNIRGVIPNNEAIVSVAQKMLGVETMSILLLGFIFNLIIARCTKYKYIFLTGHHSFFLACLFSAVLQAAEFQGWMLILIGGFLLGSWSAISPAIGQRYTRQVTEDGGIAMGHFGSLGYYLSAWIASRTGNPANSFADTEISEKWGFLRDTTVTTGIVMFVIYFVCSAVAGSAYLSTITDQNMLIFSVLTGLQFAVGVAIVYNGVRLILGDLVPAFQGISQKLIPDSIPAVDCAVFFTFSPTAVVVGFISSFVGGLVGMLLLGGLGMALIIPGMVPHFFCGGTSGVFADKLGGKRGCIIASFIGGIFLAFLPAMLLPALGNLGFENSTFADFDFAVWGIIIGNAFTQFGQITIYLICLALLVALLAPFCFRHVQVVGNTLSYEELTAKQKNE

SEQ ID NO: 13227 - protein, 183 aa, Klebsiella pneumoniae
RLDRRGPAWLWILAGLPDHRSDAEGRLMPTLREWKERRPASDIKQTVEFYHPAFGYYRVVNNLFRPATFGGNSFEPARFSVTEPAQDGTAVISMMITFVAATEHVRQTLKSWRGAARMTPIKCLYQQWNAIGDTASLKDWTLYVNDISADASNVTVTAGKTNPLTLANSIIYTTKDYPGLITV

SEQ ID NO: 13228 - protein, 389 aa, Klebsiella pneumoniae
YFCRYCFAVRGGGERFFKWPLLQSWDNNIRNRTMKSKSATLEDVARHAGVSYQTVSRVLNKSANVSEATRRKVEKSIEALRYVPNRLAQQLVGKESQTVGLVTISLAWHAPSQVAAAVKRYANLEGYQVLISMIDESVNQSIQDSINELKSQRVDKVIINVPLETEQAQKIAADNDDIVCLFLDVDPYSSVFNVSFNPADGTRASVKYLYEMGHREIALLAGPDSSVSAKLRLKSWLETLDGYGLKPVTVLHGNWDAQSGYACALQMLRETPNFSAVLVGNDQMALGVLSAFHQHQVAVPGEKSVIGYDDTYESSFFYPALSTVSLDLDLQGKEAVRRILASTSGAPHTSSILPARLVIRHSSGARIEQGKDLQAIAEQLRAIAHRLAP

SEQ ID NO: 13229 - protein, 384 aa, Klebsiella pneumoniae
DRSRQMIDYEVLRFIWWLLIGILLIGFAVADGFDMGVGMLTRFLGRNDTERRIMINAIAPHWDGNQVWLITAGGALFAAWPMVYAAAFSGFYVAMILVLASLFFRPVGFDYRSKIEDTRWRNMWDWGIFIGSFVPPLVIGVAFGNLLQGVPFHVDEYLRLFYTGNFFQLLNPFGLLAGIVSVAMILTQGATYLQMRTVGELHLRTRTVSMVAALVTLVCFALAGVWVYYGIDGYVVKSVIDHTGPSNPLTKEVVREAGAWMVNFNNMPALWAVPALGVVLPLLTVVSTKADKGAWAFLFSSLTLACIILTAGIAMFPFIMPSSTMLNASLTMWDATSSQRTLNLMTYVAIVFVPIILAYTSWCYWKMFGRITREDIEKNTHSLY

SEQ ID NO: 13230 - protein, 73 aa, Klebsiella pneumoniae
SIGRRFESCTTHQFQHLTQMLNVKDNVASATARRARQSRVILHDLPISELVSSEIIQVVPDRVVSSVGRAVDF

SEQ ID NO: 13231 - protein, 76 aa, Klebsiella pneumoniae
WLMLATDNRVIIIQWHKLEMLAAQVIRVSRPIFFKGRLSPTVFGHNKLSGGWLNFGVYNDHISSLEVWLHRIAFDA

SEQ ID NO: 13232 - protein, 69 aa, Klebsiella pneumoniae
AATRQYEGMMTDKLPGGAALARTWGEPTGGPRRLGNALSRYPGSWTRPGFPRGRIRRRARLSPAPRRPA

SEQ ID NO: 13233 - protein, 232 aa, Klebsiella pneumoniae
DMTRRADRLFQIVQILRGRRLTTAALLAERLGVSERTVYRDIRDLSLSGVPVEGEAGSGYRLLAGYDLPPLMLTTKESEALIAAIRLLKTWGGEALSQSLESAQEKMLAILPEARRRQAEQTRLFAPDFGAHRYAKNHFDVIHQAVSGQQVLQLRYQDETGRVTERDVLPLGLFFWGERWLLVAWCELRNDYRNFRLDRCLEVRRTERRFSECADRSLSDFLRKVRCEVREK

SEQ ID NO: 13234 - protein, 235 aa, Klebsiella pneumoniae
SAARRGWPAKRSAFSIPIRRCGWQAASTPNAGVFDHGPLHELDSGFEFYAPQTMQADDGRRLLVGWMGVPDGDEMHQPTRAQGWIHQMTCVRELEWQAGTLYQRPLRELVALRGEAQGWCGQTLPLAPMELAFDIAPNSTLGLDFAGALQLTVNRDGLRLSRRGLQTAEMHHRYWRGEARRLRIFIDRSSVEIFINDGEGVMSSRFFPGYPGQLIFSGATPVAFCRWLLRPCMVE

SEQ ID NO: 13235 - protein, 277 aa, Klebsiella pneumoniae
CHYRHVCLRSCRPLCRASRRRWPTAIIRNGIWRPVNGLLNDPNGFCQVAGRYHLFYQWNPLACDHTYKCWGHWSSADLLHWRHEPIALMPDEEYDRNGCYSGSAVEFEGALTLCYTGNVKFPDGGRTAWQCLATENADGTFRKLGPVLPLPEGYTGHVRDPKVWRQDGRWYMVLGAQDVQQRGKVLLFTASDLREWRLVGEIAGHDVNGLANAGYMWECPDLFPLADTHLLICCPQGLAREAQRFLNTYPAVWMAGRFDAERGSLRPRPAARAGQRI

SEQ ID NO: 13236 - protein, 709 aa, Klebsiella pneumoniae
LPYRWTTTMNNSGKYLIWALLSVIGAFALGYIALNRGEQINALWIVVAAVCVYLIAYRFYGLYIAKTVLGVDPTRMTPAVRHNDGLDYVPTDKKVLFGHHFAAIAGAGPLVGPVLAAQMGYLPGMIWILAGVVLAGAVQDFMVLFVSTRRDGRSLGELVKEEMGPTAGVLALVACFMIMVIILAVLAMIVVKALTHSPWGTYTVAFTIPLAIFMGIYIRYLRPGRIGEVSVIGLVMLVFAIISGGWVAESPTWAPWFDYTGVQLTWILVGYGFVAAVLPVWLLLAPRDYLSTFLKIGTIVGLAIGILIMRPTLTMPALTKFVDGTGPVWTGNLFPFLFITIACGAVSGFHALISSGTTPKMLANESQACFIGYGGMLMESFVAIMALVAACIIDPGVYFAMNSPMAVLAPAGTTDVVASAAQVVSGWGFSITPDTLHQIASEVGEQSIISRAGGAPTLAVGMAYILHGSLGGLMDVSFWYHFAILFEALFILTAVDAGTRAARFMLQDLLGVISPGLKKTSSLPANLLATALCVLAWGYFLHQGVVDPLGGINTLWPLFGIANQMLAGMALMLCAVVLFKMKRQRYAWVALLPTSWLLICTLTAGWQKSFSPDTKVGFLAIANKFQAMIDSGNIPPQYTESQLAQLVFNNRLDAGLTIFFMIVVVVLALFSIKTALAALKEDKPTAKETPYEPMPENLDAIETQAKGAH

SEQ ID NO: 13237 - protein, 401 aa, Klebsiella pneumoniae
QIHRVVGQQGGILLNGGELIGLPVRLRDIVKADDGRQRGGGVPQAVLGAQRQHIGGAKQRLHPGVFSNQFSGSLVAGLIAAAVAEAAAHRHIRRPGDKSLIALAGAEVLAIFANKANLPPASAAEQIRHQLRSLGVIAAHPVAAGEVRMAVDQGDGDLARQILLRQRQRRRAGGDDHPGDVIAQQLFKRGGELLRIVSVHQQRHKAIERQLMDQRRQQFAAKRVVETGGDDADKITAAGDHRPGDDIHLIAQGFRGAQHLLPGLLRHRGAGGEGAGDRRARDPGQSGHVLGLNPFFIAHRRFAPSVFQEADARAGVGHAHCLKRYHRKASSRSALRPMPGSGCAPPHAAKSPCRGEWRSAPVPDDGRPRSRFPHRGSAGSPGGLRRGRSYRPDRAPGRCCR

SEQ ID NO: 13238 - protein, 119 aa, Klebsiella pneumoniae
SLNRSGTLYAPHPSQALREGKADGCQPGEICQCYWPHEWAVWSGVMKLKMYTPSGSVIVETNDVAQFYPDAESGGELTTIELVSPTGDHGKVAVKHSFHQVTSALATAWKMDEDKAGAA

SEQ ID NO: 13239 - protein, 446 aa, Klebsiella pneumoniae
KTDRLPGQPPSVSSQRLGRAGDLAFIAKPFTGPTMKIINARLRRQEALFTLDLHDGMIHRITAQAAMQTADAGDIDAQGRLAIPPFVEPHIHLDATLTAGEPEWNRSGTLFEGITRWSQRKASITPEDTRQRALKTIGMLRDFGVQHVRTHVDVTDPSLAALQALLAVKQEAADLIDLQIVAFPQEGIESYPNGRELMTRAIEMGADVVGGIPHYENTRDKGVSSVMFLMDLAQRYGRLVDVHCDEIDDPQSRFLEVLAEEARVRGMGAQVTASHTCAMGSYDNAYCSKLFRLLKASGINFISCPTESIHLQGRFDSWPKRRGVTRVAELDRAGINVCFAQDSIQDPWYPLGNGNILRILDAGLHICHMLGYDDLQRCLDFVTDNSARALCLGDNYGLAEGRPANLLILDAENDYEAVRRQARVLTSIRHGRVILQREVEHIRYPA

SEQ ID NO: 13240 - protein, 91 aa, Klebsiella pneumoniae
TPCRAARRLPGLQCQRPPVQTVGPVRRSRHRASGRERGLNTLPGGAALARPTELAPACHTPGPVRRSRHRASAPYLTFVDNFRALETAQLA

SEQ ID NO: 13241 - protein, 401 aa, Klebsiella pneumoniae
RLRRRPPFLRRRPAGAPSDVSVPLPDAAAPPPAPTVASAPSGRKRLTTALVWGLFLLALGTCVALVALSSMESRPPVNKARLLLNPRDIDIHLVNGNSCANWSSQHSYAVGLASLITTSLNTFSTFMVHDKTDYNINEPSSSGKTLTIEFVNQRHYRAQQCFMSVQLVDNADSSTMLDKRYFVTNDNQLTIQNDLMNSLSDALAQPWPARMQAMLRQYQPSQSVALTYFYQSHQLLMKGDVDSLSKASSLLDDVIKRAPDFIYAYAEKTLVDVLRHSQQPLDDKQLAALYSEVERVGAMPGIKDMAIYYQIKAVDSLGKGKVDEANTAINSAIDLEMSWLNYVLLGKVYEMKGENRLAADSYITAFNLRPGEDTLYWIENGVFQTSVNRVVPYLDNFLSSE

SEQ ID NO: 13242 - protein, 65 aa, Klebsiella pneumoniae
ARRRESRTLQATVMLQAQAIAAQGVTDLDKYLQKGEKPAKQRVMFRGILITQDNADKVQDFNIKS

SEQ ID NO: 13243 - protein, 154 aa, Klebsiella pneumoniae
GRRRGCPARRDPVVRQSGSPPRGLSGFRQYHLPAPPATDAPAPPAPGRYPASADRAAGRGSTAPPGALPPRKRGRRRSPAAGRRGGRRWRRGRRDSRRRAAARDPGAADRYDGPARRCAPSGHRGRAPPAAPPIVGWRTADEWHPALWHGPDQS

SEQ ID NO: 13244 - protein, 303 aa, Klebsiella pneumoniae
NGRRRCSAPVFLPGQEKPAGRVTCITICASMKSSHFGARMGLLNRIKMLWRAAVGSSYSWPAMDIVLPGERYLHLVGSIHMGTRDMAPPPAKLLKKIRQADALIVEADISGNETPFSNLPTYPPLAERLSDAQLSELEARAGELGLSVGLFDSQPLWQVAMVLQATQAQKLGLRPDYGIDYQLLMAARESNIAVMELEGADSQIALLRDLPDGGMALLEDTLTHWRTNARLLQVMIGWWLEQPPSRGAVSLPTTFSQSLYDVLMHQRNLAWRETLLALPPGRYVVAVGALHLYGEGNLPDMLT

SEQ ID NO: 13245 - protein, 245 aa, Klebsiella pneumoniae
RAGRLLDFFTGGHRAGEAHLGAGRMRNQPLGNLAAGAVDHVNHPIRDTHRFCQLRHAQQRQRRIFARLEDDGAAADQGRRQLPDGNHDGEVPRHDANHHPKRLAAGKGGIFLPGHRWQRDIQRFTGDFPRPAGEVAQERHRLVQLEHPRQRDSFAGTETFQLRQRFAMLCQRVRQLQQQRAARQRRHLAPLTKRLAGALHSAIRLVTIRRGDLGNRLPGRRVDHRERRAAARLTLTGNKLPVRLA

SEQ ID NO: 13246 - protein, 347 aa, Klebsiella pneumoniae
TAGRVLRGSPRSPALFIILLRHNVWHAANSPLIARYFDRVKSARLDVETGIGDDCALLHIPEKKTLAISTDTLVAGNHFLPDIDPADLAYKALAVNLSDLAAMGAEPAWLTLALTLPEVDEVWLEAFSDSLFVQLDYYDMQLIGGDTTRGPLSMTLGIHGFVPPGRAMKRAGAKPGDWIYVTGTPGDSAAGLAVLQNRLTVDEPSDADYLLARHLRPMPRVLQGQALRDLATSAIDLSDGLISDLGHILKASGCGARIDLDAMPYSDAMLRQVDSEQALRWALAGGEDYELCFTVPELNRGALDVALGHLGARFTCIGQIAPESEGLQFIRDGKPVALDLKGYDHFA

SEQ ID NO: 13247 - protein, 366 aa, Klebsiella pneumoniae
RIIRGSSGNNALRPPVTLSKFHTTLPPSDTAMRPIWLYTELKNAPTLKTYSAAVDWNVPGHYFAETFSRSGMNPSGQSIRGEIMKKSLASMCLSAVLTVAFSYHAVAADLPEIEKSGTLKVATEDDYAPFNFMNNGQADGFNKDMLEELRKYAKFHVDQSILPWTGLLAAVSTGQYDMALTGAVITDERLKVFDFTPPWASAQHYFVKRAGDTSLNTIADLSGKKVGLQAGSALLARLPELKAMLEKTGGKLGPVVEYPSYPEAYADLANKRLDYVINVVISVNDLAKAKPKVFAKGLAVSGPGYMAWPIPKNSPQLLAYMTKFMNHMKETGKLAELQKKWFGETYDNLPTEAITSPEQFHKLAGL

SEQ ID NO: 13248 - protein, 124 aa, Klebsiella pneumoniae
GRIRRRLERLPRRHARSRPAGGKMTIAIDRLKEVTRDFGRRHIAYQMARELLEIYSGNGPVVWNVLSDFPPEVNGKYLVITSYGDIRTACYDCESGEWRASDGTITGVIKWMELPAAQQEVKGE

SEQ ID NO: 13249 - protein, 309 aa, Klebsiella pneumoniae
RAVRPSSAGLKACPGVRRLAGENADYRSARRAAAHRRPSSTAVRPAARSLRMNRPDAWNPLREFTDARIALGRSGASLPTREVLNFGLAHARARDAIHQPFASQQLVAPLAALGLDALTVHSAAPDRHTYLRRPDLGRQLADESRADLAASGVRPADLLLVIGDGLSSWAVERQAVPLIRALLPYLQTLGIGLAPVVLAHQSRVALGDDIGETLKARAVAILIGERPGLSSPDSLGVYLTWQPHRQRLESERNCISNIRPEGLSHDAAAFKLAWLLEQAFLRRLTGVGLKDESDNPALHGKIKPLPPLK

SEQ ID NO: 13250 - protein, 106 aa, Klebsiella pneumoniae
PAVRFSYNLSITFYRRQTMASGWAGDGAVQDQIDSTIDDAVARARRELPRGESNKFCDECGEPIPEARRQAIPGVRYCVKCQQEKDLHNNTFSGYNRRGSKDSQLR

SEQ ID NO: 13251 - protein, 498 aa, Klebsiella pneumoniae
CTSLQKMGYIMSSLQISQGTFRLSDTKTLKIDHLSVAAGESWAFVGSNGSGKSALARALAGDLTLLSGQRESHFSRVTRLSFEQLQKLVSDEWQRNNTDLLSPGEEDTGRTTAEIIQDEVKDPARCARLAEQFGISALLDRRFKYLSTGETRKTLLCQALMTDPQLLILDEPFDGLDVNSRQQLAALLADLHSAGITLVLNRFDEIPEFVQFAGVLADCTLSETGEKSSLLQQALVAQLAHSEKLDGITLPEPDVPPARHALADSAPRIVLNDGVVSYNDRPVINHLSWTVNPGEHWQIVGPNGAGKSTLLSLVTGDHPQGYSNDLTLFGRRRGSGETIWDIKKHIGYVSSSLHLDYRVSTNVRNVILSGYFDSIGIYQAVSDKQHKLVQQWLDILGIDKRTADAPFHSLSWGQQRLALIVRALVKHPTLLILDEPLQGLDPLNRQLVRRFVDVLIGEGATQLLFVSHHAEDAPDCITHRLAFVPSGDGYTYQLGPVA

SEQ ID NO: 13252 - protein, 839 aa, Klebsiella pneumoniae
SRTRHHPDPRHSRSAAGGALRSPSAPGGWPAAGGSMIARWFWREWRSPSLLIVWLALSLAVACVLALGSISDRMEKGLSQQSREFMAGDRTLRSSREVPAEWIAQARKSGLTVGEQLSFATMTFAGDTPQLADVKAVDDRYPLYGTLETQPPGLKPQAGSVLLAPRLMALLNLKTGDTIDVGDATLRIAGEVIQEPDAGFNPFQMAPRLMMNMADVAKTGAVQPGSRVAWRYKFAGDAEQLANYEQWLLPKLGPEHRWIGLDQDDSALGKSLERSQQFLLLSALLTLLLAVAAVAVAMSHYCRSRYDLVAILKTLGAGRSQLRKLIVGQWLLLLTLSVITGGVAGLALERLLLLVLKPVLPAALPAASGWPWLWAIGATGVISLLVGLRPYRLLLATLPLRVLRQDVVANVWPLKIWIPAVSVVVVGLLAWLLGGSPLLWSVLAGAVVLALLCGLVGWGLLWLLKRLTLKALPLRLAVNRLLRQPWSTLSQLAAFSLSFMLLALLLVLRGDLLDRWQQQLPPQSPNYFLINIAPEQIVPVKTFLAEHQTRAAEFYPIVRARLTQINGQSTDGNKDEALNRELNLTWSEQRPDHNPLVAGSWPPKPGEVSIEEGLAQRLGIKIGDTVTFTGDTQEFSAKVSSARKVDWESLRPNFFFIFPSGALDGQPQSWLTSFRWDNGPAMLTQLNREFPTVSLLDIGAILRQVGQVLSQVSRALEVMVGLVTACGVLLLLAQVQVGMRQRHQELVVWRTLGAGKSLLRATLWAEFALLGLVSGLVAAIGAEVALAMLQTKVFDFPWAPDWRLWVLLPLTGAVLLSLCGGGLGLRLLKGKALFRQFSQ

SEQ ID NO: 13253 - protein, 88 aa, Klebsiella pneumoniae
FRTRCRRAKSITTLRRPEMATFSLGKHPHVELCDLLKLEGWSESGAQAKIAIADGLVKVDGAVETRKRCKIVAGQTVSFEGQSVTVTA

SEQ ID NO: 13254 - protein, 217 aa, Klebsiella pneumoniae
PMARKTKQQARETRQLILDVALRLFSQQGVSSTSLATIAKAAGVTRGAIYWHFKNKSDLFNEIWELSDASISDLEIEYRAKFPNDPLSVIREILVYVLEATVTEERRRLMMEIIYHKCEFVGEMTVVQQAQRQLSLASYERIEQTLKECIAAKLLPANLLTRRAAVLMRSYLSGLMENWLFAPDSFDLHAEARDYVAILLEMYQFCPTLRGPESLSA

SEQ ID NO: 13255 - protein, 133 aa, Klebsiella pneumoniae
VRQRDAVGTLLTQILCTGRYVSEELSPADITQKVVASLMPATLDTIKSEEKQTYHSPLKTNYREHIHSPEGVNGLVEHSMLMDMLNKIDADGHDVSGAAAEVTAMLSYIVGIGAVLRDIETHAQYVMAKAKGY

SEQ ID NO: 13256 - protein, 62 aa, Klebsiella pneumoniae
HHKRHLKVLLELIIMRQILQLFDPLLERQTMIGKIGQGKIVTGMLQLNDQAKPAAKSVCLLP

SEQ ID NO: 13257 - protein, 318 aa, Klebsiella pneumoniae
NSKRGLTARPASDKISLSPFRKDTDGILSLMAAKIIDGKTIAQQVRSEVAEKVKARVAAGKRAPGLAVVLVGSNPASQIYVGSKRKACEEVGFVSRSYDLPETTSEAELLELIDTLNADKTIDGILVQLPLPAGIDNVKVLERIAPDKDVDGFHPYNVGRLCQRAPRLRPCTPRGIVTLLERYNIDTYGLNAVVIGASNIVGRPMSMELLLAGCTTTVTHRFTKNLRHHVENADLLIVAVGKPGFIPGEWIKEGAIVVDVGINRLESGKVVGDVVYEDAAERASYITPVPGGVGPMTVATLIQNTLQACEEYHDVEEA

SEQ ID NO: 13258 - protein, 450 aa, Klebsiella pneumoniae
GIKRGNPMSRIDTLVCTDARKTKYRFVVLTMIFLVYAINYADRTNIGAVLPFIIDEFHINNFEAGAIASMFFLGYAVSQIPAGFFIAKRGTRGLVSLSIFGFSAFTWLMGTVSSVFGLKLVRLGLGLSEGPCPVGLASTINNWFPPKEKATATGVYIAATMFAPIIVPPLAVWIAVTWGWRWVFFSFAIPGIVAAIAWYLLVKSKPAESGFVSQSELAEINAGRESHNNSVRENILIAERFTWLDKIIRVKKMAPIDTAKGLFTSKNILGDCLAYFMMVSVLYGLLTWIPLYLVKERGFDVMSMGFVASMPCIGGFIGAIGGGWVSDKLLGRRRKPTMMFTAVSTVVMMLIMLNIPASTLAVCIGLFFVGFCLNIGWPAFTAYGMAVSDSKTYPIASSIINSGGNLGGFVAPMAAGFLLDKTGSFNSVFTYFGICAAIGLVVILFLDEPQ

SEQ ID NO: 13259 - protein, 412 aa, Klebsiella pneumoniae
TSERLNQNSRIEAMSQYHTFTAHDAVAYAQQFAGIDNPSELVSAQEVGDGNLNLVFKVFDRQGVSRAIVKQALPYVRCVGESWPLTLDRARLEAQTLIAHYQHSPQHTVKIHHFDPELAVMVMEDLSDHRIWRGELIANVYYPQAARQLGDYLAQVLFHTSDFYLHPHEKKAQVAQFINPAMCEITEDLFFNDPYQIHERNNYPAELEADVAALRDDAQLKLAVAALKHRFFAHAEALLHGDIHSGSIFVAEGSLKAIDAEFGYFGPIGFDIGTAIGNLLLNYCGLPGQLGIRDAAAAREQRLNDIHQLWTTFAERFQALAAEKTRDAALAYPGYASAFLKKVWADAVGFCGSELIRRSVGLSHVADIDTIQDDAMRHECLRHAITLGRALIVLAERIDSVDELLARVRQYS

SEQ ID NO: 13260 - protein, 419 aa, Klebsiella pneumoniae
RAERRLIKGYTMSSVDILVPDLPESVADATVATWHKKPGDAVVRDEVLVEIETDKVVLEVPASADGILDAVLEDEGATVLSRQILGRLREGNSAGKESSEKADAKASTPAQRQQASLEEQNNDALSPAIRRLLAEHNLDPAAIKGTGVGGRLTREDVEKHLAKAPAPAEAKAPAAAPAAAPAPQLGHRSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVNMGVSTPRGLVNPVLRDVDLLGMADIQKNIKELAVKGRDGKLTVYDLSGGNFTITNGGVFGSLMSTPIINPPQSAILGMHAIKDRPMAVNGKVEILPMMYLALSYDHRLIDGRESVGFLVAIKELLEDPTRLLLDV

SEQ ID NO: 13261 - protein, 468 aa, Klebsiella pneumoniae
NAERDRPDDPADRPDASVPAGHRHIWPFSAWSGNAVSVTVLVALLVCLIPTTIGGLLSAIGVAGMSRMLGANVIATSGRAVEAAGDVDVLLLDKTGTITLGNRQASAFLPARGVEERTLADAAQLSSLADETPEGRSIVVLAKQRFNLRERDLQSLHATFVPFTAQTRMSGINIDQRMIRKGSVDAIRRHVEANGGLFPADVDKQVEEVARQGATPLVVAEGEKVLGIIALKDIVKGGIKERFAQLRKMGIKTVMITGDNRLTAAAIAAEAGVDDFLAEATPEAKLALIRQYQSEGRLVAMTGDGTNDAPALAQADVAVAMNSGTQAAKEAGNMVDLDSNPTKLIEVVHIGKQMLMTRGSLTTFSIANDVAKYFAIIPAAFAAVYPQLAMLNVMGLHSPSSAILSAVIFNALIIVFLIPLALKGVSYRPLSASAMLRRNLWIYGLGGLLVPFIGIKAIDLLLTLSGLV

SEQ ID NO: 13262 - protein, 69 aa, Klebsiella pneumoniae
LKPLGLGKREYPLQRPCRLKVCGDRRDYQWADCRLRRLPGCILRHVLIGTLGQWQERRVLNCCHVSSGH

SEQ ID NO: 13263 - protein, 86 aa, Klebsiella pneumoniae
SPLRVSMALTLKPQRKCINNLFLKRAVSARNALSLERVKPPGLFFSAIGIALGNSGSGNAFLSLYIDFMITMLMNYCFLLLIKSQF

SEQ ID NO: 13264 - protein, 286 aa, Klebsiella pneumoniae
LHMRVNFDVLMILDALDRHGSFATAAESLYKTPAALSYMIQKLESDLNIVLLDRSGHRAKFTDTGRLMLEKGRQLLSAARDLEKQAQQLSAGWERELAIALDASFPFSALLPLIAEFYAQNPQTRLNFSHHTLAGSWEELTHHGADIILGAINEPPTSAEWSWQTLGALDNIFVVAPHHPLAQAKEPLANKQLSQHRAIVIRDSARYCHPLNSNLLDEQPQIGVDDFASKVELLCAGLGCGFLPRHIARPWLVKGSLVEKSVACWRDKDITYMAWRSGNDGLAQRE

SEQ ID NO: 13265 - protein, 60 aa, Klebsiella pneumoniae
SPMRVLSWLTHTELNPPGNVALMLPTLLHELSLASMFCRLTLIDSPSGSVRRVSPTAWLS

SEQ ID NO: 13266 - protein, 169 aa, Klebsiella pneumoniae
LRPRQQSDVRLGRGGPRAVPRQEFLDVAMRINPQDKMCGNGKMEKHILRECFESYLPASVAWRQKEQFSDGVGYSWIDTLKEVAAKQISDQQLETASFRFPYNTPTSKEGYLYREIFEELFPLPSAAECVPGGPSVACSSAKAIEWDEAFKTMNDPSGRAVGVHQSAYK

SEQ ID NO: 13267 - protein, 334 aa, Klebsiella pneumoniae
PAPRRGTTGQGRSTSSLRTGEMGKAVIAIHGGAGAISRAQMTPEREREYVAALSTIVESGQKMLAAGASALDAVTEAVRLLEECPLFNAGMGAVFTRDQTHELDACVMDGYSLQAGAVAGVKHLRNPVLAARLVLEKSPHVLLIGEGAENFAISHGMARVDNDLFSTPERLLQLQEAKAGGEIILDHHAAPLDERQKMGTVGAVALDLAGNLAAATSTGGMTNKLPGRVGDSPLPGAGCYANNASVAVSCTGTGEVFMRTLAAYDIAALMEYGQLSLYSACERVVMEKLPALGGSGGLIAVDREGNVVLPFNSEGMYRAWCYAGDTPTIGIYRE

SEQ ID NO: 13268 - protein, 637 aa, Klebsiella pneumoniae
TKQRMKLQNSFRDYTAESSLFVRRALVAFLGILLLTGVLIANLYNVQIVRFDDYQTRSNENRIKLVPIPPSRGIIYDRNGTPLALNRTIYQLEMMPEKVDNVQQTLDALRDVVDLTDDDIAGFKKERARSHRFTSIPVKVNLSEVQVARFAVNQYRFPGVEVKGYKRRYYPYNSALTHVIGYVSKINDKDVDRLDKEGKLANYASTHDIGKLGIERYYEDVLHGQTGYEEVEVNNRGRVIRQLKEVPPQAGRDIYLTLDLKLQQYIETLLAGSRAAVVVTDPRTGAILALVSTPSYDPNLFVDGISSKDYSALLNDPNTPLVNRATQGVYPPASTVKPYVAVSALSAGVITRNTSLFDPGWWQLPGSEKRYRDWKKWGHGHLNVTKALEESADTYFYQVAYDMGIDRLSEWMSKFGYGHYTGIDLSEERSGNMPTREWKLKRFKKPWYQGDTIPVGIGQGYWTATPIQMNKALMILINDGVVKVPHLLQSTVEDGKPVPWVQPHEPPVGDIHSGYWEIAKDGMYGVANRGNGTAHKYFASAPYKIAAKSGTAQVFGLKANETYNAHRISERLRDHKLMTAFAPYNNPQVAVAMILENGGAGPAVGTIMRQILDHIMLGDNNTTLPSENPAVTAGEDQ

SEQ ID NO: 13269 - protein, 312 aa, Klebsiella pneumoniae
WAALLVPCIIATLLAPEPSDVIPVPRSLEQAVAEPLRDFFGRNNAWLILLLIVLYKLGDAFAMSLTTTFLIRGVGFDAGEVGMVNKTLGLFATILGALYGGVLMQRLTLFRALLIFGLLQGVSNAGYWLLSITDKHLYSMATAVFFENLCGGMGTAAFVALLMTLCNKSFSATQFALLSALSAVGRVYVGPIAGWFVEAHGWSTFYLFSVVAAVPGIALLLLCRQTLEHTQRTASFMPRSEFPQAYALALGILTLGCLLLAVWLALLILNALDYTSFSFLSGLLEVAALTAVGGILFGGLLDYLALRKTRLI

SEQ ID NO: 13270 - protein, 413 aa, Klebsiella pneumoniae
TSKRLDCQILTSCYSGFNNSITIGIKRMNNNPLIPESKLPALGTTIFTQMSALAQQHQAINLSQGFPDFDGPRYLQERLAYHVAQGANQYAPMTGVPALREAIAGKTAELYGYQPDVNSEITVTAGATEALYAAITALVRRGDEVICFDPSYDSYAPAVALAGGELRRIALQPPHFRVDWRQFAAALSEKTRLVILNTPHNPSATVWQREDFAALWQAIAEREIYVLSDEVYEHICFAEGGHASVLAHPQLRERAVAVSSFGKTFHMTGWKVGYCVAPAAISAELRKVHQYLTFSVNTPAQLAIADMLREAPEHYRELPAFYRERRDLFIEALRPSRLEILPCEGTYFLLADYSAISDLDDVSFCRWLTTEIGVAAIPLSVFCADPFPHKLIRLCFAKQPATLLAAATRLCQL

SEQ ID NO: 13271 - protein, 288 aa, Klebsiella pneumoniae
FTKRGKQMKMTESQKVAAAAWRIRRYALQMGEVQGQGYIGQALGYADVLATAFSHAMTYRPEDPEWEGRDRFLLSHGHYAIAYYAALLEAGIIPEAELETYGSDDSRLPMSGMATYTPGMEMSGGSLGQGLSIAVGMALGLRQKQSKAWVYNSMSDGELDEGSTWEAAMSAAHYGLSNLINLVDVNKQQADGDSRKILGFEPLQDKWAAFGWYVQRVDGNDLPAVMAAFDNAKSYSGNQPRVILCDTLMGKGVPFLETRDKNHFIRVDADEWQKAIAVLDANKPEGVL

SEQ ID NO: 13272 - protein, 139 aa, Klebsiella pneumoniae
PGKRVDVLGVRPVKTSSVVILVLGEILLSALIIFVLLHQVGKEKKRADDAEGQVTSAQAITANVLTTMTIFNSISEANQHAKEQIALDASGASADIRVAVANDDCANRPVPAGAVKRLQQYANGLRQGAGSGVTGQPDS

SEQ ID NO: 13273 - protein, 580 aa, Klebsiella pneumoniae
PFERGFPAHLTKTLAQAPRWNLPQAVKSVSFAGIMSAVSHPLILFFQDIPVLVSSNVTMQFGSKPLFENISVKFGGGNRYGLIGANGSGKSTFMKILGGDLEPTLGNVSLDPNERIGKLRQDQFAFEAFTVLDTVIMGHGELWEVKQERDRIYALAEMSEEDGYKVADLEVKYGEMDGYSAEARAGELLLGVGIPVEQHYGPMSEVAPGWKLRVLLAQALFSNPDILLLDEPTNNLDIDTIRWLEQTLNDRDSTMIIISHDRHFLNMVCTHMADLDYGELRVYPGNYDEYMTAATQARERLLADNAKKKAQIADLQSFVSRFSANASKSRQATSRARQIDKIKLEEVKASSRQNPFIRFEQDKKLFRNALEVEALTKGFDEGPLFKNVNLLLEVGEKIAILGANGVGKSTMLKTLVGELQPDNGSVKWSENAQIGYYAQDHEYEFENDLTVFEWMSQWKQEGDDEQAVRSILGRLLFSQDDIKKPAKVLSGGEKGRMLFGKLMMQKPNILVMDEPTNHLDMESIESLNMALEMYQGTLIFVSHDREFVSSLATRVLEITPDRVIDFSGNYEDYLRSKGIE

SEQ ID NO: 13274 - protein, 61 aa, Klebsiella pneumoniae
LAERRLEMTIQNMRINHNAVSATHCCDCGEEIPERRRELVAGCQRCADCQEEFEERGKHLR

SEQ ID NO: 13275 - protein, 508 aa, Klebsiella pneumoniae
DRRRADASHLRLQGGSDSPGAAGGPAGSGKRGVAGENYPWLGPDRRLYRAVVRDAGSEKQIKSSRVAVGGGLVPSPRPSPQGEGENHATGREGSPMSALPSPEYSRNMRLIGHSDQGGRPDGVQLMVHRGFAYIGHMVSQGFSVVDVRDPTRPTTVNYIAAPPGTWNVHLQAHDDLLLVINARDLFADARFADEKVYYTRSVGDTVSDVQDKGWSAGLRIFDISTPAQPREISFLSLNGIGIHRIWYVGGRWAYVSALIDGFTDYIFLTIDLADPRKPEVAGRWWLPGMHQAGGETPDWPQGKRYALHHAIIAGDTAYGSWRDGGLTLLDVKDRTQPRLISHRNWSPPFGGGTHTALPLPDRDLLVVLDEAVLDNQEDGEKLIWLFDIREPTNPVSIATFPPPDEADYVAKGAHFGPHNLHENRPGSFVSSTLIFATYQNAGVRAYDISNPYRPLETGALAPAAPERMMDTRPGRPRVIQSCDVFVDAQGIIYSTDYNGGLSVIEYLG

SEQ ID NO: 13276 - protein, 62 aa, Klebsiella pneumoniae
MSRRINNMTPKTGAIRLATLRLFLPDGGCALSGLRSVRPAFNLASTPRWRCRLPGLQRCAIW

SEQ ID NO: 13277 - protein, 71 aa, Klebsiella pneumoniae
LRRRKACPSRQLIVATDRGIFYKMQQAVPEKTLLEAPHRRRKGDLPQLRALSVDGDEWPESHCRGSRAGRR

SEQ ID NO: 13278 - protein, 416 aa, Klebsiella pneumoniae
RPRRRRCWRGLGSARSRRYRKSGPMAFITTSITTRGILSAWNTWRKISTRRPSAISTRMRRTIISCAISPTCRTSRSSSPGSRASKYSMRLTSDSVLDGLPAGTSGVMDDYRRIVRRRLLLILLLALLIVASLLLDFMLGPSGLPLQSLWQTLTDPASADPGTRAIVWDIRLPYAVMAIIVGLALGLAGAEMQTILNNPLASPFTLGVSSAAAFGAALAIVLGIGLPGIPGQWFISANAFIFALLAALLLDGITRWTQVATSGVILFGIALVFTFNALVSMLQFIANEDTLQGLVFWTMGSIDRASWSKVAILLVALALVMPLSLRSAWKLTALRLGEDRAISFGINVRRLRLTTLLRISILSALSVAFVGPIGFIGLVAPHIARMLFGEDHRFYLPASALIGALVLSWPPSPRKT

SEQ ID NO: 13279 - protein, 73 aa, Klebsiella pneumoniae
RARRRFLPRPSPSGLNCDAWLLPSQSIEGSMQERNRLLASKDVADVVSRFDEVDIAIVGIGILEPSQLLKTLR

SEQ ID NO: 13280 - protein, 250 aa, Klebsiella pneumoniae
WPRRSSIRTSFPLIWEKPIMLNARELKVFYGVIQGLKGVDIDVYDREIVTLIGSNGAGKTSTLNGIVNLVRSSGRVSFLNDDISRSQTHQIVRRGLALVPEGRRVFTNLTIEENLRMGAYNNLAGYARLRDRMYALFPRLKERRHQMAGTMSGGEQQMLAIARALMSEPVLLMLDEPSLGLAPKIVGELFGIIKQLREENMTVLLVEQNATAALAIADRAYVLENGRITLSGAAREMLTNPEIKRMYLGG

SEQ ID NO: 13281 - protein, 133 aa, Klebsiella pneumoniae
AAGRRQSPAPACCWGRCQRPAPSGRGAGSVRTSPGLPRAGRPARAADADTECQPATPAHARRSSDGSSPARGWADASRPRRGRPSSRPAGGGHRRPAWSAARRTQIRCPARAAGRGRRLPRSASKRPAIHTAG

SEQ ID NO: 13282 - protein, 474 aa, Klebsiella pneumoniae
TDQLGEFTRGINHPFAFPCQTIDQHEQIGFRFHIDPFGRFVKNQNVGITAQPFANGHLLLVAARKTAQRLTGTGSAHAEAGNHLLRPAPGLPMAKQAPARKAVIGADRQVHRDRLFNENALFASLLRDQRQAAPHRVGWIARSPRLAVQLAPLHPAFAGAEQRFAQLGFARAGQPGDTKNFPLPQAQRNILQQRLIMQTVNLQQHLFAVRRARRREDIAQLVAQHLFDDLFAAQRRHRAALNQPPVAQHRQGVADRLQLMDTMRNKHHPDPLMLQTAYYRKQTLTFMLIQRRGGFIEDQKAAMVRQGAGQQDLLFFGERAAVNGAPDVQRHIQLRQRLARQLPNPRPAEGHARLRQPVQHNVFRNAQARHQRHVHLLLHQVDPQLFSIPRRTNDDRLVVDRHFALIVGVGAAQHGHQRRLTRAVGPGQGMHRPAMEGKVHLVQRLKAGEGQANVMHLKAIRAHHCSRAAINLLI

SEQ ID NO: 13283 - protein, 851 aa, Klebsiella pneumoniae
NRQLCRWITTMPQRWITPGLKTRLAFGMIFLFVQPDVSAAAAGAQQIGGVIIPQAFSQALQDGMSVPLYIHLAGSQSTRDDQRIGSAFIWLDGGQLRVRQIQLEESEGNASVSEQTRQQLIGLANAPFSEALTIPLTDSAQLDLSLRQLLLQLVVKREALGTVLRSRSEDIGQSSVNALSSNLSYNLGVYNNQMRNGGSNTSSYLSLNNVTALREHHVVLDGSLYGIGSGQQDSELYKAMYERDFAGHRFAGGMLDTWNLQSLGPMTAISAGKIYGLSWGNQASSTVFDNSQSATPVIAFLPAAGEVHLTRDGRLLSVQNFAMGNHEVDTRGLPYGIYDVEVEVIVNGRVVSKRTQRVNKLFSRGRGAGAPLAWQVWGGSFHMDRWSESGKKTRPAKESWLAGLSASGSLSTLSWAATGYGYDNQAVGETRLTLPLGESINVNLQNMLASDSSWSSVGSISATLPGGFSSVWVNQERTRIGDQLRRSDADNRAIGGTLNLNALWSKLGTFSVSYNDDRRYNSHYYTADYYQTVYSGAFGSLGLRAGIQRYNNGDSSANTGKYIALDLSLPLGNWFSAGMTHQNGYTMANLSARKQFDEGTIRTIGTNLSRAISGDTGDDKTLSGGAYAQFDARYASGTLNVNSAADGYVNTNLTASGSVGWQGKNIAASGRTDGNAGVIFNTGLEDDGQISARVNGRIFPLSGKRNYLPLSPYGRYEVELQNSKNSLDSYDIVSGRKSHLTLYPGNVAVIEPEVKQMVTVSGRIRAEDGTLLANARINNHIGRTRTDENGEFVMDVDKKYPTIDFSYGGNKTCEVALELSQARGAVWVGDVVCSGLSSWAAVQQSGEENKS

SEQ ID NO: 13284 - protein, 374 aa, Klebsiella pneumoniae
HQVSPTPIRTASMSNSDIRVVPGPANYFSHPGSLERLSDFFNADQLSRAVWVYGERALAGAEPFLPAAFHLPEAKKIRFTGHCSERDVAGLVQASGDDRAVVIGVGGGALLDSAKVLARRLGVPLVAIPTIAATCAAWTPLSVWYSDAGQALNFELFDDANFLVLVEPRIILNAPAEYLLAGIGDTLAKWYEAVVLAPQPEALPLTVRLGINGAQAIRDVLLASSETALADQRRGDLTQAFRDVVEAIIAGGGMVGGLGERYTRVAAAHAVHNGLTVLPQTDKFLHGTKVAYGILVQSALLGQDDVLAQLVQAYQHFNLPTTLAALEVDINNRAELDRVIAHTLRPGESIHYLPVTLTPEVLRAAFEKVEYFSR

SEQ ID NO: 13285 - protein, 110 aa, Klebsiella pneumoniae
TGHSRGPAAGAPPAPPARNRGDRAAQPRGAGCRSRRSAGRPPAAVSPRGSGRPAATTPACSRPRTGRPAGSPAAAFAGRRPRQGCRSRPGDGCPDARCATQDNGREDAPH

SEQ ID NO: 13286 - protein, 158 aa, Klebsiella pneumoniae
YMNRIKFAFGFFISGAMLGLFYNLLNDKIHHKEECTASLVVFKGNTQTNLTLNFMYSLDESKGTVAVSGSYLDGGKLQGHIRRDVIYDMVKNHESHHFHSREINRYGNIDSVSDTFLATILPDFYVYPDEKISYIISKQNEHSFLIKVGSRPLLYCAN

SEQ ID NO: 13287 - protein, 447 aa, Klebsiella pneumoniae
VQCRLVNLNVFKMVYKSLMTLDDLAFDRRHIWHPYTSMTSPLPVYPVVSAHGCELSLAGGEQLVDGMSSWWAAIHGYNHPRLNAALKGQIDQMSHVMFGGITHPPAVALCRQLVAMTPASLECVFLADSGSVAVEVAMKMALQYWQAKGEPRRRFLTFRNGYHGDTFGAMSVCDPQNSMHSLWQGYLPDNLFAPAPQSRFDGEWDEMDMVPFARLMAAHRHEIAAVILEPIVQGVGGMRMYHPEWLKRVRKMCDREGILLIADEIATGFGRTGKLFACEHAGITADILCLGKALTGGTMTLSAAITTRTVAETISNGEAGCFMHGPTFMGNPLACAVAGESLRLLESGEWQLQVAAIEAQLQAELAPARGSALVADVRVLGAIGVVETRRPVNMAALQRFFVEQGVWIRPFGRLIYLMPPYIITPEQLTRLTRAVNQAVQDETFFSE

SEQ ID NO: 13288 - protein, 157 aa, Klebsiella pneumoniae
WSILARKSLARSDCGLAKKASLSASSTIFPSSIKITRFATLRAKPISWVTTIMVIPSLASSTITSSTSLIISGSSAEVGSSNSMAIGSIHRARAMATRCCWPPESCAGYFSACAARPTRSSNLRPFLRAEALSRLSTLTCASVRLSIIDRCGNSSKC

SEQ ID NO: 13289 - protein, 63 aa, Klebsiella pneumoniae
IFFSRVSNIFLCRTVCDIARSTVSFCPGLPTCVVSNACQHTMILFISRFIYWGVVFYYWGGVG

SEQ ID NO: 13290 - protein, 81 aa, Klebsiella pneumoniae
SYFSVTVLSTALLNHTFRIIHAVFWMLYVLSKETNHKEISLCQQCQLYKECQLYKAARLKAAAFHLRDSRPSTSPMLAMRW

SEQ ID NO: 13291 - protein, 139 aa, Klebsiella pneumoniae
TSFRKANMAHFCRYLLSLLICPKLTSGDRDMKKALFAFLALMSFSAVSATTISIPTDSKAKYTIIDKSLNGTMATITTMREGPSGTSYSQRLYDCTSWTVKYLGDGDTLEQMKASKPDEGMSPIVDNSIAYYIGQRACK

SEQ ID NO: 13292 - protein, 573 aa, Klebsiella pneumoniae
SPSRLRWVNSSPYFNREVFLQFDYIIIGAGSAGNVLATRLTEDPNTTVLLLEAGGPDYRFDFRTQMPAALAYPLQGKRYNWAYETEPEPYMNNRRMECGRGKGLGGSSLINGMCYIRGNAMDLDNWAKEPGLEHWSYLDCLPYYRKAETRDIGPNDYHGGDGPVSVTTPKPGNNPLFEAMVEAGVQAGYPRTDDLNGYQQEGFGPMDRTVTPQGRRASTARGYLDQARGRPNLTIRTHALTDHIIFAGKRAVGVEWLEGESTIPSKATANKEVLLCAGAIASPQILQRSGVGNPELLRQFDIPVVHDLPGVGENLQDHLEMYLQYECKEPVSLYPALQWWNQPKIGAEWLFGGTGIGASNQFEAGGFIRSRAEFAWPNIQYHFLPVAINYNGSNAVKEHGFQCHVGSMRSPSRGHVRLKSRDPHAHPAILFNYMSHEQDWQEFRDAIRITREIMNQPALDKYRGREISPGIECQSDAELDEFVRNHAETAFHPCGTCKMGYDEMAVVDGEGRVHGLEGLRVVDASIMPQIITGNLNATTIMIGEKMADAIRGRQPLPRSTATYYVAGDAPVRR

SEQ ID NO: 13293 - protein, 127 aa, Klebsiella pneumoniae
RSTRRGRGDTPAAGPPGPGSQRMTAGFHRPAGRRRHPAALRRAGGGRPGTLPRCADNRRDTPSRRRETRHTAPPNRPPAAYRPAGSRRGTPRALCAPARRFCRLAPGTAPHPARARQSPPEWPDSWR

SEQ ID NO: 13294 - protein, 306 aa, Klebsiella pneumoniae
TGTSSCLYWYWHYYAGGVMTTMPQRESTIAVPDDRRKQLGAFLRARRESLDPQRLGLPRVGRRRTPGLRREEVAMLADVGVTWYTWLEQGREVNPSEAVLVGVANALQCSPLETRHLFVLAGLTPPEATQVTVCEGISPGTRRMLDSLMPQPASIQKPNFDIVAWNDSFCRLMGIDFATLPEEDRNCIYLYLTHETWRSRIENRDVLPTFVSYFRAAMAEHRGDPAWENKLARFFAASSEFEALWHQRYEVRGVENQIKHFNHPQLGRFSLQQMYWYSAPRNGSRLLVYLPMDEAGEQALAWLDQH

SEQ ID NO: 13295 - protein, 294 aa, Klebsiella pneumoniae
RQTRMAVKLRKLLGLAAGWQNVQHNTLTRRSEKKNFAMKLNSRAQSAQNPHNHSPIVLVHGLFGSLDNLGILARDLIADHDIVQVDMRNHGLSPRSPEMTYPAMAQDLLDTLDAHQIERATFIGHSMGGKAVMALTALAPERISGLVAIDIAPVDYHVRRHDEIFAAIRAVSESAASTRQQAAHVMREHLQEEGVIQFLLKSFVDGDWRFNVPVLWDQYPHIVGWETIPAWPHPTQFIPGGNSPYVTDAYRDALLAQFPQARAHVIAGAGHWVHAEKPEAVLRAIRRYLTSIAA

SEQ ID NO: 13296 - protein, 316 aa, Klebsiella pneumoniae
RPARQQDRRFLMLIFIPILIFVALVIVAAAVKIVPQGYQWTVERFGRFTQTLQPGLSLVVPFMDRIGRKVNMMEQVLDIPSQEVISRDNANVTIDAVCFIQVIDAPKAAYEVSNLEQAIVNLTMTNIRTVLGSMELDEMLSQRDSINTRLLHIVDDATNPWGVKITRVEIRDVRPPAELIASMNAQMKAERTKRAYILEAEGVRQAEILKAEGEKQSQILKAEGERQSAFLQAEARERSAEAEARATQMVSSAIASGDIQAINYFVAQKYTDALQQIGAANNSKVVLMPLDASSLMGSIAGISELIKEGAGDRKKS

SEQ ID NO: 13297 - protein, 107 aa, Klebsiella pneumoniae
ESARYIIGRISTLPLTAIGRSLMACIPRIALCGGLMIGVDIREPKTPPLVIVKLPPLRSYTVSLPSRPFTASSLIFFWISAMPSRSTSRRTGLTRPRGVETPMLTSK

SEQ ID NO: 13298 - protein, 143 aa, Klebsiella pneumoniae
AMARARGRGRRELKSEINIVPLLDVLLVLLLIFMATAPIITQSVEVDLPDATESQAVKSNDDPPVIVEVSGVGQYSVKVGQETLSQLPPEQVIAEAKRRLEANEKTVFLIGGAKDVPYDEIIKALNLLHSAGVKSVGLMTKPI

SEQ ID NO: 13299 - protein, 159 aa, Klebsiella pneumoniae
IRYRASEERITAMTAQISAYGRLVADPQTRRTGKGTNMAMARLAVALPCNAADNGEVTFWLGVIAFGKQADALAKHHKGDLVSVAGNMQINQWTGQDGGTQQGYQVIADSVLSARTVRPGGKAGQQGQATDALRRAHEQQPPATGYEGFDQTPPYEDDF

SEQ ID NO: 13300 - protein, 106 aa, Klebsiella pneumoniae
LRHRSTKGRAASQSSNILHIATDRRGRLCEDAFFAVGGRMKLTDKIRRDWHYYAVALGLIFILNGVVGLLGFETQGWQSYAVGLITWVISFWIAGFVIRRRPAEEA

SEQ ID NO: 13301 - protein, 119 aa, Klebsiella pneumoniae
GHDSPDITAARSHYEGLRCDINYKERKRTVNKSQLIDKIAAGADISKAAAGRALDALIASVTESLQAGDDVALVGFGTFAVKERAARTGRNPQTGKEITIAAAKVPGFRAGKALKDAVN

SEQ ID NO: 13302 - protein, 243 aa, Klebsiella pneumoniae
CGDRKMKLEFSIYRYNPDVDDAPHMQDYTLEAEEGRDMMLLDALIQLKEKDPSLSFRRSCREGVCGSDGLNMNGKNGLACITPISALNQPGKKIVIRPLPGLPVIRDLVVDMGQFYAQYEKIKPYLLNNGQNPPAREHLQMPEQREKLDGLYECILCACCSTSCPSFWWNPDKFIGPAGLLAAYRFLIDSRDTETSERLDGLSDAFSVFRCHSIMNCVSVCPKGLNPTRAIGHIKSMLLQRSA

SEQ ID NO: 13303 - protein, 156 aa, Klebsiella pneumoniae
QQDRFRMTDNNTALKKAGLKVTLPRLKILEVLQEPDNHHVSAEDLYKRLIDMGEEIGLATVYRVLNQFDDAGIVTRHNFEGGKSVFELTQQHHHDHLICLDCGKVIEFSDDSIELRQREIASRHGIRLTNHSLYLYGHCAEGDCREDEHAHDAVEK

SEQ ID NO: 13304 - protein, 80 aa, Klebsiella pneumoniae
EIRSAGSGGCENCSQPGRHRRSAESYYQVNPLCLSASRNLSDFDMVGHRQVAFFVTVIPSRQNRSANNELIFCEKPYLSY

SEQ ID NO: 13305 - protein, 69 aa, Klebsiella pneumoniae
LCRRSSRPCTSPSKAPPTPGPSACMAGSAGSPLSSVRWAAAGWCRRTSPGWAGATPFLSMCRSACWCWL

SEQ ID NO: 13306 - protein, 84 aa, Klebsiella pneumoniae
PSRSHFIFKDFKNVFQVLLLKSISGIDIEVWFQLLNIKLNTIACFLCDIVTEFICIYRIGACDTIMLKQDNIITKKANHVLKYQ

SEQ ID NO: 13307 - protein, 151 aa, Klebsiella pneumoniae
SWRRCCFWKRKTRQKDIYLYINSPGGVITAGMSIYDTMQFIKPDVSTICMGQAASMGAFLLTAGAKGKRFCLPNSRVMIHQPLGGYQGQATDIEIHAREILKVKGRMNELMAHHTGQSLEQIERDTERDRFLSAAEAVEYGLVDSILTHRN

SEQ ID NO: 13308 - protein, 63 aa, Klebsiella pneumoniae
LRRSVRRMISSVSFSQWTGIQAAEITPRYRFISEQKAGPVYITNFQLQKVDNAHLGTDEFTVN

SEQ ID NO: 13309 - protein, 122 aa, Klebsiella pneumoniae
IKRLIKRIMVCWQALLTTQVGNPGQNETVDRAMSHTVRHKKMLLTRLKKIQGQSTALEKMLNREHECAEILQQLAAIRGAVNGMMLQVIQGHLTDHVVKEPDETQREADLETVMQVIKSYLK

SEQ ID NO: 13310 - protein, 127 aa, Klebsiella pneumoniae
CCSSWATRSLTSALFLTTRRSCVTLLSTPTSRPMWSLAQAASRWAKPITPKLSSKSWGRSASGSWRLSRGNPSPSASSAAAGSAACRVTRCLPPSPSVSWCNPCWRNSRASTARFRRPACGSAPPRA

SEQ ID NO: 13311 - protein, 147 aa, Klebsiella pneumoniae
PASRPEEGNNKNSMWALFMVRNVKKQRPVNLDLQTIRFPITAIASILHRVSGVITFVAVGILLWLLGTSLSSPEGFLTAASIMDSFFVKFIMWGILTALAYHVVVGIRHLMMDFGYLDETLEAGKRSAKISFVITVVLSLLAGVLVW

SEQ ID NO: 13312 - protein, 274 aa, Klebsiella pneumoniae
RKSSCLTSLASPPPRGSCWRIKASGRRCLPALANWRSLSVALAVTTAAASGVCRENEIDQLPADNYGECIVEQGINFSGEVSLVGARAHDGSTVFYPLTRNLHQDGILRASVAFPQANARQQEQAESMLTAIMNELNYVGVMAMECFVTAEGLLINELAPRVHNSGHWTQNGASISQFELHLRAITGLPLPPPVVNSPSVMINLIGTDLNYDWLKLPLVHLHWYDKEVRPGRKVGHLNLTDSDTDRLSATLEAIKPLLPPEYTSGLFWAQSQLS

SEQ ID NO: 13313 - protein, 154 aa, Klebsiella pneumoniae
KLSSFHQPPPFSVSQLCYSSLICLITIRIMPPVILTIIGWLAVALGTLGVFLPLLPTTPFILLAAWCFARSSPRFHQWLLYRSWFGGYLRHWQQYRAMPRGAKPRAIAMIVVTFAISLWLVKLTWVRIMLLVILACLLIFMWRIPVVDAKQQKH

SEQ ID NO: 13314 - protein, 167 aa, Klebsiella pneumoniae
RQGRCSMKFSKFTELVARIWSNTTTQRRDPEITIVVHSPGSIGPSPSVEVEAIHAGFDWDAGQVMIYPAQPLTVLTPEQVAEISESVRKGQSWHAYEAYKKHKSQLENAALEHAKVAGQRDELLAALEEMTDIVSKHTYPQPDKPNSTWGRLEAAKEVISRTKGGEV

SEQ ID NO: 13315 - protein, 415 aa, Klebsiella pneumoniae
RIIRSDMATHLVWLRTDLRIHDNLALAAACRDPQAQVLALYIATPGQWREHHLAPRQAAFIASHLQSLHAALAERGIPLWVEEADDFTASVERLADFCQQHQVSHLFYNYQYEFNERQRDAAVENTLRDVICQGFDDSVLLPPGSVLTGGGEMYKVFTPFKNAFIRRLRDGLPACVAAPKPRQAPACQAPPLPELNYPQTPFDGLLFAADEKTALARLRAFCQQAAADYEGQRDFPAVEGTSRLSPCLAIGVLSPRQCLHRLLTEHPAALDGGAGATWLNELIWREFYRHLMVYYPKLCKGRPFTAWTDKVAWRAEEAALQAWQRGETGFPIVDAAMRQLNATGWMHNRLRMIVASFLTKDLRLDWRAGERYFMSQLIDGDLAANNGGWQWAASTGTDAAPYFRIFNPTHPGRKV

SEQ ID NO: 13316 - protein, 291 aa, Klebsiella pneumoniae
LRISMSQALSNLLALLDLEKIEEGLFRGQSEDLGLRQVFGGQVVGQALYAAKETVPVERLVHSFHSYFLRPGDSQKPIVYDVEVLRDGNSFSARRVAAIQNGKPIFYMTASFQAPENGYEHQKAMPAAPSPDGLPSETDIARKLAHLLPPQVKDKFLCDKPLEIRPVEFHNPMKGHIAEPVRQVWLRANGAVPDDLRIHQYLLGYASDFNFLPVALQPHGVGFLEPGMQVATIDHSMWFHRPFNINEWLLYSVESTSASSARGFVRGEFYTQDGTLVASTVQEGVMRNRNA

SEQ ID NO: 13317 - protein, 204 aa, Klebsiella pneumoniae
SSVRRMNMSASALICLAPGSEETEAVTTIDLLVRGGVKVTTASVASDGSLTIVCSRGVKLLADAPLVEVADGDFDIIVLPGGIKGAECFRDSTLLVETVRQFHLSGRIVAAICAAPATVLVPHNLFPIGNMTGFPALKEHIPAEQWQDKRVVWDPRVNLLTSQGPGTSIDFALKMIDLLVGREKAYEVASQLVMAAGIYNYYEA

SEQ ID NO: 13318 - protein, 151 aa, Klebsiella pneumoniae
KPSRPDFCKGNSVKPAARRRARECAVQALYSWQLSHNDIADVEYQFLAEQDVKDVDVLYFRELLSGVATNSAYLDGLMKPYLSRQLEELGQVEKAVLRIALFELSKRDDVPYKVAINEAIELAKTFGAEDSHKFVNGVLDKAAPVIRPHKK

SEQ ID NO: 13319 - protein, 318 aa, Klebsiella pneumoniae
RQTRPQGGKENKMATEQLRWGVSPLCWTNDVLEDLGGDIPLDTCLREAREAGYQGIELGRKFPRQASTLGPLLAAADLRLASGWYSGMLADRSVEAELEAVREHAQLLRQLGAKVMVYGECGQLPGETPLDEPISLSPPLSRVSLAAYCHKLNTFADLLLRDYDLQLAYHHHLMMLVEHDDELERFLSHTHDNVGLAFDTGHAFVAGVEIPRVLHKYGHRIRHLHLKDVRPQVLGRLYRENLSFNEAVRAGLFTIPGDGCIDYAPILDFVRDSDYRGWLIIEAEQDPAMAPPLATASRAYAWLAHHLSSPSSSEEYAS

SEQ ID NO: 13320 - protein, 414 aa, Klebsiella pneumoniae
ARASAPPGNSIRPPPLLRQTGKASEDRIKNRQPLRHLLSSNGARRHHVNAVLHHKGQQPGFGQGPFDRSHVGGGQRRFLFTAAHQLQRLEQAATAHLADNGVLLRQRLETGAQHLVADRGRVLNHILLFHRVDGGDNRRHRQRMAGVGQPPGKEVVVKVAGNRLANQHPARRHVAGVNPLGKGHQIRHHAILLEGEPAAGAAKAGHHLIEDQHDAKLVGQGAHALHIACRRHEDPGGAGDGLQQDRRDGRRPLAFNDPPQMRQRALALLFLSRGVELAAVKVGVEEVNVAAGELIRHPAPVAGSGDRAAGVAMIGTIGRQHLVAPGIEPRHANRVLIGIRPGVSEEHLTEARRRQIDDALRRFAAGKVGGGGRDGDQGLQLRLHGRQYPGVLIANVDVHQLAAEIEPGVPLIIP

SEQ ID NO: 13321 - protein, 84 aa, Klebsiella pneumoniae
RNQSIKKTSEEEKMKQQFSTASNYSEACDMLRSGYVKHVRLNWNIGSDEFFRIASDWCDTGAKIKKDEDGFIISLKGFPIPRQH

SEQ ID NO: 13322 - protein, 464 aa, Klebsiella pneumoniae
NRQRAASSSSGCDSLCRLGQLIYPPRAVALVMDLGDAVARRPRMGDAPHCRRSAGAASASGNGGPAAGTGPARGGRSESEGGKIMETLMLLTYAALCIVVFKVFRIPLNKWTVPTAVLGGIALIGAVIFGMNYNFPYTDVGNQVFRTVPIVSQVRGRVQSVPVKPNQMLHKGDVLFTLDPTPFQAKVDDLQAQIKAASQDALSLNAALSQAQAELSRAVAQRDQSRREYARYREGHAQGAFSDQMVDTRLQTWKADEASVSAAQAKVVQARNALDSVVKGKNTTVASLLAQLQKAQFQLENTVVRAPEDGYVSTVGLRPGTMSTALGMIPLMTFVPVEGAASREYVAAFRQNALQRLHKGEPAELMFPAIPGTVFRGEVADVLPAIGESQFQGQGKLLTTDALNTHGRALVVLKVTDPRFAEYALPQGATLEAAVYSDHLKELSLIRKILIRMKSWENYIYLDH

SEQ ID NO: 13323 - protein, 250 aa, Klebsiella pneumoniae
IVQRAFCALDTVYGATMTPIKELGECVIGTDDREYFFRPSFRNMARIGEPAEIVQTFYDLCNDEATPLIQRAAQAYIRDEYSRLPDCVLRYVQGGMLTRKAIMAAHTVLTACCDDDIGNLVGWMKPGKSRKRGFVWRPGSMPPESMVIVAQNLMMHGIIGKAKVRKLQRYETNETTSEFRAADYIMAARNHFGISREEAENLTMTEFSLLLNAKYPNQNGFTREEYDTVMDEDDRRWQSMMEQEQARKTK

SEQ ID NO: 13324 - protein, 187 aa, Klebsiella pneumoniae
QQQSGIDAAGCQQPDGIDRRDQRADQRRRWRSEKIMIGMILAHPHLFWLSLGGLLLAAEMLGGSGYLLWSGVAGVVTGALTWLLPLSWEWQGTLFAVLTLLAAWLWSKWLRKRVKTQRPADAQLNQRGQQLVGRRLTLDAPLVNGRGHVRVGDSSWPVIADEDFAAGSKVEVIAVEGITLRIRPAVR

SEQ ID NO: 13325 - protein, 194 aa, Klebsiella pneumoniae
YFKRRWLAEVFLIKFSWINHMNNDEEFSFVSEISNSKRTIESIIKSELLENFKTDTLIFNSILINLLILTRDITYKSFKLGNEISFTDDVIITNKITNVSMLIKYARDAACHIDSDNHISIETGAKFSFNICFGKGNLANINGVEFRSDYDDDVCIFIGDQKIYLKRHIYRAATEAIQFFKEHYKDTEFSFHLR

SEQ ID NO: 13326 - protein, 410 aa, Klebsiella pneumoniae
VSKSMTAGGQAQIGNVDLVKQLNSAAVYRLIDQHGPISRIQIAEQSQLAPASVTKITRQLIERGLIKEVDQQASTGGRRAISIIAETRNFNAIGVRLGRYDATLTLYDLSSKTLEEKHFPLPERTQETLEHALLNIIATFIENCQRKIRELIAISVILPGLVDPESGVIRYMPHIAVENWGLVGALEKRFNVTCFVGHDIRSLALAEHYFGASQDCEDSILVRVHRGTGAGIISNGRIFIGRNGNVGEIGHIQVDPLGERCHCGNFGCLETVAANAAIEQRVRHLLEQGYQSRLTPDDCTIKTICKAANKGDALACEVIEYVGRHLGKTIAIAINLFNPQKIVVAGEIVEAEKVLLPAIEGCINAQALKAFRKNLPVVRSTLDHRSAIGAFALVKRAMLNGTLLQRLLES

SEQ ID NO: 13327 - protein, 187 aa, Klebsiella pneumoniae
RHESSCRRSGGTSSWVLRDDKENIMKFAYMFSALAVAATLTACANHHSNNSSTQAAAPDPYGIATLSVAQQQPSVTGTINIRQRIALPPDAVLTVTLSDASLADAPARVLSQKAVRTEGKQAPFNFALPYNPADIQPNARILLSAAITVNGQLMFITDTVQTVINQGGTHADLTLVPVQQTAVPVAQ

SEQ ID NO: 13328 - protein, 180 aa, Klebsiella pneumoniae
LLRSLIAGPRRGLAPLFLRSRSMSRSATDSRDLVISRLLSAPAPALWRAWADPALLRTWWCPKPWQTEVLAFDFRAGGAFHTVMHGPDGERNDNPGCFLEVIPQQKIVMTSMLTADYRPAVSPFAMTAIITFADEQVGCRYTATVLHADDETREQHEQMGFFEGWNIVIDQLNDLALTLR

SEQ ID NO: 13329 - protein, 110 aa, Klebsiella pneumoniae
ARGSHQSREERRNLMKFIATLYAIMDKRPLRALSLLMALLLAGCIFWDPSRFAAKTSELEIWHGFLLMWAVCSGVIHGVGFRPRAVHWQGIFCPLIADIVLALGLFFFFF

SEQ ID NO: 13330 - protein, 337 aa, Klebsiella pneumoniae
QTGRSAVMSQSQPRLKTSAMIASIADEGQATVPAPFGVALSKLAAQRPDIVGMTADLSKYTDLHIFAQAFPDRFFQMGMAEQLLMAAAGGMAKEGFIPFATTYAAFATRRAYDFIHQVIAEEHLNVKICAALPGLTTGYGPSHQATEDLAIMRGIPGMVIVDPCDALEIEQAVPAIADHQGPVYMRLLRGKVPLVLDKYDYQFELGKAKLLEDGNDVLIISSGLMTMRALEAAEKLRADNIGVAVLHVPTIKPLDEKAIIEQASKPGRLVVTAENHTAVGGLGEAVAALLMRKGVRCELDSVGLPDAFLLAGALPTLHDRYGISTAKIVEKIKYRLR

SEQ ID NO: 13331 - protein, 324 aa, Klebsiella pneumoniae
FFILFHSPAYLQNQGSTMNIKKTIVASLLACILPAVVMAKDVSIGVSMALFDDNFLTILRTSMQKEMKKDGVKSQIEDAKGDVSQQLQQVQNFIGQGVDAIIVNPVDTNAVKPIMDQATKAGIPLVFVNRRPQAELTDKMAYVGSDSILAGRLQMEALAKAMNGKGNVAILLGDLANESTRDRTKGVEEVVAKYPNIKIVQKQTAKFTRNDAVDVVSNWMTSGEDIQAIASNNDEMAIGALQALGKNPNHILIAGVDGTPDALQMLKSGKMIATIFQDAKGQGEGAVDAAIKLANGEKVEKIIDVPYQLITKENMAEFTNRNQK

SEQ ID NO: 13332 - protein, 60 aa, Klebsiella pneumoniae
ITLSCTPRCRKNQVVGTINLQLDGKTIDQRPLVVLQEIPEGNFFGKIIDYIKLMFHHWFG

SEQ ID NO: 13333 - protein, 323 aa, Klebsiella pneumoniae
STMSKSHPRWRMAKRVLTVLFFIAVIVLLVIYAQKVDWQDVSKVIRGYDRLALFSAIALVIVSYLIYGCYDLLGRAYCGHKLAKRQVMLVSFICYAFNLTLSTWVGGIGMRYRLYSRLGLNGSTITRIFSLSITTNWLGYILLGGVIFTADLVKLPPHWYISQTTLRIIGGVMLILTLCYLFGCAFAKRRHLTIKGQRLVLPSWRFALLQMGLSAANWMAMGAIIWLLLGSEINYFLVLGVLLVSSIAGVIIHIPAGIGVLEAVFIAMLSGEDISKGAIIAALLAWRALYYFLPLLLATVAYLLLESRAKKLRQKNQRKLARE

SEQ ID NO: 13334 - protein, 200 aa, Klebsiella pneumoniae
TCVRKKVVARPKSEDKKQALLEAATAAFAQSGIAASTSAIARSAGVAEGTLFRYFATKDELLNELYLAIKLRLVRTMIAGLDPDEKRPKENARNIWNSYIDWGVRNPMEHKAIRRMALSERITDETRRQVKESFPELNEMCQLSVKEIFLSEAYRAFGDALFLSLAETTIEFASHDPQRAREIIALGFEAMWHALHEADA

SEQ ID NO: 13335 - protein, 419 aa, Klebsiella pneumoniae
RIVRPARARAASLSAAISFPLQDGPSMTLPPAGGNNMIQVAIIGAGFIGPAHLEALRRLGDVEVVALCDSRLEAAQRKAQALNIAHAYDSVEALLAHPGLQVVHNCTPNHLHAQINRQILAAGLHVFSEKPLCMTAEEARELVALAARAGVVHGVSFVYRQFAMVQQAAAMIRHGEVGRIFAAHGSYLQDWMLLETDYNWRVDSAQGGASRTVADIGSHWCDTVQFMTGRRIVEVMADLSIVWPTRKAPVNGKATFSAVHEAQAYETRPVDTEDFGSVLLRFDDGSKGSFMVSQVSAGRKNRLAVEINGSLCSLAWDQEVPQRLWIGHREQPDRLLSDDPSLLRPEIADSAHYPGGHIEGWPDAFKNMMGHFYQAVRAGKMPAAGARRFAAFDDGADVMYIIEAIVKSHQQQRWVSVER

SEQ ID NO: 13336 - protein, 439 aa, Klebsiella pneumoniae
KESSVSIHSSENFSDARGPGRHAWCGLLLAIVPGFGQFYHRQWLKGLVFLVLLSSFLGIFYDFLREGLWGLYTLGEEVPRDNSIFLLAEGIISVLIVAFGVLIYFLSLRDAWLNGKKRDEGIALNSVRKQYQMLLSDGFPYLMITPGFILLVFVVIFPILFGFAIAFTNYNLYHTPPAKLVDWVGLKNFINIFTLSIWRSTFLDVLQWTVVWTLLATTLQCTVGVLLAILVNQKDLRFKPLIRTIFILPWAVPGFVTILVFAGMFNDSFGVINNAILSFFGISPKAWLTDPFWTKTALIMMQTWLGFPFVFAMTTGVLQAIPDDLYEAATMDGASAFTRLRTITLPLVLYAIAPIIITQYTFNFNNFNIIYLFNNGGPAVAGSNAGGTDILVSWIYKLTMSSSQYAIAATITILLSIFVVGLALWQFRATKSFKNDDMA

SEQ ID NO: 13337 - protein, 224 aa, Klebsiella pneumoniae
LLPSAMTSKGEQAKNQLIAAAIAQFGEYGQHATTRDIAAQAGQNIAAITYYFGSKDDLYLACAQWIADFIGDNFRPQAEAAEHLLAGEAPDRQAIRDLILSACHNMILLLTQDDTVNLSKFISREQLAPTAAYHLIHQQVIAPLHHYLTRLIAAWTGCEASDTQMILHTHALLGEVLAFRLGRETILLRTGWTQFDAQKTEQIFEVITCHIDFILHGLSQRSLG

SEQ ID NO: 13338 - protein, 326 aa, Klebsiella pneumoniae
TPARISLLCCANARAATSCSAMARKGRRAVAWCTTPATTLTMTLSPSARRYSPVWWKNTVANLWRRTRMKKSLLLWLALMASTSALAEGGKEIRFGVDPTFAPFEWKDPQGKLAGFDIDLGNAICQQLQAKCVWVESNFDGIIPALKARKFDAILSGMYMTEKRKAQIAFSDKLYNGPVFLVARKNTLQGNTPEQLKGKTIGVEQGSAQETYVNQHWRPQGINIVAYQGADSVVRDLESGRIDGAVLSGMMADYSFLQQPQGKEFAFVGGHLQDDTLFGAGAAIGLRKDDEALRQEINGAIAKILADGTYKKLAGKYFSFDVYSGT

SEQ ID NO: 13339 - protein, 230 aa, Klebsiella pneumoniae
IMARRILVVEDEAPIREMVCFVLEQNGFQPVEAEDYDSAVNQLNEPWPDLILLDWMLPGGSGLQFIKLLKREAMTRDIPVVMLTARGEEEDRVRGLETGADDYITKPFSPKELVARIKAVMRRISPMAVEEVIEMQGLSLDPSSHRVMTGDSPLDMGPTEFKLLHFFMTHPERVYSREQLLNHVWGTNVYVEDRTVDVHIRRLRKALEHSGHDRMVQTVRGTGYRFSARF

SEQ ID NO: 13340 - protein, 405 aa, Klebsiella pneumoniae
APQSANDFKKESTMLNGLKPLSRSLRWGMVGGGGTSQIGYSHRCAALRDNVYTLLAGALDVDAERGRAFGEQLGIAPDRCYADYQTLFREEAQRPDGIEVVSVTTPNNTHFAITKAALEAGLHVICEKPLCFTAEEARELVDLSKKQNKIVGVTYGYAGYQMIQQARQMIADGLLGEIRIVNMQFAHGFHNQAVELQAESTRWRVTPKFAGPSYVLGDLATHPLFVAETMAPQLNIKRLMCSRQSFVPSRAPLEDNAFVLMEYDNGAVGSMWTSAVNSGAMHSQKVRIVGEKASIEWWDEHPNQLSYEVQGEPARILERGMPYLSPNALADDRIGGGHPEGLFEAWANLYRRYAQAIDATDRDDRAFLQDFWYPDVEAGLHGVYWVEQCVKSADAGSQWVDFTLP

SEQ ID NO: 13341 - protein, 99 aa, Klebsiella pneumoniae
IKQSENVMRQTMHQQPDIYARLQDTALSDYFRNAGDKLVDESAVMSLAINSILQSEGHLNNKAIILWLIQALETTDDVVTADVIRKTLEIVVGYTMDDI

SEQ ID NO: 13342 - protein, 73 aa, Klebsiella pneumoniae
RRWRLGCWSCSATTSLPRGRQSLADILTVKESYLAAALSAIHQRYGTVDAWLAAEYQLTAPVRAALQARLLEE

SEQ ID NO: 13343 - protein, 252 aa, Klebsiella pneumoniae
PARSSPLNRITGTTSGPNWKVFRCCSATKPWRTFLLMVDMTQLQAIYGGTFDPVHYGHLKPVEILANQIGLSKVIIMPNNVPPHRPQPEATSAQRVHMLKLAIADKPLFTLDERELRRDTPSWTAQTLQEWRQEQGPRKPLAFIIGQDSLLTFPTWHNYETILDNVHLIVCRRPGYPLTMAQEADQRWLDRHLTHDVESLHNRPSGVIYLAETPWFDISATIIRQRLERGESCAEMLPAAVLDYIREQGLYC

SEQ ID NO: 13344 - protein, 175 aa, Klebsiella pneumoniae
SRRREIAVSPAATGRSGFSAAATRRRPPGRVPVCFARFPPPRRTVWLGCRRYAASAPESPGSRRCRTPSQRSPPTPARAWCVKTPPAREWQSAPAPGTRRYWRQETRKPWRWRLPPGSRPAPAAEFPRSAAAGSAGDSPTRPATLWSAHRRTGCQRSGAEWSLPYSQRNGAASAR

SEQ ID NO: 13345 - protein, 188 aa, Klebsiella pneumoniae
NGRRKAVSSLAKVIPFRPSVTVVERQVADIDDGYTRIANELLEAVMAADLTARQLKVVLAVIRKTYGFGKKFDRITNTQIAEMTGIHHTHVCKAKNEMIAMNIIVTNGLAIGVNKVISDWNFSISQNGKSLAETANETLAKSANTHKPTQLNTKETIQKKERKDPPKSPKGGKLTRSGSDGLLQRANG

SEQ ID NO: 13346 - protein, 519 aa, Klebsiella pneumoniae
LSGSGAGYSLPYPIIVQRLTMFSNRLASHLERGVVGFPTTLASSVGLIMASPVILTVTSGFGMGGDTFALAVLLAFIMMQAQVTTFAEAATLIPTTGSVYDYISCGMGRFFAITGALCAYLIVHIFAGTAETILAGIMALVNFESINAQMAAHQNTWMVGVGMVVIFGLLNAIGVEIFGKVEVVLTFGMWTTLTIFGLCGIFMAPVTHLSGWFGTPLNVSDINGLFGYIGMAMFMFVGCELVTPMAPEIKQAHRTIPRAMALGLLGVASCMFIYGAAINRQVENTVLDAANNVHLLDTPMAIPAFAERVMGHAGQYWLGVGLLLAGCATINTLMAAVPRIIYGMALDGALPHFLTWLHPRFKTPVIAIAIGVAIPCLHAWYLNGDLDRIVPLILAAVCAWGVAYLLVTLSVVMLRIRRPDLPRAYRSPWFPLPQIISSVGIIIAIVNITPPGMDSRQVLVPFGIMLGLTAAYALFWTVCVQRVNPFKPLVVEEVVERAINNYEKQTRGEMTPDVLRPLV

SEQ ID NO: 13347 - protein, 223 aa, Klebsiella pneumoniae
IRGRFSMTDKKVYAAISAVAGELAEKGISKARKQGSQVNYAFRGIDDVYNALAPALVKHKLLILPRCTERSCCERTSKNGGALFYVTVRAEFDFVSTEDGSTHTVVTYGEAMDSGDKATNKAMSIAYKYAAFQAFCIPTEETTVDPDYEAHQVRPADADQILADFTAYAGSENDPKALHDNYGKAWNSLHGFPEHQTKCRDVTGIRLRELKQAASGGSHESNS

SEQ ID NO: 13348 - protein, 106 aa, Klebsiella pneumoniae
QNPGVLYPASVPPGCVKIDNHKEPDSIPELMKKSGEMSVGRRSWRAIIPSLAADCIAIFVKQFLQTGFGGCCLAAENNSLLWPVNGLAGILLAAARRPGYLIPAGW

SEQ ID NO: 13349 - protein, 568 aa, Klebsiella pneumoniae
PYPGMVLPSIETCCGRATNKFVLGHAYEPELLGSFSESSCDEQGVMMLDIVELSRLQFALTAMYHFLFVPLTLGMAFLLAIMETVYVLSGKQIYKDMTKFWGKLFGINFALGVATGLTMEFQFGTNWSYYSHYVGDIFGAPLAIEGLMAFFLESTFVGLFFFGWDRLGKVQHMAVTWLVALGSNLSALWILVANGWMQNPIASDFNFETMRMEMVSFSELVLNPVAQVKFVHTVASGYVTGAMFILAISSWYMLKGRDFAFAKRSFAIAASFGMAAILSVIVLGDESGYEMGDVQKTKLAAIEAEWETQPAPAAFTLFGIPDQNAQTNHFAIQIPYALGIIATRSVDKPVIGLKDLMVQHEERIRNGMKAYALLEQLRAGSTDQAVRDQFNNVKKDLGYGLLLKRYTPNVADATEEQIAKATKDSIPSVAPLYFAFRIMVACGILMLLIIGASFWSVIRNRIGEKKWLLRAAFYGLPLPWIAVESGWFVAEYGRQPWAIGEVLPTAVANSSLTAGDLIFSMLLICGLYTLFLVAELFLMFKFARKGPSSLKTGRYHFEQSSAAIQSAR

SEQ ID NO: 13350 - protein, 407 aa, Klebsiella pneumoniae
THPGGRYRRPPGYLSTYAPAGRSRTGGAGLLQRRPRTARTMRPDPGPLARRAGGQSAHPRANAGRPTGGDQRRTGAFTMSTAIQRRGRPGLATLIEKFPLILFLALLVWLSVQSPYFLSWQNISLMLVQSVPLAILCFGLVCVIAVGGDDVVSGGIDLSLPATAVLGVALLSLGLAEWHTPYLLLLALLAAVCLLCGAINGLLVLAAGLPPLLATLSTSVAFTGLTDLLTGQRRIAVSDPLMVAFRDNSVLDLPWPLVYLLGVFILFQFLLHHSRFGQHVQAVGGNRDMAQMSGLNVRRLTLLVWLLAGIAAGLAILPLLSQGSGSSSGTATPLLLETVLATFIGAAFSRRRVVTIWGALLGAILVNALSNGLGLLGVNIFWMGAIKGGLILVVLAASAVRHKGGEA

SEQ ID NO: 13351 - protein, 253 aa, Klebsiella pneumoniae
LSAGVAMKNSELEQLINDKLNSAAISDFAPNGLQVEGRETVHKIVTGVTACQALLDEAVRLQADAVIVHHGYFWKNESPVIRGMKRRRLKTLLANDINLYGWHLPLDAHPELGNNAQLAHLLGINVLGEIEPLVPWGELSMPVSGLELASWIEARLGRKPLWCGDTGPDTVSRVAWCTGGGQSFIDAAARFGVDAFITGEVSEQTIHSAREQGLHFYAAGHHATERGGIRALSEWLTETTDLDVTFIDIPNPA

SEQ ID NO: 13352 - protein, 386 aa, Klebsiella pneumoniae
LTAGTRRIAMGNSFLSWRRVRALCVKETRQIVRDPSSWLIAVVIPLLLLFIFGYGINLDSSRLRVGVLLEQQSEEALDFVHTMTGSPYIDATVSDSRRQLIEMMQAGRIRAMVVIPVDFDRQMARPGADAPLQLITDGSEPNTANFAQGYVEGIWQIWQHQRAEDRGETFEPLIDVQMRYWFNPAAISQHFIIPGAITIIMTVVGAILTSLVVAREWERGTMEALLSTEITRAELLLCKLIPYYFLGMLAMLLCMLVSVFILGVPYRGSLPILFVITSLFLLSTLGMGLLISTITRNQFNAAQVALNAAFLPSIMLSGFIFQIDSMPAVIRAVTYVIPARYFVSTLQSLFLAGNIPVVLLVNVLFLIASAVMFIGLTWLKTKRRLD

SEQ ID NO: 13353 - protein, 234 aa, Klebsiella pneumoniae
SPAGLALLRSAQPADRRSGPGAASALPARHPADSPSLTARLAISVFAWRAPPASAPAARWRAPRQGRSLPASGKPPATRAIHHPAPASPDSSPPAPRCRSAPGLTSFDAGRMAEWSGSGCRTAGAASLAGTAPAPGPARWPAARAMPPADARRHSPAAADNAAPGRGSGERRASPPAARSLPAAAPECSSAAQGVPPPTAHPPPAGGSASHGKPLWPANSCPDRAPGSPAPQAA

SEQ ID NO: 13354 - protein, 115 aa, Klebsiella pneumoniae
HRAGEKTSSADVGGPMAEFSFSKSLLGNKKRGALTGSHVAYGLFVLICCWAGAQMLSMLIHAPGVFERLMQAQDASRPQVDISLAVGTLFGLIPFLIGCTFIGVLALIVRWRQRR

SEQ ID NO: 13355 - protein, 174 aa, Klebsiella pneumoniae
SRAGRRAQTRSPGTGAKMSQVILDLQLACEETSGLPDEALFQRWVDAVIPPFQEESELTIRLVDVAESHELNLTYRGKDKPTNVLSFPFEAPPGIEMPLLGDLIICRQVVEQEASEQGKPLEAHWAHMVVHGSLHLLGYDHIEDDEAEEMEGLETEIMLALGYEDPYISEKIAE

SEQ ID NO: 13356 - protein, 68 aa, Klebsiella pneumoniae
QPHGHREFHDRYKPGPGLMHTLRPPVYTPHQVSVRSFAAGMMVRTKKKMIPRQGAGRTTLQTFNIFSF

SEQ ID NO: 13357 - protein, 121 aa, Klebsiella pneumoniae
HLNGVAASQRCRRRKFMMIREQIEAKLRAAFDPMYLEVVDESYRHNVPAGSESHFKVVLVSDRFTGERFLNRHRMIYGTLTEELSNTVHALALHTYTIKEWEALQDTVFASPPCRGAGSIA

SEQ ID NO: 13358 - protein, 77 aa, Klebsiella pneumoniae
SDGGAASLCVLFHKKRRNWRGKPHHRHRYLRSRPEPAIETALYSLYIPVMQKKVRAFKLRYYTRGKGGLEWGKVNGA

SEQ ID NO: 13359 - protein, 111 aa, Klebsiella pneumoniae
IGGGIMSLVCTSVSGVAEGHFVVGRTYKPDSNGRLTTQATDDTGCQALWTVENDNIYALVGDLDSEVIVTFEPDNHPNPSHYWRGPRIPHQTKPCITSLPSSVHAWVIYSN

SEQ ID NO: 13360 - protein, 657 aa, Klebsiella pneumoniae
IQGGVAIQLLGIGRIGILRAAMIDARGGGQAFHRLDVIFGAEYRVEVSHPDGIFTVGCAFSGFSLFGIQPDGTGVKTQSQHRLAKDVHLYAAVTLLAVEAVIASGIGNGVRFFDFKQRQRSSDRTVVDLDAHFVLLRVRDPGTLPSIGRRRRRHRARLQRFGMVSIQRQLLPRLVHQAKRRHPAALGITRRGIFQPGGVAVVAHNHFLMTSSGGKQHFIVKEAEGITQQPALRTAARGDQRIVVVAAKIGVIRHRHIMVVIDISGRVPGRHPPGGRIGMHLRRIAEVHLMRNRAGIEIAAYPAHAADRVDNAVSIQAAHRRIAVFIQKLRRAVGTNFMRMLAAEGAVYRPAIGQVIFCLRHAELAFNIAIAPLLAVVFAVVRQRRNEIHAADIDAHRTAVERFLLIAEIERGAETVAAVIKPQRSQRGTAFIIIDSAFTLAMHQVDPGAELVVVAETAPQVEGAAHLRIRGIVDANARGRQIFRPLRLEVNHPADAAAGRAVKQAVSPFENFNALQHLGVHHLTRHHARQAAHRHVIAIELKPADSIGLGEVAVALYGLHASVVTDDIGDSFRLLILNQLRGIADDVKRDVHRFLFAKHPQTAAVGDLAIEECRNHQVAAGFKIAGFVSLDDEGLFARLLRGGSVRGHRRLTGGADG

SEQ ID NO: 13361 - protein, 321 aa, Klebsiella pneumoniae
GVLGMMTRPLGKTGFSIAPLVFGGNVFGWTIDEKTSFALLDAFVDHGFDAIDTADVYSRWAEGNQGGESETIIGRWLQARPGMRDKVKIFTKVGSDLGLPGHKGLSKAWIQQAVDDSLRRLNTDYIDLYFSHWPDPQTPVAETLEAFHSLQQAGKIRAMGASNLDAMQLAGALEVARKGGLPAWQVLQPEYNLYHRSAFEGALCDLCVSRDIGVVTYYSLASGFLTGKYRQPSDLTQSQRGSGIGKYLNPRGMRIIDTLAAVADEQGAKPAEVALAWLIGREGVTAPIASATSVAQVESFARAAALSLSAEQVARLDGASA

SEQ ID NO: 13362 - protein, 637 aa, Klebsiella pneumoniae
HHVGRLFGDFGAFDTHGDTHVGLAQRRRVVDAVAGHADHFAVILQGFHQAQLMLRAGTGKDVVLHRRLRQRRIVHVLQLVAGHGLATVGDPQHLADAHRRLRVVAGDHFHADAGGLAGVDGVNGFRTRGIHHPGDAEENQSLLQVLMVEGGGIKAGRLTGRRHHPQSLTGEARHLLFPVLRLERHRAVAAHLLAAHGEDNVRRTGDQHPGIAIDVLQGRHIFVLRVKGDLGHQTGLHRRELRFRRQHFKRPFGRPAGDPPQTALILGKLAVVTQVDGAQPGLQHGAGLNLHGLIAPLEEDPPLRLVAVAFHPIAAVGGDDRFDGHFVHRQGAGFIRADHGHGAEGFHGRQLTNNRPLARHRLHAERQNNRDDRRQSFRYRGYRQANQRQQQLAHRDIPQREAEDKQRHHHGENNGENRFAELIHLHQQRGTVLLNTRHHLVDMAEFGLRAGGGHHADAAAGADGGPGEDHVHPVAQRQIALQRVGDFIHHRRLAGEDRLFHPQVVGFNQAHIRRHAVAGAQDNDIPRNQVARRDSLMLAVTLDAGIAGEHVADPLQRFFGVALLDMADQGVNHRHAEDHQGINPVPHDGSQRRGGQQHVNQYVVKVGEKAQPARFAFLFRQRVRPTGIQALGGVCGT

SEQ ID NO: 13363 - protein, 488 aa, Klebsiella pneumoniae
CYVGLLNDAMENPMNTSAVSPGRAGLLLLLSGQMLPLIDTSITNVALDAITHTLAASATQLELIVALYGVAFAVCLAMGSKLGDNYGRRRLFMWGVALFGIASLLCGMANSIGALLAARTLQGAGAALIVPQILATLHVTLKGPAHARAISLYGGIGGIAFIVGQMGGGWLVSADIAGLGWRNAFFINVPICLLVLALSRRYVPETRRETPSRIDWQGTLYLALILCCLLFPMALGPELHWPLWLQLMLVAVLPLLFAMRQSALRQQQRGDHPLLPPRLLQLTSIRFGMAIALLFFSAWSGFMFCMALTMQEGLGMAPWQSGNSFIALGVAYFISALYAPRLIARYSMGRILLTGLAVQIAGLLLLCATFSRFGVATNALTLVPATALIGYGQALIVNSFYRIGMRDISASDAGAGSAILSTLQQATLGLGPAILGSLFLALARRGGGNYPQALIDFLLVEVAMMLLLGAIALWLRHHLNRQPATVAS

SEQ ID NO: 13364 - protein, 60 aa, Klebsiella pneumoniae
LSSGKLYCHCCLCLIFGITCFQVIPFYLFPGGKMFIQKLTQRIGLFTENSMHLLTKNNNP

SEQ ID NO: 13365 - protein, 96 aa, Klebsiella pneumoniae
KPSGNYYHEDMLQVLAARGAVGDICLHYYDKNGHPVLRDDEDPVIGMALEKVKKCPNVVALAGGTDKVAAIKGALTGGYIDVLITDYPTARMLVSD

SEQ ID NO: 13366 - protein, 84 aa, Klebsiella pneumoniae
SAAGFAPGLPSAPAGAPTGDAVGRRAGPAQASPAPGRRPPAPGGPAAAGWRPAAAAAPARRGGSATGAGAAGSAAGPAGLFLRQ

SEQ ID NO: 13367 - protein, 341 aa, Klebsiella pneumoniae
RPAGWRCLRLIRPLFLRFTCQKVRQPMPSGAEFTRDERQLNQHENPNDAMSDDNSHSSDTVNSKKGFFSLLLSQLFHGEPKNRDELLALIRDSGQNDLIDEDTRDMLEGVMDIADQRVRDIMIPRSQMITLKRNQTLDECLDVIIESAHSRFPVISEDKDHIEGILMAKDLLPFMRSDAEAFSMEKVLRPAVVVPESKRVDRMLKEFRSQRYHMAIVIDEFGGVSGLVTIEDILELIVGEIEDEYDEEEDIDFRQLSRHTWTVRALASIEDFNDAFDTHFSDEEVDTIGGLVMQAFGHLPARGESIDIDGYQFKVAMADSRRIIQVHVKLPDDAPQPKLEE

SEQ ID NO: 13368 - protein, 447 aa, Klebsiella pneumoniae
LAYGIQIKTIKLLYLHMRLIMKKNTLAALILTTLAAGQLASLQAHAAGQLNVWEDIKKSAGIKTAVSDFEKQYNVKVNLQEMPYAQQLEKLRLDGPAGIGPDVLVIPNDQLGGAVVQGLLSPLSVVQAKQDAFTPASINAFRMDNALYGIPKAVETLVLIYNKDLIDKPLDSLQAWLDYSKTQREQNKYGLLAKFDQIYYSWGAIGPMGGYIFAKNDSGGFNPQQVGLNTPGAVEAVTFLKKFYAEKVFPAGILGDNGLNAIDSLFTEKKAAAVINGPWAFQPYEAAGINYGVAPLPTLPDGKPMSSFLGVKGYVVSTWSKDKALAQQFIEFINQPQYVKARYVATGEIPPLKAMIDDPVIKNDQKASAVAIHSARAVAMPGIPKMGEMWGPANAPLELNPTGKHAPPGRARISGETDDDADRSDAGQQSVIHRHVKSPSGRGTSRL

SEQ ID NO: 13369 - protein, 387 aa, Klebsiella pneumoniae
MCDGYILQGTHRPGETMPLADFHRSDPFTLGIELELQVVNPPGYDLSQDASTLIADVQHQLTVGEAKHDITESMLEIATGVCRDISHAQIQLSAIQQAVQRAALRHHLQICGGGSHPFHAWQRQQISDNPRYVKTVEHFGYLAQQATVFGQHVHVGCQSGDDAIYLLHGLSRFVPHFIALNAASPWFDSTDSRFACSRLNRFSSYPDNGPMPWVADWQGFRRLFRQLSYTSMIDSMKDLHWDIRPSPQFGTVEVRVMDTPLTLAQAIHIAGFIQTLACWLLTERPFKHQPDDYLLYPFNRYQACRYGLDGTLTDVRSGEQRSIRQEILQLADRLAPFAHQLKATAALEAVVRQAKSPHSEAQQMRDFIANGGSLSGLVQKHCEIWAA

SEQ ID NO: 13370 - protein, 385 aa, Klebsiella pneumoniae
STDGEIPMKSFSGKASLMATLVAALVGASSAQAAEIKIGVVLPLSGALSGYGQPSQKGLDIIQAITPTLKNGDTIKLIVIDDKSDKVEAANAMQRLVSSDKVDAVIGEVTSSNTLAMTKIADDSKTPLVSSTATNDRVTRNHPYVSRVCFSDSFQGVVGANLASRDLKAKTAAIVFDSSNDYSVGLAKAFRTQFLKNGGTIPIEVQAPGGSKDFKAQLASVKAKNVDMIYMPIYYTEGALIAVQSKQLGLNKPVVGGDGLAADQVFFDVGKDAVNGYMTTDYYSPNAKEQTPAGETFIKAWEAKYQQPTHTWGAMAADAYNVIVNAMNQCSDPHDRVCVNEKIRATKDFQGVTGTLTLQNGDAIRSAVINEVKDGKLAFRTVVNP

SEQ ID NO: 13371 - protein, 98 aa, Klebsiella pneumoniae
GCCGFSNTARRGPISTMRPRYITATRWLMRSTTAISWEINRNAMPISRCRSSIRLIICARMETSRADTDSSAITTFGFSASARAMQIRCRWPPEKAWG

SEQ ID NO: 13372 - protein, 161 aa, Klebsiella pneumoniae
SHIFCKPLSPGRGLSAPPRRVAFCLLPAFFLRSTVPHKKFGIYLIVLLFPYLLCGRTVEVRMKIVWSKTADKPFSKIDTRYKSRIKSRLEKMDDKASPISDIKKLSSPENHYRLRLGDYRVIYTFGDPPGDTCYVVAVKRRTTTTYLHEEDTEYDYSVHQG

SEQ ID NO: 13373 - protein, 72 aa, Klebsiella pneumoniae
AGSGAAATRHKNVSLSVVSPAATETSPNCNLNDISTFYCLGRTEEEPLCLVSTTYSMTCGLRRGPPPGKRNC

SEQ ID NO: 13374 - protein, 461 aa, Klebsiella pneumoniae
RPAGSQADVTVMTLFSVRFVFQRQREREGHGEGDRHSDNVVQQRAGLHDSHSRDRRQAHRGHVDVHRHHPGAAGGTAHQRGDERFHKAQVNPEDCRLGDPQHRRKRRRQGDSFYFGIFGFKPHRKAGAALGDVGHRPDRQQEVDANRWVAQQSGLDGMEAVMDTGNNDHRIEAAEQQARQPAGVADKRAEDKRNAVAERATGRADQQQGDKAGDNHRQERSEDQVQRVRDHAAQPLLDHAHKPHRQQHREDGALVADHRHFDAEEIHGVEAGGDAPGVGQRRMGEDPAEGRAQIGVTAKFACGGKADQDRQNDKRRRTAHIQHDIESVARVDPTVSFHHPQQAHQQAGGDDGRNNRHEDVGQQAGDALERVQLFPRQVGGFGFARFADACGLDKGGIDFIDHPGAEDDLHLSGIAKAAFHPVDFANRLLIGERVVDQHQPQAGGAVRGAGDIFLAAQQGKQ

SEQ ID NO: 13375 - protein, 455 aa, Klebsiella pneumoniae
SRAGRGICYYFPLVPCYLSATMKFPGKRKSKHYFPVNARDPLLQQIQPENESSVSWVVGIDQTLVDIEAKVDEAFIVRYGLSAGHSLVIEDDVAEALYQELVRNNLITHQFAGGTIGNTMHNYSVLADDRSVLLGVMCSNIEIGGYAYRYLCNTSSRTDLNYLQGVDGAIGRCFTLIGDSGERTFAISPGHMNKLRPESIPEAVIAGASALVLTFYLVRCKPGEPMPDATMKAIEYAKKHDVPVVLTLGTKYVIADNPAWWQEFLQEHVSILAMNEEEGEALTGFADPLSAANKALDWVDLVLCTAGPAGLYMAGFTEEEAKRKTQHPLLPGAIPEFNQFEFSRAMRHQDCVNPLRIYSHIAPYMGGPEKIMNTNGAGDGALAALLHDITANNYHRNNVPNSSKHKCKWLTYSSLAQVCKYANRVSYQVLNQHSPRLTRGLPEREDSLEEAYWDR

SEQ ID NO: 13376 - protein, 502 aa, Klebsiella pneumoniae
AGAGMDFYLGIDIGTSRVKAVLFDQHFTACASAAENTSPRLSANGYAEQDMTQLWHSVLATLRQIARHPALQAGRLRAIGLAGQGEGVWLSDEQGEPVGPGILWSDTRSHELMSDLLRRPGFDRRYFADTGTHLQPCNTSLQLYWLKQYQPARLAAARYLFFAKDWIRFRLTGVAALELTDASSSLLNQQTGSWSSVVMNEMGLNELLPMFPPLLAPDALAGTLSDAVAALTGLPAATPVAAGALDVCSAALGCGAVNEGDIYTILGTTCCTGIVCRGPQTVNEATRFVTHTEAGQVISLFPMQAGTPNIDWLQQHISLDADLGRLEQAIAAVEPGSGGVFWQPYLNGERAPFYSPDARAGFFGISPHTTRAELQRAVFEGLAFAIVDALQGYPQGGELYLTGGGAASATWLQIIADCTGRTVVSSAFNELSARGAAILAARSVAALAETPPLAQTRYQPRPQAHARYAALYPVYRLLREQMLPVWQARQAALQPLSQDLQP

SEQ ID NO: 13377 - protein, 116 aa, Klebsiella pneumoniae
SLQGIAMKELTLNEMEYISGGFNLFGAASGFASFVANSGVGFTSFVLTSGTAFASFVGDSAMAFGSFLTGQSNWETFVTAGKENWGSFVNTAGNSWNTFVNNAASDWNTFLTKASA

SEQ ID NO: 13378 - protein, 374 aa, Klebsiella pneumoniae
SRQGSIMAARLSRIIPVSLTLLAAMALSACTSQQAPALKEGEKPVDVASVVRQKMPASVKDREAWAQAIATAFDSQKLAPTEENVCSVLAVAQQESNYQSDPVVPGLNKIAWQEIDRRAEKMHIPPFLVHTALKITSPNGKSYSDRLDNVKTEKQLSAIFDDFIGMVPMGQKLFGSLNPVHTGGPMQVSIAFAEQHTSGYPWKMNGTVRQEVFSLRGGLWFGTYHLLNYPASYSAPLYRFADFNAGWYASRNAAFQNAVVKASGVKLALDGDLIRYDSEEPGSTELAVRRLASQLGMSDSEIHRQLKKGDSLAFEKTDLYQQVFRLAEKKAGKTLPREMLPGIQLESPKITRNLTTAWFAKRVDERRANCMARR

SEQ ID NO: 13379 - protein, 408 aa, Klebsiella pneumoniae
FWQGSSCASESFTKSREGVGWRKDSRLETHNIGRCASIGSLIFYRVDPMKYTLPALTLAISAALSGCATPHSSAVSQPVVDSPVPNVAQPLQRQLAEGLYEMALSPQGDALYVASAEGFKNVQGGAVYTLDPHTLNTIGLTHTDLKNFALQLSAEGKTLYVSNSLDGGISAIDTATGKVKNRLLFSERNEKGRPYGARQLLLLNNTLYVGAVADPAQIWVVDATTLKLKTRIKNTGKWMTGLHYSAQTGRVYAANGSGEILVINPRNQRIEQRWKPLGDKPALLLNMAEDSDTGRLFVTDNSKAKTTLVLDIHSGKLLKQLDVGDSLAVQFNKKRHEIYISQRESGKVISLDASRYTLKKSWALPANPNSLLLSADGQTLFVTVKQPFNKDHSTKGPDSVVRIDLNAQ

SEQ ID NO: 13380 - protein, 86 aa, Klebsiella pneumoniae
ARRGARKQQHPSSIHHRRTGRHQTPLQRVTPRTRQAKGGRMNQDAIERIRERWYKLRLCRHRGTVLVDYRILKKFVRIYQTLGETA

SEQ ID NO: 13381 - protein, 266 aa, Klebsiella pneumoniae
MGRGRTLQSPVWGAVMTVELSDEEMLRYNRQIVLRGFDFDGQERLKAARVLVVGLGGLGCAAAQYLAAAGVGQLTLLDFDTVSLSNLQRQTLHSDATLGQPKVDSAREALARINPHVRLVPLNALLDETALAAQIADHDLVLDCTDNVAIRNQLNVGCFQHKTPLVSGAAIRMEGQISVFTYQDGEPCYRCLSRLFGENALTCVEAGVMAPLVGTIGSLQAMEAIKLLSGYGTPASGKIVIYDAMTCQFREMRLMRHPQCEVCGSH

SEQ ID NO: 13382 - protein, 555 aa, Klebsiella pneumoniae
AGRGDRQRAVAAGRAGPLRRPRIRRCAGQNITTHNASFQENTMTQPVSRKWWLALSIAAALASAPAFAAKDVVVAVGSNFTTLDPYDANDTLSQAVAKSFYQGLFGLDKEMKLQNVLAESYTVSPDGLVYTIKLHSGVKFQDGTDFNAEAVKANLDRASNPDNHLKRYNLYKNIASTEAVDPTTVKITLKQPFSAFINILAHPATAMISPAALKKYGKDIGFHPVGTGPYKLDTWNQTDFVKVSKFDGYWQPGLPKLDSITWRPVVDNNTRAAMLQTGEAQFAFPIPYEQAPLLAKNSKLELVASPSIMQRYISMNVTQKPFDNPKVREAINYAINRQALVKVAFAGYATPATGVVPPSIAYAQTYTAWPYDPAKARQLLKEAGYPNGFSTTLWSSHNHSTAQKVLQFTQQQLAQVGIKAQVTAMDAGQRAAEVEGKGQKESGVRMFYTGWSASTGEADWALSPLFASQNWPPTLFNTAFYSNPQVDNALSEALKTTDPQQKTKLYKEAQDIIWKESPWVPLVVEKLVSAHSKNLTGFYIQPDTGFSFEQADLTP

SEQ ID NO: 13383 - protein, 661 aa, Klebsiella pneumoniae
TNGGGLRRLRLKNFPAVPISHSTVFYPFKMALLRLNQMKGQETRGFQSEVKQLLHLMIHSLYSNKEIFLRELISNASDAADKLRFRALSQPDLYEGDGELRVRVSFDKDNRTLTIADNGIGMNREEVIDHLGTIAKSGTKAFLESMGSDQAKDSQLIGQFGVGFYSAFIVADKVTVRTRAAGDKPENGVFWESAGEGEYTVADITKADRGTEITLHLREGEDDFLNDWRVRSIISKYSDHIALPVEIEKREEKDGETVISWEKINKAQALWTRSKSEVNDDEYKEFYKHIAHDYSDPLTWSHNRVEGKQEYTSLLYIPSQAPWDMWNRDHKHGLKLYVQRVFIMDDAEQFMPNYLRFVRGLIDSNDLPLNVSREILQDSSVTRNLRTALTKRALQMLDKLAKDDAEKYQTFWKQFGLVLKEGPAEDPSNQEAIAKLLRFATTHTDSSAQTVSLEEYVSRMKEGQEKIYYITADSYAAAKSSPHLELLRKKGIEVLLLSDRIDEWMMSYLTEFDGKAFQSVAKADESLDKLADEVDESTKEAEKALEPFVERVKNLLGDRVKEVRLTHRLTDTPAIVTTDADEMSTQMAKLFAAAGQAAPEVKYIFELNPAHQLVKRAADTQDDAQFGEWVELLLDQALLAERGTLEDPNQFIRRMNQLLAS

SEQ ID NO: 13384 - protein, 305 aa, Klebsiella pneumoniae
PGGGDAGASGVAAVRYRPGLSETRRIPCRRCRQGMQAGLTAALQKLPDAFGVRLSEELLRRRLLYQQSLLQKHHLIGHLAGKIHLVGHHHHGVALGGKGFHYPQHLINQLRIQRRRRFIEENNFRRHRQRTGDRHPLLLPAGESDRVNIGFVRHAHFLQLLHGHGLRLVSFHALNAQQRLADVLLHGQVRPQVKTLKDHPHPLADFGQLAVRHRPAALFINPQPLTADMNFTAVRLFQPVHTAQQGGFSRPGRAENTHHGPLLHRQVNIPQDFHIIELFGDVFDAYGNRLRHGSFLFWLPRRSGA

SEQ ID NO: 13385 - protein, 704 aa, Klebsiella pneumoniae
AGGGLCQTAHSERVSGGWFSRRRERRSPARRASAVGGRPHRWHQLFPQRPAHLVPVAGDRRRRRTGHRRGLRPQPSRAVSRPAGPWRLAQRRSDPSAPRDDGQRGRDGRRHLASRHPGGLSAVSAGAAQRRRHVYPQRLRGVDERLGGGGPVDWLLRAAHEPVGRPTGAGADARSGRRQQRFSGAGGDPARQSAAAGQPDALPAAEKDDPTTITLTLTGQAISDYVLYTVTITSFTDEPHQSVRPPTCGEPPMSGIIAFFRASPPKAGAAFDEHRFRRVRWQTFIAMTLAYVTFYVCRLSFTVAKSALVELGITPTELGMIGSTLFFSYAIGKLVNGFIADHANVVRYMSLGLLLSAGMNLMMGMTTNALLLAIFWGINGWAQSMGVGPCAVSLARWYGVKERGTFYGIWSTAHNIGEAVTYMVIAAVIAGFGWQMGYLSTAALGAAGVVLLVLFMHDSPQSSGFPSINVIRDEPQEEVEARGSVFKNQLLALRNPALWTLALASAFMYIDRYAVNSWGIFFLEQDKAYSTLEASGIIGVNAIAGIAGTIIAGMLSDRFFPRNRSVMAGFISLLNTAGFALMLWSPHNYYTDILAMIIFGATIGALTCFLGGLIAVDISSRKAAGAALGTIGIASYAGAGLGEFLTGIIIDKTAILENGKTLYDFSTLALFWVGTGLGSALLCFTTAAIVARRHAVERQTSFSS

SEQ ID NO: 13386 - protein, 104 aa, Klebsiella pneumoniae
RAGGSMNNVINWFEIPVADMDRAVAFYEPVMQVSLRRETMDCAELAVFPHQDPAPGGALAKFEGIAPSAQGAIIYLHTDHLAATLERVASAGWGLCLRPADAAE

SEQ ID NO: 13387 - protein, 198 aa, Klebsiella pneumoniae
EQGGHMLKRAQRRCKICRTKFTPAFENHRWCCPEHGAEFAMQELEKKREKQAQAKEKKERAAWRKRKTALKPLRHWEDMTQRVVNDYIRERDHDLPCISCGTFDTVQWEAGHYRSRGKASHLRYNEDNIHKQCHHCNVQMSGNQQQYRIALVEKIGAERVEALENNNTPHRYTIEELEGIRRHCSALRRALVKQREAA

SEQ ID NO: 13388 - protein, 281 aa, Klebsiella pneumoniae
PTGGFLMSVVLNDKPRQSTLKWRWPLSRQLTLSVATLAVLLAVWWAVAALQLISPLFLPPPGQVLQKLITIAGPQGFMDATLWQHLAASLTRIVIALLAAVLIGVPVGIAMGLNSTVRGILDPLIELYRPVPPLAYLPLMVIWFGIGETSKILLIYLAIFAPVAMSALAGVKSAQQVRIRAARSLGASRAQVLWLVILPGALPEILTGLRIGLGVGWSTLVAAELIAATRGLGFMVQSAGEFLATDVVLAGIAVIAIIAFLLELGLRALQRRLTPWHGEVQ

SEQ ID NO: 13389 - protein, 209 aa, Klebsiella pneumoniae
GGLGMAEDYFHIAPKIVPKWSLFPALKVGDTIKTGDFNPFFNFFLSSNLPTENVNVDGEVSPWSWMQFLAGIRYGTMNTSMGVQDIATRGHYLAMHFCKYTRELIWESVRATHYPDKPSRQKCIWVCCGADNLEYWKPHLSNKKDDLLVYRVELDGVTHEASDEHLMKDDMPYEEALLMAHRYWKGEIANPLAKETLFEGRMKILELIH

SEQ ID NO: 13390 - protein, 60 aa, Klebsiella pneumoniae
IWLGYEDSNLGMPELESGALPLGDTPTNCLRIYRCVSIRPEFGGYDGIRTCDPIIMSDVL

SEQ ID NO: 13391 - protein, 88 aa, Klebsiella pneumoniae
RRMGKRQPARHVAKSPVITSLCRQAGDNADRTSRRRPGGSATDYFCGRMAGKRITSRMVWLLVNSITMRSIPIPRPAVGGRPYSRAVT

SEQ ID NO: 13392 - protein, 521 aa, Klebsiella pneumoniae
SQMGRIAVSDGGRVVWNLLSVTGGRNALLPEEPRMIRHLLHVDFQPGRGLQEQVRETLVNAILSGIFAADTPLPSCRQLASQLRVSRNTTALVFESLVNEGYLISRPRSGYYLHPDYHEASPAAVESAPQREAAAPRWGDRLQMTPSQQESILKPAGWMHYRYPFIYGQPDTRQFPLATWRSAANWLHGGVRDPAWVIDHIDQDVPMLIEQIRTRVLPKRGIVAAPDEILITLGSQNALYLLTRLLLSSTTRIGVENPCFREAINTFLLADAEVVPHPVDEEGIVLNERPCDYYYVTPGHQVPTGVTMSSARRRQLLEHAARHDAVIIEDDYDSESNFTLNPLPALKASDRSGRVVYVSSLSKALSPGLRLGFMVADPDLIDEARALRRLVYRHPPTNIQYQMAHFLAQGHYETHLRRYHYDSAQRWERLHAALQRYLPSCRALAGSEHANAFWLQTPAQINTQQLTWRAAHAGVLIEPGARHFLNAAPPDNYFRMGFHAINPDAIAQGVEVLRGQLEQMG

SEQ ID NO: 13393 - protein, 217 aa, Klebsiella pneumoniae
TCVGNEVSIIPIIQTGRSTHCKVHRPPRLCYNTPLYLTRHRVLAPHSSEQDAKMVTFHTNHGDIVIKTFDDKAPETVKNFLDYCREGFYDNTIFHRVINGFMIQGGGFEPGMKQKATKSPIQNEANNGLKNTRGTLAMARTQAPHSATAQFFINVVDNDFLNFSGESLQGWGYCVFAEVVEGMDVVDKIKAVATGRSGMHQDVPKDDVIIKSVTVSE

SEQ ID NO: 13394 - protein, 795 aa, Klebsiella pneumoniae
RAVGSASFIRTCQIGLIQPATECLCPLLATFMPPPLPVGRGVWGTWRQKAGITMNNRIKSLALLVNLGIYGVAFPLSAAETATDDKNSAAEETMVVTAAEQNLQAPGVSTITADEIRKRPPARDVSEIIRTMPGVNLTGNSTSGQRGNNRQIDIRGMGPENTLILIDGKPVTSRNSVRLGWRGERDTRGDTSWVPPEMIERIEVIRGPAAARYGNGAAGGVVNIITKKTGDEWHGSWNTYMNAPEHKDEGSTKRTNFSLSGPLGGDFSFRLFGNLDKTQADAWDINQGHQSERTGIYADTLPAGREGVKNKNIDGLVRWEFAPMQSLEFEAGYSRQGNLYAGDTQNTNTNDLVKENYGKETNRLYRNTYSVTWNGAWDNGVTTSNWAQYERTRNSRKGEGLAGGTEGIFNSNQFSDIDLSDVMLHSEVSIPFDYLVNQNLTLGSEWNQQRMKDNASNTQALSGGEIPGYDSTGRSPYSQAEIFSLFAENNMELTDTTMLTPALRFDHHSIVGNNWSPSLNLSQGLWDDFTLKMGIARAYKAPSLYQTNPNYILYSKGQGCYASKDGCYLQGNDDLKAETSINKEIGLEFKRDGWLAGVTWFRNDYRNKIEAGYAPVYQNNKGTDLYQWENVPKAVVEGLEGTLNVPVSETVNWTNNITYMLQSKNKKTGDRLSIIPEYTLNSTLSWQVRDDVSLQSTFTWYGKQEPKKYNYKGQPVTGSEKNEVSPYSILGLSATWDVTKYVSLTGGVDNLFDKRHWRAGNAQTTGGATGYMYGAGAETYNESGRTWYLSVNTHF

SEQ ID NO: 13395 - protein, 635 aa, Klebsiella pneumoniae
ASSGSHRGNKMNILGFFQRLGRALQLPIAVLPVAALLLRFGQPDLLNVPFIAQAGGAIFDNLALIFAIGVASSWSKDNAGSAALAGAVGYFVMTKAMVTINPEINMGVLAGIITGLVAGAVYNRWAGIKLPDFLSFFGGKRFVPIATGFFCLILAAIFGYVWPPVQHAIHSGGEWIVSAGALGSGIFGFINRLLIPTGLHQVLNTIAWFQIGEFTNAAGAVFHGDINRFYAGDGTAGMFMSGFFPIMMFGLPGAALAMYLAAPKARRPMVGGMLLSVAITAFLTGVTEPLEFLFMFLAPLLYLLHAVLTGISLFIATALGIHAGFSFSAGAIDYVLMYSLPAASKNVWMLLVMGVVFFFVYFLLFSAVIRMFNLKTPGREDKAADVVTEEANSNTEEGLTQLATSYIAAVGGTDNLKAIDACITRLRLTVGDSAKVNDAACKRLGASGVVKLNKQTIQVIVGAKAESIGDEMKKVVTRGPVAAAAAAPAGNVATAAPAAKPQAVANAKTVESLVSPITGDVVALEQVPDEAFASKAVGDGIAVKPTSNIVVAPAAGTVVKIFNTNHAFCLETNNGAEIVVHMGIDTVALEGKGFKRLVEEGTDVKAGEPILEMDLDFLKRQRALNDQSGRLQQQR

SEQ ID NO: 13396 - protein, 276 aa, Klebsiella pneumoniae
GRTGYSEKGSAVLCKGARLKYRFINDHREIWSIVTMCRVLKVARAGFYVWLHNPVSAGEKDNQRLLALIRDSYTLSGGVYGYRRIHGDLREIGEVCSRNRVAKIMRKNRIQAIHGYKVPRGTRGRPSLIAPNRVQREFTVVKPNQVWVTDITYIRTWQGWLYLAVVIDLFARNVVGWSMKPTLSRELALDALLMAVWRGKPSENVIVHSDQGSQYGSDDWQRFCRANNLAPSMSRRGNCWDNAVAESFFSSLKKERIRKRIYKTRDMARAGYFRLH

SEQ ID NO: 13397 - protein, 102 aa, Klebsiella pneumoniae
RPAGISDQVVRFLPGLLKTQEGGIGAFTQLLVGTLTFAKGRSIPYHVENVILDLEGKTDIFRIAIQRGQGSAAAFAGAQGSHPDGGADQGARFMAMDTLQRL

SEQ ID NO: 13398 - protein, 60 aa, Klebsiella pneumoniae
SCQGRKVIRYQNGIAASEPIVPGTTGLKPLPKPVASRCHGLRILRRLSASSRLRKVIVSL

SEQ ID NO: 13399 - protein, 81 aa, Klebsiella pneumoniae
GGEGRLYLIVLLPEEGRTMPNRPPYPREARVVAVEKGPQGQTVTWYQLRADYPEPDSLISEHPTEQEAVDAKRRYEDPDKS

SEQ ID NO: 13400 - protein, 574 aa, Klebsiella pneumoniae
STEGKRAHQNLNLCDLMSKAVLMVFIGLNPNQTKMPERSSAVRVGYVLLLRLSASAIDDSKTRYLILRWQAFGAKSETVQAIPFADIGEREGWRTLKAGGVNVTTKSGLRATLADWLQSCANGEVWRIAHATGWQCGAYIMPDGEIIGTPEQPVLFNGRSSAASGYTTSGTVDSWRESVGRLAFGNYSMMTGVAAALAAPLIGLAGADGFGIHLYEQSSAGKTTTANVASSLYGNPDVLRLTWYGTALGLANEAAAHNDALMPLDEIGQGADPVEVYKSAYALFNGTGKLQGAKEGGNRDLKRWRTVAISTGEMDLETFIASAGRKAKAGQLVRLLNIPMRRAVRFHEHANGKHHADALKDAYQHHHGVAGREWVKWLADHQQEAVSAVRVTEERWRSLIPSDYGEQVHRVGARFAILEAALLLGNVITGWDEQTCRDAIQYSYNAWLREFGTGNKEHQQIIEQTEAFLNAYGMSRFAPFPYDPSSLPISNMAGYRQKGGHDADPMVFYTFPAAFEGEIARGFNARQFAEVLKKAGMLTPPTSGRGFQRKSPRIDGRQIRVYVLQYLPDDDQPE

SEQ ID NO: 13401 - protein, 441 aa, Klebsiella pneumoniae
ACWGTNRMSTTPLTLSFAGQQPPIALPQVPGTRGPVGVDMRGLNQSGFCSYDPGFANTAGCQSAISWIDTENSVLLHRGYPVDQLARQCDFLEVAYIMLNGDAPDEASYQTFRETITRHTLVHEQIARMCSGFRRDSHPMALMCALVGALAAFYHDVLDVENPQHRALAATRLLSKMPTIAAMSYKYTIEQPAAYPRNDLSYAGNFLQMLFAIPAEKYVLNPVIEQAMNQILVLHADHGQCASTSTVRAAGSSGANLFACVAAGLASLWGPMHGGANESSMRMLEEIESVDQVPAFLRQAKRDPQAFRRLGFGNSRYRHRDPRADILRETSHRVLAEVGMSDRLLQVAMALEDVALTDPYFVDNGLSPSVDFYTAVILKAMNLPSSMFAVVTAVGRTVGWVAHWNEMHQAPLTIYRPRQIYVGEGYRDYVSRRGERSTGPQ

SEQ ID NO: 13402 - protein, 192 aa, Klebsiella pneumoniae
TCRGEDQYRTKGVTYCLHCDGPLFKGKRVAVIGGGNSGVEAAIDLAGVVEHVTLLEFAPEMKADQVLQDKVRSLKNVDIILNAQTTEVKGDGSKVTGLQYRDRVSGDEHHVALAGIFVQIGLLPNTTWLEGAVERNRMGEIIIDAKCETNVKGVFAAGDCTTVPYKQIIIAAGEGAKASLSAFDYLIRTKTA

SEQ ID NO: 13403 - protein, 287 aa, Klebsiella pneumoniae
CTRGDRSTRCRRGRCRARRTLTPAPCGPAGQMRIPTARCCRPSTEPRTLRRQPMAIVNLQDLQVTFGAKTAVSAASFRVDAGETFSLIGASGCGKSTILRVLAGLQREWRGSVDLLGQAIMPGARFQGDLRRNVQMVFQDPYASLHPNHTLWRTLAEPLQIHGIRDVAPRVTTALEQVGLAADAVRRYPHQLSGGQRQRVAIARALLLRPQILLLDEPTSALDMSVQAEILNLLNRLKQEHGMTYLLVSHDADVIAHMSDRAAFMAEGVIQRFFDREALVNGEHRMR

SEQ ID NO: 13404 - protein, 433 aa, Klebsiella pneumoniae
KTGGIFRCILHCAGEMVIGAGLVDEAYRPLIDGNHARFCAIGYQMGEALLAAVGPGQHRYRRPEKVGGPIGSLASVKRRRETQRGAIVGRRRHGEVFAGMWPIARRQRARGEAACGQHHPASGVQRLSLPLILNLHPADRALRFAQRQNIDIQPQVHAFTQRRSRHAGNQRIAHRQAGTARVLHPVAGIAQQQPGAMGQGAQRAAHVEKMLNIDAVDHHPAKQQHPRRRRTQVAKRVPQFTAVILHHLQRTTDVDCAGFIRIVIGRERTQAVLYCPLTLEKGQRLPPGADKRFGKIFSVLALADNGSQVGFHRLGATAFALGARLVGIVQPHGAAGDGRGAAELAGFLQHQHRQPFTAGGDRGGKTGRAAADDDHIPALHAAAPCACGMAPINWPISLICASAISGPVCTLQPRAAAKVSNGVITGAVTTSAT

SEQ ID NO: 13405 - protein, 463 aa, Klebsiella pneumoniae
AQGGQSMSRFIDLYVEQAVIGGIMLAAGRSDGADMATDAIEGLTEDHFTATPHKVALRSYKRLNESGSKIDLLTLTSDLERLGALESAGGFAYLAECSKNTPSFANLAAYCEKLREMHLGRRMTLALQVGIQKLSEPSSEGIADIIGNIQADISGIEHSADYGTEHITTGIDMSLEAIQSIINGDIWKHKTELGMATIDSAFGGFNNTDFIVVGGRPGMGKTMFSTTVTETVGLKNKKPVLFFSLEMPVEQISERVAFHRARVSKEDLLSKVSGKMDEAWGKVSHCMKEFIDSPIYINDKPSLSVHQVRAEARRMSKKLGGLGVVIVDYLQKMRMSDPENMNRSAGEIATGLKNLAKELRCPVIALAQLNRNLEQRANKRPVAADLRESGVIEQEADVIFMVYRDEKYNENTELKGITEIICVKSRHAPGAEKTYHFSSRYSGLDPVDFTYSGQVQQEADYEC

SEQ ID NO: 13406 - protein, 451 aa, Klebsiella pneumoniae
RGFIHAASSGDRAQLRIHWRPFTGRCGFAEPQVAAEHHRRENQRQQQVIPDHRHQAEHRHAEGKGRRQRVERGAERTDQLRLATAQFEQRRHGSDIHNNSPKYRHGDDAGGQRHAADGDQRVGEDRGDPHHAPGEDRQMRGARAAVEGGQPGGQIAGAGEGVDLPRVAHNDAVEGGDEAKQPQPHQHMQPAAAVAHDRLHRLGQRIVNIGQRAPVADAAGEDHHADRQHRQRQNAAAQGAGNGALRIFGLFGRHGGPLNGEEEPDGERNGGEHPRQRQAAEAVRARPAVSGEVAPGEAGGDHAHEHQQLEDGQQGDDQLEGGGDADAENIERHKDHVGAAGDPFRIQRRKLHVEVGPDGHGDGRRGEDEFNQGGKTSDKAAGGPEGAVGIGERAASVRDGGGQLGKAENKGAVHGGDRQGDDHKPHRARLRPAVAPAEVLPGYHQSDGDPP

SEQ ID NO: 13407 - protein, 404 aa, Klebsiella pneumoniae
GRFMRLLHTSDWHLGQNFYSKSRAAEHDAFLTWLLDRAQEHEVDAIIVAGDIFDTGSPPSYARELYNRFVVQLQQTGCRLVVLAGNHDSVAMLNESRDILAFLHTTVVANAGYAPIELPLRDGTPGAIFCPVPFLRPRELVTSQAGHSGREKQQQLLHAISDYYQEQYQQACALRGDRPLPIIASGHLTTVGASKSDAVRDIYIGTLDAFPAQHFPPADYIALGHIHRAQMVGGCEHIRYSGSPLPLSFDETGKAKSVHLVSFSEGRLSAVETLEVPVTQPLAVIKGDLAAITAQLEQWRGVEQDPPVWLDIEITTEDYLHDIQRHIQALTEDLPVEVLLVRRSREQREKILLNAQRETLSELKVEEVFERRLALTEIDEMKRARLHELFAHTVHTLTAEDENA

SEQ ID NO: 13408 - protein, 213 aa, Klebsiella pneumoniae
EGFMSLADRVKQKRIELGLTQTEAALNAGITQQSWQSIEKGDTRKPRNIIGIAKALKCDPDWLMNGGAFMPIAEVSSKKVPLISYVQAGALAEKNPIEAFDGSFEYILTDNEVSDFTFALRIEGDSMEPDFKAGDVIIVDPEVEPTPGEFVVAKNGGAQATFKKYRPTYTDHLGCQHFELVPLNDDYPIISSEHQPLTIIGVMIEHRIYRRKR

SEQ ID NO: 13409 - protein, 728 aa, Klebsiella pneumoniae
WLFIQYSGFLMALTAALKAQIAAWYKALQEQIPDFIPRPPQRQMIADVAKTLAGEEGRHLAIEAPTGVGKTLSYLIPGIAIAREEQKTLVVSTANVALQDQIYSKDLPLLRKIIPDLRFTAAFGRGRYVCPRNLTALASTEPSQQDLLAFLDDDLTPNNQAEQKLCATLKQDLDSYRWDGLRDHTDKAIDDGLWSRLSTDKASCLNRNCHYYRECPFFVARREIQEAEVVVANHALVMAAMESEAVLPEPKNLLLVLDEGHHLPDVARDALEMSAEITAPWFRLQLDLFCKLVATCMEQFRPKTTPPLANPERLTAHCEELFELIASLNNILNLYMPAGQEAGHRFPMGELPQEVMEICQRLAKLTELLRGLAELFLNDLSEKTGSHDVVRLHRVLLQMNRALGMFESQSKLWRLASLAQSSGAPVTKWATRVVRDGQIHVWFHCVGIRVSDQLERLLWRSVPHIVVTSATLRSLNSFSRLQEMSGLKEKAGDRFVALDSPFNHVEQGKIIIPQMRYEPLMDNEEQHIAEMAAYFRQQVESKKHLGMLVLFASGRAMNRFLEHVTDLRLMLLVQGDQPRYRLVELHRKRVESGERSVLVGLQSFAEGLDLKGDLLSQVHIHKIAFPPIDSPVVITEGEWLKSLNRYPFEVQSLPSASFNLIQQVGRLIRSHNCWGEVVIYDKRLLTKNYGARLLNALPVFPIEQPGVPEVIVKRKAKQTAKQTGRKRR

SEQ ID NO: 13410 - protein, 83 aa, Klebsiella pneumoniae
LLIIHADVKCFRVNKGNYEMNITDEELLQQVQTLADKLPPEEQQLILELLQRYSTVYSVAQSYIPDYPCGVLDALCFIQRNKP

SEQ ID NO: 13411 - protein, 584 aa, Klebsiella pneumoniae
IDIINCSGFTAARWTTAPMRLLHRLNQYQRLWQPSAGAPQQVTVGELAERCFCSERHVRTLLRQAQEAGWLSWQASSGRGKRGQLSFHKTPESLRNEMMEQALNNGQQQNALELAQLAPVELKALLHPFLGGQWQNNTPTLRIPYYRPLEPLRPGFLPGRAEQHLAGQIYAGLTRFDEGDNMPIGDLAHHWQVSPDGLRWHFYIRSTLCWHNGDTVETAQLRQRLLLLLELPALRTLFASISRIDVTHAQCLTITLHRPDYWLPFRLASYCSVLAHPDDPAIGCGPFRLKRFSPELVRLENHPRYHLQHPLIQAVEYWITPQLFDRDLGTSCRHPVQITIGDREELHNLRQVSNRISLGFCYLTLRHSPRLSKAQAQRLVSIIHHSSLLDTLPLEEDLITPSHEVLPGWSIPQGPANNAVPLPARLTLLYHLPVELHAMAEQLRQRLALLGCELTLLFHDAKNWEGCQHLGQADLMMGDRLIGEAPEYALEQWLRCDMLWPNLLTGAQYAHLQATLDAVQSQPDARSRNDALRNVFNSLMEDAIMTPLFKYNYRISAPPGVNGLRLNARGWFDFASAWLPASST

SEQ ID NO: 13412 - protein, 220 aa, Klebsiella pneumoniae
GRVMDIVSVALKRYSTKAFDATKKLTAGEAEQLKTLLQYSPSSTNSQPWHFIVASTDEGKARVAKAASGTYVFNERKILDASHVVVFCAKTAMDDAWLQRVVDQEEADGRFATPDAKAANHKGRTFFADMHRKELKDDDQWMAKQVYLNVGNFLLGVAAMGLDAVPIEGVDFAILDEEFDLKAQGYTSLVVVPVGHHSVEDFNATLPKSRLPQSTTITEI

SEQ ID NO: 13413 - protein, 298 aa, Klebsiella pneumoniae
IRIFSSLPPTGNLWERDVHKTKQGFRGKTMRNKTTKIALALGMLLLASQAQADQLADIKAAGVVKVATFDANPPFGSVDAKTHHIVGYDVDFAQALAKALGVKLELVATNPANRIPLLQSGKADLIVADITITPERAQVIDFSTPYFVTGQQFLVPAGSPDKLDEYSKARIGAVKGTTGEQALHQRFPQARVLSYDDIPLALTALRNGNVQAITQDSTILAGLLAEAPDKAKFKILPDLLSKEEIGVGVKKGEPALLKAVNDELVKLEKTGEAAKIYDVWFGPATKTPQPRAFTIEAK

SEQ ID NO: 13414 - protein, 304 aa, Klebsiella pneumoniae
GISMRNRTFADLDRVVALGGGHGLGRVMSSLSSLGSRLTGIVTTTDNGGSTGRIRRSEGGIAWGDMRNCINQLIAEPSVASAMFEYRFGGNGELSGHNLGNLMLKALDHLSVRPLEAINLIRNLLKVDAFLIPMSEQPVDLMALDHEGHEVYGEVNIDQLDNVPQELMLTPPVPATREAVEAIAEADLILIGPGSFYTSLLPILLLDEMAQALRRTPAPMVFIDNLGKEHSPAARLSLAERIAIMERYVGKRVVDAVIAGPKADISGIDDRLVIQTPLEASDVPYRHDRALLRGALEKAIQLPG

SEQ ID NO: 13415 - protein, 97 aa, Klebsiella pneumoniae; identical to SEQ ID NO: 10490

SEQ ID NO: 13416 - protein, 212 aa, Klebsiella pneumoniae
PYPMRHHRTALPLAGYTIQQIDFDPATFQPEDLFWLPYHASLTGWGRKRQAEHLAGRIAAAYALREVGDKQLPAIGDQRQPLWPTPWFGSISHCGQRALAVVADRPVGVDIERRFTPQLAAELESSIISPAEKTALLRSGLPFPLALTLAFSAKESGFKATPAANQRALGFADFQIVEITASTLALMFAEQRYLLHWIASEEQVITLCALQQ

SEQ ID NO: 13417 - protein, 409 aa, Klebsiella pneumoniae
REPMAINQTAQPLSGPAAPPQKARTSFGILGAISLSHLLNDMIQSLILAIYPLLQAEFSLTFVQIGMITLTFQLTSSLFQPVIGYITDKRSMPWSLPVGMCFTLCGLILLALAGSFGMVLLAAALVGTGSSVFHPESSRVARMASGGRHGLAQSLFQVGGNFGSSLGPLLAAVIIAPYGKGNVAWFVLAALLAIVVLSQISRWYAAQHRMNKGKPKPAIVNPLPRKKVILAVGILLMLIFSKYFYMASISSYYTFYLMHKFGLTVQNAQLHLFAFLFAVAAGTVIGGPVGDKIGRKYVIWGSILGVAPFTLVLPYASLEWTGILTVIIGFILASAFSAILVYAQELLPGRIGMVSGLFFGFAFGMGGLGAAVLGLLADHTSIDLVYKICAFLPLLGFLTIFLPDNRQKA

SEQ ID NO: 13418 - protein, 407 aa, Klebsiella pneumoniae
LFTMNVTTLKDTLVARRLALNPWTGFYFLQSLLINLALGYEFSLLYTVAFTCVLHLLWRAFPRVQKAVVGAYSLLAALYYPFGQAYGAPNFNTLLALHATNVEESTEILTIFPWYNYLLAVFIFALGVIAVRRRIVEPSRWGKMDTLGLLFSIGIFFLQPVQNLAWGGVFKVIDTGYPAFRFVKDVVVNNNEVLDEQARMAQLAGMKDSWHVLAVKPKYHLYVVVIGESARRDALGAFGGHWDNTPFASSVNGYLFNNYIAASGSTQKSLGLTLNRVVDGKPQYQDNFVTLANRAGFQTWWFSNQGQIGEYDTAIASIAKRADEVQFLKNGDFEANKNTQDEQLLKLTEQVLSTQRTQPQLIVLHLMGSHPQACDRTKGKYTVFVQSKETSCNFYGRRQTDFAAGLA

SEQ ID NO: 13419 - protein, 272 aa, Klebsiella pneumoniae
GVTMQSQESEALQARYRLACELAKAGAELAFEYYQQREALTVDHKGDDLQDVVSVADKRVEAFVKQRIQSAFPEDGFLGEESGARLPDARVLWVVDPIDGTSCFLNGLHTWCLSLAIVADGEPVIGVVYDPNHRELFHALRGHGAWLNDAPIRPHPATTVKEGVMGVGTSHRVTPADFLPFLQALLSDGGMFIRNGSGALMSAWAAAGRLIGYYEPHMNPWDALPGLVLMREAGGASNDFLAQEGIQRGNPLLLASQTLYPQLKKMIPQPLH

SEQ ID NO: 13420 - protein, 293 aa, Klebsiella pneumoniae
EGTMTMNYQLVKQVRENNPLRKSFIDLAVKTFDLSFEEWYQQGYWTDAYIPYAFVERNKVIANASANIIDLRWQGEPRRYIQIGTVMTEPDHRNKGLAGQLIHHILQDWQQEADAFFLFANPTTVDFYPKFGFTRSEEHQYIMPVSPRAGDFRKLDMDSADDVALLRHYYEKSNPFSPLRVEHNFGLLMFYCSAFMKHFVYYSAKNEAVVIAMQNGPVLICFDLFCDVGKSLSTLVNELADDHVYQAILGFTPNEDRLGEYEKIEGEDILFVYDQKENLFKDRKLMFPLLAHA

SEQ ID NO: 13421 - protein, 205 aa, Klebsiella pneumoniae
GTAMWQERLAQLVTTCHWIGAKGWAPATGGNMSVRQDDTWCWLSESGRDKGSLTTEDFLQVEIATNQAPSGRKPSAETGLHTLVYRLFPEANVVLHVHTVNATVLSRIEKSDTLALQGYEMQKTLSGQHSHLDTVPIAIFDNDQDIDALAARIADYAQTRPLRYGFLLRGHGLTCWGKDIQEARRQLEGLEFLFECELMRRRYEP

SEQ ID NO: 13422 - protein, 346 aa, Klebsiella pneumoniae
GAAMFPSHLPTPRRPAAQSIPILRWGIIGPGWIAERFVHSLKTYSRQQVVAVASRSQAKADRVAAEWGIPQAYGQVEEMLARPDIDAVYIATPHNHHFPDGMQALKAGKHVLIEKPFALNLGEGRELQAEAARQGKLALEAMWCDYAPKYDVIRQLLEDGALGDLHTLLVDHGEYFTPEHRIFNADLAGGPMMDLGSYLTSFALMVGGMPQEIVARGSATAEGLNGQTSMLFSWQNGMQGLLNTTLFSNTPGGAVVAGRQATLTIDGQFYAPGGFTLAASQGGQVLRWEEPRNRYDQLFWQAEHFAWCIGQGLQDSPLRPLSRVLQNLQVMDEVRRQVGAVFNEER

SEQ ID NO: 13423 - protein, 127 aa, Klebsiella pneumoniae
RLAISPPAIWHNTPPTNQENIMIYEKRTYTINPLKMADWLALYQSDALAVQTDHLGQLIGFFFTEIGVVNQVVHIWAYESLDDRLVRRARMAQDERWQTFSRKNRELAAVERLESVLMRPTAFSPLQ

SEQ ID NO: 13424 - protein, 383 aa, Klebsiella pneumoniae
SSYIIKPPGWGLLSGQDMNRVTFSVVAIMLLAAATTLPFVLNAGFGKAPQGAQLSQVEASPHYRDGQFHNQLPTPGFTGQKNMLAAWWDFLMTKRENARPAQPLPLVKTDLATLPLGQDVMVWLGHSSWYLQLAGKRILIDPVFSDYAAPFSFINKAFPGDYPWRAEGMPEIDLLIISHDHYDHLDYATIRALLPKIKRVITPLGVGSHLRYWGMDGALITEADWQQAVPASDELTVHVLPARHFSGRGLKRNQTLWASFLFVTRQQKIYYSGDSGYGPHFKAIGDEFGPVDLAIMENGQYDQDWKYIHMMPDETAQAADDLRARAVLPGHAGRFVLAKHSWDEPYQRLAAASEGRAWRLLTPVQGEPVWVADKTQSFNAWWR

SEQ ID NO: 13425 - protein, 220 aa, Klebsiella pneumoniae
RHLFIACQSLFMKLWLVRHGETEANVAGLYSGHAPTPLTPRGVAQARTLGERLRLAPFDKVFCSELARTGTTADLLLGDRAIPRERHPALNEMFFGDWEMRHHRDLQREDAENYAAWCADWQHAAPTNGESFQNFARRVSEFIPTLTDCRHLDHLLIVGHQGVLSLLTALLLQMPPAAMWHFPIAHGAWSLLEIRDDFTTLRVLNSQAVWQPQEEFPPDH

SEQ ID NO: 13426 - protein, 508 aa, Klebsiella pneumoniae
GIHMSEQQAQGADEAIDLNNELKARREKLAALREQGVAFPNDFRRDHTSDQLHAEFDAKDNDELASLNVEVAVAGRMMTRRVMGKASFVTLQDVGGRIQLYVARDDLPEGVYNEQFKKWDLGDIIAARGKLFKTQTGELSIHCTELRLLTKALRPLPDKFHGLQDQEVRYRQRYLDLIANEESRHTFRIRSQILATMRQFMVARGFMEVETPMMQVIPGGASARPFITHHNALDLDMYLRIAPELYLKRLVVGGFERVFEINRNFRNEGISVRHNPEFTMMELYMAYADYKDLIELTESLFRTLAQTVLGKTEVPYGDQVFDFGKPFEKLTMREAIKKHRPETNMADLDNFDAAKALAESIGIQVEKSWGLGRIVTEIFDEVAEAHLIQPTFITEYPAEVSPLARRNDVNPEITDRFEFFIGGREIGNGFSELNDAEDQAQRFQDQVNAKAAGDDEAMFYDEDYVTALEYGLPPTAGLGIGIDRMVMLFTNSHTIRDVILFPAMRPQK

SEQ ID NO: 13427 - protein, 396 aa, Klebsiella pneumoniae
KNNMKISKVKLIAFISTMLVSVDVLSVAGLRVTLLPLFLYGGYIFIKNNYIDKWAFFALTFSVLCLPSLFFSAEFYKSVGYLVWIFFNYIALCVVYKSLIVRSLDNTLLGVRDAYRFQIFLGCLLYFSGLQPRAAVLYYEPSYFALSLTPYVVMVVSSYIKSKGYVGDVVKRTSFIDVFLLLAAIYTTKSANLMLVCALSVLIISFLGKGKLKKICILAVVGTISIFGLYFYSQNSNDLIAVTINNLFSASDPVKALLDRTGNRWPRFNLAYDISLSNFWGVGIGAYEKYTLSHTFAGYTGLPFYLSPIGYPPINIYLELASTCGWLALAVWLIWHFKMIKAANKRPVGGPVIVCSLIVAMLALFIESSFMRPYYWMLMGMVMGQIALNKRARQNS

SEQ ID NO: 13428 - protein, 407 aa, Klebsiella pneumoniae
QLNIVVHEPGFATLWRIFAYFQDYSITTVKSRLHYFSEEIDWRDCISLNKYGNAGKKMNYQNDDLRIKEINELLPPVALLEKFPATENAANTVAHARKAIHQILKGDDDRLLVVIGPCSIHDPAAAKEYAARLLTLREALKGELEIVMRVYFEKPRTTVGWKGLINDPHMDNSFRINDGLRIARKLLLDINDSGLPAAGEFLDMITPQYVADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKIGLAKAGLPAQVMIDFSHANSSKQFKKQMEVGADVCQQIAGGERAIMGVMIESHLVEGNQSLESGEPLTYGKSVTDACIGWEDTETILRQLAEAVKTRRG

SEQ ID NO: 13429 - protein, 84 aa, Klebsiella pneumoniae
LANILALMFIPGHNVRVYLRAWSARRKIPFLIIQSTSSPDPCGYLREAEYKLRSTRHDDTSFGQNRIFHRPISLWRQRLWLDHR

SEQ ID NO: 13430 - protein, 207 aa, Klebsiella pneumoniae
GKNMLRRLLQLYIGLVLYGVSTALFVHANLGADPWDVFHLGVAKQLGISFGTVIILTGAAVLLLWIPIRQMPGLGTVSNVIVLGLAADATLAVLPPLESMVARSALLAGAIVLNAIATGMYIGAGFGPGPRDGLMTGLHARTGWSLRGIRTVIELSVLLIGWLLGGKFGVGTVIYALSIGPLIQLCLPWFSQPVSRNAVSPPREIVS

SEQ ID NO: 13431 - protein, 155 aa, Klebsiella pneumoniae
YVDIDANEQGGLHMYKTIIMPVDVFEMALSDKAVRHAEFLAQQDGVIHLLHVLPGSASFTMSRFTADLRRFEEHLQHEAETRLQTMVSHFSIDPSRIKLHVRFGSVRDMVNELASEINADVVVIGSRNPSISTHLLGSNASSVIRHAHIPVMVVR

SEQ ID NO: 13432 - protein, 409 aa, Klebsiella pneumoniae
DILFQRYGLRGGVGMGGRETQQFGDRFLVARIFRRALFQHQAELFPEGLVFFSVVFRQLIQHLQRAFGQRGAQVAGHAAVLQDFTGDVQRQIVGIDQAAHEAQVVRHKLLGVVHDEHTLDVQLQAVFMIAVPHIPRRLRRDIQQAGVLLLTFHAVMAPGQRVAVVVSDMLIKLFVFVVVNFGFAAGPQGLRLVDFFPRNHGFAVFLFPFFNLNRQRDMVGILADDRAHAPVVEEIIFAFAQMQGDFGAAIGFGDISYGIFAFAGGLPEHAVFRLVARRTGTHGHFVRHDEGRIEADAELTDQLAILRLVGTHRFEERFGAGFGDGAEMVDNLFPVHTDTVIGDGQGAVVFIKRNPHAQLAVSLIQIRLRQRAETQLIGRIRGVGNQLTQKDFFVGIEGMDHQVQKLFYF

SEQ ID NO: 13433 - protein, 595 aa, Klebsiella pneumoniae
QNCIISVKSWLAHSCIDKYMYLRKQRSLSGETPMSQSKYRQLDVRAPRGTTLTAKSWLTEAPLRMLMNNLDPDVAENPHELVVYGGIGRAARNWECYDAIVKALKNLESDETLLVQSGKPVGVFKTHENSPRVLIANSNLVPHWATWEHFNELDAKGLAMYGQMTAGSWIYIGSQGIVQGTYETFVEAGRQHYQGSLKGRWVLTAGLGGMGGAQPLAATLAGACSLNIECQQSRIDFRLRTRYVDEQATSLDDALARIKKYTAEGRAISIALCGNAAEIVPELVKRGVRPDMVTDQTSAHDPLHGYLPKGWSWEEYQQKAESDPQGTILAAKRSMADHVQAMLAFHEMGVPTFDYGNNIRQMAQEVGVSNAFDFPGFVPAYIRPLFCRGIGPFRWVALSGDPQDIYKTDAKVKEIIKDDQHLHHWLDMARERISFQGLPARICWVGLEWRQKLGLAFNEMVRSGEVSAPIVIGRDHLDSGSVASPNRETEAMRDGSDAVSDWPLLNALLNTASGATWVSLHHGGGVGMGFSQHSGMVIVCDGTDEAAARIARVLHNDPATGVMRHADAGYDIAIECAAEQGLNLPMVAATQGNAK

SEQ ID NO: 13434 - protein, 209 aa, Klebsiella pneumoniae
PICITSAAGRRCISSPLTVDTEDNHRRTTDMANLKTKLSAAMLALIAAGASSPVLMDQFLNEKEGNSLTAYRDGSGIWTICRGATRIDGQPVRQGMKLTQAKCDQVNAIERNNALAWVDRNIKVPLTAPQKVGIASFCPYNIGPGKCFPSTFYKRINAGDRKGACEAIRWWIKDGGRDCRLTKGQKNGCYGQVERRDQESALTCWGLDQ

SEQ ID NO: 13435 - protein, 223 aa, Klebsiella pneumoniae
QERIMQFDWSAIWPAIPILLEGAKMTLWISVLGLAGGLIIGLVAGFARCFGGWIANHIALVFIEIIRGTPIVVQVMFIYFALPMAFSDLRIDPFSAAVVTIMINSGAYIAEITRGAVLSIHKGFREAGLALGLSRRETIRHVILPLALRRMLPPLGNQWIISIKDTSLFIVIGVAELTRQGQEIIAGNFRALEIWSAVAVIYLIITLVLSFILRRLERRMKIL

SEQ ID NO: 13436 - protein, 479 aa, Klebsiella pneumoniae
IMGIIETSLPTHVYTESSMLKIFNTLTRQKEEFKPIHAGEVGMYVCGITVYDLCHIGHGRTFVSFDVVARYLRFLGYKLKYVRNITDIDDKIIKRANENGESFVALVDRMIAEMHKDFDALNILRPDSEPRATHHIAEIIEITEQLIAKGHAYVADNGDVMFDVPTDPNYGLLSRQDLDQLQAGARVDVVDVKRNPMDFVLWKMSKEGEPSWPSPWGAGRPGWHIECSAMNCKQLGNHFDIHGGGSDLMFPHHENEIAQSTCAHDGEYVNYWMHSGMVMVDREKMSKSLGNFFTVRDVLKYYDAETIRYFLMSGHYRSQLNYSEENLKQARSALERLYTALRGTDKSVDAAGGEAFEARFIEAMDDDFNTPEAYSVLFDMAREVNRLKTEDAAAANAMAAHLRKLAAVLGLLEQEPEAFLQSGAQVDDAEVAEIESLIQQRLDARKAKDWAAADAARDRLNEMGIVLEDGPQGTTWRRK

SEQ ID NO: 13437 - protein, 69 aa, Klebsiella pneumoniae
LLFILSLLNVNFDSDDRLYPWRFVPLSGGGLGKDGLFPREGQQNILFVRVIVMTSMNKLHHIGYVGLSA

SEQ ID NO: 13438 - protein, 351 aa, Klebsiella pneumoniae
GTFMSVFNPVDHPHRRYNPLTGQWILVSPHRAKRPWQGAQETPAKQTLPAHDPDCFLCPGNTRVTGDTNPNYTGTYVFTNDFAALMTDTPDAPESDDPLMRCQSARGTSRVICFSPDHSKTLPELSLEALEDVVKTWQEQTADLGKSYPWVQVFENKGAAMGCSNPHPHGQVWANSFLPNEAEREDRLQKEYYAAQGQPMLLDYVQRELADGSRTVVDTEHWLAVVPYWAAWPFETLLLPKAHVQRITDLTDAQRSDLALALKKLTSRYDNLFQCSFPYSMGWHGAPFNDEDHNHWQLHAHFYPPLLRSATVRKFMVGYEMLAETQRDLTAEQAAERLRAVSDVHFRESGV

SEQ ID NO: 13439 - protein, 300 aa, Klebsiella pneumoniae
AMIFNIQRYSTHDGPGIRTVVFLKGCSLGCRWCQNPESRARSEDLLYDSRLCLAGCELCQQAAPAVITRTLDGLIIHRQNVNDSHIAALRDCCPTTALTVCGEEKSVEEIMATVLRDKPFYDRSGGGITLSGGEPFMNPTLAQALFEASHQAGIHTAVETCLHVPWKYIEPSLPFVDLFLADLKHVDEAVFQQWTDGSARRVLDNLQRLAQAGKKMIIRVPLIQGFNASEADVAAITDFAADRLQVSEIHYLPYHTLGMNKYQLLSQPYTAPDKPLDAPELLAFAQDYAQSKGLTAILRG

SEQ ID NO: 13440 - protein, 141 aa, Klebsiella pneumoniae
MRLITRHVREDIMKKAMIALSAILVAAPVFAATTHATDDTVAAANANANTAKEKLHQAQHEGEEQQLKAKHAAEGKQDSVGSQVSEGAQKTWNKTKEGTEKGWDKTKEVSEKGWNATKSGAEKGWDKTKTGAEELKNKVTE

SEQ ID NO: 13441 - protein, 207 aa, Klebsiella pneumoniae
  UNSURE (200),(201),(207): Identity of amino acid at the above locations are unknown.
YEIIIFIRSASQRDIMSHQLTFADSEFSTKRRQTRKEIFLSRMEQILPWQNMVEVIEPFYPKAGNGRRPYPLETMLRIHCMQHWYNLSDGAMEDALYEIASMRLFARLSLDSALPDRTTIMNFRHLLEQHQLARQLFKTINRWLAEAGVMMTQGTLVDATIIEAPSSTKNKEQQRDPEMHQTKKGNQWHFGMKAHMGSIXXDISSLX

SEQ ID NO: 13442 - protein, 89 aa, Klebsiella pneumoniae
HSVINPMYSVTFLINCHYLLIILLITICICNSVLARRGKRVFHQNMSNRAYSASDGVPLPAFGNIYAASPPGGKGRLGNVATKSRNNNE

SEQ ID NO: 13443 - protein, 357 aa, Klebsiella pneumoniae
VTVMRVTDFAFELPESLIAHYPMPERSSCRLLSLDGPTGALTHGTFTDILDKLNPGDLLVFNNTRVIPARLFGRKASGGKIEVLVERMLDDKRILAHIRASKAPKPGAELLLGDDESIKATMLARHGALFEVEFNDERPVLEILNGIGHMPLPPYIDRPDEDADRELYQTVYGTRPGAVAAPTAGLHFDEPLLDKLRAKGVEMAFVTLHVGAGTFQPVRVDSIEEHTMHSEYAEVPQEVVDAVLAAKARGNRVIAVGTTSVRSLESAAQAAKDALIAPFFDDTQIFIYPGYQYQVIDALVTNFHLPESTLIMLVSAFAGYQHTMNAYKVAVEQKYRFFSYGDAMFITYNPQAISERP

SEQ ID NO: 13444 - protein, 181 aa, Klebsiella pneumoniae
HGVIERLDALRERHFSRCQQRHRDRRQDQSADAGQLHHLHHERLSRANHRMTQSDFIGLVNGKPWANRACSFEQMDCWGLVVLYYRHVLGLELHHIASYESGADFITCYEQEHAHWRRVPVAATGCIAVFYRGEVPAHIGVMISPVKCLHARGEFGFVRCDSPLALLKVYSKVEYMVHGSI

SEQ ID NO: 13445 - protein, 348 aa, Klebsiella pneumoniae
WISIMKRGAMKNISLAMLARQIGVGVATVDRVLNERGGVSPQTTRKVLQAAREAGLKRILPEEHRFPWQIEVFLSSNDSFFFPQLAQDFAAVADSLGYRRLTLHRTFVPESQPTTLARRIARSCQQRQGIIVFGNDHPAVHDALRRCREAGVPAITLATDLPGADRLCHVGINQLQAGRTAGLMLGRMTPRPGEVLMVSGRQDYSAHRLRIQGFREVLSQRFPHLQLSDVLAGEERREQITRLVEQALCRSRNIVGIYNTGLGNTQIAEALARHRREGDVCWITHERYNTTRQQLAKGSLALTLDQNTRQHAQLAIDLMLRHLESGYQPQTYADGKVDFILYSAENVD

SEQ ID NO: 13446 - protein, 363 aa, Klebsiella pneumoniae
WKSIKTAVSVSLANRLWWQRPLAILEKKMICKRFALVGSGFIGQVHAASLARHEGSSLTMVADAAPERAQALAARYGARAVTVSEAIHSDAIDAVLIASSTPSHAELLEAAARAGKAVYCEKPIDLSLARAREVVERVLPLNVPVTVGFNRRFDSSHQQLRRQLEQGLIGRVELVQMVCRASSMPPLDYLRSSGGQMRDQAIHFFDLLRFLTGDEVRTVAAMGAALALPDIAEFGDVDTSILMMQMRGGALAQLDNTRRTGHGYDERITLLGAEGALESGSQSPAGPTLWRGNQRIEPGLWPDWFSRVQGSYYQHLDAFIRSLNGETVADLPGLLDGLQAQAIAEAAVQSLQHGQFVAVDDCR

SEQ ID NO: 13447 - protein, 423 aa, Klebsiella pneumoniae
DASIPGIRNAACINFSSRYRDKSLIYFPESGMSDYVIPEIKATEAEMISIRHYLHANPELSLEEFNTSELVASKLTEWGYQVTRGLGKTGVVGSLSKGDSPRTIGLRADMDALPIEETTGLPWASTAPGKMHACGHDGHTTILLAAAKYIASPACQFNGTVHLIFQPAEEAIGGADLMIKDGLFEQFPCERIFGLHNMPGLPVGKLGFYAGNFMASADTVKITITGYGGHGAHPERTVDPIVAGAALVMALQSIVARNVPPGETAVVSVGTFQAGIASNVIPESAVMELSVRAMKPEIRDLLIKRIHELADFTAKSYGASSVVEVYDSYPVLTNSPEETDFARALALEVFGREGVLESVSPMNASEDFAFMLRERPGSYFLLGNGEKGEKGGCMVHNPGYDFNDDIITIGATLFARLVEKHCR

SEQ ID NO: 13448 - protein, 103 aa, Klebsiella pneumoniae
SLPMKIISVKTLRDFWAENPDAEQPLKAWVDEATKADWKTPAEIKDQYRSASILKNKRVVFNIKGNDYRLIVAVAYLRGWVFVKFIGSHKEYDEINAETIERK

SEQ ID NO: 13449 - protein, 1304 aa, Klebsiella pneumoniae
PPPIMRHKELTMTTRLPLVAAQPGIWMAERLSTLPGAWSVAHYVELRGALDPTLLGKAIVAGLQQADTLSLRFEEEEGEVWQWVAADRTFAEPSIIDLRTAPDPHRAATERMQADLAQDLRVDGGNPLVCHQLLRVGDDRWYWYQRYHHLLVDGFSFPAITRQIAAIYRAWQRGEATPESPFTPFAEVVDEYQRYAGSEAWQRDKAFWQAQRQALPAPASLSAAPLGGRAAGSDIWRMKLEMNADAFRRLASHAPQCQPADLALALTTLWLGRLCNRMDYAAGFIFMRRMGSAALTSTGPVLNVLPLAVHIDARETLADLAMRLAGQLKKMRRHQRYDAEQIVRDSGKAAGDEPLFGPVLNVKVFDYQLDIDGVQAVTHTLATGPVNDLELALFPDETGGLSLEILANKARYDEAELRRHMARLTALLAQFAADPTLRCGEAEMLSADELARLAAVNDTAVPLPATTLSALVADQARKTPDAPALADARWQFSYREMRQQVVALAQLLRQRGVKPGDSVAVALPRSVFLTLALHGIVEAGAAWLPLDTGYPDDRLRMMLEDARPSLLIATEDQLARFSDIPGLESLCYQQPLAAGDDAPLALSKPDHTAYIIFTSGSTGRPKGVMVGQTAIVNRLLWMQDRYPLSADDVVAQKTPCSFDVSVWEFWWPFIAGAQLVMAEPEAHRDPQAMQQFFARYGVTTTHFVPSMLAAFVASLDADSVAACRTLRRVFCSGEALPTELCREWERLTGAPLHNLYGPTEAAVDVSWYPACGPELAAVTGSSVPIGWPVWNTGLRILDAAMRPVPPGVAGDLYLTGIQLAQGYLGRPDLTASRFIADPFAPGERMYRTGDVARWLANGAVEYLGRSDDQLKIRGQRIELGEIDRVMSALPDVGQAVSHACVFNQAAATGGDARQLVGYLVSDSGLPLDTAALKAQLAEQLPPHMVPVVLMQLAELPLSANGKLDRKALPLPTLGGERSGRPPEPGMETLVATAFSQLLGCEVNDIDADFFALGGHSLLAMRLAAQLSRQLARQVTPGQVMVASTVGKLSALLAADLSDEQAQRLGLDTLLPLRESDGPTLFCFHPASGFAWQFSVLARYLSPRWSITGIQSPRPQGPMASAASLDEVCEHHLRTLLAQQPHGPYYLFGYSLGGTLAQGIAARLRQRGEAVAFLGLLDTWPPETQNWAEKEANGLDPEVLAEIDREREAFLAAQQGQASGELFSAIEGNYADAVRLLTTAHSAKFDGKATLFVAEKTRQEGMDPQVVWGPWVGELEVFSQNCAHVDIISPQAFEAIGPVVREILG

SEQ ID NO: 13450 - protein, 267 aa, Klebsiella pneumoniae
QPPIMLKTLTVYWRCCMATVNKQAVAAAFGRAASGYTQHDELQRRCADLLLRQLARRDFAQVLDAGCGPGSMSRYWREAGSVVTALDLSAGMLAQAQRNDAAQHYLLGDIEALPLPDACVDLAWSNLAVQWCDDLRAAIGELYRVARPGGRVAFSTLLADSLPELNQAWQAIDDRPHANRFLSEAAVRAALSGLRATGEVHQISLPFADALSAMRSLKGIGATHLHQGRTAAPLGRGKLRELQLAWPQRQGICPLTYSLFTGVIERD

SEQ ID NO: 13451 - protein, 87 aa, Klebsiella pneumoniae
KLAIMAISAARSRSASSAIISGDLPPSSMVTSFSDEAAELAITFLPLATPPVKEILAMSGCSVRYWPVSAPIPGRTLNTPSGRPASL

SEQ ID NO: 13452 - protein, 257 aa, Klebsiella pneumoniae
EAYMQGCANDTGKLIGKVAVLRMAFGCADTVPALSEWKRLGAMTTKGFDYSMNTVTSEADDTKGLVENLVNNMDFTISGEGEFRKKDKTTEVGAIAISKYIFDEVQAGRQPTVWARFDFTGEDAGTYIMGYFNTTSWSGDFGTTDISTFSGEWKVYDADTVVFEVAPPAMAFTTNLPTTKSVAAGSALNMSVVVEGGTSPYTYVWKKDGTVVSGQTTATFNKASAVSGDAGVYTCEVTDSSATPVKITSTSCTVTIS

SEQ ID NO: 13453 - protein, 108 aa, Klebsiella pneumoniae
YRYMSRYQPGCTASASWRPRWAICPCCSTKISLASVSADRRWALIMTVRPSPHWRRLCRIWCSVRPSTADKASSRIKISASSSRARAIEMRCFWPPESITPRSPTSVS

SEQ ID NO: 13454 - protein, 424 aa, Klebsiella pneumoniae
GYNMPMQVNITTKVNSQSIRRETYNGREHLVLPSYTLPANVVMNGGLYTQEEIDAHYQGLEGTLAPLGHPQVNGQFVSAFSPEGINAGHIGAWNRNVKKSGNRIYLEKWVDVARAGESEGGKELLERVAAIDRGEDVPPIHTSVAAFLDQLEPNEQQRATGADWVAKIHSMDHDAILLHEVGAATPEQGVGLMVNADMAKPLKANSGALVGESYRELEQRLDRAAKAKFAPGPDEYAWIADFTDSQAVVIRNGGKAEVFGYSTEGGEITFDDTGTAVQRQESWVAVVANKFKSLFTPQEQPAPNHKTEGDMPLTKEELEQIGSMIGQAVATNTDAAIKPLVEKVDALQANQQQLAETLTANSRAEEKTKREAVAKVHGDIVANALSGEALDAMFKTIGEAAPLGTNNAQQPKETGAPAASEYFK

SEQ ID NO: 13455 - protein, 195 aa, Klebsiella pneumoniae
DLNMLKKILFPLVAMFMLAGCATPPTTIEVSPKITLPQQDPSLMGVTVSINGADQRPDQALAKVTRDNQLVTLTASRDLRFLLQEVLEKQMTSRGYMIGPNGAVDLQIIVNKLYADVSQGNVRYNIATKADIAIIATAANGTKMTKNYRASYSVEGAFQASNKNIADAVNSVLTDTIADMAQDTSIHDFIKQNAR

SEQ ID NO: 13456 - protein, 152 aa, Klebsiella pneumoniae
SVNIPQCGIKLHSGNFSAIGKILQEQLSDGKCLRLQVKEWREKRSLSQNALSHMWYAEISEYLINSGRTDATPEWVKRNLKKTYLGCEEVTYTDFITGEKTTTWEPRHTSDLDTGEMHIFLTKVEAWCAQFGLALTIPNGCEYQQLQQKQEA

SEQ ID NO: 13457 - protein, 267 aa, Klebsiella pneumoniae
ENCMSSNFRHHLLSLSLLVGIAAPWAAFAQAPISSVGSGSVEDRVTQLERISNAHSQLLTQLQQQLSDNQTDIDSLRGQIQENQYQLNQIVERQKQILLQIDSLSSGGGAASGAQAPSSSGDQSAAATSAAPAATSGAPAMTGDANTDYNAAIALVKDASRQDDAMVAFQNFVKKYPDSTYQPNANYWLGQLNYNKGRKDDAAFYFASVVKNYPKSPKAPDAMFKVGVIMQDKGDTAKAKAVYQQVINKFPGTDGAKQAQKRLNALG

SEQ ID NO: 13458 - protein, 88 aa, Klebsiella pneumoniae
HCRINERKMRSRQRFEAIPPGGVVIYPPGKSVLSGREAPHALVHVLGAVEDKVDFTVGIGLRLVAGLQMAQHQVDRQLGVLAGVLIER

SEQ ID NO: 13459 - protein, 126 aa, Klebsiella pneumoniae
GGRIMTPETLHPCAHRIALTYPFTEHCWPFGPEYDVFKVDGRIFMITMTIRGRALVNLKAEPQKSLLNQQIYRSIEPGYHMNKKHWITVVPGEDISEDLLAELIDDSWHQVVNKLSKKAQQRLRPR

SEQ ID NO: 13460 - protein, 100 aa, Klebsiella pneumoniae
GNSMAKYEVVRPWNGVALGQVVELENLHPALKSNVRLMRGEAGGELSPAIPEAGTDTKSRKEIIQARLTELGVEFKGNLGAEKLGELLPDGELEKLFPAE

SEQ ID NO: 13461 - protein, 465 aa, Klebsiella pneumoniae
GGGMYKTTLSGQVWRFDSLKTLMAKASPARSGDALAGIIATSAEERMAAKMALAEVPLTDILDNPLIPYEQDEVTRLILDTHDAQGFAALRHLTVGDFRDWLLDDATDTATLQRVARAITPEMAAAVSKLMRNQDLILAASKCQVVTRFRNTIGLPGHLSVRLQPNHPTDDLKGIAASMLDGLLYGAGDAVIGINPASDSLPVLAQLNVMLDDIIQRFAIPTQSCILTHVTNTLQLIERGAPVDLVFQSVAGTEAANSGFGINLAMLQEAREAALSLRRGTLGNNVMYFETGQGSCLSANAHHGVDQQTCEARAYAVARHFEPLLVNTVVGFIGPEYLYDGKQIIRAGLEDHFCGKLMGLPIGCDVCYTNHAEADQDDMDTLLTLLCAAGLTFLIGVPGADDIMLNYQSTSFHDALYARRLLGLKHAPEFADWLAKMQIIDPHGALRLTDARHPLLSVLPQGASV

SEQ ID NO: 13462 - protein, 139 aa, Klebsiella pneumoniae
QKGISAMQTQIKVRGYHLDVYQHVNNARYLEFLEEARWDGLENSPAFQWMMEKNIAFVVVNININYRRPAVLGDVLTVSSKLEQLNVKSGTLSQVVTLNPNGEVVADALITFVCIDLKTQKALPLEGELRAKLDQMNLR

SEQ ID NO: 13463 - protein, 700 aa, Klebsiella pneumoniae
KFLINFFVVFFRKFIMNKFAPLHPKVSTLLHGADYNPEQWENDPDIIDKDIAMMQQAKCNVMSVGIFSWAKLEPREGVFNFAWLDIILDKLYAAGIHVFLATPSGARPAWMSQRYPQVLRVGRDRVPALHGGRHNHCMSSPVYREKTLKINTLLAERYSSHPAVLGWHISNEYGGECHCDLCQNRFRDWLKARYQTLEYLNQAWWSTFWSHTYTDWSQIESPAPQGEMSIHGLNLDWHRFNTAQVTDFCRHEIAPLKAANASLPVTTNFMEYFYDYDYWQLAEALDFISWDSYPMWHRDKDETALACYTAMYHDMMRSLKGGKPFVLMESTPGATNWQPTSKLKKPGMHILSSLQAVAHGADSVQYFQWRKSRGSVEKFHGAVVDHVGHIDTRIGREVCQLGEILSKLPEVRGCRTEAKVAIIFDQQNRWALDDAQGPRNLGMEYEKTVNEHYRPFWEQGIAVDVIDADVDLTPYQLVIAPMLYMVRDGFAGRAEAFVANGGHLVTTYWTGIVNESDLCYLGGFPGPLRNLLGIWAEEIDCLNDGEFNLVQGLAGNQCGLQGPYQVRHLCELIHIESAQALATYRDDFYAGRPAVTVNAFGKGKDWHVASRNDLAFQRDFFTALSKELALPRAIATELPPGVVATARTDGDNAFIFLQNYSAQNHTLTLPQGYWDCLTDAAVSAPLTLTAWDCRILRRHA

SEQ ID NO: 13464 - protein, 403 aa, Klebsiella pneumoniae
LFLISLSFLEDDMETSLAEDVKKPTRTLSPDSFFFMSPYRSFTTSGCFRRFSQPAVGGDALNGEFQQQMAAAFAEARAAGIRKPVMVGAIPFDTCQPSELYIPERWEAFSRPEKQRSARYAAPLEAMEVVERREIPEQDAFLAMVERAAALTATPEVDKVVLSRLIDITTRDRVDSGALMERLIAQNPASFNFHVPLSDGGVLLGASPELLLRKEGQHFSSLPLAGSARRQPDDVLDREAGNRLLASGKDRHEHELVTQAMKSVLGPRSSQLSLPESPQLITTPTLWHLATPIAGTALAEENAMSLACLLHPTPALSGFPHQAAKRLIAELEPFDRQLFGGIVGWCDDEGNGEWVVTIRCARLQQRTLRLFAGAGIVPASSPLGEWRETGVKLTTMLNVFGLN

SEQ ID NO: 13465 - protein, 187 aa, Klebsiella pneumoniae
MSLINTKIKPFKNQAFKNGEFIEVTEKDTEGRWSVFFFYPADFTFVCPTELGDVADHYEELQKLGVDVYSVSTDTHFTHKAWHSSSETIAKIKYAMIGDPTGALTRNFDNMREDEGLADRATFVVDPQGIIQAIEVTAEGIGRDASDLLRKIKAAQYVASHPGEVCPAKWKEGEATLAPSLDLVGKI

SEQ ID NO: 13466 - protein, 258 aa, Klebsiella pneumoniae
YDVMSWSETMLLKDKVAIITGAASARGLGFATAKLFAENGAKVVIIDLNGEASKTAAAALGEGHLGLAANVADEVQVQAAIEQILAKYGRVDVLVNNAGITQPLKLMDIKRANYDAVLDVSLRGTLLMSQAVIPTMRAQKSGSIVCISSVSAQRGGGIFGGPHYSAAKAGVLGLARAMARELGPDNVRVNCITPGLIQTDITAGKLTDDMTANILAGIPMNRLGDAIDIARAALFLGSDLSSYSTGITLDVNGGMLIH

SEQ ID NO: 13467 - protein, 433 aa, Klebsiella pneumoniae
LAVMTLNRVVLPAPLGPIRPKISASSTWKLTLSMARRPPNCMVTSCTCRITLFSAIAAVPSSHLPNLFFPQQPLAGEEHDNQQQQGEDHHSQARVRAEIVTEELQRLIEEAQPLAAADHQHGAEQGAGGAAEPAEDDNNQQLEGEHKVEQPRGNGGQQGSQQTAADPFEEGAGGEGAGFNAEGVDPHGDRRIFIVANSFHHPAILRPHQLEDHAGGQQGEQPAPEQEMRLLRNIVQPDGAVGDLRVVNGEDLDDKPKAEGDNGQVVATYPEDRHGEAHRQRRRAQAAYQQGREEARVQAEDPRAGGGHFKHVYLAVAGEDQQGGHVGAHRHEAVRLQRQLAGHAVDQVVADREDHKDKNGADDTNNVVIENHVDSGQQRDTDDNNDQVAQLRPGGRRRVEHQKRLLSRRSSPIMPTGRNKRTRIKNRKAKASL

SEQ ID NO: 13468 - protein, 323 aa, Klebsiella pneumoniae
EAVMHQTKTGILLANLGTPDAPTPGAVKRYLRQFLSDKRVVDTSRLLWWPLLRGVILPIRSPRVAKLYQSVWMEEGSPLMVYSRRQQQALAARLPDTPVALGMSYGSPSLASAVDDLLAQGVEHIVVLPLYPQYSCSTVAAVWDELARILAKKRAIPGISFIRDYAEHPDYIHALAASVRASFAVHGEPDLLLLSYHGIPQRYANQGDDYPQRCRDTTRELVSALGLPPERVMMTFQSRFGREPWLTPYTDETLKMLGEKGTKHIQVLCPGFAADCLETLEEIAVQNREIFLEAGGKQYEYIPALNADAAHIEMMVNLTAPYR

SEQ ID NO: 13469 - protein, 168 aa, Klebsiella pneumoniae
PASIMPLTIASGVRSSRNSAAFLPPSSRVTRLPDALADCWTFSPVATEPVKLTLAQAGCVISRWAISPPAPLTTLITPSGIPTAFASSATRSSVSGVYSLGLRTMVQPQTRAAASFQMAIMMEKFHGTMPTTTPSGWRRVKAVYFSPAIDGSETSSVSPVTFPAQPAK

SEQ ID NO: 13470 - protein, 317 aa, Klebsiella pneumoniae
GRSMRLRKYNKSLGWMSLIAGTVLLSGCDSALLDPKGQIGLDLRSLILTAFGLMMIVVIPAVLMAVGFAWKYRASNKDAKYSPNWSHSNKVEAVVWTVPILIILFLAVLTWKTTHALEPSKPLVHDEKPITIEVVSMDWKWFFIYPEQGIATVNEIAFPANVPVHFKVTSNSVMNSFFIPRLGSQIYAMAGMQTQLHLIADEAGTYDGISASYSGPGFSGMKFKAIATPDRATFDQWVAKAKQSPNSMDSMAAFEKVAVPSEYNKVEYFSNVKPDLFKDVVNKFMSHESMNMSKPEGEHAAHDGMEGMDMSHAETAH

SEQ ID NO: 13471 - protein, 182 aa, Klebsiella pneumoniae
SPSIFKTADVISSIIFINVFGHDLTQEQEYVQELRMEIIFDPSLIALKQNISRAEEAIELAGSLLARRQICSAEYVNEMLTVYEDFGAAIVIDDGIAMPHARPEKGALQTGFSLVTTATPISFGHDEFDPVSVVIAIAGADADSHIKMIQLIASLIESDIVTFLQQENDVNSVLHFIQKQME

SEQ ID NO: 13472 - protein, 155 aa, Klebsiella pneumoniae
GCPMLDKIDRKLLALLQEDCTLSLQALADAVNLTTTPCWKRLKRLEDEGILRGRVALLDAEKVGLGLTAFVLIKTQHHSSDWYCQFVSEVTQMAEVLGFWRMAGEYDYLLRVQVADMKRYDDFYKRLVNSVPGLSDVTSSFAMEQIKYTTALPVE

SEQ ID NO: 13473 - protein, 160 aa, Klebsiella pneumoniae
GSTMNRRAGKPITKKVTQLVNVEEHVEGFRQVREAHRRELIDDYVELISDLINEVGEARQVDMAARLGVSQPTVAKMLKRLASVGLIEQIPWRGIFLTPEGEKLAQESRERHQIVENFLLAIGVSPEIARRDAEGMEHHVSEETLAMFLKFTQTQGSQEA

SEQ ID NO: 13474 - protein, 306 aa, Klebsiella pneumoniae
GGTMKVTVLGCGALGQLWLTALYKQGHEVQGWLRVPQPFCSVNVIETDGSVFNESLTANDPDFLASSELLIVTLKAWQVSNAVKHLAGILPDTTPIVLIHNGMGTVEELRGVKQPLLLASTTQAARRDGNVIIHVAQGTTHIGPAKSYEGDYSYLAEVLQSVLPDVAWHNNIHSAIWRKLAVNCVINPLTALKGCKNGDLRDYTQEVAAICREVAAVMEREGIHTSAENLLFYVEQVIESTAENISSMLQDVRAQRHTEIDYITGFLLNRARAHGVAVPENARLFELIKRKENEYERVGTDLPRPW

SEQ ID NO: 13475 - protein, 121 aa, Klebsiella pneumoniae
QETMMFKSFFPKPGPFFISAFIWSLLAVIFWQAGGGDWLLRVTGASQNVAISAARFWSLNYLVFYAYYLFCVGVFALFWFVYCPHRWQYWSILGTSLIIFVTWFLVEVGVASTPGMRRSTT

SEQ ID NO: 13476 - protein, 131 aa, Klebsiella pneumoniae
VLAINEISGRSCAKTRTKALPTKKDSDFYHFLAKLHWTKGTTIGVLIPDTALVSIFHIKVILMSKIKGNVKWFNESKGFGFITPEDGSKDVFVHFSAIQSNGFKTLAEGQRVEFEITNGAKGPSAANVIAL

SEQ ID NO: 13477 - protein, 253 aa, Klebsiella pneumoniae
YLAIKTLRRLNANVIPRYAHSGETMIRAIVTDIEGTTSDIRFVHNVLFPYARERLAGFVTAQQHAEPVKTILDNLRRETDAPAASTADLITTLFAFMDEDRKSTALKALQGIIWRDGYLNGDFTGHLYPDVLPALEKWKAQGIDLYVYSSGSVAAQKLLFGYSDEGDITHLFTGYFDTLVGAKREVQSYRNIAEHLGHAPGTILFLSDIHQELDAAEAAGLRTIQLVRGDRDPASHHPQVQRFDDIHPEQIPA

SEQ ID NO: 13478 - protein, 533 aa, Klebsiella pneumoniae
NNKITILQGLHMTKKLLPLLLLSALSAAAHAATPPNTLVVAQGLDDIVSLDPAEANELSSIQTVPSLYQRLVQPDRNNPEKIVPILAESWQADPAAKTLTIKLKPDAKFASGNPLRPEDVIFSYTRAVTLNKSPAFILNVLGWQPDNIASQLKKIDDHTLTLHWTADVSPAVALNILSTPIASIVDEKQVAPNAKNNDFGNDWLKMHSAGSGAYKMRVYQPHQAIVLEANASSPTGAPKIKSIIIKNVPDPASRRLLIQQGDADVARDLGADQIAALQDKPGVKVLSIPSAEQNYLVFNTANSANPLLNNPAFWEAARWLVDYEGITKNLLKGQYFIHQSFLPAGLPGALETNPFTFDPQKAKAILDKAGIKDAHFTLDVENKPPFITIAQSLQASFAQGGVKVDLLPAAGSQVYARVRAKQHQAAIRLWIPDYFDAHSNASAFAWNDGKSSTVAGLNGWQIPELNKATLAAVAEPDPAKRLDLYKTMQETLLQHSPYVFIDQGKTQIVVRDNVKGYQQGLNADMVWYDNVTK

SEQ ID NO: 13479 - protein, 472 aa, Klebsiella pneumoniae
ENKMQSTTQHQGGQLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWIWCVVFCAVIFGLNIISTRFFAEGEFWFSLVKVITIVAFIILGGSAIFGIIPMQDGSPAPGLRNITAEGWFPHGGLPILMTMVAVNFAFSGTELIGIAAGETENPHKVIPVAIRTTIARLIIFFIGTVFVLAALIPMQQAGVEKSPFVLVFEKVGIPYAADMFNFVILTAILSAANSGLYASGRMLWSLSNEKTLPACFAKVNKRGVPVTALSVSMLGGVLALFSSVVAPDTVFVALSAISGFAVVAVWLSICASHFMFRRRHLQQGKALSDLQYRAPWYPVVPVLGFVLCLVACVGLAFDPSQRIALWCGIPFVALCYGAWYLTRSRNMTQEPQHVAD

SEQ ID NO: 13480 - protein, 373 aa, Klebsiella pneumoniae
KCKINPESEGNIVNRYFSLIPVVIIFTTACDQKALTVESAPRMVKVAQVTAVGNTQQRTFPARIESGDSTELSFKRGGQVESLDIRQGASVAQGQTLARLNAREAQQRVNERQTAATLAQRQFDRFQTLAGRQAISQAEMDVQRANRDAANAALKIAREELAQMSLIAPFSGIAAGVHIRNHQVVAAGQPVITLTRTDLLDVVFSIPENLFTSLDIRNTAYRPVVRINTLPGREFTAEYKEHTGSSDNSTLTWQIVLTMPRPDDFPAVGGVSGTVTVNLGNLPASAGRETLIVPAEAVFNPDNRPKNEPVVWVVKGDNAHRYLEERKVTVGEVTSQGVAITDGLRAGEQVVAAGVSELHAGQPVRVWTRERGL

SEQ ID NO: 13481 - protein, 105 aa, Klebsiella pneumoniae
NCKMWGGKKDRETTVDRLFFVARIINVFREAKLKIMTKRTYFMSFCYSLISDDFVMEVIAKSGKNAIIESDYIGFLYVTGNIRSAIYYHAETELIRIAKMKSLIS

SEQ ID NO: 13482 - protein, 438 aa, Klebsiella pneumoniae
YKKMAKIGFLSLGCPKNLVDSERILTELRTEGYDVVPTYDNADMVIVNTCGFIDSAVQESLEAIGEALKENGKVIVTGCLGAKEDQIREVHPKVLEITGPHSYEQVLEHVHHYTPKPKHNPFLSLVPEQGVKLTPRHYAYLKISEGCNHRCTFCIIPSMRGDLVSRPIGEVLAEAKRLADAGVKELLVISQDTSAYGVDVKHRTGFHNGMPVKTSMVSLCEELAKLGIWVRLHYVYPYPHVDDVIPLMAEGKILPYLDIPLQHASPRILKLMKRPGSADRQLARIKQWREICPDLTLRSTFIVGFPGETEEDFQMLLDFLKEARLDRVGCFKYSPVEGATANELADQVPEEVKEERWNRFMQLQQQISAERLQEKVGREILVLVDEVDEEGAIGRSMADAPEIDGAVYLNGETRVKPGDVVRVKVEHADEYDLWGTRV

SEQ ID NO: 13483 - protein, 187 aa, Klebsiella pneumoniae
GKKMSHHNTCYRSEHYDLWFDNGFLLYGMSLILNSLPASYFRKKHVFFTSDNYFAVLQHNYNRRDTLFILLTEGNDLNFLSELPMLRLPANSTPEELKIFLHQPTRYYKTHPAPGASVQFTEREKKVIQLISNGEAVASIGRSLNLHIKTIYQIRLNLIKKLGCSGRTDFFNISRSETFKSWSQIHL

SEQ ID NO: 13484 - protein, 182 aa, Klebsiella pneumoniae
AMKIDLNADLGEGCASDSALLQLVSSANIACGFHAGDAVLMQQCVREALKNGVAIGAHPSFPDRENFGRTAMQLPPETVYAQVLYQIGALAAIVHAQGGELRHVKPHGMLYNQAAKEPAFGRRYRPCGARCRRRPGAGWAGGQRAYPRRTALSVDDAPGSLRRSRLSGRRQPGAAQPTGRAD

SEQ ID NO: 13485 - protein, 171 aa, Klebsiella pneumoniae
GGKMRGKSVMLLAGLVSLAQANELNLYSVNTGSYVYHLTNNHGQYTENFENHFFSVERKFSADSKYSLLLGTMNNSFNDRCLALGVRRDWYHSGSGWTFKGVYGYTGEFFFDAFEHCGDHGSYKDFKDATGIGFSPYIYHAIQYNFTDYFAVESGIIIPSVFVISIQWSFR

SEQ ID NO: 13486 - protein, 105 aa, Klebsiella pneumoniae
RNEIRIPLILRILKLVISPGVCQMLCTKTVSIEITEASNFFVKLRACKYRITNIGTRYRNLRRRWEWNFCHVLSPCKRRTTPSEVNLMVCAKVGNYCCVLRINRV

SEQ ID NO: 13487 - protein, 242 aa, Klebsiella pneumoniae
GEEMDFFSTQNILVHIPIGAGGYDLSWIEAVGTIAGLLCIWLASLEKISNYAFGLVNVTLFAIIFFQIQLYASLLLQLFFFAANVYGWYAWSRQSSNHEAELQIRWLPRSKALGWLAACVVAIGLLTLFINPFFAFLTRIAVSLMQALGLQVTMPELQPDAFPFWDSCMTVLSVVAMILMTRKYVENWLLWVIVNVISVVIFARQGVYAMSLEYLLLTFIALNGSRMWINSARERGSHAFSG

SEQ ID NO: 13488 - protein, 153 aa, Klebsiella pneumoniae
GAGIMARYRRVNIDGLSLYKTETRTTAADLLPGTAATINSSDEFAQATALTGRLYIIDVGYHQGLTITEAIPAGDSAVGNYVEEGRELALRCLPGAYKKDSPIKLGTAGQFTLATSDTDSVIGYSQDEYTIAASTTDFIRVRMRVGTVAAAGA

SEQ ID NO: 13489 - protein, 437 aa, Klebsiella pneumoniae
LLTLVQRVGILFDVFARDAAKHLPVTPAGVGQNDRHENNRHVGHQVQRPLTGGRVPHCQAGVQHGAGRHDEREHRDTGSQNDAGQGQRGEQECPGTFIRFGRNDGQQRQHHAQGRHRPQRWHIVKVHHPRASFPHHFLGQRVRRAGMVNHRFHHIAVDAVVDPHARQREADQRHQRRHHGNGASTQVQFAYGTHLQVGGALSQDHRHADDTGQQTKRVQQLEEVTGIEQTQVFIDVERHALQQVAKGHANHQRRHKATDEDAPVPHVAPAGVLDLGTVVKTDRTEEQRGQHQNHRHIEARERRGVNHRPGSEQRAAGGDQPHLVTVPVRGDGVDHNPTLGVVAAEEAGEHAHPHVEPVGDGKTNQQNANQQPPDKTQYFIIDHLTTPVLACRLNSRRGLFKVIAAGFQAARSFAGKLEHQEQFSHQEQRVQTADQQH

SEQ ID NO: 13490 - protein, 850 aa, Klebsiella pneumoniae
LHLINGYGILGQFNFNMKYACLLMMSALFNAPAISFADEFFNPALLEVREGEGAPTTDLSVFEVVNGQPAGNYRVDIYVNNEMVTADARDVMFSKNQDGKLEPCVTLAELGQWGVDTASFPELAVSDSECANLAGIPDAFADFQFNRQKLNLSIPHAAMNTRSLDEVPIERWDEGIPALLLNYNMNSYQSRYKGAETYESTYLNLRPGLNIGPWRLRNYTTFEHSNQSGSKWDNVYSYLQRNIVSLRSQLTLGDSSAPADVFDSVPFRGFQMASDDDMLPSSVRNYAPVIRGVARSNALVTIRQNGYVVYETKVAPGAFEISDLASTGGAGDLDVTIKEADGSEQHLRIPYASLPVLQREGKFRYSVTGGQFRAYDSHTEKNLFVQGTGIYGLPWGFTLYGGVQNAGNKYQSYALGVGKNIGSWGAFSADAIHSRSMSTDAGRQQGQSLRVRYSKNFLQTGTNFTIAGYRYSTSGFRSLEETLGTYRSDNNIPSYITDRRRNRAELSLNQDLGDNFGALNASLISEDYWQNERNSLSANLGYYKNFNAIGISLNYSWNRNTGLYGHAEQDNVVSFEINVPLDKFLNRTYASYGTTHASGNGTSHNLRLNGSAFDDASLDWGINATLAGRSEQQVVGGNVSWKASHGTLNGSYSRSRDSQQLGYGIAGGVVIHENGITLSQSLGETIGLVKAPGAEGIGVNNYAGISTDSRGYAVVPYLTPYRRNDISLNSKTLRDDTDITYMTNKVVPTRGAIVRAEYKTAIGHRVLMTLTRPGGKPVPFGAMASLLKSEENASIVGDGGEVLLSGLPQKGTLQVKWGNGQGQETTCRADYIAHKSAGASGLWNATSVCQ

SEQ ID NO: 13491 - protein, 114 aa, Klebsiella pneumoniae
PPLMVLITLMNSAGGKASDLFGELTGIAVLLTMLPYFYSCVDLIRFEGIDIRNFVSLICSVLGCVFCFIALMGASSFELAGTFIVSLIILMFYGRKMHQRQNNASDNNTTANAH

SEQ ID NO: 13492 - protein, 204 aa, Klebsiella pneumoniae
PTLMNGVAKMPKLGMQPIRRRQLIDATLDAINEVGMHDATIAQIARRAGVSTGIISHYFKDKNGLLEATMRDITSQLRDAVLNRLHALPDGSASQRLQAIVGGNFDETQISSAAMKAWLAFWASSMHQPMLYRLQQVSSRRLLSNLVYEFRRELPREQAQEAGYGLAALIDGLWLRAALSGKPLDKTLAQSLTSHFIRQHLPNP

SEQ ID NO: 13493 - protein, 145 aa, Klebsiella pneumoniae
WLMMSLWDALRMNMMISYQELVRTFLNMNKKMVFLAAFMLTACSANSLQHGAEGVRITHNEPDASCTYLGDVTGSQGNFFTGGWTSNSNLETGARNDLKNKAWKMGGNVVVLLTQRAGQTGSVYHGTGSSQQTNVTLSGTVYRCR

SEQ ID NO: 13494 - protein, 217 aa, Klebsiella pneumoniae
GGMMAGVLITGFEPFGGETVNPSWEVVKQLDGMIIRGQQVVAKQLPCVFGEALTVLKAALETYQPRLTIAVGQAGGRVDITVERVAINVDDARIPDNKGQQPIDEPIVANGPAACFSTLPIKAIVSALRQQGIPASVSQTAGTFVCNHVMYGLLHQLQGKSGQKGGFIHIPYLPEQAAAHPGEASMSVATVRAALETAIAVALEQDDDVKIGGGATH

SEQ ID NO: 13495 - protein, 227 aa, Klebsiella pneumoniae
GIVINVLIIEDEHAIRRFLRTALEADGMRVFEAETLQRGLIEAATRKPDLAILDLGLPDGDGIDFIRDLRQWSQMPIIVLSARSEEHDKIAALDAGADDYLSKPFGIGELQARLRVALRRHGAAQADEPVVRFADLEVNIPARRILRGSEEIHLTPIEFRLLAALLNNPGKVLTQRQLLNQVWGPNAVEHSHYLRIYMGHLRQKLEADPARPQHLLTETGIGYRFMP

SEQ ID NO: 13496 - protein, 684 aa, Klebsiella pneumoniae
GGVIQQTLCQQMTHFSRPAVNSTAALVLRSLSDEPETRAQTVILYVFIRSPMTSSLSRHPAFLSLQGGINFRDLGGQLAADGRRVRSGKLLRSGALNRLTAEDLNHLDTLPLSRVLDYRDPGEVARTPDKLSPLTHYLNAPANPPVSEVNAKVTELNAATLNALNGEQFMLQLYRQLPFNNPAYRQLAAWLTTPFEGALLQHCAVGKDRTGVGCALTLFAVGCDSETVMEEYLLTHGMLTQVEAWMLELLGNDLTAQGAPKPGGYFDGKRVLSRRRAVGYSPALWHRRRLAGGRVPAYRAGSRRAAGPAAGRVTARYPRGERCFGRLPDRGSRGDREKNVISYTSDLPVQRNAHIMRSHLLSQSLTKACVALISHTTLKTMKLSTLLAAAFAIVGFCNTASAVTYPLPTDGSRLVGQNQVITIPDDNKQPLEYFAAKYQMGLSNMLEANPGVDTYLPKGGSVLNIPQQLILPDTVHEGIIINSAEMRLYYYPKGTNTVIVLPIGIGQLGKDTPINWTTKVERKKAGPTWTPTAKMHAEYAAAGNPLPAVVPAGPDNPMGLYALYIGRLYAIHGTNANFGIGLRVSHGCVRLRNDDIKFLFENVPVGTRVQFIDEPVKATTEPDGSRYIEVHNPLSTTEAQFQGGEIVPITLTQPVQAVTSQSDVDQNVVEQAIQNRSGMPVRLN

SEQ ID NO: 13497 - protein, 239 aa, Klebsiella pneumoniae
LNVFLSPGPILKSVKPSPAAPCCRRLICWVVHTAGYKPWPSGSELTGDGLRNEDALALQRHSRVALRYDQVNPYTFAEPTSPHIISADEGRPIAAARLSSGLRELEGLADWVLVEGAGGWFTPLSDSLTFADWAQAEQLPVILVVGVKLGCINHAMLTAQAVRQAGLPLAGWIANDVQPPGKRHAEYLATLKNRLAAPFLGEIPWLADIAQRDDLGQYLDLRALDPALSTAPAAAHPAP

SEQ ID NO: 13498 - protein, 397 aa, Klebsiella pneumoniae
PTSIIRFADPVGRANAMPPGVVEWAKGAIMFHRLWTLIRKELQSLLREPQTRAILIMPVLIQVLLFPFAATLEVTNATIAIYNEDSGRHAVELTQRFARAKAFTHVLLLQSPQAIQPTIDEQKALLVVRFPADFSRNLDNYQTAPLQLLLDGRNSNSAQIAANYLQQIVKNYQQELLEGKAKPNNSELVVRNWYNPNLDYKWFVVPSLIAMITTIGVMIVTSLSVAREREQGTLDQLLVSPLATWQIFVGKAVPALIVATLQATIVLAIGIWAYQIPFAGSLLLFYFTMVIYGLSLVGFGLLISSLCATQQQAFIGVFVFMMPAILLSGYVSPVENMPQWLQDLTWINPIRHFTDITKQIYLKDASLEIVWGSLWPLLVIAATTGSAAYAMFRRKIA

SEQ ID NO: 13499 - protein, 194 aa, Klebsiella pneumoniae
EASITVSNTNKGIPVLIQSWVDEGENSKAKAPFMITPPLFRLEPGQDNTLRAVFTGANLAQDRESLFWLNIKTIPSVKKNEVQENTLQLAIKKRLKFIYRPSAVKGLPEENADKLVWKKIGNQIQVTNPTPFYMNFSVITVGGKTFKPTLPEQTYVAPATERLFTIPAGAVGNTISWKIINDYGTSGKEFHSKY

SEQ ID NO: 13500 - protein, 352 aa, Klebsiella pneumoniae
IKSITIITIIIISGMSVMSFSTTAVRSVAVPGLLLLLALAAALSLTIGAKSLPIGTVFTAFSGTCQSADCTIVLDARLPRTLAGLLAGVALGLAGALMQTLTRNPLADPGLLGVNSGASFAIVLGAALFGITSPQEQLLLAFCGALCASLLVAFTGSQGGGQLSPVRLTLAGVALAAVLEGLSNGIALLNPDVYDQLRFWQAGSLDIRTLQTLKIVLLPVVVAGIAALLLSRALNSLSLGNDTATALGSRVARTQLIGLIVITVLCGSATAVVGPIAFIGLMMPHMARWLVGADHRWSLPVTLLATPALLLFADVIGRLLVPGELRVSVVSAFLGAPVLIWLVRRQPRGGGL

SEQ ID NO: 13501 - protein, 522 aa, Klebsiella pneumoniae
SPSISLRARPPGPRSAPSASPATPAPAWASFSPGSLLIKRLSLKTAKRCMISARWRCSGWVPVWVPRYSVLPLPPSSPGAMPSNGRPRSPHNRLTNKEEDMMPARHQGLLRLFIACALPLLALQSAAAADWQLEKVVELSRHGIRPPTAGNREAIEAATGRPWTEWTTHDGELTGHGYAAVVNKGRAEGQHYRQLGLLQAGCPTAESIYVRASPLQRTRATAQALVDGAFPGCGVAIHYVSGDADPLFQTDKFAATQTDPARQLAAVKEKAGDLAQRRQALAPTIQLLKQAVCQADKPCPIFDTPWQVEQSKSGKTTISGLSVMANMVETLRLGWSENLPLSQLAWGKITQARQITALLPLLTENYDLTNDVLYTAQKRGSVLLNAMLDGVKPEANPNVRWLLLVAHDTNIAMVRTLMNFSWQLPGYSRGNIPPGSSLVLERWRNAKSGERYLRVYFQAQGLDDLRRLQTPDAQHPMLRQEWHQPGCRQTDVGTLCPFQAAITALGQRIDRSSAPAVAMVLP

SEQ ID NO: 13502 - protein, 172 aa, Klebsiella pneumoniae
RDTITLRSRDEALSRLSMRNPWHLLATGFGSGLSPVVPGTMGSLAAIPFWYLMTFLPWQLYSLVVMMSICIGVYLCHRTAKDMGTHDHGSIVWDEFVGMWITLMALPTMDWQWVAAGFVIFRIFDMWKPWPIRWFDRNIHGGMGIMVDDIVAGVISAGVLYVIGHHWPIGLL

SEQ ID NO: 13503 - protein, 608 aa, Klebsiella pneumoniae
GFTMLKAWHLPVAPFIKVQQDRLFITLWLSGESLPQRITLRAEEDNEELSLPMQRLRQAPQPGVVAWRGEISLASGQPRRRYSFKLLWADHQRWFTPQGFTRFPPARLEQFAIDLPDAGPQWVADQVFYQIFPDRFARSAARDADQDAVYYHHAAGREIVRKAWDDPLTGEAGGSTFYGGDLDGISEKLPYLKQLGVTALYLNPVFAAPSVHKYDTEDYRRVDPQFGGDAALLRLRHNTQRAGMRMILDGVFNHTGDSHPWFDRHQQGSGGAGHDPDSPWRDWFTFSEEGQAHNWLGYASLPKLDYRSTSLVNEIYAGEDSIVRHWLKAPWSMDGWRLDVVHMLGEGGGARNNLQHIAGITQAAKQAQPEAFVFGEHFGDARQWLQADAEDAAMNYRGFTFPIWGFLANTDISYDPQKIDAQTCMAWMDNYRAGLSHQQQLRMFNQLDSHDTARFKSLLGKDVARLPLAVVWLFSWPGVPCIYYGDEVGVDGNNDPFCRKPFPWDPALQDTQLLALYQRMAKLRKAHQALRYGGCQVIYAEDNVVVFVRVYKQQRVLVAINRGEACEVVIEDSPLLNVAGWTLQEGAGAFQDGVLTLPAISANVWSGR

SEQ ID NO: 13504 - protein, 938 aa, Klebsiella pneumoniae
GITMQNGAMKAWLDSSYLSGSNQSWIEQLYEDFLTDPDSVDANWRSMFQQLPGTGVKPDQFHSKTRDYFRRLAKDASRYTSSISDPDTNVKQVKVLQLINAYRFRGHQHANLDPLGLWKQERVADLDPAYHDLTEADFQESYNVGSFAIGKDTMKLGELIAALKQTYCGSIGAEYMHITSTEEKRWIQQRIESVAGKASFTAEEKKRFLSELTAAEGLERYLGAKFPGAKRFSLEGGDALIPMLKEMIRHAGKSGTREVVLGMAHRGRLNVLVNVLGKKPQDLFDEFAGKHKEHLGTGDVKYHMGFSSDMETEGGLVHLALAFNPSHLEIVSPVVIGSVRARLDRLDEPSSNKVLPITIHGDAAVTGQGVVQETLNMSKARGYEVGGTVRIVINNQVGFTTSNPLDARSTPYCTDIGKMVQAPIFHVNADDPEAVAFVTRLALDFRNTFKRDVFIDLVCYRRHGHNEADEPSATQPLMYQKIKKHPTPRKIYADKLEQEKVATLEDATEQVNLYRDALDAGECVVQEWRPMNMHSFTWSPYLNHEWDESYPDKVEPKRLQELAKRISTVPEGIEMQSRVAKIYADRQAMAAGEKLFDWGGAENLAYATLVDEGIPVRLSGEDSGRGTFFHRHAVIHNQTNGSTYTPLQHVHNGQGQFRVWDSVLSEEAVLAFEYGYATAEPRTLTIWEAQFGDFANGAQVVIDQFISSGEQKWGRMCGLVMLLPHGYEGQGPEHSSARLERYLQLCAEQNMQVCVPSTPAQVYHMLRRQALRGMRRPLVVMSPKSLLRHPLAVSSMDELANGTFLPAIGEIDQLDPQAVKRVVLCSGKVYYDLLEQRRKNEQKDVAIVRIEQLYPFPHQAVQEALKAYAHVHDFVWCQEEPLNQGAWYCSQHHFREVIPFGASLRYAGRPASASPAVGYMSVHQKQQQDLVNDALNVD

SEQ ID NO: 13505 - protein, 460 aa, Klebsiella pneumoniae
KTTMESSNKLKRGLSTRHIRFMALGSAIGTGLFYGSADAIKMAGPSVLLAYIIGGVAAYIIMRALGEMSVHNPAASSFSRYAQENLGGLAGYITGWTYCFEILIVAIADVTAFGIYMGVWFPTVPHWIWVLSVVLIICAVNLMSVKVFGELEFWFSFFKVATIIIMILAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTDGSPFVLTFQHLGITFAASILNFVVLTASLSAINSDVFGVGRMLHGMAEQGSAPKVFAKTSRRGIPWVTVMVMTIALLFAVYLNYIMPENVFLVIASLATFATVWVWIMILLSQIAFRRRLSPEEVKALKFKVPGGVVTTVIGLLFLAFIIALIGYHPDTRISLYVGMAWIALLLLGWVFKTRRERRLAQAQ

SEQ ID NO: 13506 - protein, 285 aa, Klebsiella pneumoniae
PATIHIFRRAWCPAQRKGKNMQRDFQNKTVVITGACRGIGAGIAERFARDGANLVMVSNAERVHETAETLRQRYQADILSLQVDVTDEAQVQSLYEQAAARFGTIDVSIQNAGVITIDYYDRMPKADFEKVLAVNTTGVWLCCREAAKYMVKQNHGSLINTSSGQGRQGFIYTPHYAASKMGVIGITQSLAHELAPWNITVNAFCPGIIESEMWDYNDRVWGEILSTEQKRYGKGELMAEWVEGIPMKRAGKPEDVAGLVAFLASDDARYLTGQTINIDGGLIMS

SEQ ID NO: 13507 - protein, 686 aa, Klebsiella pneumoniae
SSTMPYRRWMAAPSTRSCITCASGGRGGRSLSAPTACRRSPRPVKFWYCSMGILPSAAATRRWPCSPAGTATCIDISSWRPRSTRFRRRKRRPWMRSFTELWPTLKRLLAYGSPWRKPLAIAVAMMWIAAAAEVSGPLLISYFIDNMVAKHTLPLKLVAGLAVAYIGLQLLAALLHYNQSLLFNRAAVGVVQQLRSDVMDAALHQPLSEFDTQPVGQLISRVTNDTEVIRDLYVTVVATVLRSAALIGAMLVAMFSLDWRMALVAIAIFPAVLIVMIIYQRYSTPIVRRVRAWLADINDGFNEVINGMGVIQQFRQQARFGERMREASYAHYLARMQTLRLDGFLLRPLLSLFSSLVLCGLLMLFGFSAVGTIEVGFLYAFISFLGRLNEPLIELTTQQSMLQQAVVAGERVFELMDRPRQAWGADDAPLSSGRVEIDHLSFAYRGDRLVLQDITLDIPSRSFVALVGHTGSGKSTLASLMMGYYPLTHGEIRIDGRPLASLSHSALRRGIAMVQQDPVVLADTFYANVALGRGISEAQVWEALEAVQLAAVARSMSDGLYTQLGEQGNNLSVGQKQLLALARVLVDTPQVLILDEATANIDSGTEQAIQQALAKVRQHTTLVVIAHRLSTIVEADTILVLHRGQAVERGTHQQLLAAKGRYWQMYQLQLAGEELAASAREESLSA

SEQ ID NO: 13508 - protein, 76 aa, Klebsiella pneumoniae
HRVLRQEFDMQFSNPFDNPQGQFYILRNDQQQYSLWPAHCDLPAGWAVVCPPQSAEACNAWLAANWSTLTPAHHAS

SEQ ID NO: 13509 - protein, 69 aa, Klebsiella pneumoniae
TQAIRFPTEEKTKVALWQRLTGWLAFLSNGEAGQQDTQRVMEAILPVASLYGVDIGNVETRWFRHDKTY

SEQ ID NO: 13510 - protein, 435 aa, Klebsiella pneumoniae
GNKMQVSVETTQGLGRRVTITIAADSIENAVKSELVNVAKKVRIDGFRKGKVPMNIVAQRYGASVRQDVLGDLMSRHFVDAIIKEKINPAGAPNYVPGEYKLGEDFTYAVEFEVYPEVELQGLDAIEVEKPVVEVTDADVDTMLETLRKQQATWKEKEGAVDAEDRVTIDFTGSVDGEEFEGGKASDFVLAMGQGRMIPGFEDGIKGHKAGEEFTIDVTFPEEYHAENLKGKAAKFVINLKKVEERELPELTEEFIKRFGVEDGSVAGLRAEVRKNMERELKGAVRNRVKSQAIEGLVKANEIDVPAALIDSEIDVLRRQAAQRFGGNEKQALELPRELFEEQAKRRVVVGLLLGEVIRTNELKADEERVKALIEEMASAYEDPSEVVEFYSKNKELMDNMRNVALEEQAVEAVLAKAKVSEKATSFNELMNQQA

SEQ ID NO: 13511 - protein, 185 aa, Klebsiella pneumoniae
SPEIFTGHENFRTQGGGKKVEKNVADKRTASLWCQAIREAATPYTSSEILLDVDKEFGTNTKSLWGKIFDLLPIYAIFKADRESSDGDSEAKKTSLQQAVKDAQAALQDKITALEKDIQDSVLDVAQRTLDKLREMAPELASELTPRFKEWSDHAPVDSFCPHGEAFSKASGLTPPRWLWRRLRL

SEQ ID NO: 13512 - protein, 321 aa, Klebsiella pneumoniae
AQEITMLDTNMKTQLKAYLEKLTKPVELIATLDDSAKSAEIKELLAEIAELSDKVTFKEDNTLAVRKPSFLITNPGSDQGPRFAGSPLGHEFTSLVLALLWTGGHPSKEAQSLLEQIRDIDGDFEFETYYSLSCHNCPDVVQALNLMAVLNPRIKHTAIDGGTFQNEITERNVMGVPAVFMNGQEFGQGRMTLTEIVAKVDTGAEKRAAEELNQRDAYDVLIVGSGPSGAAGAVYSARKGILTGLMGERFGGQVLDTVDIENYISVPKTEGQKLAGALKAHVNDYNVDVIDSQSATKLTPAATEGGLHQIETASGRGAQGA

SEQ ID NO: 13513 - protein, 86 aa, Klebsiella pneumoniae
GGWIWAFMLTSSLRYNITLRVRRAVTKINPAQFKSKVIRRVSPPLASGCQTVGDGAELFRNGLQIFSLLDSGAAGMAYHQARRQNG

SEQ ID NO: 13514 - protein, 76 aa, Klebsiella pneumoniae
RRWIMRNNCLPTAIAEKPYLLDELTYETECVLAILRTINDVSDPHTKSHLVDSAELIGTQLLKKLEHNARLEDGDC

SEQ ID NO: 13515 - protein, 237 aa, Klebsiella pneumoniae
TLRIYHPLMFLSEPEWQAVLLSLKVSSLAVALSLPFGIFFSWLLVRRTFPGKALLDSILHLPLVLPPVVVGYLLLVAMGRRGFIGSWLYDWFGISFAFSWRGAVLAAAVMSFPLMVRAIRLALEGVDVKLEQAARTLGASRWRVFLTITLPLTLPGIIVGTVLAFARSLGEFGATITFVSNIPGETRTLPSAMYTLIQTPGGEGAAARLCLIAIGLALVSLLISEWLARVSRQRMGG

SEQ ID NO: 13516 - protein, 237 aa, Klebsiella pneumoniae
LPRITPIKSRISTLSPEFGWLRPCGGAEESIMFKKTCLTLAVLALGGCRIVSQQELADLKSPPNPHMANMDKTWQQSIVPQVVTKARPAAELMSALKAAKDIDSACKTLGYRAQDENPCIFYVKVSGTVSKLDTASRSGKMTLTEASVGKVTVQIGPTLRGTQLRDGYSGASYQDFNDQVLFGEYSKNINSQAVKMIQTANVKTGDSVEVYGVFSAWDIPQTLPEITPAKIIHAGGQ

SEQ ID NO: 13517 - protein, 311 aa, Klebsiella pneumoniae
INRITMSNLPKFSRALLHPRYWLLWLGIGFLWLLVQLPYPVIYRLGTALGRLAMRVMKSRARIARRNLELCFPEMSAADREALLVKNFESLGMGLMETGMAWFWPTHRVARWTETSGVNEVVELLEEKQGILLIGIHFLTLEMGARMYGMFTPGIGVYRPNDNPLIDWLQTWGRLRSNKTMLDRKNLKGMVRALKEGEILWYAPDHDYGPASSVFAPLFAVEQAATTTGTWMLAKMSGATIVPFVPRRKPNGMGYELISLTPERTPPLASAEVTAAWMNQIIEQCILMAPEQYMWLHRRFKTRPEGVPPRY

SEQ ID NO: 13518 - protein, 538 aa, Klebsiella pneumoniae
EARMIAFTRWPEEFAARYRQKGYWQDLPLTNLITRHAENDAVAIIDGERQISYRQFNQLVDNLACSLQRQGLKRGETALVQLGNVAEFYMTFFALLRIGVAPVNALFSHQRSELNAYAAQIKPALLIADREHALFADDSFLHAFIAEHPSLRVALLRNDGGERDLATEINRPADNFIANPTPADEVAFFQLSGGSTGTPKLIPRTHNDYDYSIRRSNEICGINAETRYLNALPAAHNYAMSSPGSLGVFLAGGRVILAADPSATLCFPLIEQHQINVASLVPPAVSLWLQAIHEWGSNAQLQSLQLLQVGGARLSATLAARIPAEIGCQLQQVFGMAEGLVNYTRLNDSPERIINTQGCPMCPDDEVWVADADGNPLPRGEVGRLMTRGPYTFRGYYNSPQHNAEAFDAEGFYCSGDLISIDEDGYITVQGREKDQINRGGEKIAAEEIENLLLRHEAVIHAALVSIEDNLLGEKSCAYLVVTSPLRAVAVRRFLREQGVAEFKLPDRVECVAALPLTPVGKVDKKQLRQWLAEGKLG

SEQ ID NO: 13519 - protein, 133 aa, Klebsiella pneumoniae
  UNSURE (116): Identity of amino acid at the above locations are unknown.
FSRINMAKQDEQRLLVKIATLYYLEGRKQSDIAQLLSLSQSFVSRAITRCQKEGVVKISVVQPSNIFLKLEKGLEDRYGLKQAVVVDTEEEASDHNIKRAIGSAAAHYLETRLRPXRSDWRLLVELNHSRDGR

SEQ ID NO: 13520 - protein, 109 aa, Klebsiella pneumoniae
VTRIRVVPCSRLSENSRSAILSPVWRSRLPVGSSANRMAGRPLKARASATLCCSPPESCAGRWCRRLPSPSCSSSARASPRLWLSLAPRNSAGSSTFSRALSVGISIND

SEQ ID NO: 13521 - protein, 319 aa, Klebsiella pneumoniae
EKRMAAKKTKPPILPRNYQDPTGADALERRAMKDFARRMNKIGKAYKAALDKIPSSLAVNARYEYQLNPTLLSIILNDASYLVDQVLLDGNEYNLWFYEYVDLASEKGTGQSFYNLSQQSPVYAAGRESLASILASDPYQQRMALVHARVFEEMKGLSADVKRDMARVLTDGVGRGLNPRDIARNLTEQTGIEKRRANRIARTEVTTALRRARWDEAESSMDDLGLNIRLLHLSALSPTTRIKHALRHAHTYTVQEVRYWYAVDANSINCKCSQVEVLVDADGKPLYPNVIEMAKKEFDSHWKKMKVNHSVCHCCKKAA

SEQ ID NO: 13522 - protein, 524 aa, Klebsiella pneumoniae
TVGIRRAAVINQHPGGERPAAGLVMEQIGKRFASVTALNAVTLRLNPGEIHGLIGENGAGKSTLIKILAGVYQADSGSATLDGHPLPLGNPAAIEAAGIRVIHQELNLIPHFTVAESVFLGQEYRTRWGALDRRRMKAATAQFFQQNWQLAIDPERLVRDLSLAERKLVQIARALIDGAARLVVFDEPTAPLEAQEASLVSSAILRLRDQGIAILYISHYLNEIATLCDRGTVLRNGEVVGYPDRDLLQNTEALIAMMVGREIDQLYTPRQRPAADNGATPLLSVRQLSDGRQLQDLSFDIQPGEIVGVAGLLGAGRDVLVDLLYGLRPAERGTIHLEGRPRRIRTPKQAIRAGMALVPRDRRHQGLILPFTTADNINLASLPETATFGWERRGIAEQKARDWIEQLAIRPGRPGLPVRYMSGGNQQKAILARWLGTDARLFILDEPTLGVDIGARRDIYQRTRQLADQGRAVLVSSSDAPELLGLCDRILVLWRGALAANLPTRGLTLDALLVAINGGQEPSP

SEQ ID NO: 13523 - protein, 138 aa, Klebsiella pneumoniae
RHGIAVFSVVTRNFFFSTPALTSRLFFILNLEFIMVSLKSFLHYFSPARPAQPLSEAEKQQIEALIQAFGGEANITQVDACITRLRVSVRHLAAVDSEALQQQGALGVIILGQQVHAIFGKQSDALRQLLDEHFAARK

SEQ ID NO: 13524 - protein, 1033 aa, Klebsiella pneumoniae
GEGMLTFFIRRPRFAMVIALLLTFVGAVSLKLIPVEQYPAITPPVVNVSASWPGASASDVAEAIAAPLETQLNGVDHMLYMESTSSDEGTYRLSITFAAGTDADLAAIDVQNRVAQTLAQLPAEVQQNGVQVRKRASNLLMGVSLYSPLGTLSPLFVSNYASTQVREALARLPGVGEVQMFGARDYSMRIWLRPDRMNALNITTDDVAQALREQNVQGAAGQVGTPPVFNGQQQTLTINGLGRLNEAASFGEIIIRRGAQGQLVRLADVATIELGARSYSSGAQLNGKASAYLGIYPTPTANALQVASAVRAELNRLHTRFPADLTWEVKFDTTRFVAATIKEIGVSLALTLLAVVVVVSLFLQSWRATLIVVLAIPVSLIGTFAVLYLLGYSANTLSLFAIILALTMVVDDAIVVVENVETKMAEGLDRLQATAQALRQIAGPVIATTLVLLAVFVPVALLPGIVGELYRQFAVTLSTAVALSSLVALTLTPALCALLLRPRPARPAAVWRAFNRLLDGTRDGYGRLVGWMNRRPWLALAATVAAGALVAFSFTSMPKGFLPQEDQGYLFASVQLPEAASLERTEAVMAQARKLLMANPAVEDVIQVSGFNILNGTSASNGGFISVMLKDWHQRPPLDAVMADIQRQLLSLPEATIMTFAPPTLPGLGNASGFDLRILAQAGQSSAELEQVTREILQLANQHSQLSRVFTTWSSNVPQLTLTVDRDRAALLDVPVAQIFSSLQTAFGGTRAGDFSRNNRVYHVVMQNEMQWRERAEQISELYVRSRDGERVRLSNLVTITPTVGAPFIQQYNQFPSVSVSGSAAEGVSSRTAMAAMEQILQAHLPPGYDYAWSGISWQEQQTGNQAVWIVLAAVAMAWLFLVAQYESWTLPASVMLSVLFAIGGALLWLWTAGYANDVYVQIGLVLLIALAAKNAILIVEFARSRREEGLSIVDAAREGATRRFRAVMMTAVSFIIGIMPMMLATGAGAQSRRIIGTTVFSGMLVATMVGILFIPSLYVLFQRMREWAHRRG

SEQ ID NO: 13525 - protein, 220 aa, Klebsiella pneumoniae
VRGMLYGKSHAEWIHLRHYSAQNRYWGEKMFNPIQPPCSPAVRAVSIYCGCNHIAGTIRKKQLREPGSLVYVEKAPAKSGAGIGVLITCIVPTRTKRVFLSAKFLHTQIMVGWMRLPKGRPVSIQAGYANLVQLTTSLRLASHGGEFTIHCIEAATMATTPTQNPQFIWIIAAIRRDIESVTVKIFHVTAVSEREARRTLVRDHVCFFAGRIRLTEVDHA

SEQ ID NO: 13526 - protein, 484 aa, Klebsiella pneumoniae
WPVLEKWIAMSARRFGTQSLVRLLGNWQETSSRTPLWRQLAEALRLLILDGRLTLQTRLPGERELAAALNVSRTTIASALGQLREEGFLYSRQGSGSRIVLPERPADLPLPAGISSTLNLSTAALSAGPEVHQAFQHAMTLLPPYLAQTGYDQQGLPVLREAIARRYSERGLPTRPDEVMVVNGALSAFALILRLFTGPGDRVVIDAPTYPMAISAIQGASCRPVGVALPQQGWDCDGLAATIAQTAPRLAWLMPDFHNPTGRCMDAPTRQRVADIAARTRTTLVIDETMADLWYNAPPPPPLASFNPDAAVLTIGSAGKSFWGGLRIGWIRASARTIASLIQARDSLDLGTPLLEQLACSWLLENAATLLPSRRDMLKARRDMCETLMAEYFPRWRFSPPEGGLSFWVELPDMLATLFSARAESQGIHIGTGTRFGLEGAFDRYLRLPFTLPDEALRRAFSTLQPLWQSLAEQKENTRMRKII

SEQ ID NO: 13527 - protein, 145 aa, Klebsiella pneumoniae
LGHFHLPNKVTIMKLVIASVISLLSFSALAAPEGTLSVHILNQQTGLPSPGVQIELDKQQGESWQHIATGKTDADGRIKSLYPQAENMEPGVYKVTFKTGDYFKSQNMNTFFPVIPVIFNVTKQNQKLHIPLLLSQYGYSTYRGS

SEQ ID NO: 13528 - protein, 505 aa, Klebsiella pneumoniae
WVNFAEKRVLTMSEITLLAEVTAFLRQPHGQFIAGQREAGRGAPFAVINPATGQAIAEVTAADSDQADRAMESARQAFSQWREMPTLARGALLLKLADTLAEHREALAQLESLCSGKTITLARMLELDQSVAFLRYFAGWAGKVTGETLDVSLPSMAGEKYTAFTRRQPLGVVVGIVPWNFSIMIAIWKLAAALVCGCTIVLKPSEYTPLTLLRVAELAKAVGIPDGVINVVNGAGGEIAQRLITHPACAKVSFTGSVATGEKVQQSASASGKRVTLELGGKNAALFLDDLTPEAMVNGIIEAGYLNQGQICAAAERFYLPQGKLDAVLALLKDKLSAFAPGSPLDERTLMGPLANRQQYDKVLRLIQTARDEGDTIVCGGEALPGEGYFLQPTAVKVRSEESTLMREETFGPVCSFIGYRSEEEALARMNASPYGLAASVWSDNIRQALRYSEAIEAGIVWVNMHTFLDPAVPFGGMKGSGIGREFGSAFIDDYTELKSVMVRY

SEQ ID NO: 13529 - protein, 415 aa, Klebsiella pneumoniae
HIFVTFPLQDARSRAIKWRARRPGCWQAGRLLLQHQLDIDIPFERQRIMSESQTLVVKLGTSVLTGGSRRLNRAHIVELVRQCAQLHAMGHRIVIVTSGAIAAGREHLGYPELPATIASKQLLAAVGQSRLIQLWEQLFSIYGIHVGQMLLTRADMEDRERFLNARDTLRALLDNSIVPVINENDAVATAEIKVGDNDNLSALAAILAGADKLLLLTDQPGLFTADPRSNPQAELIKDVYGIDDALRAIAGDSVSGLGTGGMGTKLQAADVACRAGIDTIIAAGNRPDVIGHAMAGLPVGTCFHAQESPLENRKRWIFGAPPAGEITVDAGATQAILERGSSLLPKGIKIVSGNFSRGEVIRIRNSEGRDIAHGVSRYNSDALRLIAGQHSQQIDAILGYEYGPVAVHRDDMIIR

SEQ ID NO: 13530 - protein, 67 aa, Klebsiella pneumoniae
GRFVYGLGGTPIDRIGRNTIDLLQTVEALKEKGVSVISMHEGFDLSTPAGEACLPSWQHWQKWNCLY

SEQ ID NO: 13531 - protein, 852 aa, Klebsiella pneumoniae
PGVVMANEFLTQCEMTVNTAAGRKLSEDEMESLVRDMNDTTNRILAGNEALSLEDAAMRAAQELGNREQLAKVIEARNKAINTRIAAQRLGELRRTWKDRPDIGLEAMLVGRNDARTGSRRSVSSEVAQLRGKYHAGINYDFDQAGLVKFIASGSNDREIADAMWRIGRGQKTDGMTPQSVSAAKIIMKWQETARVDENRAGAWIGKMPGYIVRQSHDILEIRAAGYEAWRNSILPRLDDVTFDGITDRESFLSDVYDGLASGVHLTSEKPDWMNGFKGAANAAKRASQERVLHFKDGVAWHEYNEQFGTGSLREAVFGGLNSAARTTGMMRVLGTNPQNMFNYLASTIEKDIKKSGNPAALADFNTKVKRINRTVMPQVDGSLNIPGSVGWANASANVRGWLRMSQLGGAVISSFNDVPISATEMRYQGQNFMQALTGAMKGRLSRYTSDEQKEILSSIGVYSDTMTQEIIRRMSGDDSMSGKMGRAQQLFFKYNLMNFWTQSGRNSNAMMITNWLAKNADHQFSALQEDLRRVLDLHGIGDAEWNIYRNMDMADSEGRKFMTSSGIRGVPEDVIASYVEGKGIKPTERSIADARDTLEGQLRGYVLDRLNIAMSEPGDRTQSLMKMGTVPGTVAGEAIRFAGQYKSFTASFMQNVLGREVFGRGYTPAGLGESKTGSLTNALLRNGKGAFMGAANLFVWSTLFGYVSLQAKLMLKGQTPRPADAKTFLAAAAQGGGLGIFGDFMFGEVNRMGAGPVTSLMGPAASNADSIITLLRQTTRGEADLGDWYRTSLDNTPFLNVFWLRTAMNGLILNRIQDALAPGSLERYQRRVEREQGNDFLIPPSQFMLGK

SEQ ID NO: 13532 - protein, 224 aa, Klebsiella pneumoniae
SISVLHGGGIPRFNSAVDNFVHRAGRQQALKQRHRVGDQGDRIAQLWFIAGKSMAHFFHHRLRPEGKAGGDARIFYGLIALRLVDVIGKAGADRARFNQADLNTAVAQLHAQRVGPCLEGIFTGGIGSAAGTGDKPHHRGGHHDAPFAVRRHRRQQQHGELMRAEKVSGKLLFHLLAADGVQRAIDAIPGVIEQAVETIIGQRNHLRCRALHALRVIQIEQNTG

SEQ ID NO: 13533 - protein, 188 aa, Klebsiella pneumoniae
ASSVNGILTMTRRYLKLAIAGCLFTLTACAQQSEIRQMHQSVSTLSQEMTQLNQQTIKITQQNALNAKSTRGVYLLPEAKTPARLESQIGTLRMSVGSITPDGDGSRLTLRIQGESNDPLPAFTATVASGQITGTTHSYQEVNVQDQLISAPASTLAPSDVDIPLRLNVTPDKVGFIRVHDIQPAAAQ

SEQ ID NO: 13534 - protein, 309 aa, Klebsiella pneumoniae
PRPVSFSALRRPPSSAALRWSPTAGPVSSMFPLWRLPNALHCSGAPMTSEAVFIQVGALADGFAPHGNLLATASLPAGENFTFYVAGSEPQQLVIEDEQTLSWNGKRAPWRATALRPDILFIDFLDPERDNASISAVCNLTQRNATLVYGQLPDEAAARLDAFSRVEQGLPLTAVEARFVFARLDAQPGPLPGFTTALVGMRNQYTYSPTERYEHIYLNDNFYAWQCLDGVEKGLADVDRCHYVQVAEDLYLFVWREKIIPTLGVILIDLQQMRTDGKIMGYQGSDFGALSNFPVGASAKILNVTRHQE

SEQ ID NO: 13535 - protein, 410 aa, Klebsiella pneumoniae
RRAVLRRRYFCRLRRDHLHAQLYAGVGWDPDRTVAYCPVGDPDGDLRLSDPRRAPVATRSPSPARAGPDKRRTGERRCGMNFQQTYLYWLAGAVLLVVAIMSWRDKSNPRRLTTGLFWGLYGLVFLLGDWTYQLVGDKRTVNIAVGGVVVILALIAGFGGVRLGSYHQRTQEEKTASAKRLGNKLFFPALAIPVVTVIGVLLFNNLPSWQVALFGPGNHATLITLFSMTVGTLIGLAMAIRMTHETVAQPMQEARRLLDSVGWAFILPQILAVLGLLFTAAGVGTSISWLTEHYLAVDNRFIAVAVYAIGMAVLTMVMGNAFAAFPIVTAGVGIPILVLQHGGNPAVMAAIGMFSGYCGTLMTPMAANFNIVPAALLELPDKNAVIKAQIPTGILLLIVNVFLLYFLMFL

SEQ ID NO: 13536 - protein, 120 aa, Klebsiella pneumoniae
MMNVKPIRTEQDYEAALRAVEPFFDNEAAPDTPEGDFFEVMCLLIAEYEKKHYPIEPPTPIEAIKFRMEQQGLTVKDLEPAIGKSNRVYEILNGTRNLTLPMIRRLHAQFGIPLESLIGA

SEQ ID NO: 13537 - protein, 911 aa, Klebsiella pneumoniae
WRDVALTSASEIEGKSMNTDKPGAPYYQRSVEETLASVQSSPEGISGTEAATRLQQYGENALPQKPGKPAWLRFIAHFNDVLIYVLLAAALLKAVMGHWIDMAVILAVAVVNALIGFIQESNAEKSLQSIRNMLSSEAVAIRQGNHETIPTTSLVPGDIVVIRAGDRIPADLRVIEAHNLRVEEAILTGESTVVEKTTEPLNGDLPLGDRSNLLFSGTTVSSGAGKGIVVATGGNTELGHINQMMAGIEKHRTPLLVQMDKLGKAIFILILVMMAALFVFSLLFRDMPVSELMLSLISLAVASVPEGLPAIISIILSLGVQAMARQKAIIRKLPTVETLGAMTVICSDKTGTLTMNEMTVKAVITADSVYRVEGDSYEPVGKIHAIDDPTPVTIAPGSLFERYLRTIDLCNDSQLIKEESGLWKITGGPTEGALKVLAAKVTLPPLTSELRSKIPFDSQYKYMSTLYRLGEEEVVLVTGAPDVLFRLCQYQQSDSGLQPLDLPYWEGKIEEYAREGLRMVAAAWKPAAAGQTELTHQDLQQGVILLGVAGMMDPPRPEAITAIADCLQAGIRVKMITGDHPQTAMSIGKMLGIGNAGNAITGRELEVMDDAQLSVAAQQFDIFARTSPEDKFRLVQALQSKKEIVGMTGDGVNDAPALKQADVGVAMGIKGTEVTKEAADMVLTDDNFATIASAVREGRRVYDNLKKTILFVMPTNLAQGLLIVIALLAGNVLPLTPVLILWMNMATSATLSFGLAFEAGEKNIMRRPPRDPKIHVMDGFAIWRVAFVGSMIAVSAFILEAWLQPRGYSPEFIRTVLLQTLVTAQWFYMLNCRVSDGFSLTKGLLANKGIWIVSGVLLLLQLLIIYAPFMQMLFGTTGLPFRYWVITFIIGFAMFLIVELEKPLTRKWRSA

SEQ ID NO: 13538 - protein, 213 aa, Klebsiella pneumoniae
RSCVIFSLRMHCGTDSDNTCFRFHFFATDGTRGSSVMTQPIFLIGPRGCGKTTVGHALARARHFQFSDTDHRLQAHEQRTVAEIVQAEGWARFRELETLSLKAVTLPNTVIATGGGIVLAEGNRQFMRENGVVIYLQASVSALIDRLEAYPKAEQRPTLTGKPVREEVGEVLAQREALYRDAAHHIVDATASPDRVVEQIMSMLCSATATPVS

SEQ ID NO: 13539 - protein, 163 aa, Klebsiella pneumoniae
DKCVIIAPFPFCLGLSCMLQPVVRVGEWLVTPSVNQISRKGRQLTLEPRLIDLLVFFARHPGEVLSRDELIENVWTRNVVTSHVVTQSISELRKSLKDGDDVSLEYIATVPKRGYKLTVPVIWCTEEGEELAPSMEALTPSPSTAVPAPPARRCAIRRLCPSP

SEQ ID NO: 13540 - protein, 127 aa, Klebsiella pneumoniae
FWSVNCLLRNKAGKLDDCAASRTVVPGYTFPVRDLARINGTLRLLLSVCFIRGRVRAMHIKNTIPAEFVFNSALMKNIENTLIKQHRTVNNERMITEIQHRLQTESNEILSDLYLQALDMLYSKPHH

SEQ ID NO: 13541 - protein, 387 aa, Klebsiella pneumoniae
IRSVMMSLKEKTQTLFADAFGYPASHVIQAPGRVNLIGEHTDYNDGFVLPCAIDYQTVISCAPRDDRTVRVIAADYDNQTDEFSLDAPIISHDTQQWSNYVRGVVKHLQQRNSHFGGADLVISGNVPQGAGLSSSASLEVAVGTVFQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTLEQFNAVAHELDPVVAKRVRHVLTENARTVEAASALEKGDLKRMGELMAESHASMRDDFEITVPQIDTLVEIVKAAIGDKGGVRMTGGGFGGCVVALIPEDLVDTVQQAVANEYEAKTGIKETFYVCKPSQGAGQC

SEQ ID NO: 13542 - protein, 883 aa, Klebsiella pneumoniae
GDLVMPTVPTVQGVPTVQGRQVESRGVSSPGFQTFDQPNVSDALVNVGSQALDVFGQAKQQADLALTQDATQRLYAVGSGLMDDPKEGLMTLQGKNAIGQAPGYIQKFDNEMQTIAGTLPESTRNVFLKHAQQQRMQFATQAERHELGQRRQYESGQQDGYLSLQAQQAISNPQLFNQSALNARASIMAYGQAHGQSPEEIEANWGRWREQAANRASEAWYNPIYQQMMGPEGKIEVTNTPQEAQLFSSIIWQESGGNQFGKDGAPLVSPKGAVGAAQVMESTGPEAASLAGLSWDRDKWLNDPRYNVQLGKAYFGAQLKKYDNNPVLAVAAYNAGPGAVDGWIKQFGDPRDGTVSNAQFAAAIPYEETRNYVAKVTGSAGAIPGNATIENLVNQPFWNAMSPQKKSEMLSKQSGLYDMQTAAGRVSLQTRMQDDLAKLEAGQEVNPITEHEWAAVMPLQASPSERIQLQQSFEQYQQAMMLQPAYKTIVQGSAQQGIAAVQAMIPQESDSDFKFKQGLYATAQAKLNATLKARESDPGTWLQTHSPVAKNAFDQYSNGQASGEWLVSRLQSEKDRLGIRSKKVLPDSMVNSLIARIDNNQESSVAAIQQMAQSFGKYSGQVMQQVQKSAYPALQVIMATNNPRAANALWQNRSVKTSDLRGNFEKTDADSADSSWNDQAKDFAGTMVVQPGGAAVWNNFNEQGKRLTYTYMQRGMSPSDAAKQAYQDVLGEQYQTSGTWRMPNSAGQDIRDVNDGANEYLKNLSADQIMPLIGDARLPDEVNREQSISRIRENAQWVTNSNETGLTLMMNGLLINNAQGQPITVPFADLAKLGAGNRTTWNSLTKFVQTPVKYTPGQSKNYTVESQRENLLNIIQNGQQTGR

SEQ ID NO: 13543 - protein, 77 aa, Klebsiella pneumoniae
FTLVNTSCRADIAQLVEQRIRNAKVVGSTPIIGTIKCIPFQHAPVFIKYKNFLIGGMASVHRMRLPPPRWGSPFLTG

SEQ ID NO: 13544 - protein, 402 aa, Klebsiella pneumoniae
NLAVGAADPADAGGQRPAGSPDAAAGDGRRYRLRAGGAGRAFAPAADAGGGGAHRRLDGAGRADLIYRAGGAAYRPPPERHGPLGTNPVGPVRRAAAGAGRLRRPTAVYAVAAAGWRVNRQPRRYLPYCIVDSGVPQKMSAVPSRLRGEQLTLAYGNKTIAESLNVTIPDGHFTAIIGPNGCGKSTLLRTLSRLMTPASGHVWLDGAQIQQYASKEVARRIGLLAQNATTPGDITVQELVARGRYPHQPLFTRWRKEDEEAVNKAMRATGISDLALQSVDTLSGGQRQRAWIAMVLAQETAIMLLDEPTTWLDISHQIDLLELLSELNREKGYTLAAVLHDLNQACRYATHLIALRDGRIVAEGAPKEIVTADLIERIYGLRCTIIEDPVAHTPLVVPLGRR

SEQ ID NO: 13545 - protein, 141 aa, Klebsiella pneumoniae
KDSVRNIVETKEFVWNLATRPLAMAMNETSASIPHHEDEFVRAGLTAAASRLVSAPRVAESPVNFECRLSQCIQLTTADGNPVDTWLVLGEVVAVHIDESLLDNGIYQTARAQPILRAGGPSAYYGIDDSLRFDMIRPDAR

SEQ ID NO: 13546 - protein, 378 aa, Klebsiella pneumoniae
FCSVRWSTSATRHRAQGAARRRLSVIPFQAVCVTDARPGVGLLENRRRETTMSDKKWIKAEDVARLAGVSRSAVSRTFTPGASVSEKTRQKVLSAAEALGYQVNIIARTMITGSSNFIGIVTAGFDNPFRSKLLAPLVHQLALNGFMPLLMNADDPQQLAPSLKQLLSYHVAGVIITSGAPPLSLAEEYLARKIPVTLINRHADLAGCDRVCSDNAQGAKLVADLFSRRGWRQVGFIGENRENFSTRQRYEAFIARTSDMAVSSRFCDGGGYQAGNQAARELVAENPGMQALFCATDMLALGAQDGLRDAAAPLPAIVGFDDIPQADWQPYQLTTVQQNTALLAHHAVDLLMTRIARFSLPSRHREVPVKLIIRHSAK

SEQ ID NO: 13547 - protein, 390 aa, Klebsiella pneumoniae
SEGVILMSITKRINKMNSFKWILLAFPLALLSGCTIVPGSSISTISKDKQDVPDSDFNINDMVDVTTITPSLVNQMSADIIKTNSNPSTSFGNKSYAYKVGAGDILRITVYNHPELTNPQGQYRSAKEAGVLVKNDGTIIFPYVGELKVSGMSVEKIRSTLSERLVKYIEDPQVDVSVAEFASQKVYVSGSVNIPGKQPVTDVPLTVMDAIGAAGGITSDADWEHAVITHSGKNEIVSLRSLLQMGDLSQNKTLYPGDSLYVPRNDELKITVMGEVTTQTTLNTGLYGMTLAEAIANSEGISQSHADASGIFVIRPTGTNEGKIAKIYQLNMSDAASMVMATQFHLKPNDVVYVTTAPITKWNSVIKQLLPSISLINKTITTTRMIKNWP

SEQ ID NO: 13548 - protein, 508 aa, Klebsiella pneumoniae
SEIVLANLWYGGGCMNAFALEAEGISKFFPGVKALDNVSLRVRPGTVHALMGENGAGKSTLMKCLIGIYRPDKGSIRVKGEPVEFTDTMDALRSGISMIHQELNLVPHMTVAENIWLGREPMKYGFVDHGQLTRQTQALLDKLNIRLTADRLVGDLSIAAQQMVEIAKAVSWNADIVIMDEPTSALTEGEVAHLFTIIRDLRAQGKAIIYISHKMDEIFAITDEISVFRDGTWVGSKNTTEFTRQSLITQMVGRELTQLFPKFNNTIGEEVLTVRNLTRQGVFHDVSFSVRRGEILGVAGLVGAGRSEVMESLFGMERFDSGEVLIDGAPVTIDSPSVAIEKGMALLTEDRKKSGLFLVLSVLENMSIVKMPEYIGKSGFVQHVKMAEDCMEQIRRLNIKTPTMDQIINNLSGGNQQKVLIARWLLAQPKILILDEPTRGIDVGAKAEIYHLISELANRGVAVIMVSSELPEILGMSDRVMVMHEGRITGILEKDEADQETILSLASH

SEQ ID NO: 13549 - protein, 178 aa, Klebsiella pneumoniae
NSVVDVTKRCGVTEFSVKCGTLSSREKSFRREAMKWQQRVRVATGLSCWQIMLHLLVVAVLVMGWMSGALVRVGLGLCVLYSVTLLAMLFLQRHHEARWRDVGDFLEELTTTWYFGAAMIALWLLSRVLHNNLLLALAGLVILAGPAVVSLLAKDKSRYPKAFGLQQGGNAANPQKHR

SEQ ID NO: 13550 - protein, 403 aa, Klebsiella pneumoniae
IRVVMESWKVNLISVWFGCFFTGLAISQILPFLPLYVSQLGVTSHEALSMWSGLTFSVTFLVSAIVSPMWGSLADRKGRKLMLLRASLGMAIAILLQAFATNVWQLFILRAIMGLTSGYIPNAMALVASQVPRERSGWALSTLSTAQISGVIGGPLLGGFLADHVGLRMVFFITAILLTISFLVTLFLIKEGVRPQVSKSERLTGKQVFASLPYPGLVISLFFTTLVIQLCNGSIGPILALFIKSMAPDSNNIAFLAGMIAAVPGVSALISAPRLGKLGDRIGTSRILLATLCCAVVMFFAMSFVTTPLQLGTLRFLLGFADGAMLPAVQTLLLKYSSDSVTGRIFGYNQSFMYLGNVAGPLIGASVSAMAGFRWVFIATAIIVFINLWQLAWMLRQTRRANA

SEQ ID NO: 13551 - protein, 171 aa, Klebsiella pneumoniae
VSSVTPRQFCFLNGSPGHHVLNSTQDEKAMKKKVLAIALVTAFTGMGVAQAADVTAQAVATWSATAKKDTTSKLVVTPLGSLAFQYAEGIKGFNSQKGLFDVAIEGDTTATAFKLTSRLITNTLTQLDTSGSTLSVGVDYNGAAVEKTGDTVMIDTANNIMGGNLSALANG

SEQ ID NO: 13552 - protein, 409 aa, Klebsiella pneumoniae
PRAVLKDKHMKRFTPAWLAVCLACSFSTSSLAADALTTRAFQGMSADFIKGADISTLLDAEKHGATFYDQNNQRKDPIAILKENGVNYVRLRLWVDPQSASGEDYGGGNNDLATTLALAKRAKAQGMKLLLDFHYSDFWTDPGKQFKPKAWEKLDYPQLKTAIHDYTRDTIARFKQAGVLPDMVQIGNEINGGILWPEGKSWGQGGGEFDRLAGLLNAAIAGLKENLRQGEQVKIMLHLAEGTKNDTFRWWFDEIDKRRVPYDVIGLSMYTYWNGPISALKANMDDISKRYNKDVIVVEAAYAYTLANCDNAENSFQAKEEKDGGYPASVQGQYNYIHDLMQAVVDVPDQRGKGIFYWEPTWIAVPGNTWATPAGMKYIHDEWKEGNARENQALFDCQGKILPSVKVFN

SEQ ID NO: 13553 - protein, 143 aa, Klebsiella pneumoniae
KQGFILTEPIMVTLDQAKEYLEGQVITIPDFVLQAFVDEANSIQDCLDAHYPTSTALLIQLYLLALMGLGSGDKYISSQTAPSGASRSFRYQSFSDRWKASVNLLRSLDKYGCASALIPADPTASPAFAGIWIGKGGCMCGDK

SEQ ID NO: 13554 - protein, 423 aa, Klebsiella pneumoniae
KREVASHFPGVRLLLVILFFQHFNGVTTIRLTIGAVDIGFEAWIVGADFAQHLQELQHRTALFGDHLTRHHQRHSRRIRQDHVGVDAADHLFEIHFFRLTVQLFLERGIRGHHHRWQHFKRAEHQIRQVVMLNQFVNVLREVLNTHVFIEFRIFTVQRRQHVFHPQVQVERAFEVGQRTQQAQRFSLIDTDTEQEQQVVRTGFLNHDAVFVEVFRHDACRNTEVIHGAVFLHPRSQQRDFDRVEVHVFVIDVFETVPCAVGTQRPAFRTIDMLRLPDVEEPAVRLAFQTFDLFTELNGTFNRAVDQTLTSVPLHHRRRGFGGGHDPVVWRGGGVHHVGFVEGLFVYVAFHVDHRRLGERRQQFVRGLGFINHFPFDAAAAHPAFAFIDRREVGVRHPRGVKVNGFHIQGFLDEVGVIQQTIIG

SEQ ID NO: 13555 - protein, 69 aa, Klebsiella pneumoniae
FDRVVAEFDHFAAVEADQVIVVMLLGQFENGFSAFEIMTSHDAGVIKLVEDAVNGRQTDLFAHVDQAFI

SEQ ID NO: 13556 - protein, 104 aa, Klebsiella pneumoniae
GRMVMVMVVIMFVVVIMFVVVIMFVVVIMFVMVIMVRVGLRFAPGAPEHPAGNQHNRYPRDQLKPGFRGLGVPAAAKPQAGHGDQPDHRRMRNRGRQPQQYRLF

SEQ ID NO: 13557 - protein, 84 aa, Klebsiella pneumoniae
IMMVIINKTELMTNLSKCCTGAAPTCQADMINDSYIAQEEGYGFPSAKNILFNMKPSLSRCQALYAKDDDALGCWQKKHRLDNN

SEQ ID NO: 13558 - protein, 324 aa, Klebsiella pneumoniae
SGVVMAILSIGFACFDQFFFLNEWPQENTKNFCHDFIESGGGPAANAAWLLGLWGEEVYYIGHLQQDLYGQRIIDEFAEAGVDTSQVVFSDDMITPLASVLVNRLTGSRTIITRKMQTPPSLTYEQKLKLDDLAERLIASEEPVTILIDGHEAEISEYLIKKLPNARVVMDGGSLRASNIKLAAWTDYFVVSEHFARDYMSYRSLSTEAEIKAALIELNKICRGEAFITLGEKGCAFLKSGMLQIVPSWLCNAVDTTGAGDVFHGAFTYGVHYSWHIDNIILFASLTAAISIEKKGVRESMPDLAVVHHSLNSYERNLTQYFEE

SEQ ID NO: 13559 - protein, 561 aa, Klebsiella pneumoniae
KSPVALSLTGATALCGLVARVRRSRYPGNGQGLLDTFAAQVVFVVAAEVDHAVRSDLQDAGRQRADKLTVVGDKDQGALIHLQRHVQRFNRLHIQVVGRFVHHQDVWLLHHQLTEQHAPFLATGKHLRRLFDIVLAKQQTAEDAAYCLLVVAFLLPLAHPFEDRQVVFELVLMVLRVVADLRVFRPFHAAVVRLQFAYQGFQHGGFTHAVGAQNGDLFAHFQQQVDVFEQRTFIKAFGKGFHFQRVTEQFLILLEADKWVLTAGGFNLFQLDFVNLARARGGLTRFRGVGAEAANEGLQVRNLRFFLGVVRQQTLTRLGGRGHVFVVVARIHAQLAVVEIRHVGADHVQEVTVVRNDNHGAVAIVQRLLQPANGVDVQVVGRFIEQQDIRIGKQRLRQQDAQLPARRDFAHRAIMLFNRNADAEQQFAGARFRRVAVHFAIFDFQVGHFVAIFFTHLSEGVDTIALLLHFPQLAVAHDDRIQHGERFKGELILTQLTDALVRVERNVAQRRFEIAAEDLHKGRFTAAVGADQTITVAAAKFNGDIFEQRLTAKLHGNVAGY

SEQ ID NO: 13560 - protein, 320 aa, Klebsiella pneumoniae
SAPVINRTALMANLYDLKKFDLNLLVIFECIYQHLSISKAAAMLFITPSAVSQSLQRLRQQLNDPLFVRVGKGMTPTTACVNLHYHLQQNLEQLEKTINLNNRSELRKRIVIYGPPLFCSVNSHVMINQLCHQANLQIEHHNLTTTESAEELLAYRQADLVFTRMPITNRATICQPYQTVQTLAVCRAGHPRRETLTSVESLAQEFFTHYITNDPVIQRVQQSSIAWLNPRNIAFRSDSFMTILNMINKTDLIGFLPSYLYDFISPTMQLHAINIDNLFPDITIYINYHHASSQNHFLTELITILMNDREASRPKFNHSE

SEQ ID NO: 13561 - protein, 77 aa, Klebsiella pneumoniae
ATTVSPTVLVCSSTRSKTLLWTSPTSSLVFVTLTSAPGLLAWVTASNHSGDMKNPPLGADFFCLLTAGPGDWPGRRD

SEQ ID NO: 13562 - protein, 105 aa, Klebsiella pneumoniae
PATVGFHLEMIMYLHITLNSGRTMHGGMTQSIIEVYDVSLGVTAPCKGDDDNAHPVVLWRTKGNKDCEGIMFLHELDIAVVKSTDGTVLHEWHGAKSQKQKRKSE

SEQ ID NO: 13563 - protein, 150 aa, Klebsiella pneumoniae
LMTVLSIRSPARWNSRMSLLIRPPAQSRLRAIFPNPDHTLLPGMFVRARLEEGINPDALLVPQQGVTRTPRGDASVMVVGEGDKVEVRQVTASQAIGDKWLVTDGLKSGDRVIVTGLQKIKPGVQVKAQEVASDDKQQAAGNAPSEQTKS

SEQ ID NO: 13564 - protein, 315 aa, Klebsiella pneumoniae
WNAVLSTATPIKWPLSRVKNVATEREALLRKPEWMKIKLPADSSRIQRIKAAMRKNGLHSVCEEASCPNLAECFNHGTATFMILGAICTRRCPFCDVAHGRPVAPDANEPQKLAQTIADMGLRYVVVTSVDRDDLRDGGAQHFADCISAIREKNPSIKIETLVPDFRGRMDRALDILTVTPPDVFNHNLENVPRLYRQVRPGADYNWSLKLLERFKEAHPEIPTKSGLMVGLGETNDEIIEVMRDLRRHGVTMLTLGQYLQPSRHHLPVQRYVSPEEFEEMKAEAMAMGFTHAACGPFVRSSYHADLQAKGMEVK

SEQ ID NO: 13565 - protein, 469 aa, Klebsiella pneumoniae
SLQVGASARRPVAGIARRRCASRIQANSFWEPIVSKATEQNDKLKRAIIISVALHIILIALLIWSSFDEHLDASAGGGGGSSIDAIMVDPGAVVNNYNRQQQQQASARRAAEQREKQAQQQAEELREKQAAEQERLKQLEQERLQAQEAAKEAKEQQKQAEEAAAKAAAAAKAKADAQAKEAQEAAAKAAAEAKAKADAQAKAAEQAAAKAAADAKKQAEAAAAKAAAEAKKQAEAEAAKAAAEAQKKAEAAAAKKAQQEAEKKAQQEAAKQAAAEKAAAEKAAEKAAAQKAAAEKAAAEKAAAAEKAAAAEKAAADKAAKAAAAKAAAAKKAAAAKEADGVDNLLGDLSSGKNAPKTGGGAKGNNAAAAGSGNTKNSASGADINNYAGQIKSAIESKFYDASSYAGKTCTLRIKLAPDGLLLNIQSEGGDPALCQAALAAARQAKFPKPPSQAVYEVFKNAPLDFKPQ

SEQ ID NO: 13566 - protein, 359 aa, Klebsiella pneumoniae
RKQVCHQSQGMPMNVTRKEQRIIQRALNAWQASGELTPSDSQRLAQTMRVSPFDWRRLSRYAFWTALACVLISLGSLFADSELVAWLLSLFSHSALMRILLPALLAVVCYGWGFRRQRRETQWHYSTEAILFLGVVFTAVALWQLGERLDNGSGHIAPLFLAGCVIYGAIGYIARSGLVWLFFLLALGNWFGAETGYVSGWGAYWLGMNYPIRFVLFGGALLALCYGAQSLLRQRQLFTVSKAMGLTYLFIALWILSIFGNYDADSWYQVSQARLLPWGLLFAVAAGVCIFISLKTDDGMLRGFGLTFLAINLYTRFFEFFWNGMHKVLFFLILAVSLAVIGRYAERIWHAGEGQVEKK

SEQ ID NO: 13567 - protein, 373 aa, Klebsiella pneumoniae
CMKVVSPASWKKTKPTRKPFCRWHPIEAQRMSNMKLTAAPASEGSSFFANLRHKMPKDTGIFVVMLVIALTFEIAGWYVRDQSFLLNTNRLVLIVLQVAIIGIIAVGVTQVIITTGIDLSSGSVIALAAVVAASLAQTSDSLSPMFPALVNLPAVIPICAGIGVGLLCGLTNGFLVTRTGIPPFIATLGMMVSARGLAQYYTQGNPISFLSDSFTAIGQGAMPVIIFFVIAAVFHIALKHTRYGKYVYAIGGNMTSAKVSGINVNKYLVIVYTIAGALSGLAGVVLAARVSSGQSSMGMSYELDAIAAAVIGGSSLMGGVGRITGTLIGAMILGLIKSGFTFVGVDAYVQDIIKGIIIVAAVTIDMRRNRKKH

SEQ ID NO: 13568 - protein, 216 aa, Klebsiella pneumoniae
PSKVMVPPWVSTSLSSARPVVDLPQPDSPTSDRVSPGQRSKLTFSTACTSRVTRLSSPPRTGKRATRSRTCRIGSPATTVSGVSLSASGWPGSGKRRGRSWPRISPSRGTAASSDCVYGCCGERKISSTLPVSTASPRYITSTRSAISATTPISWVIKITPIAISFCRTAMSCRICAWMVTSSAVVGSSAINTAGRQESAMAIITLWRMPPESWCG

SEQ ID NO: 13569 - protein, 348 aa, Klebsiella pneumoniae
GGEVLLVMLPVRNHLHHRIIITMSQKRKLLPAALGLLSLASLSVAAADALSLQGKTIGVAVVGTQHFWDREAFKGATEEVEKLGGKFIGVDGGRDNQVHANNHDILLSRKVDAVISILGDSAVEPKFKALRDAGIPVFTVDHVSQYSVNNTTSDNYTLGSTIGRYMADELGGKGNVAVFNAFSSALRICGIRYDQWKYVLKDYPDIHIIQPELAEQFANSPEDARKKTLELLSQYPKGKLDAIHVACWDQPAIGIVQALEETGRDKDVKVTAIDAGPETLEIMAEPGSPFVANVAQQPHLIGQTSADNVARYFAGQKLPVQTFIPVVPVKGPQEAKAVYKQLGYGELQ

SEQ ID NO: 13570 - protein, 90 aa, Klebsiella pneumoniae
DCRVVDLLSARACIRYQFVMLHTALRQRKGQGTEQRRLMARPQGCGETTANQRFSSPNIKTYIPLITVLITSVNTDTLLHNLFSGERVTP

SEQ ID NO: 13571 - protein, 91 aa, Klebsiella pneumoniae
GRRVSQSARVCPPSAPACRRESDGCAASQYTPHQYPDAPASPPPGRKPGGSPIPRPPGRPSPGCGRPPPPPAAGCRFSMSAQSARRSSQDR

SEQ ID NO: 13572 - protein, 66 aa, Klebsiella pneumoniae
AVGVTPCPLRINSGSGNSARSLLIDWLIADGVILSIFAALTIPLCTYTASKIVNRLRSILRRMRNI

SEQ ID NO: 13573 - protein, 164 aa, Klebsiella pneumoniae
PSLFKVFNVLFNFSFDRCLLYRGYVMIKKKGGTMFSYIMLGTNDPQASYKFYAPLMRVLGHPLDGRSEKGAAWGTFKDNHTTGLCVGMPFDNLPATRGNGVMVALNAVSVDMVQELYRLAIENGGEDEGPRDYRPHYGADFYSAYVRDPDKNKIAFVFYDASKR

SEQ ID NO: 13574 - protein, 1138 aa, Klebsiella pneumoniae
EVLFCALATTPGILRHLHSFILTMLHTISRQRATFIFIITLLCFIGLFSPVQGRAADLPDRAEVQSQLNTLNKQKELTPQDKLVQQDLTQTLETLDKIERIKSETAQLRQQVEQAPAKLRQAVESLNNLSDVPNDDATRKTLSTLSLRQLESRVTQTLDDLQNAQNDLATYNSQLVSLQTQPERVQNAMFNASQQLQQIRNRLNGTSVGDETLRPTQQVLLQAQQALLNAQIEQQRKSLEGNTILQDTLQKQRDYVTAWSNRLEHQLQLLQEAVNSKRLTLTEKTAQEAVTPDETARIQANPLVKQELDINHQLSEKLIQATENGNQLVQRNIQVKNWLDRALQSERDIKEQISVLRGSLLLSRILYQQQQTLPSADELQDMTNRIADLRLEQFEVNQQRDALFQSDAFVAKLEEGHSSEVNDEVHAALLEVIDMRRELLDQFNKQLGNQLMMAINLQINQQQLMSVSSSLKEILTQQIFWVNSNKPMDWEWIKAFPEALKGQFKAMKITVNWEKAWPAVFVAFLAGLPLLLIAGLIRWRLQWLKDYQAKLASQVGQLRNDTQLHTPKAILIDLIRALPVVLLILAIGLILLTMQLNISGLLWAYSKKLAMFWLVFGLCWKVLEKNGVAVNHFNMPAQLTSHWRRQIVRVSLALLPLNFWSVISELSPLNLMDDVLGQLVIFFNLLLIAVLVWPMCRESWRDKESHSLRLLTITVLSIVPVALMVLTATGYFYTTLRLAGRWIETVYLVMIWNLLYQTVLRGLSVAARRIAWRRALARRQHLVKEGAEGAEPQEEPTIALEQVNQQTLRITMLVMVALFAVMFWAIWSDLITVFAYLDSITLWHYNGTEAGASVVRSVTMGSLLFAIVASMVAWALIRNLPGLLEVLVLSRLNMRQGTSYAITTILNYAIIAIGAMTVFGALGVSWDKLQWLAAALSVGLGFGLQEIFGNFVSGLIILFERPVRIGDTVTIGTFSGTVSKIRIRATTITDFDRKEVIIPNKAFVTERLINWSLSDTVTRVVIRLGVAYGSDLDKVKEVLLKAAHDHPKVMQEPAPAVFFTTFGASTLDHELRLYVRELRDRSYTVDELNRAIDRLCRENDINIAFNQLEVHLRNEKGDEVTEVKRDGKGDDLAPTTAS

SEQ ID NO: 13575 - protein, 508 aa, Klebsiella pneumoniae
MKSLTLIPGQLSLSQLRDVYSHPLNITLDSSAFAAIDESVACVNAILAEGRTAYGINTGFGLLAQTRISTEDLENLQRSLVLSHAAGVGEPLDDDLARLIMVLKINSLSRGFSGIRLSVIQALIGLVNAGVTPWIPAKGSVGASGDLAPLAHMSLTLIGEGKARVRGGDWLPATEALRQVGLEPITLAAKEGLALLNGTQASTAFALRGLFEAEDLFASAVVCGALTTEAALGSRRPFDARIHEVRGQRGQIDAAALYRHLLTDDSAISQSHHNCSKVQDPYSLRCQPQVMGACLTQIRQAAEVLLAEANAVSDNPLVFAAENDVISGGNFHAEPVAMAADNIALAIAEIGSLSERRIALMMDSHMSQLPPFLVKNGGVNSGFMIAQVTAAALASENKALSHPHSVDSLPTSANQEDHVSMAPAAGRRLWAMAENTRGVLAVEWLAAAQGLDMREGLTTSPLLEEARHLLRERVPHYTQDRYFAPDIDNAIALLAARHLTRLLPAVLH

SEQ ID NO: 13576 - protein, 498 aa, Klebsiella pneumoniae
KVPLEYVFMGPRGGNMNIPDEGFFTLLTQGMRNRTVETLQRALYHTLRDAILQGTLTARCRLPGSRVMAERLHLSRNTVNAALEQLALEGYLTRSRQGTQVAPLASCRQEAGQMPPVVLPERLQRLPAAMRRDSPTLAFTPGMPAVNYFPLPLWRRLMDNVLREDGTALLGYGEAAGDPLLREAIARHLALSRGIRCDIRQIVITEGALEGVNLCASLLTNPGDSVWLEEPGYLGARSGFQRAGLRVRGMAVDDEGMCIANSFTEPPRLIFTSPSHQYPCGSIVSVGRRLALVEYARRHGAWIVEDDYDSEFRHSGEPIPEMLGMVPDIPVVYLGTFSKTLFPALRIGFMVMPPALVDAAQDAIGALLRGGNRAEQRALAISIDKGHYARHLAAMRRLYRKRQQQLREALAQEITVPCDVLGGGGGMHLTVAMEGVNDRTLAQQARQFQLAPAALSHFYLDPQRARSGLVLGYGNTSASRYLPALRTLNRLIAQHRRA

SEQ ID NO: 13577 - protein, 124 aa, Klebsiella pneumoniae
LRPLPNTDWRGLMKLVTVVIKPFKLEDVREALSSIGIQGLTVTEVKGFGRQKGHAELYRGAEYSVNFLPKVKIDVAIADDQLDEVIDVISKAAYTGKIGDGKIFVAELQRVIRIRTGEADEAAL

SEQ ID NO: 13578 - protein, 349 aa, Klebsiella pneumoniae
CLFLYHFIFRTYLVQISNLVGSWSGQLMVLYHDLYLPNKLRRKTTMSSAKKIGLFACTGVVAGNMMGSGIALLPANLASIGGIAIWGWVISIIGAMSLAYVYARLATKNPQQGGPIAYAGEISPAFGFQTGVLYYHANWIGNLAIGITAVSYLSTFFPILNNPVPAGIACIAIVWIFTFVNMLGGTWVSRLTTIGLVLVLIPVVMTAVVGWHWFDVATYQANWNTSSTTDSHAVIKSILLCLWAFVGVESAAVSTGMVKNPKRTVPLATMLGTAMAGIVYIAATQVIAGMYPASQMAASGAPFAISASTILGGWAAPMVSAFTAFACLTSLGSWMMLVGPGRCTCRQRR

SEQ ID NO: 13579 - protein, 588 aa, Klebsiella pneumoniae
PSPLATGTDMSETVIALNGLSRRFPGMDRPAVAPLTCTIRAGYVTGLVGPDGAGKTTLMRMLAGLLKPDEGRASVIGFDPLKDDSALHAVLGYMPQKFGLYEDLTVMENLTLYADLRSVTGEARKKIFDRLLEFTSLGPFTERLAGKLSGGMKQKLGLACTLVGDPKVLLLDEPGVGVDPISRRELWQMVHELAGDGMLILWSTSYLDEAEQCRDVLLMNEGKLLYQGEPTALTQTMAGRSFLVSSQQENNRRLLQRALKLPQVSDGVIQGKSVRLILKKDARIEEVQQHGDMPPLQVADTAPRFEDAFIDLLGGAGTAESPLGAIIHRVDGSKEETVIEAQSLTKKFGDFAATDHVDFQVKRGEIFGLLGPNGAGKSTTFKMMCGLLVPTSGKALVLGMDLKVSSGKARQHLGYMAQKFSLYGNLSVEQNLRFFSGVYGLRGRAQNEKIARMSDAFGLKSIARHAADELPLGYKQRLALACSLMHEPDILFLDEPTSGVDPLTRREFWLHINSMVDKGVTVMVTTHFMDEAEYCDRIGLVYHGKLIASGTPDELKAQAADDSQTDPTMEQAFITLINRWDKENSHGQ

SEQ ID NO: 13580 - protein, 82 aa, Klebsiella pneumoniae
RRQLTGSANYAEATDNINNNTAVLPLTLALSRRERELSGWRLGPCKRSAAGQDIRHGILDFAGWRLRLTRPTAPNHRWRWGR

SEQ ID NO: 13581 - protein, 77 aa, Klebsiella pneumoniae
HFKFECVFKRNNNMTVKAVTNKNSTLKGALAILKIKNKVKEEVMALRIVINVHRALLHNRKNHGASFIGWKKDFIRR

SEQ ID NO: 13582 - protein, 343 aa, Klebsiella pneumoniae
TIKFLNHSMIISTALSLNQAGMIANCRYACIVNRGEELSVRIGIDLGGTKTEVIALSDQGEQLFRHRLPTPREDYRQTIETIATLVAMAEQATGQQGTVGMGIPGSISPYTGVVKNANSTWLNGQPFDKDLSLRLEREVRLANDANCLAVSEAVDGAAAGAQTVFAVIIGTGCGAGVALNGRAHIGGNGNAGEWGHNPLPWMNDDELRYRAEVPCYCGKQGCIETFVSGTGFATDYQRLSGKGLTGSEIMRLVGEGDEKAELALSRYEQRLAKSLAHVVNILDPDVIVLGGGMSNVERLYQTVPDLVKQWVFGGECETPIRKAMHGDSSGVRGAAWLWPLQGT

SEQ ID NO: 13583 - protein, 75 aa, Klebsiella pneumoniae
LSKFCTLRGCSMANSIPNSGRAVMMRNRRTGAAWLVSFDYRDGSYWHEPQGNLRHIRRPYASRSIEPNLVPAGTH

SEQ ID NO: 13584 - protein, 360 aa, Klebsiella pneumoniae
FSFSLSSTTRKSRTNFSGGGMKTIKGPGIFLAQFIGTQAPFNTLAGIAQWAAGLGYKALQIPCNHPAIFDVERAAASQTYCDEVSGILAEHGLVISELSTHLEGQLVAVHPTYDAAFDAFAPAALHGDPQARQRWAVEKVRQAAVASGRLGLQAHATFSGALAWPFFYPWPPHNQPLLDEAFAELARRWRPLLDLFDEQGVDVCYEIHPGEDLHDGVTFERFLALVDNHPRCNMLYDPSHLHLQQMDYLAYIDIYHARIKAFHVKDAEFRRNGRNGVYGGYQPWQQRAGRFRSPGDGQIDFKGVFSKLTEYDFAGWAVLEWECCLKDSETGAREGSEFIRRHIIPVAGRAFDDFAAGGRE

SEQ ID NO: 13585 - protein, 418 aa, Klebsiella pneumoniae
REFSTIKGLMVMSFIKYPLPESVLQATEQRIQWVIDNFSRICVSFSGGKDSTVMLHLTAQAARLQGKKICVLFIDWEAQFSCTIAHCEKLRALYADVIETFYWVALPLTTQNALTQYKPQWQCWEPGTEWVRQPPPWAITHPGYFSFYQPGMSFEAFVSHFAEWFSQRRPAAVLVGIRADESLNRFMTISSQRKQRFADDKPWTTSAPGGHAWYIYPLYDWKTADIWTWFAKSGEPYNPLYDLMYQAGVPLRYMRICEPFGPEQRQGLWLYHVLEPERWAAMCQRVSGAHSGGVYAGHDNQFYGHRKIDKPDHLTWKSYALFLLDSMPETTAEHYRNKIAVYLRWYQKKGMEDIPDTQPADIGTKDIPSWRRVCKVLLNNDYWCRQLSFSPTKSSHYQRYRKRMEKHRQQWGILCNNN

SEQ ID NO: 13586 - protein, 171 aa, Klebsiella pneumoniae
KSLSSTQGRFEIACEFDGLPDFIMIDNRVQTILPSEHLLNKDGNFEIIKSFKATTTGKTEQTCISCIHPDDNPLRYLLGMKISELKAVGKKLKKTWLINAPHLYGVRPSGKPQLPIPLRKFYWMSIKSLEPTQNHYGVRSSICCPYMRFSKPTGKVAMGIPKLKKPPYSRP

SEQ ID NO: 13587 - protein, 123 aa, Klebsiella pneumoniae
CAPFAWVSIASRFSGIGSYGVSFAVGLSSFSAASAVLIENSASTTTTIIKKMVSPASRRLLNTSCASCDSVYCGGMLPLSIIAWNLLAIARKPTLVSGLNDFCQPAVNVQISNQLVGSSATHA

SEQ ID NO: 13588 - protein, 101 aa, Klebsiella pneumoniae
PTISLLCQRQPGKPGQSIVLELLQSKGGIMSDKPLTKTDYLMRLRRCQTIDTLERVIEKNKYELSDNELAVFYSAAEHRLAELTMNKLYDKIPTSVWKFIR

SEQ ID NO: 13589 - protein, 1021 aa, Klebsiella pneumoniae
MDISRQFINNPTRVWLAILLLGVGGLLALLNIGRLEDPAFTIKTAVIVTHYPGASAQQVEEEVTLPLENAIQQLPSLDNVSSISSNGLSQITVNIASQYHSSELPQIWDELRRRVGDASRLFPPGVVPPFVNDDFGDVFGFFFAISGDSFTNPELVRYAEQLRRELVLVPGVGKVAIGGVIPQQINVDISLAKMAARGITFNQLAAILARLNVVSSAGEIRVGSESIRLHPTGEFQSIDELGDLLVSPHGASATTRLRDIATLTRGLTDSPASIYHANGRQAVTMGVSFIPGVNVIDVGHALEARLQQMAADKPAGIDIAIFYDQAAEVAHSVNGFITNFLMALAIVVGVLLVFMGVRSGIIIALSLALNVLGTLLIMYIWGIELQRISLGALIIALSMLVDNAIVIVEGVLIARQQGSPLLGAINYVIRRSALPLLGATIIAILAFAPIGLSQDSTGEYCKSLFQVLLISLMLSWFSALTITPVLIKWWLFKNAPSAAAAEEKADPYRGSFYRGYQQALRILLQQKTMTLVLMGALLAGAIWGFTFVRQNFFPSSNTPIFFVDLWLPYGTDINATEKMTRDIERSIAGQPGVVTTVSTIGQGSMRFILTYSGQRQYSNYAQIMVRMDDQRGIAPVTRHVEDWIARNYPQVNASTKRIMFGPSGDSAIEVRIKGPDPDTLRALASQVGDILAADPATDSVRNDWQNRSKVIRPQYSPALGRELGVDKQDIDNALEMNFSGSRAGLYREGADLLPVIVRPPEAERQDANHLNNVLVWSQSRQQYIPLSNVINGFALEWEDPLILRRDRTRVLTVQTDPSPLSGQTSGDILARVKPRIDALPLPHGYRIEWGGDAENSSGAQQGLFTTLPLGYLVMFIITVLMFSSLKNAVAIWLTVPLALIGVTPGFLLTGIPFGFMALIGLLSLSGMLIRNGIVLVEEIEQQKQEKDQRQAIIDAATSRLRPILLTAFTTVLGLAPLLRDVFFQSMAVVIMFGLAFATVLTLLVLPVIYACFHHKDMTPQR

SEQ ID NO: 13590 - protein, 845 aa, Klebsiella pneumoniae
LTISLKQLTKRGDFISPFIFPAFPPLNVWNTSPYTGLHINDDAVECGVVGYLADFKLRESSMNPERSERIEIPVLPLRDVVVYPHMVIPLFVGREKSIRCLEAAMDHDKKIMLVAQKEASTDEPGVNDLFTVGTVASILQMLKLPDGTVKVLVEGLQRARISALSDNGEHFSAKAEYLDSPAIDEREQEVLVRTAISQFEGYIKLNKKIPPEVLTSLNSIDDPARLADTIAAHMPLKLADKQSVLEMSDVNERLEYLMAMMESEIDLLQVEKRIRNRVKKQMEKSQREYYLNEQMKAIQKELGEMDDAPDENEALKRKIDAAKMPKEAKEKTEAELQKLKMMSPMSAEATVVRGYIDWMVQVPWNARSKVKKDLRQAQEILDTDHYGLERVKDRILEYLAVQSRVNKIKGPILCLVGPPGVGKTSLGQSIAKATGRKYVRMALGGVRDEAEIRGHRRTYIGSMPGKLIQKMAKVGVKNPLFLLDEIDKMSSDMRGDPASALLEVLDPEQNVAFNDHYLEVDYDLSDVMFVATSNSMNIPAPLLDRMEVIRLSGYTEDEKLNIAKRHLLPKQIERNALKKGELTVDDSAIIGIIRYYTREAGVRSLEREISKLCRKAVKQLLLDKSLKHIEINGENLHDYLGVQRFDYGRADSENRVGQVTGLAWTEVGGDLLTIETACVPGKGKLTYTGSLGEVMQESIQAALTVVRSRADKLGINADFYEKRDIHVHVPEGATPKDGPSAGIAMCTALVSCLTGNPVRADVAMTGEITLRGQVLPIGGLKEKLLAAHRGGIKTVLIPDENKRDLEEIPDNVIADLDIHPVKRIEEVLTLALQNEPFGMQVVTAK

SEQ ID NO: 13591 - protein, 121 aa, Klebsiella pneumoniae
LMSSVANWSYTATATIWRRIRDADGSDTDGGGQPYGWEAPIAILCDYQGGLSAKIGNLGREIVVKNTIWTEHSTAREGDYILIGASTDAAPPDEADEIRQIVQFADTFERLADDFALITGV
